United States Patent 9,567,581 (SELECTIVE REACTIVATION OF GENES ON THE INACTIVE X CHROMOSOME) - sequence listing, part 16

SEQ ID NO: 1236 - DNA, 745359 bp, mus musculus
cctgggagcctggagtcccgggggcctgaaatcggcagcttcccgggcagacactctctccctcaggaagaggtgccgccgagtcagcgcggggcagtgtgagcgccccgaggtgctttctcagttgaggagaggtggggttacagggcacaggtgacagggccggagaaagatggagcagcccggggcggcggcgtcgggagcgggaggcggcagcgaggaacccggtgggggccggagcaacaagcggagcgcggggaaccgggccgccaatgaagaggaaacgaaaaacaaacccaaattggtgagtgctcccgcagcccccgccggccttagggacagggagagccccgggatcctcctgccattgaacacgggggcacccggggccccctcccaaggatgaccgcgacctcgctgtgcaactcggggagccgctaaaggagtggccacgccgaggcgcggagacggcgtgggggcggaagagcacccccttctctacttaacccctttctcactcttgtcagcccgggaggcggtgcgggaaggagaaaggcccagccccaacttggggacaccccgagtactgggtagggctgttgtttgtctaacttgtgggcgcaaacctttgcgcgattccattctcctcccacttcttgttagttgctgttttgcctcctaacgcgtagggtccggggcaggggaacctccctcctttttattccaagtccttgggagcccacctacagcttcgcaaatcaagaagaacactatttatgctcccagtctttctactttaccagaaatctcaggaagaggcgcctacgtgcctttttcctcctccttgcctctctccatgtgctctcccaagaaatgtttctttggaagggtgggggcgcgtgggagtttgaggctgggtgaggtaccaccaactgtcgagtgtgtgtaataggcatagtcatacagtacttccacttagttgattaagaacgctcaaaagcagtaggcacaaactgtgcaaatctcaccgtgctgatagtgtgaaccgatggtagcagtccatttcctgccactgaatgtgcagaggaatgaaatcgatgaggcctggtattgcattgggaaatactggagtttcctcagctcatcagaagggttccgctttttgtaaactttctaatttgggtggtgtgaggggaaagggttttcctgtacaaattcagcagatactccttagagctgtattcttagtccagatccgaagcacaagccacatgttgaatgtatagatttcagctttaactaccaacttgattataatagacaaggagagggtgacatataaataaagccgtttcttatggcatctggccatttggtttggatccagtacaaaactgtggtttaatcagtgattaaaaatttaagtaaaaagttaactgatagtttccacaaatggtttggtacgtctagcaagaatctgccacttttaagaagtatgctttcgagaaaaaaaaaaacacttatctctgttagtagtaacaccttgattatattcttctcttccctttagccatttgtcctgattcatcttttatgttttacttgctttgacaaggtaactagatagttatgagatcgtatcattttcagttcctagctaacttcactgttccggttcctagctaacttcactgttccgtgttgaacatagcttgatacggtagaacaagatttgaatccaagagtttgttaatattaacatgaattttctttttttgctcaaacataacttttgagccttacgtgattttacaagcagatgtgtcagagttaacaaaaacaaatttaggaagacattgtggcacattttaaggcaagcaagttgaccaaacagtaagatttagtaagcttttcaggaaagaattcatctgggattcttagaagtttgctagtaagatacaactttacttagatgaaatttttttattttgagtattatgttaataatctctgaactagtccttaatttgtgtgtgtatatgagtgtaaaggagttgtggtatgggattataaaagagagccatatggtgatagaaattatttgtgtaggtgatcttggggcataggggttcttaaactcctgaaattgtatgaaaatatttgagtgtatatgggtacatttatttttctgggccccatggctttcatcagtttttcaaaggcatccattacctatagaagagtaagaactatggcattacaaaagatagaaagtaaaggaaagaatagttgattccactctaagttactgagtagggaagaaggggaaatggcattgaccacacaggtgattgatattgaaacgaattcttctagtggtaaaaaagaagttaactactcaatgtctacatagattaaaatttccgctacagaggaaaattaattcagtcgctccagtataatggattcataaggtataaggcttgtgtagtttggttgttttcatttagttcctcagaattctggaaaaatggaaatggaacacatattttcttttctttttttttttttgggacgaagtctcgctctgttgccatggctggagtccagtggcgcgatcttggctcactgcaacctctgcctcccgggttcaagtgattctcctgcctcagcctcctgagtagctgggattacaggcacgtgccaccacacccagctaatttttgtatttttagtagagacgggatttcaccatgttggtcagcctggaaagcagattttctatagagaggaactgctttcatttatatcctcaactttttaatgagtattagtgagaaatttttcagagtggcatttcaacactataatgatttctatttaagattacttaaataaaaatttaatggaattcacttcagtttttttcatataagcatcctcataatgacccttttgttttgattcttttaaaataaggcattcctgtcttggactcatcacattttgaataatgcattagtagtagagttttggattttatgtaactattttggttaggcccagattgcaacatgtcatcaaacagcatgaatcttagattaatttgtaatttgatgtcaaccatggaatgcattttgttaaattgagtagaagagaaagctctataaatgttgtgaaggaactacatcttgaatcctacttatttaaggcagtgacttaaccattaagagaggccaatgttgatgcagaacaccgcaccccacaccacacggtagtgtagagtgacctaacagtatttgatgtttttgcatttttgactttgtgttcctgcataatttctgaagcctttggttcttcaaacagtaaagtcaaattagttaatttttctggttattatgtaacttcctatttggttatttgtttacaactggataaattatgtttttatttatttatttattttgagacggagtctcgctctgttgcccaggctggagtgcagtggtgtgatctcggcccactgcaacctctgcctcctgggtgcaagcgattctcctgcctcagcctccctagcagctgggattacaggtgtgcaccaccaggcccagctaatcttttttgtatttttgtagagacggggtttcaccatattggccaggctggtcttgaattcttgacctcaagtgatccacccacctccacctcccaaagtgctaggattacaggcttgagccactgcacccagtcttgatttttaatgataaggtatgagcaacaatgatttcatttatgcaatacaggtttactgagtacctactgtgtgctaggcataattctaagggttggtgatacaaagatacttgtagtctactgagacagacagggaagttaattaatgcttaaaatgcaatgtgagccagacgtggtagcttgtgcctataatcccagctacacaggctgctaaggcaggaggatttcttgagctcaggagtttgaagctgcagtgagctgtgactataccactgtattacagccttggcgacagagaacccatctctttaaggaaaaaaaaaaaagcagtgtgataagttgctataggaatatgcatggttgggggtggtcatggagaggcatctacgtagaattgcatgcttgagtaagaaaaggcttatcgcagtaggtgacatttgcagctgaaggctgaagaaaataggtgagggaaaggcattctaggttgaaaaaacaacatatacaaaggtaaacagataagggagcatatccaataaagaaagttcacttagatgaatatggctgaaacaaagggtacacatggtagacttgctagaaaagagacggggtccggatcatgatggatcttgtatgccatgttagagtttcaacttctttctgaaagtaggggtaacccattaaagagattaaggcggagaatgacctgatcagatttgggtttcagaaaaaaaagtactttggagaatttcttggaaaagcatgctagaatggaggcaggaagaccatttagaaggagcagagtagcataaaagagtttttgatatttggagacctggattccagttgcagcttatccattcattcatttaccagctcatccatttactaggtgtttttctctgcacctcagtttccttctgccacctcccttgcctctccttagtaccacacaccctgaacatccccaccaaatctgaaatggccacccctttctcttttataactttcaccccctttcacagcccagctcatgtctcaatattctctcactcttccattaaacaccgattacttcagtttagtgagggctttccttcttctggactcaataactgtcatgagtctgaatgttacatgctgatcttgtctctgcaaatattttaaactgcctctgggaatgggtcccattttatgtctattcttgaaaacctggcaggccggtgcttgggtgcaaaactattcagtaaataattattagctggggatttttttcccctatataccaggtattttgagagtgtaaattggtgaaaagaggctttttaaaaaaatgtttatttgtatgtgccttttttttttttaaagtatatgtactccatcaattgaacctatccatacattcctctttgtcttttctccaattttgaaactcagtaaacttcttcagggctgtgagaactcttctacccccagcttgtttgaattcttgtgatgtcagagcctaaacttccaagcatggaaacagtaccaacaacgatgagccaagtaacattttactcttattagcaggagacttcatattattggcaaaagaatatggaacggagagccaaaagacctgggttccagtgtcccatctgtcttttatttgcttgtgatttctgatgagccatttagcaccagaagtttgagctctttgattaatgtttgccagttggggataatgctgcctgcctgatttgcttcacaaggtgttttagataaaatacagtaaggaatgagaaagcattaggaaattctatattgttatacaaatatagagcatttttattaaccccttatattacttgaatcaaatatgattatggttggatggtttaatgtctttcttgcattttgacagcactaatgttattattgtataaagtaccataatatggttatatgttgaaagattccttattctctccccaataccatttgtccctttggaggaatatgcattctatccttttactaagatttcattctgttgaatgaatataagatgtgagtctaatttttttccatgataattttttggaggactagtctacccttttctttcattgtgtcaatttgaggcattaaaatttttttaaacaaaacttccatttgatatctgtgacattatgccttgtcaggcagcttactgcctttgtacaaataaagaaactgagtcactgaaatgttaagaggactgctttagagataagtttaaaagctacctcctctattgtagaaattatccgtagcactgagtcattgtgcttcagggactctgaaggtgaaaaagttattcaatttttcttcttttgttcctttttggaacaattctaattgtaatccacctagatattattaagctctggcagtagcaacatgttactgaagtgaaatcatgttcttttccaacctgctttcaaagaacactgtaaataacagcatacataatatatgctaatttatataaatcagcacatctggttaaatgttactgggtaccactagcactacaggggttattgttgaagacccaactccagtctaccatgcagaagaaaccggttccttctgctggatttggggtgtttgatacatttttttcccctcaagacaggagaaactatgatgatgtccaggtaacttaaaatatagttattagcttgatatccaagtgggcatgttgtggaagacacccattgtgggatacagctcaaaactgatgcatttaaagaaagattaagatatattttcacatagctatttattgtgaatgtcagtaatggagagaaattaactcatactgatttaaaacttattttcctcatcaggttgagtctgtttccaaataatatactctggctgtagcttaaacagacaactgaattctggtatttaactgactttgtgtgaggttacctggcagggaaaggtattggtccctttctcatgaaagaatgtagaaaacaaaattcttacttatcaccatttgcacagtctttggtttactgaagattttactgtattgctttaaggagagtaagctacattgctacaaatacataccagcatattggccaccagctgtatacagtgtggcctatgaatgagtgagaagcttctaggtagctattaaggcaggcctaggtaggaatccaacactttattaggaaggaattattccgaaatggctgttgactcaatcacctggcagttctggcactcacccaagggagaagagattttgggtacaatcctttttaaaaaatctatttgttgttctgtgatatcatagacatccaggctttaaaaagaaagatctgctcaaaattaagaggaattttaacctacccttaattcgttggtctgttattaagctaaaagtaaaagaaataaacttttaaacttcataatatgagccagttaatgagacttttttacaaaacttaaacaaattttcaaacgtgctaaaaagtagaatagtacaatgaaccaccaccatctatccattgcccagatataagttatctacattttgcaacatttgcttgatccatcctttatttttcccttgctaaagtattttagtgcaaatctcagatatcttgtcattttactcctacatactgtcacgtctttaaaaattaaaattaacatattccttggtatcatccagcattcattccataatcaaatattaccaattgcctaaaaaaattagatttttgatctaaggtgtacctaattgatatacatgtcactgaactccttaaacaaatacagctttaaattactggtaaaatcttattcagagttactccacataaagtgctatcataaagcctcagcccaaattaagttcacttctgtctttaattctgtagaagtatctggaaaggttgactatacaagggtggatagactccttggaacagctgttatgtaccatcaaaaatagaacaaattagttttggctttactcactggttgggcaatcactaattcttcattttgcaatttgtgaagtggggtggggcttatgtgtaagaattttcctttcagggaaatgctgtagatagttaggcaaaggaaaattattcttcatttctctagataaagcgttcatatgactctttgacattcacaccccaccacaacaactaagtttatgttactggctctagttttatttcaaaacaaatgccggtttggtctatctttgtttttcagcccctttgatatagtctaggttgctgaatctggataattgggtgagtaaacctttacatagaagttattcttattgagatgtttgtgggcttacaattgaaaatcagactacactaatgaggtgatggagctggggatgggtggagtaggtaaatatgagaaatcaacttgggcaaatggcctagactccacacagatttgctaaagaaattgtgtaactattactttccagacagcagtttagtgctgttattgtgctgagaggcaataggcaaataatttcactagctgtagactcaagtagatttaggctagtaatctgtctccactctgcaacttctagactgaccatttactaacccagtcagttgggtagttttcctcaaaacagatagatgagtgataattgttggagccagagagctggcattttcttcttttgtttggcccgggagggaaaactatggaggtggtgttttatgtgctctgaaatcaatcactgataaagtcttaaatgcttagtagtctattgtgctggctgaaactgtttacaaagattctatatgtagataggaagaccttgtataggctgtacacttgcattgtgagctttaataatgtatacgtataacagagaccaggtcggtatgtatgggtgggccctgaccaagggtgtgagaccacagaggtcacaccacttaccaaatcatgtgccagttacaagactatgtcttcctggggctgcgttttctgattcacacagaggcaccatatgggctagctaatacatttaaagccagatggattttagtctcatacctgataagaaattcagcaaggattccgggcatggtggctcacgcctgtagtcccaggactttgggaggctgaggcgggtggatcacctgaggtcagaagtttgagaccagcctggccaacatggtgaaaccccatctctactaaaaatacaaaaattagctgtgcatgatgggagacgcctgtaatcccagctactcgggaggctgaggcagaagaattgcttgaacccagaaggcagaggttgcagtgagccaagattgcaccattgtactctagcatgggcaacaagagtgaaacttcattttgagtagggatttcttatttgtcattggttctgagaaaagaatgtaagatgtatatttatgtaatatcctacacctgattacttttgcttttgaattattgaaatcttcaaatgtagatggctgtgcccttgagggcctaggttatagttcagtatgttcattatcttccccaacttaagggttgagttctgttatagctaattgtagatcaattagcttaaggctcctccctttctgcactcctttcagcaattttcttgacataattgtttcacagagttttatatggttacgcattatctaggctgcattttttttttttttagatggagtctcactctgtcacccaggctggagtgcagtggcctgatctctgcttactgcaacctccgcctcccgggttcaagcgattcttctgcctcagcctcccgagtacctgggattacaagcatgcaccaccacgcccagctaatttttgtatttttagtagagatggggtttcccaatgtttcccaggctagtctcaaactcctgacctcaagtgatccgccctcctgggcctcccaaagtgctgggattacaggcatgagctaccgcgcctggctgcattgttttttgaagtttgtaccatgcttatttccactttcattgctcacgatacagggcagaacatatagaaagttaagatgggttaaaacaaatttggcagaagcatttcctctgataatatgctctgcaatctagtacctcacattacaaaatcaacgtttttcagaagagtcagtgtgtacataaaatatttgtgagtgaaaataaacttcttagggtgccctcagcttgtttttcattgacattgcattagtttacattatctacctccccacccccactttggttgactagctaatggtcttttttttttttttttttgagacagagtctcgctctgtcgcccgggctgaagcacagtggcatgatttcggctcactgcaacctccacttcttgggttcaaaagattctcctgcctcagcctcctgagtagctggtatcacaggtgtacatcaccccacccggctaattttttgtgtgtttttagtagagacagggttttgccattttggccaggctggtcctgaactcctggcctcaagtgatatgcctgcctcggcctcccaaagtgctggagttacaggtatgagccacaacgcctggcgctaatggtctttaaacaagctgttacagggaagaataagtttatgattcaaaaatggcctggattttatccatgctggcagtttagattttcacgtgtttgttttacgaaagtagggcttccctgtattctcttatctcaaattcttaggcttcttcattacagcctatacttgcttcatcaaactgcattcagatggtcttgtaagttcccatgagagcaaaatcctacattttaatataagctgagttggtctgggacaaaatactagattttaaatggccattatctctgtataaaatggagctgaggtattagttgcactttacagtaggaactgtgtagggctctgggcccaatttttcacattcttcctatgggttctgttatagctaattgtagatcaagatatgttacaaatccctactttcaacctcctctctcctccttaaataatgttactacttgcatgtttataactctgaagggcatcttatttcttgttgtttttactgatttctgtgactattatcaatggtgtatcctattgtctgaccacggagataacaggcagaaggatggccattggatgttaaatcgattactgaacatgacagagatttattttaaagcatttcctatcctcactcatcaccacgtagttatgaactagtcaaaacttcattttgatcttagcaccaccacttcatgtttttcaagatgcctacattgtattttatggaatctaaatgtatttaatatgctatacagagttgaaataagctaaataggatatttgatcctattaagtgttttttaggagtttgtttctggttatttaaaaaggttgggctgggtgcagtggctgatgcctataatcctagcactttgggaggccaaggcaggaggattgcttgagcccaggaggttgaggctgcagtgagctgtgatcgtaccactgcattccagcctgggtgacagagtgagaccctgactctaaaagaaaagaaaaattttaaaaaaagatcctgtagagataagccgactactttttaaaaatgtgactctggacaagtcttttatttttcttctctctgggtgtcagtgtattctgtaaaataagggaatcgaaatagatgatctacaaagttccatttagctctggcatactgggagtcaaagtttattgaaagctgtaatacatctaccctaacataaatacaagacctctggattccagttagacaaaaagttggaattaggctgaatgctaaagagtgaatatcccagttaactttattgtcctgtttctggagtctaggttagcctagtctagtgaaggccacatcaacgtttctttttaactatgaattgtacggaaggtaatggtctgagccctagggaatgctggcttcctctgcgtcatcctgattcttgggaggatgctttggttcagtgaccaagtacagtatgcaagccttcccagagatgattctcaatagtacacaatatcataggtaccagtttttgttctaagtgctttgcgtgtatttgttaagaactgtgcaaggtctgggattttcccttacttacctacctgttaactgtttaatggatgattgcagaagacccaaaggacaaaagacagtttattattcattgcaaaagcagtagccagaatgtcagcatgacatgctggttcactatgaccataagtcccatcgtgggtagaccagcatgatggccacaaacggagtcagtgacattgcaggagaggaactctgagcttgggggtttgctacttttatagcattaagaagtcagcttgatctttggggtggggagatatcacctcatcctcaaggttgtttgctacaaacacagccatgggaaatggccccagtaaaatgctgtcagtgccttttagtcttggcatagccagcaagaatgggcaggggatgctcagggattcatggcagattgcctccttcatcagttttaactaatttcatcctcacagcaatcattttgtaggtgaagaaaacgtctccaagcagatgagtaactggcccgaggacatgcaaaggtgaatttagaattgaagaccaatgtggggccagatgtggtggctcacacctgtaatcccagcactttgggcggccgaggcaggtggatcaccagaggtcaggagttcaagaccagcctggccaacatggtggaaccctgtctctactgaaaatacaaaaattagccaggcatggtggcatgtacctgtaatcccagctacctgggaggccgaggcaggagaattgcttgatcccgggaggcagaggttgcagtgagccgagatccgccactgcacttcagcctgggcaacagagcgagactctgtctcaaaaaaataaaatatttttaaaaataaaatagaattcaagaccaatgtgactgtaaaatgtatgttttacaccacgattttctatactgcctgagaacctcaaggtagctctaaattgaagacctagtggttctctagactggtgatggtgggacctagcctagatttgcactctgcttatgtataatttagaagacagagttcaggggccattcgttttagtgccattgtcaaaaaaaaaaaaattctttgaatcactgccatgaagtaatgggtcagaaatgtgaccactaagaaaaagccaagaggacaaaagtgatatggctgtggattttaaggctacttgaacacagttcttaaaaataccagcctgtgatagcccaccactggggaaaaaaaaaatacctgtctagcagtctggcctttattaactaattgcatggccagcagaaggcctgtgtactttactactgttgcatattgcatatgattttcttgttgtttgtacgtcagccttgcagagactagcttctgaagaggttacattgcaagttatactgcctacttcatgttttagcttctctctctcctctattgcccacttcctttctgtttgtgatcttttgcatgaagtaaaagtgctttggaaaaattaatgctatctcctgttaaacaagtacacgatatgcattgtttcttgtttaggggagtgccaagaaccacctaccctctcctgctgcttcctgcgtgtgctttgcctaaagattggctgctataaaagtgtggtatattcagccaagtgctatctttttaattagtttgcagaaagtgttgtgacaaactatttttgtgttgacttgtgacgagtaatagacccctaaactacgggcgttaagtgccagacaatatggaagtgcataatgtagtttgagttctagtccccttagtttgatccatcatccttccccaaagaaaaagcccctaatttttaaaaatgtgacaggtaaaatagattacgaatataccagtatgtgtctggagcctgaaattggcctatttcttataattactaatcttaaacttttttttttttttttttaagagatgaggtcttgctctgttgcccagactggaatgcagtggcatgatcatagctcactgcaaactcaaactcctgggttcaggttatcctcctcccttagcatcccaagtagctggtactacaggcatgtgccaccatgccccactaaattttttttttttttcagtagagacagcattttgctgtgttgcccaggctggtctggaactcctggcctcaagtgatcctcctgcctcaactcagcctctcacttggattataggaatgagccaccacacctggcttgattaccaatgttaatgagctaatatttccatattggttctgttcatacaactgtgtacaacacagcatgaaactagaaagtgaaggatatcttaagctctcataatgatagagacataactgggaaagctgataattaagcagactaagaatcttagtaaatttttgtttttcaaatacttcttatcaatttttacaaattcatattttctctaaatatagtcctggttgttgatgttcttttgtttttcactccatctaacccaaagggcttcgtgttacggataaatatgtaaggaaggatatagcattcccatgtcccaaaaactgtgttgttctttttatttagaccagtgattttcagtgggggctaattttacctcccagggaacatttggtaatgtctggagacatttttggttctcacaactgggggagggtgctacactggcatctagtgaatagaggcctgggttgctgttctctatcctacaatcataggacattctctccagcacaaagaattattcagtctaaaatgtcaaggttaagaaactctgctttagaccctataacattttgtatatttagtgtgaaaaactttttgtatatttagtgtgaaaaatttctgtggctcctcagctgttctttactttccattctctcctttcctctctattcagacagggtcagctaatccctgtcttcatggaagcatggtttgtttcattgattcccgccaattttatttgcattttcttcttttctgctactggaaatctggtggactgcactgttgtgaactttttagttgtcaactataccttttatcacttacctcatttctgacatctaaggaaaatattcattttcatcgtagtgagtttaaaaggctctttttccatctgtggattctttgatacttcaacaacttttgatgctggtgacttttaactcatcatctatatgaattttatttatttatatatcattttgagacagggtctccctctactgcccaggctagagtgcagtggcgcaatcatggctcactgcagcctcgacctccctggctcaagccatcctcccacctcagcctcctgagtagctgggactacaggcacatgccatcatgctcagctaatttttgtatttttcatagagatgtggtttcgccatgttgcccaggctggtcttgaacccctgggttcaagcgatccacccgtctcagcctcccaaagtgattacaggcctgagccatgcatctggcctgaattttagattctatggtacagtcttctctgacaacttctgcctcttgatttgctgactgctaaagtgccagctttgtttgccttccatctcaaaacttctcactgttatctgttcttctccacatacaattgcaggcaatcatatgcctcttcaaataccacctggatgcagatgcagatgcagatgatgccaaacttttctatctactttgacatctaagtttgatactttgtcatcatttgctgagaggcatctcctgactgtgttgcagttctactaaaaactgcataacacctcaaatacttcatagtggtgtttttaatatttttcctttttacaggaaaaataaaaattaacttgatgctctcaacacacatacatacacatacacagacacacatggacacacacacactgtttatcaggtttaccttttcaagctaaggtttacttgcttcacttatcaccagactgtattattctgttgttagtcactgactgacctttatgatttctggtccagttgaatgaaggttaacttccctatttgaccagtgaaagtcagtgactccttctcattcaactcatcaggtcccactgtatttttacatttagggctactattaggcacctaattgtatcttcttccttttttaatttgctccccttttaaaagttgaagccgttaggtgtattgtctcatatgcctgaaataacctcttcttttttctgttctcagtgaatcctaagtactttctttctagttctttatataactcttaaaccctttattgcctacttgaaggtgacatgatcatttcattccccttcaatttcccatagagagccagttcatttctgcagcatgcatggccatattaacaattgtccttattataaatgtatgttatagtgttcattccagacacatcaaatctttgttatgtatggggcatcatgctgagggtataaacataagtatatacaggtcttactcttgaggagctcatggcctaatgagaaaaggacagatacatataaagtagtaaattctataataaataggtatgaggagaacgctcttgggaatgccgcatactgtgcttggtagggagaggaaagacttcacagaggtaacatttgatttgggtcttagggatgaagaacagctttgtaagattaaaaggcaagtttttttttttaagactagtcgagtgcagtagtgagaagtggggaaagagtagaacaaggagttagatctgtaactgactgtgaacaatcattcgagataacttactaccttcagaccagccaaggcaagccattcttaatagtgggattatcatgtatgcaagtttagagttatgtaaaggcacatatttgttttaagtgtcattgattttaaaatattaagatcttagagagaaggttgtgactgaacttgttttatgactgaacgtaggtgatcataggaaatatttttcaccaactcagaagtgggatagagagagggaactaacgtttagtgagcacctacagtatttcaggtgttgttctaggagctttacatcaccatcttaattttttattataaacacgtaggcatagttatttcccacatttaacaaatatgggaaacgagtctcagagaggttaattgattctgattccaaaatacatgatattttatgatagcattctgtcttcttcttacaagtaacaggctatatttaaaatctagaaatgagctgtaattttctattttttacataaatatgttttatttttctcctatcgcagatcctattaggagtctaataaatgtattttaacacatttcctttttgttggattacattagttgagaaataatagagcttgagaaattggctgggaattgtccacaaacatctaatttgtagctgtatctggttagttttattactgatgatttgggcaagctcctcagttggtaatattctacctctgaaattcttcatgttcaatagttaatctaatttaataaatgttttggagaagctcacctcagtgctgcggtaagcattatcagggttaaagtaaagaactcctacccactagaaacatagagttggagaatctgatgtatacaaacctgtggtgctgggtggaatgtgataagtgctactgtagaaggaaaaagtgctatgggagcacaaatcgtgttaattccaaatgaagtattagggatgacttcatggaaagataggcaatagaagagagtcttaaagtgcagagattttttttaaaacagttattgtgatagaatggagaaagggcattgtctgtagtgagaaaaatatgcatatctcagtcagcacaggctgctatagcaaattcccatagactaggtggcatatgaacaacagaaatttattacacacagttgtggagactggaagtccaagatcagggtaccagcttgatagagttctggtaagggccctcttccgagttgcaaactgctgacttcttgtggtatcctcacatggtggagaatggagagcgaaagcaaactctcttgtgagttttacagagtcactaatcccattcatgaaggttctaccttcatgacctcatctaatccttattacctcccagagacctcacctcctactaccatcacatggggtgggggttcagtttcacggtatacattttagggggaaacagacattcagtccatgacaacgcataactgcaagagagctaggaagttagggcatgtttgaggaaaaatatgagttagtctagtaaagcccagatgtatgtatgagagtggtggaggtcagtctggatggagagactgcagcttgattacataagcattcagtgctcaccataaacaatttggaattcattctataacccatgtagagtatttgagcaggagattgatgtgatcagagcttacaatcatatcttactttagacattttacagttggaaatatgaagtctaaaatcttatgtccaaactttctggtaattggcctgtttgtagtataaatataaagatatttattaattctgataccttttggcatgctttaatttgacagctttgaacttgcaaaattaaacatgtactgtaaatagtgtgtactttgataacttactgttttacagcaacttaattggcccttgctcccagcctactattctgtagatctgtgcctctaagtctaaagatcttgttgttgtttttttcctccacaaatagatcctactctaaaggtcaggtagcttagattacaaggctgctgctgtcaaactgaatgtgttgggtctaggctgaattacagtcttatagtccctggaatattccaagagaagctgcaagatttatgacatacaaaactaggtaaagttatcctcactagataaagttgtcctcaatcaagtgttatcatgaattttttttccgtttgcatatatcaatcccctatgacaaaatgagaagagatacattgcttacaactgtggcaaagtagtcttagggctatgatttgaactcaagtcccctacttaagataattcacttaaataagtggaatttttattaagagactccctccctccttttcttttcttttctgttttgagacagggtcttgctctgtcatcaggctggaatgcaatgttgtgatcatggcttactgctgcctcggactgttgggctcaagggatccccccaccttagcctcctgagcagctaggactacaggcatgtgtcaccatgcctggctttttttatgcagtgggttgtagctatagaaagaggacattatttcacaaggtataggctgggaaaatgttcaggttccttgtggggttacaaaattattttaaaaagatataggtctttaggacatgaatcatcttttggtagactactttctcatgagggatttgtgatcctggcaaaatcccttttgagcctttgaaacatgaagagcattaactacaaatgaagaagacaggaacttcctgagttataaatacctggccatatgaaaggcccttgggcaggggctcccctggtatgttgagtcaaaatattgcctggcctttttctcccccttgctactgatgttgccttgggaatttgagacccagtcacatcagagtactctttgtttatttctttctcagtgaccttcataaatgtgatagtgctgggaacaatcttctgaagcatctctcttacttgccctaccatatgatttttttgccaaaaaggttggggctgataggagcttttactctgctactggtctctcctccatttttgcttagtagtgtggagcacattttcccatgaacattattcctgtatttgatatgtattgtagtatagttcagtttcctaatatgtttagtgcttaaagatataggtcatgagatacaggtacttgttatcaaggaatttacaatattataaggaaaacagctgtatataacctcagtattcggtaagttccatatgaatgattcagatttaggaacaggaaagattaataatttggattaaaatagactaggaactgagtcactgggaacttctcttcctccctccacgtacttactccaagggaagaatgcattcagagttcaaaacagagggttttttttttttttttttttgaggtggagtcttgctctgttgcccaggctggagtgcagtggtgcgatcttggttcactacaacctccacctcccaggtacaagcaattctcctgcctcagcctcttgagtagctgggattacaggcacatgccactacgcccggctaatttttgtatttttagtcgagacagggtttcaccatgttggtcaggctggtcttgaactgacctcatgatccgcccgcctcggccttccaaagtgctgggattacaggcgtgagccactgtgcctggccaaaaccgagttttgaggctgcagtgagctatgatcgtgccactgcattccagcctgggctacatagtgagacctcaactctaaaaaataaaaattaaaagaaaaaagaagtttgtggcataggtatttcttgttttaagaaaatatatcagcaggaaatttgaattaaggaagcagacaattaatgggcaatgattgcttttacaagagttaatacagggttaccgcagccaactcctttcttcttttaaaatgttttatatgccaaaaataaatactacttttaaaataattttttaaataaacaaaatgtttatgatttttttagaagaccaccttatattttaatgctaattataaccatctccacactattgatctgaaatgtgcagtacattgaaaaacgtaaaagtattttcaatgcattagaaacatagtttccattttcccaagcttctcattccccttaatcctgtagattccctttctcacagattaaagtagcattagaatcacttgcctcaaggccactgggaaagcttgcaaaaaatatagatacaggagtcccaatggacctattgaaacagaatcctttgagtgcaggccctgggaatctgcattaataagctgcctgcatgattttgtactctaaagttggagaaccactaaacttgtgcacagtttgcaaaatggcagccctgcaagtcatacctggcccatagatttgtttggtttggctttcagtattagcaatgtggtttttaaaatttgatttgtttgctaactcttaagaattgggagtttgtacacataaatctaaattcctggcttctcttgaaacatcagagtaatttttacagtactaggctcatgttctcacatggctggcagcaatccactgtgtctgaataagatctgtcttatttgaataggccatgtgctcttgaattggccacagaccaccctcctgcatttcacctggggtccagtgttaattgacatttatttttctatagctggcctgcatcactcaattatatcccctgcttagaatccatatacatttgagtttttgactctggatctagaggttaagaactacacagaaactatgggaaagaagtgagactggaagctgggagaccagagagattataatagtggagataagaaatgaaccatggaactacggcagtggtactagggatggagaagaggaggaagattaggatttagaagctactaattgagttgggttggggatctggatgggagaaggaagaatgagtgtggtggagttgggagagatgaaagtaggtgggaagatgaatttgtttctggatacagtcacttgaggtgatcgtgggacatcattgcgaggtactgaagtatagcttgctatggagcagagactctacagtgttggagaggatgactcctggatggagcatatgacagactcctgggtgtatgtgtagactgagaaagcatattcagaagcctaccatcttttcctaatgcaagctgaaaaaaagtagagatctatatgtaccctataaacatgtatgaatattacatatcagtgaatgtagagatctacaaaattgtggctagcataaatagcatatcctcaactttaactaaagtagaaacacacacagaatctttgggtggaggtatatccaaatctctggaggataggagattcttatccaaattgtcaaagattattaaaggttgacacattgcaggtgggcacggtgactcaagcctgtaatcccagcactttgggaggctgaggcaggcagatcacttgaggtcaggggtttgagaccagcctggccaacatgatgaaaccctgtctctactttttgattgattgattgatggattgattgactgatggattgattgatttagagacagagtctcgctcagttgcccaggctggagtgcagtggcgtgatctcggctcactgcaacctctgcctccggggctcaagcgattctcatgcctcagtctcccaagtagctgggattacaggtgtccgccaccatgcccagctaacgtttttgtatttttagtagagacggggtttcaccatgttggccaggccggtcttgaactcctggtctcaggtgatctacctgcctcggcctcccaaagtgctgggattataggtgtgagccaccatgcctggccttagtaattttaatttttagtacaaaaattaacctgatatggtggcatatgcctgtaatcccagctactctggaggttgaggcaggagaatcacttgaacctgggaggtggaggttgcagtgagccaagatcacgccattgcactccagcctgggagacagagtgagactctgtctcaaaaaaataaataagtaaaagaatacatatgtactcgtctcaaaagaaaaaaaaatgcttggcacattgctgtagggtatcaccaagacacaatgatttaatgacaaccacttctttcttgcaagtggtaattttggtttctttctccctttatctcttctgcattttaaattttgctctgtgagtattctttagttctgcggatgctaggagcatgctgtattctaaaaagtgtttgcaaggcatttttctttttttatatctccaagaaaatgtttctttgggaacatgttatgaatggaggttaggttcccagggtagctcatctttttcaaatcccacttaatctacattgcagatgagctgttctattaatagcatgtgtctgagctctgggagcagacatgtgccatgtggtatagaaacattgaagaaagtctcttcctcttttctgaccataggctaaatttggaaactggtaaattttatctttgggatgctccaaatccctttctgtacctcttttccatataattgtacccctcccctcaggtgacacccatcctcctgtgactcttccccaccccccacccagatcattttttttttttttttgaggtggagtctgctctgttgccaggctggagtgcagtggcgtgatcttggctcactgcaacctccgcctcccgggttcaagcaattctctgcctcagcctcccaaatagctgggattacaggcgcctgccaccgcgcctggctaatttttgtatttttagtagagatagggtttcaccatcttggccaggctggtcttgaactcctgaccttgtgatccacctgcctcagtctcccaaagtgctgggattagaggcgtgagccaccgtgcccgtcccccaccccctgcgacatctttcccattcctcagtgtacctacctcttcccaaacttgatttctgtcacatctctgctgagtgttagaatgaactaagttatgcaattatttttgaatgtactttattgtgatttaaaaaatgattattaacatccattaattgcttggtgaaatatctgtcaagtagcacaataaagtgaataaagcctggcagtgcagtagaatgttctggggaggtaggtaatcatataagcagtcttgctttgaggttctcccctagggataattgtttctacttttcaagtcttgccttcattcacatataagcctatttttcagaagttctcttttttcatgactgcctctatgagagcagcagagaggcttccggggttgagggtaggcaaatagggcaagaagagtggctgtatgggatgggacttccgtaagtctaggactgcccatatggccttttgaatgaagggaatattccataatggcttattttaagcagtaattaacaaatgaaaaaaatttcatatttcttcccataaatggtaacatgtaatttgtaagcttagacaatttgatcactgaggtaaatgatgaatatcattaaaagcattggttcctaataatttgtaaagtacttcgtttctgtttgttaatttgcttaccaaatctgtctatcagtcacttgcatttgttcccaaacctatatatgccagtggtaattgctattgtaactatattatttaattaaacatgcaatttgatgaaatgtgtgaggcaaaagaaatctttctatgaaaattgagaagtcttttgcataaattgataaaggcgctaaaaggattgctactgaattaagcataggtgaggtaactgaaagcctaggaaaaaaataacaagtccaaaaggattcatatggctttgcaggtgtctccagtttctatcttctaaagaaaatgaaactacatatagtagagaatgcattaagggatggtttatgaaaggaagatgctctgatgtagctctacatcaaaatattgataaatgtgtattttgatgtcataaattaaaatgttgaaggtaatgtttgcttttaatgattcctccattaccaactttaaaaaaattaaccacacactggaccttatcatgtctgtataatactttacagtaaaagctcgttttccatgctatgaaatgacgttctagttaacatttcccttctttgccatttctaggtgtagtgaaggaccagcataccttcgaatcaaagtttgttgaatgatcatcgtagtcaaacagattttattctaattatttagaatttactaatcacaaattgttgctttgttataacattctttccatgacagataaaggcatttattgaatatggtaattttattttgtgaacatgataaagtagggaatgatttcagtatatagtgactgagtccttgccattaaagattttttcaagtacggtacttatccagggacatactttctggaacatttgtggttcctcttaggtaatcttgaggaattctatatatttgtaccttgacattatcttagtactcctgctgtttttagtaggatttttgtttgggaggttgctaagtattatttagaagtgaaatctgataaggggattctaaaacctttctcctaccacaatagttcttttcaaatgcagataaactgtcattcagtgagactacctaggctcagccttcagggtaggatgaataaagcaatatatttgctggattgactttttgtccaggctgtatcgaaaaaataatgtacttagccactgaccatttatgtctttttaatgattgtatgtatagtagtcaaatggttagaatttatatgcagaaggatataccatatcacattttcattgtaaattgctgctttactctcctgtctgccacattctttctggtgattctatatttgtgttgattgcttttcatggataataaagaaatttacatttttctctttttactttgtgtggattaatgctctagatttgaatgcctaatgctagtcaatctttggatcacatatgtaatactcctccataatagcacccccctccactcccaccatatgatgaggagggaaaattttttctaaatattttatttttatttcagtagttttgggggaacggggggtttttggttacatggataagttctttagtggtgatttctgagattttggtgcacttgtcacctgagcagtttacactgtacccaatgtgtagtcttttatccctcaccctccctcctgaaaattcattgcatcattctcatacctttgcatcctcatagcttagcacccacttatgagtgagaataaatgatgtttggttttacattgctgagttacttcacttagaataattgtctccaacactccactcaggttgctgcaaatgccattatttcattcctttttatggctgagtagtattccatgttgtatacataacacatttgctttatccacttgctggctgatgggcatttaggctggtttcatatttttgcagttgctaattgttctgctataaacatgcatgtgcaagtgtccttttcatataatgacttcttttcctttgggtagtgggattgctggattaaatggtagatctacttttagttctttaaggaatctccatactgttttccatagtggttgtactagtttacattcccaccagcagtatgtgaaagtgttcccttttcaccacatccatgccaacatctattattttttgatttttagattatggccattcttgcaggagtaaggtggtatcgcattgtgggtttaatttgcacttccttgataattagtgatgttgagcattttttcatgtttgttggccatttgcatatcttcttttgagaattgtctatttatgtcctttgcccactttttgatgggattatttgtttttttcttgctgatttgagttccttgtagatgctggatgtcctttgtcagatgcatgggaggaaaattaacaactggttagagtaatagttttagaatttgtgtatatagattgctggtacaaaatgattgaatgcctatgtgttatcctggctgtatagtgaatcaaatgggtaaactattagagatagtatatgaggtaaagacaacttttttttttactttttttcattttcagaaataacttgctttttcttttagctctgctgttgctgtgtttatctatattagtttttagatgtaacagtctattcaaatgtcataatatttgttagaattttctgttcttgcacagggtggactttctgtagacagtaggtctgtggtaaaaaataaatttaaaaacccctgaacttctaaatgggtgatatccttggcaaactaaagtaatcacatggctagatattgaatttttagaatattgaactgtactaaataagcagatttattacaaagaggttgtaaaggtagagttaggttctaatcttaactcctctgtggctttagctacatcactatgctggctcttcttcatgtttgtatctgtcatcttctctgtcatcatcatatattgttctccccagttgtgtttcatttgacttcatcacgcctgccaaccaggtccctaatgttatttttcagatgttttattctctgaaaaacgttgttgctccttcttttgtggattttttatataattttttcatccttttttttctagagctctaccagcttggcttttacttccccttttataatttttcttaaaaagatctttatttttatcaaagtaccatatgtacataattaaagttaggcatacagagggcttgccataaaaagtaacaactgatgccccaccctttcctattcctaatgttgctcaccctgtggcaaccctgttaactcttttgttttgtctggtagttttctccttatttctaaataatatgcttataatgttatgtattaccttatctattttagatattatctattgcctgcctgctatgatagaagaagattaatctcacatcaatcttcatcaccctgtccttatcatcaacaatacagttatgatttttagtttctctcgtctaaagtaaaccttctttgatcttttttacataatctatgaagaataatacctgtagtccatctagatttgtttgttgcaaattttatgcatagatcctctggtcactttctgatcattgatttgaaaaattaagttctatttatttttttccacactggcgaaagttctcagggaactcaaagatagttaaacattttaactatccctcttgatactctctgcttttgaatttaccaagcagaggagagagcaggagtctcaatttttagtggttccctattttcttatgctattcgatcccactcatgatttgtcttggaattggtctggctatctactatgaagagtggtatggtgtatgtgcacagatgtgcacatacacacttatgtgcacaaggcacgtactagtacatatttccaaactcatgcatgtaaaagagatgataaaggggacctggattaactcacagcctgaacttgagcttgttttcttgtgtacctttgttcctaatttttaaaaaatttcctttatcttgagaatgtcttcccgaggttttgcaatcagtgatctttgtagcagtgtcaacctaacctcctgcctcaaggattgtgtgtgtgtgttagtgtgttttattttttttaagatgaactctattttttacagcagttttaggtgcacagcaaaatcaagcagaaagcagagttctcatattccctctattcccacacacccacaggttacctgctattgacatcctacaccacagtgatacatttgttgcagtcaaggaacttatgttgacacatcattcacccagagtccatagttcaggttcactcttggtgtgccttgtgtgattttaggcaaatacataatggcatggatttaccattatagtagaacatacagagtaattccactgccataaaaatcctctattcaccacctgtttattcttccctccctttaactcctggcaaccactgatcttttcctgtctctatagttttgccttttccagaatgacatatagttggaatgatagagtatgtagccttttcagactggcttctttcacttagtaatatgcatctaaggttccaccatgtttttttcatggctggatagctcatttctttgtagcactgtatgatattccattgtctgaatgtaccactgtttatccgttcacctactgaaggacattttggttgtttctaaattacagcaattatgaataaagctgctataaacatccaagtgcaggtttttatgtggacataagttttaactcatttgggtaaatgagtgctattgctggatcctttggtaagagtatgtttagttttctaagacactgccaaactgtgttccaaagtagatatatcaaggatttttgcataggttgttcctacagcctccacttttttttctaattagactatactcttccttaggacttctcagctcagcaatctctcattacctcattgatttagtaactacctgccattatatgcattcatggcacatgtattgcttctttatagcacgtatcataagtttgtgtgtgtgttttttttttttttttttgagatggagttttgctcgttgcccaggctggagtgcagtggtgtgacctcggctcaccgcaacctacacctcccaggttcaagccattcttctgcctcagcctcccgagtagctgggattacaggcatgcgccaccacacccggctaattttgtatttttagtagagactgggtttctccatgttggtcaggttggtctcgaactcctgacctcgggtcatccatctgcctcagcctcccaaagtgctgggattacaggcatgagccatcgcgcctggcctgtgtgtaatatgttaatgtctagcttcctcattagtttgtaagctctatgaaagcatggatcatgtttcatttgttgctcagcattttacctctagcacttagcctggtgtctggcattttagcaagtatttattaaatatatgttaaatgagtgaatgaatgagtaaataaataaatcaataaattgtatcaatgttctttttttccatagtgattgataactatgttttgatttggcaagtttattttgcttggagaattttacctataagatagcagaaaagctgggcaaaatcacttgaaacttcatatcagaagagactagacacaaaagtttttcaaaccccattttttgtatatatgtgtctgtgtgtgtacatatgattgtgtatgtttaagtattaaaaatggtgtgttttcaagtgaattaatttgtgatagctattgacctggcaaggaaaacattaggtaactttttaaaaattgttattattaagcaagggacatttcttgacttctcttaaatgccatgaatgattaaatagtgaattagagagttctgtatcttttaaaaaattactacactaaaactttgcttgcattcttataggataaatgtatattgcacacaaaatcacatgtatgatttaaatcttagtgaagacttgcatgcagcttatttctgataatcatttgattactcctcagtccaaataaaaaaaaatctaggtagcaaggcatttattcacatcattcatttttgtgcaacaaaatagtcttgcagttgacagtgaacttcagaatgcaggttttcaactcagggcaataattattaacatgaatattcaccttatgaatattgactatatgaatatgcaagctattaatggagtcaaatgtctttgaaagtcacactctagggacacttgttgcaattcttcactctttatggctggattatatatgctttcccgtggcagtattgattacacagtgaagatttattctctttcaccattggagttacatagtcctagtgaagaggaagtggggcacatgcaagatgtaatgtgctgctttgcctcatctttatttctattttaagcttcaatgacctagactagagtattttacaagaaattttatgtgtgattaagagtgagtcttttcatgtttgtttaatgatgagaaacgattagggtttgagggagtgactgctacccagtatgtatttaaacatagccaaaagtagcagtcttatcatagaaatattttcatagacgtaatagcatgagaataagatgcatttgttgtcttctttgcttttggtttaatctttttttttttttttcttcttgtcttgcagtatccttccaaaacaaaaggcataacctaacacttttattgtgctttgagtacctctcctctggaccaggtcaaccatacaactctttcagtcatctggttaggatagaaaacttattttgccttagtgttaacacatctcagatgacaacggataaactgagcctttaatataataagtgcacaacattttgcagatatgtttaatcattgtcccttcaataggggtttggttttgattttgttctgatgctgctaccattttaaaaaatgcctttaggattgtttgggaactgtattcagaattaattttgtaagaaacatgagaaagctattcttatggtcacattagttttgagtctaggatatacttgagagcctgcaatagtaatcagagtttattgtttttgaaaaggagcaagtgatttgagtatgtacattctagtgtattaaagaatgaattcaatccttatattattttcataccttataatggagataagttagttactgatgtatagtctcttatgtattgtttatttcagcagctttattatttaaatataattgacatacagtaagctgcacatacttaatgtgtacagtttactaaactttgcgtatgtgaaaaccaccctcacaatcaagacagtgaacatattcatcaccctcaaaggggttatacctcttggttacctcccgtccctctcttccatccccaaactgagaattagtttgcatttttgtcagttttctggaagagttgccgtagaattgatgtttactagaacaccccagtaaagccatagtgttgggtcttctctcattgtttatcagttttatggatcttcaaagaagcaacttttggttttatttttctatattttgatatttcatgatttaaattttgacccattatttcttttagcttgcttactttgagtttcatttgcttttctttttctatttgcctaaggtgacagcgaaggtcattgatttgagtacttaagagcttattttataatataggcattcattgttagaaatttctccccaattactgctttttggtgtcccacaaatccttatattttgtgattttaattttacttagtttaaatattttctaatttctcttctgatttcttcttctaccgatcgtttacttagaagtgcattgtttattttccaattatttggggattttgtagaaatcttttggttttgatttctaaagactgctgtggtcagaaaatatactttgtatgacttgaatacttttacatttattgagactttgttttatggtaaatgttccatgtgcacttgacaaaaaatatgtagtcttctgttgttgggtcgagtcttgttcggggcctccatatccctgctgattttctgtctgcttgttctatcaattattgagagaagagcactgaagtctgactgttactgtggatttgtctgtttctccttgtagttttctgtttctgcttcgtgtattttgaagctctgttattacaggcataactgtttaggactgtatatcctcccgataattgacccctttgtcattatgaaatgaccctttttataccaggtgatttttttttttttttgctgtgaaatccactttgcctgatattaatacagccactctaaccttcttttgactagtgttagcatggtttatcttttatccttttatataacatgtctttcccccacccgctctggctgcttttaatatttgctctttatcacactggctttcagtaacttaagatgtgccttggtgtacttttcttcatatttcttgtgctggggttctttgggcttttgggaatcactggtttatatgttttttaatttttgtgggtatatagtatatatatatatatatatatatatatatatatatatatatattcacatgagatattttgatacaggcatacaatgtataataatcacattgggggaaatgggctaaccatcacctcaaacatcctttggtacaaacaatccaattatactcttttggtttttaaaaaatatacaataaacttgttgactgtagtcacttgattgtgctatcaaatactagatcttaattattcaatctaactttatttttgtaccaattaaccatccccacacctcactctccaacttcccagcctctggtaaacatcattctactgtctatctccatgagttcaattgttataatttttttagatcccacaaataagtgaaaacatgcaacgtttgcctttctgtgcctggcttttttttcacttaacatgtcctttagttccatctgtgctgttataaatgacaagatcttgttcttttttatggctggatagtactccattgtatatatgtaccacattttctttgttttttttttttttttttttttttttttttttttttttatggtgtctcattctgttgcctaagctggagtgcagtggcatgatctcagctaactgcaacctctgcctcccacgttcaagcgattctcctgcctcagcctcccaagtagctgggactataggcgcgtgccatcatacccagctaatttttgtatttttagtaaagatggggtttcaccatgttggccaggctggtcttgaactcctgacctcaggtaatccacccgcctcagcctcccaaaatgctgggattacaggcgtgagccactgtgcccagccaccacgttttctttatccattcatctgtttatggatacttaggttgcttccaaatcttggctgttatgaatagtgccacaataaacatgagagagcagatatctcttttaatatacttattttctttcttttgggtatatactcagctgtggcattgctggatcatatggtacttctatttttagtttcttgagaaactgctaaattattctccgtagcggttgtactgatttacattcccaccgacagtgtacgaggaatccctcttttccacatccttgccagcatttgttattgcctgtcttttggataaaagcaattttaactgggggtaacatgatacctctgtaattttgatttgcatttccgtgatcaatgatgttaagcaccttttcatatacctgtttgccatttgtatgtcttcttttgagaaaagtctattcagatcttttgtccattttaaaattggattattagatttttttctctatatagagttgtttgagctacttatatattctggttattaatcccttgtcagatgggtagtttgcaaatattttctcctatactgtgggttatctcttcactttgttgattgtttcctttgctgtgcagaagattttttaatttgatgtgatcttatgtgtccatttttggtttggttgcctgtgcttgtggaatattatgcaagtaatctttgcccggtccaatgtcctagaggaccttccccaatgttttcttgtaacagtttcataatttgaggtcttagatttaagtcttgaatccactttgatttcatttttgtatatggagagacacaggggtctagtttctttcttctgcatatggagatctagttttctcattacatttattgaagaaactgtcctttacccgatgtatgttcttggcacctttgttgaaaatgagttcactgtagatttatggacttatttctgtgttctctattccgttccattggtctctgtgtctgtttttatgccagtaccatgctgttttggttactatagctctatagtataattcgaagtcaggtaatctgatgctttcggttttgttctttttttctcagcatagctttggctattctgtatcttttgtggttctgtataacagttaccatttaaaaaaaatttctgtgaagaatgtcattggtattttgatagggatgcatcaaaaacaaaaacaaaagtaaaaaatgaaaacacaaaaaccagtttgtgacatggttaattaaagtgatcgggatttttacaattctctttcacttttctacccttctacctgagcatctggttaatcatggctgaacgttaaccaaccccttccaactttcttgcttagactccaggtataacctcttggattcgggtcaaaattgcttactcaataattatcttaacctcaatctgacagtctccttttattttgcttaatagttatttggcaattcctttactgaacttcattagtccttaaaaactgtgtacatatagcttctttcagtttccaaacatttttccttctaattattgtttctctggtcatgtgatgtatcttttccttgcctgttgtttattacaaaaatctctccagccttggtcaaaattctatccttctgggctcacataccacaggctccagctcaggcacatattgtatttttattaaaaatatagcatagatacagaattttggtactaacaagaacaatacagtttattacttacactcgaagagattgagagcatacttctcagtctctcttctaggttttgccttgtcacatgatgcttaaggtattttcacccttgattattggaaaaattcagcaaaaccttattagaatactttaaatatatataatacagtttggggattattttattagcataactttgtatgttctttaagctagaacattctcattggtcatgctggcagggaaaagagaagccagaagaaaattcaagtcactgttccgtaagaacaaatgttaacatttgggctggatggtcacatcaacatggattttgacagaaaatgtcctgtcaatttgatggattttacttgtgataaatatacttccagagagcttgcaacaaaccactcggttataaatgggtatttctgaagtaatcctttctgatttgttttcagttctagtccctccccaataaaactgtaccctagaatgatgtaattaaaacatatgagatgtagagactaggaaactttttagtaacatgttatacatgtgacctcattgtatactggttttccttgtcctgattccattcagtaggactcttaggcctgtggttctaccttcttactggaactggagggaagcttctgtttgaccaagctaggtcaaagaaaatgaatttttttgctgttggctgtctccagagtttatcttgaaatcatcaagtacctgagggattaagttaatatactcattttgcatgttgctggaactaaaattaggtagaagaaagcagaaactgggaagtttttatgtttgtttaaagatttattatgtattatgggtgtatctaatcttcttgtcatgtaatttaaataaataggataaatatttttaatgcaaatccaaactgaaaattcactttgcagagatcattaacatttatttcatgtcattgtccttctatagttttaaaatgcaaataccatgggaaaatcttctggtatatgctcatgagagtgcatttgttgcttactgactgttttatattttacagttggctagtcaagtgctgactaatgaacacaaagcctgtgtttgaaaataaatttaacagctttatacacaagctaagtttatgtaaagtgatctaggagacacatgacctttgtgctccatagcccttgctcaaattctgaaagtaaactatgtaaatgatctaacatgtcaggtcaaacagtttcagtggttttcagccaagggaactattgaatatgttgaggtgcttccctctactatgatgggtcatgcatcataccatagtactctgtttgctgtttaccttgtgaaggtgtatttgctgctggaaccatgatgctgcatacaggacagagaacattatatggttctgtttttacctcagtatgccttggtttcctaatcagaaaaacgggaataataataatagctacattacaggtttgttttaggaattaattaaatcagagaactaaaaacaatgcctggcacatagaaggtgctcagtgaatcataaatagtagtactaatagtagtgatgctctctctttaggtctagcttttcttttttctttttaatatacaaattataaattaacaatttccttttaggtattcatgtctacaatttggcatttaaagagactcttggccgggcacagtggctcatgcctgtaatcccagcactttgggaggccaaggagggcggatcacctggggtcaggagtttgagaccagtctggccaacatggtgaaagcctgtctctactaaaagtacaaaaaattagccgggcgtggtggtgggcgcctgtgatctcagctacttgggaggctgaggcaggagaattgcttgaacctgggaggtggaggttgcagtgagttgagattgcaccactgcactccaacctgggcagcagagcgagactccgtcttagaaaaaaaaaaagagagactctcattcattcattcgttccctccttctctcctctttctctcttcccttgtccctgtttccttcccttcctctactgtatttccttgacttgttgctgtctagctgcagcagtgtaggcaaaccaggcaggctctaatggctaaaaattggtttgtttgggctacatttaaaataattggatatgtagcaatttgaggtgggctttgagctaatgggtcttatgctgctgtgaagaagtaaacaacataaggccaatatacagaggccatctttaacccatttatgtaatatatacaaaactatataagacccacctcctgccttaggaaattcatacattctagtgagaaattatcgcactatgataaatgctaaaatcaaagtttgaactaagaccttgggagtaataaaaaattccacttttgtggtgtttccaggttttttcaagcatattgtagctcaggaagcactctacattgttggctactggcgactgacattgcatcataacttttaagttttaaaactgtgtcaccctttcaatatctgtgggttacgtgttcatattcagttatgtttgtagctttgagtctacatacagtctcatttctgcatttcatgtgaaagaaaatgccagtcttagcacattctcttatgctattaatggagaggggaagaagccattctagttccttcctaaaaaaagtgatcactgtttaaagctcaagtaggtgggtgcttgtgtatagttcatgaaatttgggatactcagagctcagtgaatacctgaaaatgaagagaccttttaacctggtgggtcaagtttgacttaagttcttgaacaaattcactgtaagtactctagaggcagtgtttatgagggaatttagatgccaggataatttttttaaatagaaggaataaattgccccttgtttcccaattaagacacctaagaagcttgatctgtaatcatgtcttctgtggttactctctgaagtcttatgttgaaataagtggctgtctctcttctgtccctttatgtaccatcactggtatagccagtcctgcctatagaaaggaaaaatcaagttttttacacctcgtgttagaatgggtattttctacagaaactgtttcaaaggagaatggagttggaatactacttactaccagtgtgactctgaaggtgtattatagatttttataggattttaataaggttttttaaagctgatttgcgaattcaaccatcattgagaactttgtttctgtaagaaaatgtagtcgcagaactaactccatatgtttcatcagggctacgaagggcccatgtatgtagaaaacttcagtagtattgattatggctactaaataggtaattttgttgaaaataagtttaacattattagcaaatagaatggtaattgaagagaagttaatttaggaattttgtaaaaaacttggctatgattatggtactgacacagtaatgtggggccagaacttatggtaaccccataagagtgattctataatttttttttttttttttttttttttgagactgagtctcattctgttgcccgggctggagtgcagtggtgcgatctcggctcactgcaaccactgcctcctgggtttaagtgattctcctgcctcggcctcccaagtagcttggattacaggcgcccaccaccacgcatggctaatttttttgtatttttagcagagacggggtttcactatgttggtcaggctggtcttgaactcctgacctcaagtgatccgcccgcctccgccttccaaagtgtcgggattacaggcgtgagccaccacgcttggctaattctataaatttttaagcgtatctttatttgtttttcagtgatctactgactgtaaatcattctgtcagcttcatagtaacatttaatttcaacctacccagtccctaattggccaaactgttataaaaccaaattacgcagcagtgaggaaaatagaaacttgaatgaatgctattaaaataagtttagaccatctcaaatttatcctcataattcagactttctctgttttcaaagaagacgtctcatacacactgagtgttattggcagatttgacatggctggagtcttatgtgcagaaatataatatgtatctgtcagtggttttcaggagcccctatgaaagggcttgattttgctggtttgaagcctttgttggcatcagcaaagtcaaagagttgtaggcaaggttaacagccacttcatatttaatgggtttatgcaaaccgtgatctatatattgattatataaaatacatcactgttgtcttaacatccagatgaaaaggaaaaaaatgttttctacatcaaaatctttagacttaaaaatctctgtgattcataatattaattaaaagagaaaataaaaatctgaataatttgctttgacctgtgtatgtataagggtcattataagggttagtgcttgggttgcttgtgagttttcaggcaaagggacatacagctcatcttttttatattgcaactgatcagtgattaatacttaagaggcttcaggggctaagtatagttgctgatttatttgcagctcttactccacttcaattatttaaatacagcgaagagtccgtcgtgagaaacacaacagagtaggagaaatttgagatctatcagcataaacagatacaagtgttgctttgccccaaatcataaaaagtaaaaaaattaaaactacctgttaattcattgtgatattatttgtaaaacacagtgacataaatgatattttcctacaatgtgttatttattattttgacaatttctgtcactatgttgagaaagaatctcttatccaaattaaaactaagtaaaaaactatttaaggaacattatgagacaaaaggttttttcagttatcactactcagcatagaatctgaagcccattgggggaaaaatgaagtttataaaattgagtaatttataatattaaatttttccaaaaacactttttaaattttctgaaaattattttttgttcaccatataatcacattctgtttaagcttctacgttttaaatatttgatataatatttagtgatttttaaagttcttcctgtgtgagtaaatgagctgtttttgttttccatgtagagaagtttgtctgctttcactctggaaatgatttcttatgggttaacgcctttggatacatgtgttccaagagctaaacaactgctatacaagtgaattttgagacatggcccattcctgaattggggattgtttgcaaattcaagaccatcagttaaaagtactaatagtgaagttaacttaaatcactgtatgacttttatgtattttttcctacaaaaaatataataataccttattcacaactcaggtataattttcagtttttggcaatttatactcttgaatttttaaagcagtgaatcattttgttttgtcagattaattttgcaactacatcagaaaactaaatgatgtggttatttgtaaaagctgcttgaagtagacagatagcaagtcattgtgaggtgaagtatctccagagtgataatcatagccatttagaggttatttttgcattataaagatagtaatcataacaacagatatttaaattactctatttaatacaaacagcaatcatatgtctgggtacattgcttcaataacaagcgttattttaaacaaaattatatatactaactgccttatctatttatattgctcccatcctaggctaagcttttatcatcttgcaactggatcacattctctctctgtcgctctcttcctctgtctctctcctcccccagccccaattctgtcaatcatcacaggtttgagtacttactatgtgctagaaatagtgcaaaaacctgaggacacagtgggaatcgagaaaaacctggtccttactacattgagtttacagtattgcacagaagactgatattgataggtaattaggatttgatacgtggaatgtgttgcagaaggaaccatgggagactataacaggatcaactgtatccttagctgagagcagaacagttgagtagaagatggctagatgattaagaaagaggtgaggtgggatggagcgggtgctgtaagcagagcaaagagcacctggaaaggccgagactgaaaaagagctggagctctaaccagtattgttatactgatgaagactgttgcacacagatttcagaatatagatagatgttctagagtgtgtgttctagtcagacctgaatgctaatctggactgtgtaatttattatctttgtgatttaggcaaatgacttaatgactgtaaaccttgatttcctgatgagtaaaacaagacagtaccttcttgtacataggattattgtgaggatttaaacaaggcaatgcctgtaaagctcttagcatagtgcctataaatgctcagtaaatggtagctattagttaggtagaatagaccaaacttgctgatctctgcaagccgcctttttagcctttgattccttctttagtttattctcaatattacaggtccataacccttttctgaaattctgaaatatgaatgctctgaaaacactcttatcatttggccacaagccccaaccttcttaaggccgtataggtactctttatttatcctgttttgtgaaatatccatgttttccttttaaacttgaatacatttgagttaatgtgttaccccagatcctgcttagtgtgttttgtaagatatgatacacctagcatattcctttctaaaacatgaaacatgctgagttccaagacgtgtttggcttgaaaggtttcaaataaaagattgtacacgtgtgccaacccaaagtcagctttctaaaataccattttctccatgtctgtcttcaaatcagaaaatcataagaacgcctagtggttttccagtttagttttgactattccttgtggttttcaagactgcctctaatccaccctacatattcaaaatttaatacccttgtacttgaaccatttgtttcataagtctgttctcttcaacttccctgaagtaaaatgttaatgctgctccttttgtctgacttccctctctttctctctttgtggctcttcagatccctacccaacaattaggccacaattctttgtagtttctcaatgaagctatatttatctatttcttctctgaattcttattgtgcttaaatgaatttatttaacagtatttgagcagatattatgtgccagctactgttctaagtgtcagagatctgaaagtgaataagacagttaaggtctctactgttagggaacttgttttctagaaagtagaagacaacctgtaatcccagcactttgggaggctgaggtggatggatcacgaggtcagaagttcgagaccagcctggccaagatgatgaaacctgatctctactaaaaatacaaaaattagccgggcatgatggcgggcacctgtatccaagctactcgggaggctgaggcagggaattgcttgaatccgggaggtggaggttgcagtgagccgagatcgtgccactgcactccagcctgggtgacagagggagactccgtctcaaaaaaaaaaaaagaaaaaaaaaagtagaacacaaataagtgaacaatatcatttcagataacagttaatgctgtcaagataagacaggaggatagtgccttgggagaagcgacatacctgagaaactcatagtttcgcatttagttatttttgtttttatatggttagttttttttttttggtttgacggagtcccactctctcgcccaggctggaatgtaatggcatgatctcggttcactgcaacctctgccttccaggttcaagcaattctcctgcctcagtctcccaagtagctgggattacaggtgcccaccactacacccagctaatttttgtatttttagtagagacgggggtttcaccatgttggtcaggctggtctcgaattcctgacctgaggtgacccacccgccttggcctcccaaagtgctggtagtacaggtgtgagccaccaagcccagcctatatggttagtttttactccctggttagactgtaaatgccttaagggaagaatccttaaacttctatgtgccataaagtgttgggtataaaatgggtgcttgattaaggtttggttgagaaatttgtccttttttgacagagaaggtaaaaatctatttattaaatataaagcactacttggctaaatcattgatctaagagtatctgttatgtacaaagtactgtgttggttttgaaatttttgtatttgtctaaatctagctttttcatttctattgctttttattcatagtctaagaaagaagaactttcatgtctacacaacttttttttcccatttgaaatgctttaatattgtgaaccccataaatttgagacaggtctcagtttagaaagtttattttgccaaggttgacaatgcgcttgtgacacagcctcaggaagtcctgatgacatgtgcccaaggtggtcagtgcacagcttgcttttatacatgttagggagacatgagacatcaatcaatatgtaagaagtacattagttccatccagaaatgtggagacaactcaaagtaaggcctccctactgggggcttccaggtcacaggtaggtgagagtcagatggttacattcttttgagtttctggtaagtcttttcaaaagaggcaatcagaatatgcatttgtctctgtgagcagagggatgactttgaatagaataagaggcggttcccagcttgaagaggcccaagatattttcctttcacagtataaagcaaacaaacattctttctatacctgtagaggatgctactactctaaaagctggattattcctgcaattgtttctgcttaattcaggcactaagtgacttcctccaattcattagtgtgaacattcttaaagacctaagtggcagacatatttcctgaaccatttacccttagtcctgaagctgatcaggtttgtcacacacagactgctatagtcacccctcctggcagttcaagattgagctttatggcaagacaattcatttaagattgagcataacttgttatgacagatttatcaaaattatccagtgaagtaacatagacttctgctttgtgaagaaaactgaaaccctatactgtgatgtcatatttgttctcttatagataaatattttgttctttataaattgaaagagcatcttgagaagagaatctcaaaaggatttttttcttgtcataaaaatggtggaatgaattttgatttgtaatagcaaagaactctggtgggttaaaatttgaggcttttgaattgactgtacttctgagatggtgtgcttatggtcacaaaaatacaaaagtattgctctactaaaatgatgaaatggacagttcaagatgttaacaatggcaaagtaaggtggagaactggaacttcatatctgtaacttcatcttctcaactactaggcttttgagctttgagggcagggccatatctctctaaatccccagtgcctcacacaccaccacttgatctagcatctattcttaagtgctaatggtgatagaggactacagtgcctaagatgaagtgtaggtggctgaaaatgactcttacttttagaaaggagatgaaagaatgattgggagtaattttaagtacacgcagtaaatagttcagtgattgcaaaaggaaaaatttgttttctaaaaggtcatcttagactcaagcctgtactttgagcttagttctaaaaataaaattagacattgctttcttggtgaaattaaacacaactgagaggtactcaactaacagaaaatctttataataaagcatttgaatgcctgaacagaatgttcagcttggttaccaggtgattggccttgagttgtttggattggccttactggtttttaaagttcaggagtgagtatagggtctgaaaagttggaaggcaggcctttgaatagtaactacttccctctgtgactgctgcttatctgaatagggattgggcagggatgtcgtccagagaaatcaaaccctgaatcattggttgatgttgattacctttctcaaggtccattctgacttggaaaatatatggagattataatagagtattaccatatcagaactctcagaagctttatattgtgattgttctttcattcttctgatcttcaactagagtgtaacctccttaaaggaagacagcatgcttaccttgtttaccactgtattcccagtgcccagtactgaacagtttcacttatgtcactcgtgtccatgtgaagagaccaccaaacaggctttgtgtgagcaacaaggctgtttatttcacctgggcgcaggcgggctgagtccgaaaagagagtcagtgaagggaggtaggggtggggccgttttataggatttgggtaggtaaaggaaaactacagtcaaagggggttctctggcgggcaggagtgggagtcacaaggtgctcagtgggggaactttttgagccaggatgagccaggagaaggaatttcacaaggtaatgtcatcagttaaggcaaggaccagccattttcacttcttttgtggtggaatgtcatcagttaaggcaggaacaggccattttcacttcttttgtgattcttcagttacttcgggccatcggggtgtataggtgcaggtcacaggggatgctatggcttagcttgggtccagaggcctgacaaacagatgcatagtagatgcttaaatatttgttcagctgaagtgaaggttgttttttgtgtcctattgtacctgccattcttggaacgcaagaaacttaaggaaggtaaagagttgacccttcatctctattgtaatggccaacttaattcattttctttaagagagaagaaaatagtcaaatagtgcgaatacgtttttgagttggtggtgagacttttgaattatatgcaacttagttgtccaatttctgtggtagtagagtaattgcacgatgtttataaaacattgtattaccatgtaacattagctataagagagttgaatctttacatcttgctctttttgttaatttctgcctgattgagaaaattaaaacttaattttcttacaataatgactcttgcattgcaatcacaacttcagcattagagtttataagtaagtcagtcatttctcttagtcttaaggggttgagactctggagtgatacttttatagttacacaatattcatataatactgtgctaagttatatttaatatagctgatcataaatgaagtttaataaactctgattgcttgactaatgcacagtcttattgcttttccagagttgattttaatgaaaatatatggtcactatatttattggtacaatatgccctcattgtaatgagcatgatcattagatttgcataataaaaacttacaaaaatgactttaatcagtgcttttaattcaggggtatgactctaataaagatttttgggggggtcatttttgtttctgactttttttaactccatagtagctctgtagtttgtacacaggaatgaaatccatgtttacttgcatgtggtgtgagacagatgcacccatccacataaatgaattttgagagcttgtcccagaagaccatcattataaatgaaaaaaatttttttggtgtttctgttgttattctcaagtccttttatacctttcttttttgactaatatagaaagataattgtgtagcagaaatgatttcgttttgtttgcagatcatttaattgtaacttatacaatgatttcaatgcatgtttaatgtacagtggctaaaaattaccccttctgaaattcagcccttcatatctgcttaaagattttccttttcgatagaccatatttgttcttttttctgaacagttataacgaagagctttaaatagtattatatttatgaaagcagatttttacatgagggaaatctgagaaaatattcgtattaaatgtatgtggttatacaggatatccactctagttgaatgaaatttacaaatcaagaaatcaggagtggggtgtttttctttatgtttctctatcacacgtaattaggataattttttacataagtataatttcctatgtgccttcgggtactctatcattcttgtagatgcctgtcaggaaaaaagaaaattctttaagaataaaacaaagcacagtccttctccagtattatttttgaccaggggtccacatttggtttatcaacaactaaactttcaattcaagggcagctctagaattagaaatgtatatagcagaatggacattccaaatcaaagggaacagtaggggcacaaagaggacatcatgggagtatgcattgggaagaggattttaatttttgttttctgtagaatagggatcataagagaagaagtagaagatagcccagggctgaatcatacagggctttgaattccatattaaggatattcatctttattctataggtcatcaggaggcattgaatatttatgaacaggagggagtatgatagtcattcatactctttattgagcctcaatgtgccaaacactgctttaggcgttagggttacatccctaaaccagatgggcaaaaatccctgtccttgtggagcttatattttttgttggaaaaacagaccaagataatgataattaagtaaattatagactatgttagaacgtgctaaatcttgttcaggagtgccaggaatatgtggagggaggcagatgtttccatttgaaataggatggccagggtaggcctcactgagcaaaaccttgaaagcaggaagagggagtaagccatatgggccatggagaaagagcattccaggcagagagaagagccagtgcatgtggcttattgcctcattggggagccgtgaagtggtcagtgtgactggagctgggggaatgaagggagagtagtaggagatgaggtcagagggatatggagagtgtatagatcagtagggccttgtaggtcattgtaataactttgacttgcactaggagggaaaatagcccttggaaagtgttgagccaaggagtgacatgacgtgacttcagttttcacagtatcactttgtcagctgtgttcaaaattaactgtaggagagcaaaggtggaagcaaggagatagattaggaagtcactacagaaatttagttaagagctgatggtggcttgaaccacatctttgcaaatggcagaatgattatcatgggactggatagctgcttggctattggaaatgaaggagaggaaggagaacaagatttggaaatcttaaacctagacaagtggaatgcaggtggagccactaacaaatgttaccctcttgtttgtaaaatgagaggctttgactagattatcttgaattccatctaacttgaatagtttctacctctatactctgtggtttactatagataaaaagtatgttaattccaaagaagagtactgaggggaagggaagacttcagtctcgtcccataggaccaagtgaaaatattgctagcaatgctttttttcttgtgtctgtctcccatgattaaactgtcaacatgtattcaattgagatacagatttgaaacattttaaacatatgtgtaccttaatttagataatttgactaaagcaaaaagtattttcccttcatttacattcttgctttggagatatagatgggtttccagcctggagtttataaccccaaaagatgggaagagaaggaaagcagtagttgcatgaagaactgtataatctgtctcaaaaacacatgtggacaagcgcacatagggatggtagcagaattagttcaggcacttttgatactttgtcattttctctctgatttggtattgcaggaaatcatgaaattggccattgtgtttaaaacagttttctataacccactagaaaaattaaggagaaaatacctggtagagagagttgcagggtgaattcatccttcttaaagtggtttcagttctgatataaataattcccacttttttcctaggcagtaaagattgattggggtttgtgtcagcaggatgtgatgaagacatggtatagagattagaagtttagatccctgagggaatcagtggattaaaagtagaaaagaaaagagttatacatagaatagtatatttgccccagctgatctggggaggatggtctttaacagcattggattggtggtatttgaagacaattttctgagatccaagcaattttcattcacttaaaactcataatggaatcctccccactgtgagaagaccctattttttttttagtgtgcatgaccaagttgatatacattattcagcttctgttgtaagaaataaatgtataggatctggcagaacatttaattcaatttctaacagacaattaaaaaaaatctggttctttcctaatcacacccctaattggcacttcaacatatttataataaaaactatatttcatgcttatcatacattattgtaaggtcttgaactatcccgtgaatcatggaacataactacattattaggtattgctttagtattgctgtacttaaattcttcaaataatgttgctcatatatgttcaattttatgttcaaataagttcaattttatttagaatattttaaaaatatttctaatttatttataaggatagtttttaaaaataagttcaattttatttagcatatttataaaagtgtcctttaaatatccatcaggaataacacagttcttaggccaagctgtttcattatatttcattcttgttaaatgtgacatttttcctattgtacgtggtgttgttttttaaatttaggtatcttagcttgaggattcatttccaaacttatatatagcatgccagggcttatgattttgttgtatcttttctcacatttcagcactgtggtagtgacgtctgatttagatctgatttgggacattgggagccgtatttaaaaacaaatatatacacctttgccaaaccttcatttttaatcattaaaaagatttttttctttaaagaatgtattgtttatatgtttgaactttctgattctttttgactgtttacagttaataaaaatgaaaattattaaattattttattgtttgatctatgagtttctcttatctgatgggttttttttgtttgtttctttttggttttaatagaacattcaaataaaaactttggcagatgatgtggtaaggtggtcttagcatgttattacattacttatgcatgttgccttttaattaaaatgggtggacataaaagcattgatatatgtaagatacaaaatgtctggatatttacaaagtatagtagaatggaataattgtcaattcagtgacttccttttcgaatattaacacaaacaattatatgagatcccaacagaattttcatatcatcctaatatttaccttaaccaaatgttttttaaaatcttgtgaatctagactctggaaaacacagatgcttccttttttgatggccaaataaattgtgaatgtattaaacattaatattggaggaaattaatttccattagaaaggaaattaagttcactgttagtcagatgtgtgctactaaatttaaaaaccagtattttaaagctgaatttgtcatagtatatctttttaaaagttatgggctcaaaatgtaaatatacccttttatagctaaactataaaaaatggtattttaagccttgtcagttttttttttcctatgtgaaattacctatttacaaataatttaaagtagtgatagtgctcaaaggagatgaaggtatgtggcttaactacattttctttttgagacagagtctcgccctgtcacccaggctggagtgcagtggcgcgatctcggctcactgcaacctcgcctcactgcaacctccacttccctggttcaagcaattcccctgcctcaccctcccaagtagctgggattacaggtgcccaccaccacgcctggccaaattttgtatttttagtagagatggggtttcaccgtcttagccagactggtctcaaacttttcctggtgatccacccacctcagtttcccaaagtgctgggattacaggcgtgagccaccgcacccagccaactacattttcttaccaaggtatagctgaaatcaaaagctaattttctagataaactgaaagacacagtggaatatcaaatatatatgttattaatgctactcagtaaaaaggctagtactggaaaagtaaatattaagtgatatgaagggaaaggagaagagatatgttgatttaatggtcagttgcatatttaaatgctttcatgtccaccatatttttagtgaaatttgactattggatatatcctcagcttattttggattacttaacttttttcttgagttgtttgaagatatactatataactaaaccaacttaatttccctcaaaaagttaaaagaaaatgtgaaaatatagttcaagatgattagaagaaatgaatcttaagttaatgtgaagactgggataggaaccaggggctgttggatttaggaaaatcaccttctctgtgaaatgaggggattggtttagattatttttcaagtttcttctcagctctaaaatactatgatttatataatgtctttgtcagcaactgtgtactcaaattgcttttgtaatcctaaataagctgcttaaaactgctcatatttctttcaaagtatactttttggttttaaaaaagtgttctttgaatttaaaataaaagttatgctcattaatgaggagttcacataattttacataagctatggtaataacttctgtgatgctctttgtattgttgaagtaattatataaggattctggttacatggcggtgaagatatattctcctgatatttaacatatctgcttgtttaatgtgagcttgatggtatgcatgtgcttcctaacagaaaccataataaaactgagttgcattcagttttatgcacattactaacttttgatgtcccatgttttgtggtttaaaatagaatatcctatttacatgcaactgaagtcattaactcactttatgtgaaatagcaagctaattattagagattttacatggaatcagtggttcgaagtcaatatccgtaaaatagcaagtttttcttaatgatatttgtaggaataagaaatttctgtttgttacatttccagtaaatggaaaagccgatgtttttatctttgttttgcttcctcattggcccaacattttagggaagaaaatgctgggggaaaataataatagtaacaacaataataaatagcagctaagtgcaataaacatattaacttatttaaatttcacagtaaccctatggtgtaagtaatatcattatccctatttcagagatgaggaaacagagagagaccaagtaaactttcacaaggttactcagctagtaaatggcagagcttggactgaaacccaagtaatctgtcttgagtccacgctcttaaccattctactgctacactgacacattattcatttatacttgtcacaatttttgcaactttgaaggagaaaaacattaccataattttctcttagaattggaaatcagtagctctttttcagtttctttctcttttttcatagttctaaagttgccaccaaagacacactctcccagaaacaaccaacaggactttgatccgagactttttttttcacttatttactgtgcaaaacagaaatgacaagggactaagttttacttttgaagaatacttttcacccccagagttctgaggctgaagagtacttcaaggtttcaaaatagtacaatctctaactggagcttgctgcttaaaatagtattttgtcagaagacaataatgatatgtattatactaagtgccgttttgatgtttcaattcttcatgttagtagttcttgatctttttctcagggctttttatttatttatttttgtttgcagcgtgaccgaattacaagttttagaaaatctactgtcaaaaaagaaaaacctcttattcaacatcctattgattctcaagtcgcgatgagtgagtttcctgcagctcagccattatatgatgaacgatctttgaatttgtcagaaaaggaagtattggatctctttgaaaaaatgatggtaagttatacccctaattttgatgtaattttaaaatgtgtgtgcccagaatagcactgagttttaaggaggtgtgtttgtatggacagtgtttatatcacataaagaagagaccagaaacttgatataacaaaactatttgcaaaagtatcctttttttttcttttttcttggcaaaaatgtccttacctgtctatctcttccactgtgagctcctaaaagtagaggcagttttatttatctttgttttctactatttagtagtctctaggacatcgagtcagtttttcagttaactgatttgtgtgtctgtttctacaaagcaaaagaggcctaggtcctctgctgaaaacatcacaaggtctcttgttgggtatatgaaatagacttgggagggtagagagtaacaatagaagggacagagaaattaattcatccaagtttgttctattagcaacattcacacaacctacattttctagcatgtttcctgtgttttatagcttgtggcctaaatcactgcctatattagataatgaataccatattttgagtattcagaagtttatggcaggagaggggagagatgaggaattaaaccgtattacattgttaatttgaccagagaagaactagagatcttgatttgtgattcattcattcaaaattatatcccacatgttactgtacattttttgtggttgtctatttacctgtagttgtccacaggagtttcaaaggtcgccttacaccaaaataaaaggttaaggatcagtgaaatctagaccctactgtgcccactgtggaacatcttgtcatcacctctcctgctaccctcatgtttatttctctcctgcacctagaagagttagtaggccttgaataaatatttgttggtagctgttgaatgaatccaaacaaaatttccctttaaaattttccttgactattccttccatctagccacaactggcattttgggtattcccctgaaacgagtcctgacacttttaccctttttcactcttcttcctgcttctgtggtgcaccctttttcctgctgctcctttcgtgctatcttctttaaaccatctttcaacaaccttttctcttttgaagtctgttattgctgaccttccttgatgatagcacctggctatgcttttgtcctttacccttgctactcattttggtgatttcaactattacgctaatagccttcaatacattttttgctcttagttccttgtttgctaaactctgacttttgcatttatatatttagctaattataggtatgactgtaccttggactgtgtcatcctttagaataattccacctctaagagctttaactctaaaattttccttagaagctaaacaatttacactacctttccaagacccttaattttatagagcatgtattgtgtagtggttaaaaacctggactttggggtcattcagaatgtttgtagtgtttctttcctttatcaaataagctctgttgtgtctttaattgctagtattttctgattacctagatacccctcagtttatcaccctggtgtccttaatcactgaaaacaatgatgacagcaacaaacacagaaacattccttgatactattaacactttttatctttttaaatctttcttctctttaaataaaaattatactcattgctttaagctgctgacaatttggttactaccttttgcagtattgaaatagttctccgagttcatcagtggcattgctgtattcagtttttctacactgagcattacagggctatcttcccttcattgattatctcattcacttctaatttcttgccaaatcccattggttttgcttttgtaataactgttacatttgtgtcctcagatgtcctccagctgttcttgccctactttagatgataaccctctctagttgtttctcatggctattaaaatagcctcccaactggtcttcctcccatcctccaggttttgcctattccaatccagtattgccctatgatttggacacagagttcttttctgaagccccaggtgggcctttatgttttcagagaatcagtttatatgtccctactccgttccctcaactatgcccctagatgcctttcacacctttgcttttctgctccaacctcagagctcttccccatctttattctctgctgatgaccttgctgcttaatttacgagtaaattgaagcattcagaagagaacttccacaggctccccccaccacatttaccttttagtatctgcattcatgtatctgtcttgctacctatcaccatagatgaaattttcatgtccgcattcttctgcttgtgtataaattttcattcctttcagctactcacagatattgcttcaataattttttcttctctctcctaccattctgagcagcatgtaaacatgcggtcccatttttcaaaagccttcttttgaccctttctctgttgctagctatcactccatttatttactctccttggaagcaaagcacctcacaatataattttattcatatgcactgcttccagttttaatcctctcactttctcttctaaactcactccaaccaggtttccatcccaccattctatcaaaactgctcttatcaatgtcaccagatatcttcatgctgccaaatcccatggtcaattctcagttctcatcttaatttttttttttttttttttgagacaggatctcactctttcacccaggctggagtgcagtggcataattatggcttactgcagcctcaatctcctgggctcaggtgatcctcccaccttaacctcccaagtaactgggaccacaggcatgcagtgcaccaccatacccagctaatcattttgtattttttggtagagaccaggtcttgctacattgtccaggctggtcttggactcctgagctcatgtgatctgcctgccttggcctcccaaagtgctgggattacaggcatgagccaccatgcccagtctctcatcttaattgacctatcagtagcattctgtgcagttgattattctctccaatttgaaacactttttatttttttgtctcctcaacattcatcttgttttcctcctacctctcaggccactccttttcagtcttctttgctcattcctctttatgtcctgaacctctaaatcaaatttacattcaacttagtcctcacatttgaactccagactcatatattaaacttcataaccaacatctttccttggatgcacaatagatctctcaaaataacacaaccaaaactgaactgctaatattcccctccagacctgctcctacaaaagtcttccctttctcagttgacggtatctccatccgtccacctaggccaaaaactttggatttgtccttcactacccttttctcacattctacagtcaaaccattagaaaatctcattagcttttccttcaaagtaaggcactttcaacagctgaccatttcttacccacctccactgataccacactagttgaagtctcagctggaccactataataatggtaggattattaggattaccacaacccctaattgatcttcctgctttcactcatgaccctctattcttagcacagaaagattattcatttaaaatatgaacatcatgtcacttggctcctcaaatctccaccatggttctcatgtcactcagtgaataaaagccgatgtacttgcagtagcttataagatcctatatgttttgacacccaccacaccttacctttttgatatcttcctctactattctctttccgctagctcacagcttcagttgcactcatgccttttattttattgtagctctaaggaacaatgattcctgttagtttttctttcttttttttttttttgagatggagtctcactctgtcatccaggctggagtgcagtggcgtgatcttggctcactgcaacctctgcctcccaggttcaaacgattctcgtgcctcagcttcccaagtagctgggattacaggtgcatgccaccatgcctgacttatttttgtatttttagtagagacggggtttcaccgtggccaagctggtctcgaactcctgacctctggtgatccgcctgccttggcctcccaaagcgttgggattacaggcatgagccactgtgcccagccgattcctgttagtttttaatttttaaatttatgtacaacatttacagtgtttttaaacttcgtacatttctattttgtggtttgaatatcataatgtttcatcagaaaattactatttcctctttatgattttttttaaaaaaggatttgcttgttggattcataaatgtgatttaaagaactgtacaactttgtgccacattttctcaaatgggaattttttcttccatgggaattttgaaataggatattaagaaaatatgtttttcaggtactatcatattgtgttataattttatttgatggatctcttttatgttatgtgacccacataatcattatagacttgtatatgcagatattaaaatcctgtttatatctagtagtggaattgctggatcatatggtagttctgtttttaatttttaaaggaaccttcatactatttatcatagtagctgtactaatttacatttttaccaacagtgtatacaagtccccttttctccacatcctggtcaacagttgttatcttttgtcttcagtaatagccattctaaaagatgtgaagtcatatctcattggtgtcttaatttgcattatgttaagtgaaataggctaggcatagaaagacaaatagcacatgatctcattcctatgtgaaatctaaaaatgttgatttcatagaagtcgagagtagaatggtggttaccaggggctagggtaattgggcagtggggagaggggtaggttgaggagatagtggtcaaaggatacaaaatttcagttagatagaggaataacttcaagagatctattatacaacatggtgactattgtatttttgaaaaatgctaagagtagatgtaaagtgttctcaccacaaaaatcacaaccatgtgaggtaatgcacatattaattagctagatttagtcatcccacagtgagtatatacttcaaaacattgtgctgtacatgctaaatgcatacaattttatctgtcaattaaaaaaacttatttataaatggacatatattatttttaaataacagtataatataataggatatcagagaaatatggtttgattaaaagtaacaaccaaaagttaaactgaaaactttaaagattatctctctactttgagagaagtctacttataccctgaatattgcgtattttctatattagtttgacggtaataaccttacagtgaacaaattattttatgaataactatagttttcatctactgtatacttatgcctaaggcatgaaactaaaacatttaagtgtattatttcaattgatccttatgacagtgccacaaagtaagtaagattgttataccccattttcagatgaggaaagtgaagcttagagagaggcaagaaaattggttcattaacttgactaagctagtaagtagctgagccgaaacttaaatttaggtacataaaaatctaaaacattgactttttgtaacatctgcctttaataatgcttcatttaaactaaatataaaattagtacattttccttgcacacatagtgaggagaagtagaaggcaaatcagaggtacattagagtggtaggtaaagccagcctgggatggattatttcctactgataatggaacattgtctgtaattgctttttatggagcatcaattgagaagaatgagtccaaaaatctagcaatggaaaactgttaaaaatgtcattatcacagttgattgggagaaagcacttaagtcattctgtttctaaaacacggaagtagacttccagatatgaaatttatctttttttatttcactccttgtgggtgtctttccttgtacaaataacgtaaaaggtgttcttgtcgtatttgatggctcttatgacaatcttccttcttctgggtcttttgatggtagctttattgtgctgtttctcttgattggcttttctgactttagagaactacaaaggtttagaccatttggtttcaatactatatatgtattttaggataacatactttgaggtgtaaaacttttttttttttttttgagatggagttttgctcttgttgcccaggctggagtgcaatggcgcgatcttggttcattgcaacctccacctcctgggttgaagcgattctcctgtctcagcctcccgagtaggtgggattacaggcacgcgccaccatgcctggctaattttggatttttattagagacgggttttctccatgttggtaaggctgatcttgaactcctgacctcaggtgatctgccagcctcagcctcccaaagtgctgggattacaggcatgagccaccgtgcccagccaaaacgttttaaataattgcagcacatagcatgagattatgcacagtaataatatatgagacacttgacaagaaataaattaccttacaatttactatttagaatttctgggtaatgatgtattggtgaaacttttggttaaaaacttaacaaaagataatattcaaatataatcctttcttactctgaaaattgaaactcttgttatacctgaggatcacatctatcaacagcagttctcattggataggcttgtagatgtagataattgagctaaatctaaaattactgcaggatatgttttttctaaaagaaggtagctgtttttacttaattactaatagatcatttcacaaatcacttgattcttcatagctaagaaaaattgtgaaatgagtccagttaactgaaagatctgagtagtctggttttactagtgtattagtagactactaatgtctcattgactctggcatctattctgtgcattggtgcatcacttttcatattgtgcttattcaatgatgcaattttaaagggactttctaagtaatggtatcaatggctattgctggcaagtttaaagttccaaatttgaaataaatatttatttatttttttgtttagagacaggaccttgctctgttgtccaggttgtatcatgggtcacagcagcctcaaactcctcggctcaagccctcctcccacttgagcctcccaagtatctgggactacaggcatgtgccaaataaacgtgatttttttgtttattttttgtggagatgaggttttgccatgttgcccaagctggtctccaactcctaggctcaagacatcctcctgccttggcctccaaagtgctgggattataggtatgagccacggcacctggctttgaaatttcttgatgattgtttattttatagaatataagctctttattaagagagtgtctttcatagtttgtaaaagtgaattttgtatttagagtatggttaccaactactaactgaaaattgagaagtggttcttttactaaagttttcaagaattaaaaccactgcttttataagattgataaaattacctgcatggggtaaatcacacttgctctttaagattcttgtctccctcccatacccagagtcatgttttcaaatcttccacaagtgggtaaaggtagtaggatgaaaacaatactccttccatgttattattattggtaactttttttttcttttgttttttttgtttgtttgttttttcgagatggagtcttgctgtgtccattaggctgtagtgcagtggtgtgatcatggctcactgtggccttgaccttctgggatcacacaatcctcccacctcagcatcctgagtagctgagactgtatgcacgtgccaccatgcctgcctaattgttttgtagagtgtgggtcttgctattttgcccaggctgatcttgaactcctgggctcaagcattcctactgacttggcctcccaaagtgctgggggttacactgtacccagcctatatttagtgacttttaaagatgactgaactaaagcggttcatattcgtaactcttctcatattgatcagaagcattttatattgcctctaattaggattggatgaaatatctcctcaattccactttaaatgtaaggaaattaataatgctgtaattgagtaactcttcaatattttaagttgtcataacctttgagcttgctgagaataactgatctggtttttgtacattgagtatactgcttagggactgttaaatgcttattagtgttttcatctagactgaattatgcaattagagttctttttggggagaggggtgttgggagaggggagattttcattttaagattaaaaaagtaaacccatagaaatttcttgggagttcatgttggaatttgatttctattagcagcacaaggaactcccaagtggaggttcaggttgcattggcaacatatagatacgtcaataaggactgtgttctgatataggtaattaaatagtttgtcttatgcaaaagatgaggctagtaatgatttatgattaacctctagccatatttcatttcaacctaatttgttaaaggtaatgtttaatatatgattatacatgcaaatttgatgttttacactcttttctattcagcaatttatattaatatactttgcatttttgtcataatttaatgataatagttatatgcaataaatactaaattattccatctgctagaactctcataagtaatcccaaaccttttaatttttgttctctcacttttctctttcattaatttagagagaatagttgtgcttgaacaccaggtgttatacattaacccaagcatccttgttctccactgactgctattataggtttctttctcacccaaccctagtcttttagaagttagttagcttggatgaatcttttcatgccctcagaataagtaattttaattaatagtttaaggtagcacaaaataaattattggtaaactaggtcttaaaatctataataagccatggaaatagttgtcagaaatgattagaatctcagaaattgtctagacagcataatatccataggttatatttacattttcaatatccttactccatatcattagacggagataatgccagaagcatttctagacaacatgttttattttcttataaaactcctatgacgagcttataaaagaggagcaaaacttacccagtaaacagatctaaaaggtaactaaatctgggtcaatttttaattttattgccgagcatgattttttaaaaacttggctctgttcttgatttgtacagagaaatgctttcaaaaatatttcttctgttttgaaggattctactagtatttatttgcatgagtgtatttaagcaactatttattcatatgtgcaatgtgccaggtaggatgctacatgttggaagtgtaaagatgaatgcaacacctcccttaccctcagagagctcagtgtttactcagggagaaaagtacataaattatttccatagcactaggatagctgtgaataggctactgtgggaacttagccctgtgtaggggctcaggatggaagcagagaacaccacctaaatacactgtgaaacccagtgttacttctgaattatccgtctttattttttggcataaatgttctcaaaatttgaacagtttagttcatcaaagtcccatgccttccatatgcccaatactgttttaaggtctgagaagagagcagtgaacaacttaaagaaaatccctgccatcaaggagcttatgttctggcaagggtgatatactggaacataaggtggagttataaaagaaaaggaaaagacaaatatctgtgtcatggtgaagtttatttgacaactctctactgaatgccagatactttgttaggtacagcagacataaagatgtcaaaggtactatccctgccacaaggtttttattttgtatatcctgctgactaagaatggttttatatttttaaattgttacccaaaaaaagactgtttcagggcacatgaaagttatatgaatttcagtgtccacaaataaagttttgctgaatgtatccacgcccatttgtttatgtattgtctatagctcctttgtgctacagtagagttgagtagttgagacaaagattatatagtttgcaaaacctaaaatatttactgtctggcaatttacagaaaaagtttgccaacctctggactagtccaagagtctctaaaccttttatttcctaccccatcagaaaaaaaaaaaaaaaaaatatatatatatatatatatatgtttgagtaagtagccctaatatattttaaacattatatacatgcatgtatgtactaatattaatatgtacattacaaaatatacacagtaaaaatgagaaaaacatgaacaagattttaaaatgatttaaaattagtttatttcttaatcatacagaagtctttgctgtcatgattaataactttttagtgagaacagtgtcactatgtcatttttttatgtcttgcttaaaaataggcggtaattagaaagtttagctccaagttcattttattttgatatttggtttaatttctctcataattgaaacataaatctgacaaagatttgtaggtccaaatcgaacaaatgcaccattagcaacttactaaattgtagtattaacttttatcagaccaatccatgaatcaagcaaagatttcctgctgaaccatgactagtaaattcctgtcttacttgatgacagccagttattcttgcaactaatctggggtgttgcatttttatatttctaaataaatgggtttaaattggactttaataaatgggtcttcaacaagtgccattgggaagatgggctctttccattttttcttctacattattaatgtgtagaccctcatcctcatgtttgtgtactcatgcctgttccagacagtacatctaacaccaggaagaaagaggaagtaattcaagcaagggtgaaggggactgacttggaagttgagtctgttgggactgacttggaagctgggtctgtctgtgtggcttttccagtaaagtaggtttgaaaaggagttactttcttactaattgttaaaacgtcaaggaatttcttcactttttgtaaatgaaaaatgcctaactcatgctatatttcaagttttttttttttttttttttttttgagatggaaactcactctgtcacccaggctggagtgcagctgcgcgatctctgctcactgcaccctttgcctcctgggttcaagcgattctcttgcctcagcctcctacgcctggctaatgtttgtatttttagtagagatggggttttgccatgtcggccaggctggtctcgaactcctgacctcaggtgatccgcccgccttggcctcccaaagtgctgggattacaggcatgacactgtgcctggctaatttcgacagttttaaaatactttatcttgaaataaccagaaatatctctggttttcatgttaacttcctatttcatttcaaaatattgtaaatattttattgtatttgaaatatcttgcttttatttaaagaagaacaatcttcttgactctgtagtattctgtatacttcagtttcaacttcttgcaatggccttgaattttacgtgtaggtttacctgactcaggaatccttccctcatagtttttccacaaaacctctttttattaaataaatcatttattttggttatgtgttttctctgttaaattgttctaacggtgacacaaagaaaagtagtttatatatgtcattatggaaacaatctagcaaatactataaggtgaggtgtttttaaaaaggttatatttttatccaactgtatagtaaacctcctacactaattgcttaaatacttgctttagcaaattttcagtaatgatctatacgtgtcttctgatacgtcagtatttgctgacaaagaaatgtacttcagcttcctgccatgttgttttgcatggattgtttcagctgcttttaccaagtgtttctctaatgccatggtaccttttgtcagttgttattaaagaaaattcatgagaagcttctaaacacatatcattaagtttacaaagtatcactaaggtactggatttgagtataacattctaattattgcggagaaaaatgacgaatgactgagaattgaagaatgaatgaatgagaatacaaatgaatgaataggcagctggttcaacttttgaccttctcatttgatcctattcttatggcttctcagtaatagctttaagaatataatgtttgctgaagtgaaggaatttgtctataataggaaattgtatcatggcatatgagaagcataaaaaaatggtttagtatttacaaatgtggctttaaaaacattataggctgggcgcggtggctcaagtctgtaattccagcactttgggaggccgaggcaggcggatcacgaggtcaggagatcgagaccatcctggctaacacggtgaaacccagtctctactaaaaatacaaaaaattagccgagcgtggtggtgggcgcctgtagtctcagctactcgggaggctgaggcaggagaatggcgtgaacccgggaggcggagcttgcagtgagcctagatctcgacactgcactccagcctgggtggaagagcgagactctgtctcaaaaaaaataataataataataaagaaaaaataataaaaataacattataaatggtcaactagacttcagtgttttgtttttttttttttttttttgagacgaagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacagggtttcaccgttttagccgggatggtctcgatctcctgacctcgtgatccgcccgcctcggcctcccaaagtgctggtattacaggcgtgagccaccgcgcccggccgacttcagtgttttttaaaatcacaaaatactacattttttctcatgtattatagatatatcaaatgttaaacatgctaaaagcttgcttttgttttgaataccataagaaatcagtatgtttagaaatagtttcatattcaattacgctgtttagagttaatattgaattatgaatattgctctatttagctttattattgtattatggatctggagttaatgatttggaagtgttagctgcctaattagtagaatgtatcttatttctatagaataaaatgagtcattatggtcttttcacatgaatgatactcatttccaatcaacctatgcagcaaatttataagtataaaaaactgttgctgattctaaagcaagttaatatatttaaagaaaaggtcttaaatatcacattggttcaacaaatatttattaaatgtttactgcattccaggaattatgctctttgctaggagtacaaagataagtaagttcctattttcagcttcgagtttagaagagatagatttatcacataatttcaatgtaagtgacacataaggaattaatatggaagactaggataagggtaattattttcaaatcaggtgctttaggagaagtcttcctgaaaaattagtggttgagcacagtcttgaagtataatagccagatgtgaatttggagggggcaaggatgggcattaacagatggagaggatggtaaagatgaccacatttcaggcagggagaacagcgcatcatgagcaaaataatgagtgtgtaacaacacagtttatgtagcaaaactacaaacaacctaacattattaaaacataaggggtaagatgaaaagcggttaaaaggctgaggttgggaggtgataacgctaatagctagcattctttgaaagctagttaatatacaccaggcttgtcatgcatgatcacacccagtcttgacaacattcctctgaggtgtataatcttacattgctcttattgtcctgcctgcctccctacaaaataattctgtgatggcgtgatatcagcagtgtgtgccattaaaaactgaatgggtacacggtaatgtagaaatgtcactggaagcagagaaactctctacctagagactgccaaaggtgacgccaccacactcttaggccaggctgtgaagtatacaaatacagacacttaatcttgtcactgttccagagttgattctacttggaggttgcggattgatgataaccacatttacaggagactgaaatttaaccagaatttttttaggcaatagagacatagcccagcatatgtgagcagaacatagggattttgatgaaaacaaaaacaatatgagtcagcagaatgatgtacttggccagtaagataataaaatcaagagggtgaattaacagaggtgtaagtatttcaaggtgagggaggtggacattctttcctaccttgcatttgttaaaccacagagtatttgagagagagagagatgtggacaccaacccatgttacatgaagataagttgagtactttagcctgaaagaaggaatgtggtcttcaaataacatttatgtggctcttgaattaatttccttctgtccaatctgagttttcttcttagttcgactcttatctctagtcacttaaattacttcagcccaaattattgaacataagaaaaatccactctggcaggtttaaatagaatataattttagaggatattacgtagtcttgaattaacagagttgcagaaacaggctctagataacattataggactaacttccagaaccacacaactgaaatacagttccaattaaggagctcttatcccagaactatttgatcaaaatgtcttaatgaaaaagacacagttaatgccatcagttctgtaacaacatcacctctgttgccacctacatcagcaaaatgaatggcctattcgtggcctgcttcctcacatagttcacttctaaatctacacctcctatgcatgcattttattggtggagactaagccacatgcctgcactctagttaaaagggagactgacaaatgtagtttttatggattctacctttgtcaggtgggactgacaatgtgaggatgtattaaattgtagagggtatgttcaagtgatgttgagcagcaaaaaatgacacatgaccgctagagtttcctgaccggtctccttccttccagtcagatttttttcatcctttgagacccacaacctggtgaagacttctctgacctttccatctgccctgtgtttccaaagaatctgatacatgcctcagttagaattatttgttactactggaccataaattatttattcaacaaacatatatagcatttactaagtatcaggcattgttctaagtgctttataaataatatgtaatttgagtataaaaacagtctaccagattagacagcctagcatagtttctggtgtgtagtatgtgttcagtaaataagtgattcagaattttaaaagagaagaaaaaaggtcatgccacccaccttaacacacattattttgttgtacatatttcatgtccaatcattgaaggaaaaatttggcaaaaattaaactaccctaagatgagtggggctgtctgaggacgtagggagtacactgtcagttgaaatagatacatatgctgggtgtggtggctcacgcttgtaatcccagcactttgggaggccgaggcgggtggatcacttgaggccaggagtttgagaccaccccagccaacctggcaaagctctgtctctaaaaatacaaaaaaattagctgggtgtggtggtgcgtgcctgtaatcccagctacttgggaggctgaggcaggagaatcgcttgaacttgggaagcggaggttgcagtgagccaagatcaggccactgcactccagcctgggcaacagagcaagtctccacctcaaaaaaaaaaaaaaaaaaaaaaaaaaaaaggaaatagatacagaacatagatgagcatctgtggaccacattatgagtgctatccaacctagtttctgtgattctactgtgattcaacaatgccagagcctatgagagagagatgaaaaagatgtcttctgccttctagtaagtcattaacaagtaaaatatccaaatgagaaataacattagatagaaaagtggggatagggacagtgatccagataattaggaagaaaggtcatgtatatatacacaaaatttataggtattgactatgaatgaatcatcataggagttgctgcagtggttgcaaatatagatttttgctgtcaacaaagttattattcaatagatagatgcaatttgtctacttttgaggattgtcttccacattctcacatatgcatctttaaaataactttgatgccaggcgtggtggctcacgcctgtaatcccagcactttgggaggtcgaggtgggtggatcatgagatcaggagatcgagatcatcctggctaatgcagtgaaaccctgtctctactaaaaatacaaaaaattagccgggcatggtggcgggcgcctgtagtcccagctactcgggaggctgagggaggagaatcacttgaacttgggaggtggagcttgcagtgagccgagatcgcgccactgcactccagcctgggcgacagagggaaactccatctcaaaaagtaaaataaaataaaataacattgatactgttcttcgccaattagtttatttactttatcaaaaaaaaaaatagaatgctcagaatttctgtaagagtaaagggataaaaatactgatttgttttcttaaaaaatttagatatgattcacataccataaaattcacccttttacaatgtgctcttttttttgctttttctttctttcttccttttttttttttggagacagggtcttgctcagatttccaggctggagtgcagtgacaggaacacagctcactgcaacctctacctcctggtctcaagcgaccctcctgcctcagtctcccaagtagctgggactgctggtgcacaccaccatgtccaggtaattttttaaaagtttttatagaagcgaggtcttgctatgttgcccaggctggtctcaaactcctgggcccaagtgatcctccttcttgggcctcccaaagtgctaggactttggcgtgagccactgtgcgtggccaaattcataattttttttttgtatattcaaagagtgtgaaactagcacaacaactttgagaacagttgtatcaccccataaagaaacaccatacccataatcagtcagaatccaaactccctcctcttctcccctggccctggcaacctctaatttattttttgtccctataaatttgcctatttgggacatttaatatgaatagaatcatagaatatatggtcttttataatgcttctttcacttagcataatgtgatttcaagattcatccaggttatagcatgtatcagtacttcattcctttttagagctgaataatatttcattgtatgatatgccacattttgtttatccattcgtcaattgatggatgtttggattgtttctactccttggctattatcaataatgctgctatgaacattcgtgtgcaagtttttgtatggacatatgttttcattttgcttaggtatgtaagctgggtcatatggtagataaatctgtttaacttttggaggaactgccagactgttttccaaagtggttgtatcatttctctttcccaccagcaatgtgtgagggttccaattttttcaattcgttgccaacatttattattttcctctttttttctagttatcctagtagaagtgaagtagtatctcactgtggttttgatttgcatttccccacagattaatgatgttgaatatcttttcctgtgcttattggccatttatatatcttttttttttttttttttttttttgagatggagtcttgctctgtcacccaggctggagtgcagtggtgtgatctcagctcactgcaagctctgcctcctgggtttgcgccattctcctgcctcagcttcctgagaagctgggactacaggcacccgccaccacgcctggctaattttttgtatttttagtagagatggggtttcaccgtgttagccaggatggtctcgatctcctgacctcgtgatccacccgccttggcctcccaaagtgctgggattacaggtgtgagccaccgtgcctggcctgtatatcttctttagaaaaatgcctattcaagtgttttgctcatttgttactggactcttgtctttttattattgagttgtaaaagttctttgtatatctgggtacacatctatatcagacatatgatttgtaaccattttcacctattctgtagattgacttttcatttggtgttgcattttgaggcacagccatttccaacttggttttgtgaccctgtcaagggtgtcttcatatgtcacaaggattaccatgaatttcaaaatgaagaaaaacaatttgtctaatcaaagtgttataagtgtatatatcacaaaataaaggtagatttccaactgaattaaagtttattgaacctcaaaacaatgtgttcttgtaactgaatacttttccttctaatgagtgacatttattaccgcaataccgctgtttctgcttttttttcttttccaaatccaacaacttcttgtgaactttcttcagtgacatattatagatatatagaccctgacaatttgcaaattgtatttgctttcccaggtaataatgatcctaagggagcatatgccaaacagcattttgtgtgtgtatttgctatcaagataaataaagagctttgttagcatagataccatgtatatctatgttataaactgccaatttattctgtggaatagttttaaaaatatttttttctttctgctcagtagttggctaggtagagatgtgaaccgtgaatacatggtagaatttacacaaaactgtggtatctagagtgaaaaataatagcgaagtatcccaaaaaaggatttttgacattagtcaccacatgaattagtattttaagacatagaaattattaatgtttactaatcacttttgaagctcttaagtggaaatttatcaatgcccacagtaaatgttatctcttacaggaggacatgaaccttaacgaagagaaaaaagctcctttacgaaacaaagactttaccaccaaacgtgagatggttgtccagtatatttctgccactgccaaatctgtaagtagggagatttttctagctccaacagaatgagcaatgagcttagcatcattttgcttaaaaataaacaaacctcagctcttcagattacctcattgtactcatatagactgttcagaagacaatttatatatgttatacatttagtattaagtatatatttttaaactattcatcattagaaatgggacgtttccattattacaagcaagacaaaggatacaaagctctgaggtaatccagtccagtcctgagcttttgtgtacatactaaaaatcgactgcattttgcagatattccaccaaaatgtggtttgttagatgaaaatttcggattttgaagaaggtacaacttagtatagtcacagcttaagtttacattaaagctacatgtctggtgtctacttgcatgaaacttttagccatattttttaattcgcagttagcttttttcataattttatatgatgcaaactaagctgcctcataattgctattgtatagcttcatttaatgtaaaggatgtcacctaataggagctttaatcaaatctgtttgtgagtcccaagacttgaaagtaaagttcattgaaaggacttgttgttattaggaaactgtgtgttttagtggagtattttgctctgttctcttcctaatgcacttccaaatatagtcttaagctttgatttttttttttttggtaagaaaaaattgtatttttgaaatagcaaaatgcatcttttacatttctgtaaagaaaaagcttttaatacctagagttcataaaatcactgtatgtgtgtatatgtgtgtatatatatgtatacacacacagtgatattttgtgtgtatacatatgcatgtacacacacatacactatttaggtcatgtgttttaaatttcataagttgaccattgcagaaaacaagtcttcattgaaaaaatatattctaaagttatttggctatcctattaatgctatttcagtacagcaattccagtggcaattactaatgcattttgccatgaattctacgattgtattgattctatattgtacttgaaacaagctaaatctgaatgctgagctatttaaacataacacattgcagctccgccatagcagagcaacagcatgtttttaaatttgcttctggtatccaagggcagaaatatgtttcaagtgataagtgaaatttgccatgagcgtcgttttcaatagaattaggtgatgcatagggttttactttgaaattctgatgaatctcttctcatttttgcactcaagttattgttcaccataaaatgctttaggaaatgcaggatgtacattcaatgttatttttcaaagacctaaaggctgatacactagtaaatctatatgactgaatctgagtgcaaagtacagataataacatatgaataatcatgtggtggttttaatgataagattttgttagagtctctggctcatttgttgttgtttgtgtaagtgggactgaatataatgattatatgaaactcttattccttgaccttttgagtattacatgatttctgtgcagaacttgttttcatttattctcatattatttcctcttcaagtgaccaaagaaatgcacacttcaagttatatactgatttttcagattaaaatgcaaaaaattggataaatattagatgagctcacttgaactgcattattcaaaagatggaaattcaatgttcctcaaaagacatgaaaattctatgtttaaggcattagcctcaaaatcagaactacttaagggcccttatttgtttcattcagtgtacatatgagcacctgaaatatgcacagcactctgataagatttccaggattatacatatttttgctaatatttttcgtgggccagatactatgatggaagaaagcctgttgacaagcatttttgaagctttctcatcttggaaagacgttaattagtactatgttttctatcattaaaaccacaaaaattagttatgtaatttccttttgaaggtgagagggttggccttcagtgacaaacaataatctaacctttttaccttttcattatcacagcactaaagtttgcatttagagtagacatgatagttaccactactttatgaaaatgctttctagttagtcacagctttcatcttgaggtagcaaagttaagagctagagtccctggtggagaaatgttttatagtcacatgtaaaacatgtgagaattgtagtgaaatttaaacgtaaatcatacattttccccgtttaacacctgcattaatcattttgtatgggatctaaaaccagattttagatagaaatgtctatcatgctcctgggttcttgagtaaggacataaaagtaaaatgaagctatacaccaatatgtggtcaaaactcgtttctaaagcaaacaagagtcttttgtcgtataattaactttgctaaaattagcatggaaaaggagactataaaggaaaccataagataataataaaaactattgcttagttttttcttctcgaagtcccataatagagaatgttaaattgtgtgaatgttaaaggaaaaagtttgaataactctgtccatgatgaatgaactttaaatagagggatggagaagaaccttctttctgcattttatcctccattgttcattgtaggaagcgtagttatggatctgacgtagggtaataggaatatgtagataatttgaccacaaataacctggaagagtctatattttcaaaacaccagcatatgttttcagaaaatggaaaaccaagctttgttaatattgcaaaagttgtcctaccgattggtaatcctgaaacaatatgttggtaatttagaggggatctcacgggcacttaacagcacatatagacatttatgaggaaaagttattcaccgaagtcccaacgttagtttgtcaaatgccagtgtcattcctagaatgttaagggattggtttattttgaatttaaatcataatctttgaaattttaaaatatgtaaagttatattttttaagacatgtgaaccattgagaggcagcattggtttttttttttttaatctcagtaggaaataatttaaaatagtggtgctagctacatctgcagatttgttagactgacctgtataatgagtagttaaaagttgcagtatatctatatgtgtatgtgtatacatgtattatggttttgcttttgtcattatcagatactctttcagctcttttccaggtatgatctggatatgatcaaacagttgaacccagacatggccaaaatattttctcttagcttctgttgggtactaaatcttatctattgccgtttgtgctttagctaaatgcagttattttgcaatgcaaatgaatcattaaatgggccatattctggttgtttcactgagtatagacctgctttaattgttaacgcaggctcacattcttttgttagtctcatgtctgtgctaaataaacaagggacaaatacgacctctgtcttttcggtgggaggaaataattgaggtcaatagcatatcttttaattcagaagactgttaatggcaccaaagaggcttttattcaactaaataatcactgcttgtaaatagtctactgaatgaatatttaagaaagctgcttctgtattctgagattcatggattcttctgaaataatttacttggaaactgtcattatctttttgtattttatgatatccttttcaacataggattcttactggggtttcagttaaatttgatttttatttttaaagcactagctgaaaaatagaacacattttgataataactgctatcggattaatggttttgtattgtggcttagctgttttttggacactgcttgatattcaagtgtgggaatctgataacagtgatttgatttatatttggatttttggataaaattatgtttaggactatgagtttacttcctgctttcttaaacacaattctgcctctcagaaattcttttatcacttatccattaggaaagctcagttggagctgcaatttttgaactatttcctccttctgaacatgtgcatgtttagatgtaaaatgcttctttgtcttcacattatgtagaaaattctgatcttataatagaaatgctaggattacctagaaaactagaataataagtaatctatcttttttataattttcaagtataatataaaacagtatcgtacaccttaaatttataacaataaaaaatatttgttttcaacctaaagtttacttctgaacttaatgcatgactttaaatgtaacatttatatactaaaataccttaatagtatacctgccataagaaggtgtactatttcaaccttgatagtatacctgccataagaaggaaagaaaagaaaaggcaatattggaaaaaacaaaatttctattgataattttttcagggactatgagctggtaaaaaaatctgatgcctgattacacttaacattgcataacttgatatttagattatactatatgagaagcccattatagtacattaaaaaaatcctcaaatagtaattatcacttatttgagaatccttattctgtagactttacacatttttgaaacatagtagaaattaatattgatgtatctattttagcctgtatatctaaagtatcaaaaatataaatagggttagctatttactaatttactaaacacttaacctctgtgaaaagcttctgactactaatattgttgctgtttgttttttttttacaccataaccactcttcgttgaccactgcatgcagatagttggaagtaaagttacggtgagtacaaaagatgtgttttacccttagatatgaatttgtggttttgtaaattgtgatttttgcttgtagtattttatatgtttggttcttttggtatatattttaccaaagcaatgagatgaatattatgatcaggtgattagaatttagcctggacaagtattttttctgtggtttttgggagatgttttagaactagaatatgcttgtatattttatcttagaagttttcacctttttttttgtttttggaattatgcctgtgtcagtctttatgattctgatgaaattgtatgttttacctcaatttatcaggaggagaatcctaaaatgttggtttatgctaacaggaattcttattaaaatatgtcactttgatttcagtatgattgagcacatagagtaatgaaaacaaccctttccatgcagtcgggaggcctgggtgcttgtctttgttgtatgctactaatcagcttttgctactttgggcaagtcatgtaatttctctggggctcaattattaaatggataaattgaaatgattagctgaaattatcttttaaggttctttccatggctgtcatttaaaggttttatattcaaggcactatatttcagtgctataattacatgatacactattatataacacgcccaaagtggcccgtactgtgattgagagctgtttgtaattaccttatcttcatgactaagcactccctagagaacagggtggtaggaaacattatctttaacatcaccgagtactgaggtatctagaatagtggatttatttgttcattttgcttttaaaaattgattccttcttttcattatcttactcttcttttttttttttttaaattcacgagacatctagggggaaaagccatcatcctttcaggataattttaaaaatcgaatatttatttagtgcttattatatgccaagaattattctaggtgcactgatgactggaaaataagaatgagataggacctagttgatatgtgttgaaataatcaaaccttaaattatgcatgctgactataaatgtaataggaattcataagtaggagagagaagtaaggttggagtaattagagaaaaatctgtgtaaatttctgcacttaaattgggctttcagggaataattagttatgatggctggtgtttggctagggaggagagactgtggagaagctctcagattctggaagtaatattaaatgcaaaggcctgaagagaaccaaaccatgtgtgtggaggcagagaagaaggaagtgagagatgaggttgactttgttgaaacaaagaatgtatattggaaagagtaaaaaatcaagttgaaggatggtcttgaagtccaggcggcaaattataaattagtttgagcaaggaggtaacatgatggaagcagtgtttaagaaaaataaattcgataggtggataggctggattaggctaatggttctcaaactggaaagtacatgaaaatgcaaattttgtcctgctccaggaagattgtgattcaggtggcctgggatatggccaagaaatttgcatttttatctagcacctccagagattctgctaaggtagtctgagaagtatacttcacactttaagaagtactggattctgatagacttattcgggaagctacctaggagatttttgagtgattcagtgaggacttgtattaaagtcctcactttgaggctaggtggggttaaataacgagtttggggagataagagatttttagcttattttaataagggctggaagcagcctgtatttctagtcttggtaccaactctctcccctaattacccacactgttacttccttagttcagactgtcatcatttaacacccctgtgattgctgtagcctaccaagcagtctccttgtcttcagtctctcacccacccatgcatattctacactgttaccagttatcttgctccagcagtaccctcttatctgtggtttcattttctgtttcagttacctgaggtgcagcacaataatacattttgagagagagagaccatattcacatgttttttttttttttttttttttgagaaagggtctcactctgttgcccaggctggagtgcagtggcatgatcttggctcactgcatccttgatctcccgggctcaagccatcctcccaccttagcctccagaatagctgggactacaggtgtgcaccaccatgcccagctaatttttgtatttttttgtagagatggggttttgccatgttgcccaggctggtctcaaagtcctgagctcaagcgatccgcctgccctggcctcttaaagtgctgagattacaggcgtgagccaccacgtccggtccacataattctattatagtatattgttataatttttctattttattagctattgttaatttcttactgtgcctaatttataaattaagtgttataggtttatatgcataggaaaaagcatactatatttagagtttcaaaactatccacagttttaggcatccactgggtgtcttggggcgtacctcctgtggataaagagagactactatatttccctcctcaaaacattcaaatggctccctgttgtcctttgtgatctcatccctgcctgcttctctagtttcatctccagcttcgttcttactggtacctgtcttctatctgcataggaacacttggcaattccttcatgccttattctttaatacctttaaatcaagcatgttctatttttttgagctggaatgccgttttcttctttagtgtgtccgccaagctcctaaatatccatcaagattaagcttcctgtcagtcttagaagaagctgtcctaggtaactccttccttcccatagcaccatgtttatagctctattgttatatttaacatattttattataataagtcatttatatgttctttttccacaatgtacacagcttctgtgttcaagaaactaggtctaacggggaagacagacaggtaaacagaataaagataggacctgaagatgcaatatggtaaaatggcaggccagcaggctatatgtagtgtatatatatatatatacacatatatatatatttcccagagtgttttgaaaaacagtataatgaggtacgtgttttgatccacaatgtaaactatttcatacccattgtcttatctgtgacctcctcacatttgagtttgcaaatcctgctataaagggaagaaactataggaattagcttctagaggaaatgattaggggtttgttctagagtttaggtgggatggttgtcttaaggaagaaatttttttgtttgtttttttttctgcaactaaagggaataagaaaacaatatgtaagatcactggtgaaaaccaggtacaaaagggcttttgcatcatggtctcaatcttcaacagatggagaggtttattcattgataaaaagggcaggtaggaaatttatagaggtgtttcaaaaagaaattctagaataatcactttaagtattgcatttgcccagagattacgtacattggtccaaaaatgagtgatacgaaagctagactgaaatccaacagatggaatatgtaatgaactaggaggtcggcatgggcctgttttgcgtttgtctaaccaatgttgattagaagcagaaatggaggcatttgaggccctcctgatcttgagctaccatcagtctttacttttcactatcctatataaattgtactttaaaagtcaagccaggaaactgcctgttacctgaacaaaaccacccccttagcctcaggcagtattgcttctgactttgctcaagggatcttttttgtatagaatgttttctttcctttgtcaacattctagccatcctccacagctcttccatgaagcctgtcttgatcttgatccgctctcccatttccacctacagtaatatatctgaactcctatagcactttatttttaactcttagggagtcactcttaactttatcttatagttcctatttctttatatattccttaagggctttcagaatactcctattttactttatgcctgtagtaatttatatccttaaataatactgtctcacatactatgagtctttgtatatccacgatacagactctatgaaggaaggcaaattttagtagcaatcatgggtttagaggcaaatggacctggtttcagattctgtctctgctatccaaggtcacatactagctgtgtgaccttggataatttacttctctgaatctcagtcttttcattgataaaatgaagagaataatactaaatttgtgatatttttgaagtatattgtttatgtttaatatatttaacatgtaaagaatcttgcaaatagtaggtctgaattacatttttgttaaatgtcttgaattctacaaaatgcttgatatgaaagacataaaacataaagactacatggtaaaatgagataagactgagctgccttttttgttgttgttcagtgttcaagatgtttgctatttgaagatttaaagggaaaaatgggatttattctgggtcaagaatggtgggaaggattcagctggatgctggaaggagaatgttttgcctgtttattggaagctatttgttatgtggtgtggattattgctgggctttgaggaaaaaagtaaaatcatatatgatctcaagttaatattgacaagattattttaaagatttaataaaatagttgaggatttggtatagatactgtctgtgatgggaaatgataaaatatctttctggtagatctctagaaatagcaaacagaatttggagtagggaagagataaaactgaattacttttttcaatggcttctcgttctaaataactgttgcagaattttgtgaagcaaaataaattgtttttattatttagtaacaatgcatgaaacagatttagaaaacagctaaaatgattgattttatttcactacaagccaggaataatttatccacaggtagaaaaataagcattcttctgtgacaaaaagtaagaattgatatgattacatatgatagttggaaaatagcaaacattgtaatgaccagaccttataattttaaataagaggtaatttaataagttggcagcagcaacggctttttgggaaagcatttgtctcgtcatcagaagagtctgagtttgaatcctgattcactactcattcattccctgtgagcttgtaaacctctctagactcagtttcattcctttcttgaacacaaagttactgggtacttattagtgccaggcattattccaggtgctggaatgatgaaccatacagataatgtcttcatggaacttacattcaagatggggaaacagacaatatgacacatataaaatataatgacaggtaagcgctattagagaaagcagagagtgatcagggtgtggtattttagataggcgagctctttgggcaaatgacatttgaaaggagacctgaatgaaaatgggaagagccatgcaaatatctagggaagagagaacatcaagtgcgaaggccttgaggcaggagtgtgcttggagtatctgaaggaatagcagaggtcactgtgcatggagtggggtgaacaagggaaagtatgggggtgtttaatcccaagagttagggtgactaaaaacatatgttaagcatagttagtgggttgttaatttggaaaggtaagttcaggtcattttaggagagatattttgaagaattgtcactttaatagccagccaggagccctggaagggtttgagccgtggaacgacaaaatccaaggtgtatttggggaagagaaaggtagcagtggaaattggagaggttagacataagggcaaggagatcaagttgggggttgttgctgtagtttaagtaataagggtgctgaactggagtgtggttagtaggaactaaatggaggatatagatgagagacagagactgtggaagtaaaatatcccagcctcagcaaatgattttaaaagggcagaagagatgtatgaatcaataatgactgaaatttcaagcatgggtgaccaaaatgacttgagcattcatagagtagtcagggacgagaccgagtttggagtaaaagaagattgagttcagttagatatgttaatcagggagaaattactagaatcacaatagcaggagtaaaggtatcaccatgcaagaacatttatttagctcttacagcattagcagtataattttataatttggttctctgtttcaaactactgcttttaccattttaaatgtactctctgtatattgctgctgagactatgttgctgatcattctaataacatttacctgcttaaaagctgaagcctgaatatctttactaggtattgaaggccaagtatacttgtagatgattcagtggaccaagacagagaagagtgaatcattttggtggcttgtagtatcatttaccagataaacaatctgacataaaattaagaggtcatatttgtaccttttgcaatgttcctaataatctcagtcaaaaaaacaagcccataatagtgaaggtcagatacaaatgcatgcttctttgccctaatggagcatgggaatcatgagcactaactgaatgactgttgcaagagttttctcaaaatagagccaaatgaactcccacccgccagccggccctcttccaggctgacaatgaaggtaatactgagagtaagtttctgttaaaagtataaacatggctgggcgccgtggctcacgcttgtaaccccagcactttgggaggctgaggtgggtggatcacttgaggtcaggagttcaagaccagcctggccaacatggtaaaacaccatttctactaaaactacaaaaattagctgggcctggtggcaggcccctgtaatcccagctactagggaggctgaggcaggagaattgcttgaacccgggaggcagaggttgcagtgagccgagatggtgccactgcaccccagcctgggtgacagagcgagactgtgtctcaaaaaaaaaaaaaaaggataaacatatgatcaggcttaaaataataaatttagtgttatctatgtattacttactataagctgcctgatagtaatatacctaaaataccaccaagtgtggcagcatgctttgtaggctgttaagctgctactacattaataaattgaagttttattagtttatttatagaatagtatttgataattacctcacgtaatattacacttgtgtcaggccaattatttgaatatgttctgtgaaaaaagattaaatcttatttttccttttttctcctttttataattgtgtagtccagaagggggagacaaaacattgattattggaggttgaagtagctgcttcgtgatgataaaacattgtgttcttgtattccaatttgatttttttaaatgggtttagaaattgtaggatagttgctactgtaaaatatttagttttatggtggtgataattttgttaaaaatctaaattcagtcagaataaaaataatgccattattttaaactagcatatataaaatagaaaaactcatttggtgatcagatgaaaataagacctgaaactatttaatgatggtatattataagtgatcttttaaaaatagcacaaacactattaaagtaccaatttcagtcttttctaatttcacattcattatatgcaacgagtagctactttcccatttcctaatgttttaacactgcaagctaacttgtacattatacttattttggataggggtatctgtatatgttttgaaaggttttgttatttgaatttcccttcatttttggaacactatcgtatcagttccttcccttcccgtgcattgtcataaattgcattatttcatcatgccagattaaattcattgttcaatgaatgctgaaatatagattatgaaatattaacaagtcatcttaccttgggcatttggaaatgtctaaaagacagcatgaatgttagtattatgtttagacatgtattttgaaaattgattatattaatatttatgaataggggtcattatgttttataatctatcctgatattagaaatgaaaagatgtatatttcatgtatgattttgcatcacaaattcattagctgtgcattttgattgtgatcatgttggatatttctattgaggatatttttctgtgtgtataatcaggtaaaagaatcaatttaaaatctgatgcttgatataagacatttaagactagtatagccattattttttgtactggattggtttattttactaacaatggaaaaaattttgatcatctatgtagaatgaggtaattatatgatgtctttttttgtgtgtttttgttgttaagtaatatagtctctacaatatatatcctttaaaagctctgtataaaatttgctgttgccattataaaacttaaagtggcataacagagggattttttttatgaggcaatgcttcctctatccagatagccttgtcggcaggggaaaaagaggaaacaatcagattacaatcaatgtttagaagttaccttaggctagatgtagttggctcatgcctgtaatcccagcactttaggagggtgagatgggaggatcacttgagcccaggagttcaagatcagcctgggcaacatggcaagaccctgtctctacaaaaaaataaaacaattagctgggtgtggtggcacactcctgtagtccaatctcctagggaggttgaggtaggagaatctcttgagcctggaagtcaaggctgcagtgagccgagatggcgccactgccctcaagcctgggtgacacagttgagaccctgtctcaaaaaaaaaaagttagcttagctactgtatataaaattttgggcccttttctcatatatttgattccatttttcattttagttaatcaagtttcttctgtctgtttatctgttcggaaaggactgtttggttgaacaaacattagttcctttgaataagtagaataagataatcttaaaaagaaaaaggccgccttagatttatgaagtgtttcagagtgtttaaagcccttcatgtatttcctcacttaagctacgtgttatatgtatttctgtaggttcgtgcatcagtttttcagaagacattgcctccatctccaaattcttggaggctagttagagtctggccttatcccatggagatttttttggctgaaagctatatggacagtcttttgagtagtttgtactgaccaaggtatttcctgtcagtggtccactgatattcataacatttaaaaatgatacatgatattcataacttgtattaatatctagtttatatgcttgtatgaaatgctttctgggtctgcattgctaaataatggtgatgtgaccagtgacatttagagtaattttttgtactgtggtcaccataattcggataccatgattattacattaattgcatgtgcttttatagttgcagccataattacctattaaaacaatatagaaaaaaatgaactttaacagcatcaaagatattaaaagcatttgggttcattttttatgctgatctgtttgtaaatttttagtaacctgtcatggttcttttctttaatgaatttgtgatctaaggagaaaataactgcttgtgcaatgtaactcttgtgcttggagaacataactgctttgtatatttctggtaaatcatttatttttattgatgattatgatgcttttttggcagagtgcttatccactcaaagagctgttctacgaagtgtgattggtgtctgtatccaagatataacatgtattctatgtgtttatatatgtctctctatatctatttatccatctttctgtctatcctcccaaagttaaatgagcttaaataggttgcctctgtgttagaaagcagagaagtattactagagaactgaggctcttccccaaaattatttcagattttcttattgtgtggagtggttttgcttggaatgagaaaagctatgtgttaccggctgaattgtttccccccccctcccgccctccccaaatttgtatgttgaaaccctaacatatcagaatgtgactgtgtttagagatagggcttttaaagtgttaagttaaaaaaaaaaagatgcctttagtgtgagccctaatccagtctgactggtgtcctggtaagaggacatttggacacacagagaggtgccagggttgtgtgcagacacagaggaaaggccatttgaagacagagagaaaagatgaccatctgtaagccaaggagggaggcctcagaagaaaccaaacttactgacactttggtcttggacttttaatgtcaagaatggggagaggggccgggtgatgtggctcatgcctgtaatcaccaacactttgggaggccgaggcaggcggatcacttgaggtcaggagtttgagaccagcctgggcagcgtggcaaaaccccatctctactaataatatcaaaattagctgggtgtggtggcacatgcctatagttccagctactcagcaggctggggcacgagaatcactggaaccaaggcagaggttgcagtgagctgagatcgcgcctctgcactccaacctgggcaacagagtaagactctgtctcaaaaaacaaacaaacaaaacacaaaacaaaacaaaaaaataaagggacaacaaatttacaaaaataaacaaaacaacaaatttctgttgtttgtgttccagtctgtggtattttattatggcagccctagcaaactaatacagtatgtaacagtcattttgttgtatttaacactgaataatagtgaacttttagagaacactaagtgccaagaaccgtgctaggcaagcttcatgtaaaacctaatttaatcctcataagaattatcacccccattttatagattaggaaagtgtggcttagaaaagtaggtacattgtttggggttacatagtaagtaagtgggagagctgggatttgaatccagtcaggctgacttcagagcttggcctcttaaccaataactaagtaagatttggtggatttcaggcagttgtggataataattgacaccacaggtgttcatcctctctaacactgttaatatttagtctttcaccatgtgctagtaggcaattcttattttctgccaactggagaatacctacagtcatacctacaacacagagagaaccttgcccatggaaaagctgctacattacagagaattaaagacctctgtgcacgtgttgctcaatgggccaaaaatgactctgccgatatggtctttgtggctttcatagcagatgttcacgaacaggtaacatcaatgcagataaaccatatactcagcaatttaaatgtgaggaaaaagatacataaatattagaaagaatcccatttttagcaatggcctataattctaagccatttttcctgtgtctgaaatagattaaccattgtgcctcttcgagttttttttctatctgtgtgttcacctttcttatgcacgcttgccttttataattaatttcaattaaacattagttttgtttaaataatactgtgtaattaaaatgcttatgtgctctcagagggcaaggaccatgtcttaatacactttagacatttttaaatacactaggctataacagcaataaaataattaaacatcgttttgttcaatctctacatattcacaattcctctgacactgaactgtgtataaactaaaatcagaaagctgctagttattttataatgcttctcaaaacagaagtcctcttccattggaaatgcagtctagcatcttaaaatctttttttttctttcaagaataaaactaaatttcttctattgtaatttaggtcccttgcctcttggtaagttttctatttctgctgaggaccgttgttcatcatcacccatgcaatctctcttagagtactcataggtttaagtggtccctcagctgctgcttctcccacttcctttaatttttccatataatactgccttctttttaattgcttttagagtgtctacagtttggggcctcagaagtggaaatgctacttgataatacacccaatctaaatgttcattcttattttactcaacgtgtgcttgtgtgtgtgtgtgtgtgtgtgtgtgtgtgtgtgtgtgtatacttcctcagttttggtggtgcctcttctattgatggtgattgttatttttttgttatacagatgtgactaaaattgagagttttttctccccgttctcttcgcattatctaggaaactccaaagatagctcttcatcataccaactagaaacatcttgagtgttcacctggagtttttctccagttgttttcgcttatagcttggtgtgcgaagttaatcatacccgtaggaaaaccaccacatgaaatggatgcttagagcgtacgttaaaacacagtgaaaatcataatatttgggctttgaagacctgggggtttaggtcatggctctctctcttaatggctaagtgattgggggtaaaacacactcaacctttctggagcctaagtctctttatctgtacttactctgtcatcctaatagagttactgaatactttgtaaactgtaaaacacagtacacatttaaatcattatagtaatcagttaaggaagtgattctcatggtaattcctaatatatatatttttgaagaatgtgttgatcacaactactgccaccttttagtgacacatacatcaatgcatttgttcctttattactcagtgttagtttagaagccagttatagttataaactttgtaaaagctgacgtcttctaaggtagcccctaggctacagactacatgtaaagttaccctttttatgaaaagccacaagcaactgtgaagattatccctaatcttccatctaaatatgaaaatatttgcattttaagctgcataaccatggtatccttttcttcttttcttttcttttctttctgtgtttttgagacagagtctcactctgtcacccaggctggagtgcagtggcgcaatccctgctcactgcaccctctgcctcctgggttcaagtgattctcttgtgtcagcctcctgagtagctgggactacaggtgtgcgccaccacacctggctaatttttgtatttttagtagagacggggtttcaccatatcggccaggctggtctcgaactcctgacctcaagtgatccgcctgccttggcctcccaacgtgctgggattacaggtgtgagtcaccatgcctggctgcttttcttatttcatttgaactcttttctccaggtatattatatatactgtataaatattattaaattaaatattattatatatagtatataaatttggggtttaatgactgtttctaaactaagatcacatgaactcagaaatggtaaagtagtactttgagatttgtggtagtaaagaatttgactttttttcctcctaagtttactaaatatttcaatacaaaagcccatatttccttaaaagatatgatgtaaaccaactatgcaatttaaagcaaatcatttttcaagtttgctattctcattataagaagagttcaatacattttagaaaatgtgagaatgcagttaaggagaaggaatcaaaacaattgcctataaactttacataaactattgttagtaatttggtatgtttatatttaatcgtttgtcagctgtgtagttaaacttttagaattctttctaccactttttgtagctatacttccctttcagaaatgaattcctattttattataaggtacactgatacagataattttggtagatgatagcttctaatagcaaagtagtattttaataaatcctggcaccctcacttcatttaattatagtctggttactggaaattcagtatctagaagcattttatgccttgaatagttgtggcataattttatctttagtcatgtttgagtatgtcagtagtcataggccatttttatgtgttttgctggatagctttaaaaacctaatgaaaaatgtttatgatttatccctttatcggattaaaattatacacaatttgctatcaagatgtaaaacaacagaatctcagttttctcagattagtaattataatgatacatttttcttatttttgagatgggaataatttggaaaaaatctagaggtgtagagtggatatgtagtactagaaacatatcaacaagtttcaggaaatcttgtaaacctctattttcattattttgggatgggggggttctattgaattaccattgcaaatgaagcaagatcttcatttggaaaatttacttgtattaaacagatgactgggctgaaatggctgctaaaacaatttcatgcttttgtttttaatgtagtccagttataaaatgtcacatcagattgtgtgtgagtacacaaatgcataattttaattttatttctgagttatcacattttaggaagttgattaaaatcacccagaattttttctaagctttttatatataacaaattaactatttgaaatgagttaaaacaagattgatattttggcagtaatacctttattaaagaaattgatcaattcttcagtagttacccattttgtccttttttaaattttattattattatactttaagttttagggtacatgtgcacagtgtgcaggtttgttacatatgtatacatgtgccatgttggtgtgctgcacccattaacttgtcatttagcattaggtatatctcctaatgctatccctcccccctccccccacctcacaacagtccccagtgtgtgatgttccccttcctgtgtccatgtgttctcattgttcaattcccacctatgagtgagaacatgtggtgtctggttttttgtccttgcgatagtttgctgagaatgatggtttccagctttatccatgtccctacaaaggacgtgaactcatcattttccattttgtccttttatttttgaatatgtaactcactgccaaattttatttgctctaatttcttattttagaaatgtcaagcctacagaatcattgtaagaatattacaatgaatagccatagacctttcacccatattttaaaattgttaacattatgttatatttgctttatcattctcttttaaaattttttttctttttttgccttttctgagccttagttgcctatttgtaacactttactcctaaatacttaagcatgtctctcttacgaacagggactttctcctatataaacatagtttaattactaaatcaggaaattcatcactattataatgttgttgcctaatatagagcccgtattcaaatttctccaactatcccaataatgccctttataacttcttgttttctagaatctaatcaaggattgcacattacatttatttgtcatatcttcctaatcttctgtagaacaagtcctagacttaaaaaaaaatttcatttcattaacattttcaagagaccaagacacttattttgcaaaatgtttctcagtggattggtttcattgtttccccatgattagattcagggtaaacattgtgggcaaggatgctacacaggtgatgttcttcctcagtacatcacatcaggaggcacagggatatcagtttgctccattattgatgatgttacatgtgatcatttggttggagaagtatcttccctatttgtctttgtaattaataagtgatatgtaggataatactttgagatcatgtaaataacctatttctctgaaacatttcacatggttttaaaatctgttgatgagattcttgcctgaatgaattataactaggattgctacaaaatagtgatttttctaattcattgttacttctgtatttatcatctggtattcttctgtaaagtagaactttcccttacctctttaaccttctttgactttttaaaagaaatatcagcatggactcacagattctttatttaaattcaattaactaccctaccttattgatagaaactctataaaatccattcaattgtttactgaaaataacacataaaataaagaaatcaaacaattaacatctgttggtttttactttatgaggtaactatacccatactaactcattaagtctcatctagaagcagttctacttttccccctagaagaaaacattagacaggtgcagtggaatttgaagtaatgaaatgtctgatgtgatacatttattcactgcatttgttatatttaggccttacttatattcattgctgcataatccttctgaatatcttaaacattaaaatctacttttctatcttatcagatacaagtcttacttcagattgctatttgaattagaatgcctttagccatcttcattttcaggcttccattgtttaaaaagtcatgatggcttatccttaactgttatcaagcatgaatctataaatacctacaaatgtgttttctaaaaacaaaaaaattatggtgtttacatatagaaatgtatgttgccatagtgttcaataatccagagcaatgcttttcagcctatcttccttgtaaaaagctgttcaccttaggcttttgtagcggtgctttgtaagttctacgtttttttccgattctgttttagaactctatttattttaaaaatttacaaaaatagcacccatgttcaaagacctcaaaattagtaacttgtaagaccagatgaattcatttttgtgtacaccccagaatgtagtttatctttgcatctttaatggcaaggtattctaagactgcaagagatgctattttaactgttaagatttgtagatacttatttgtgaaaatctggattttctttgtatgatacaactaaaacaaaatgtgtaaatcatctggatgttttgtttaataggactgtagctcttctataaaatgcctggtgttagatgttaatgtttattcaaatagtctcattgttcttttcgattaacttataaatcaatccccactaatggaacactactttaatatgcttgaaaaaatgtttagtcttggggaaaaaagctttaaaactactgatcttacagaaaatgtccatttcaatatgtaaatttagtatacccattatttaaaatgtgtgtgtgtgtgcgtgacacttttaaatgcatttgtatttgctatcatgggacattgaatcagggttttatttttttattttttgttttttatttttaattttgagatggagtcttgctctgttgcccaggctggagtgcagtggcacgatctaagctcactgcaacctctgccttctgggttcaagcgattctcctgcctcagcctcccaagtaactgggactataagtgtgtgccaccatgcctggctaatttttttgtatttttagtagagacggggtttcaccatgttagccaggatagtctcgatctcctgacctcgtgatccgcccgcctcagcctcccaaagtgctgggattacaggcgtgagccaccatgccctgtcgagtcaggattttaaaactagctctccctgatctttttttttttcgatgaagtctcgctttgcacccccaggctggagtgcagtggctcgatctcactcactgcaacctccgcctcctgggatcaagcaattctcctacctcagtgtcctgagtagctaggattataggcgcccaccaccacacccgactaatttttgtatttttagtagagacggggttttgccatgttggtcaagctggtctcaaactgccgacctcaggcgatctgcctgcctctggcctcccaaagtgctgggattacaggagtgagccaccgtgccgggcctctgatctttataaaaataagataaatggtgaaaattgggaattcttactgctcttatgtaaaaacaagaataattttagtggtctgaattgaagggtcatgagaagcagcaggtatactaagctgtaaatctgtgggactaaactataaatcgtggacaagtggtcaagcagcctttaggaaggcaacaatatcatggcaatactctatttctgagctgatgttagagtttgtattgtcaataagatcatggtaaagtttaaccacaagttttgcagcctttcatgtttcctccatactcgtggaatattacccttccaacacagacatttcccttttaatagagggttatccttattacctccaccacattcactatccattttatatccatatcttgatttctgcccttctaattagtctactttgagtaattaggataaagcatttctgaaatttcattatataagcattaattactgtctcttaggtctaaaataatttttcggtcacattttctaattgccaaaattattccttggatcgacattcatactatttttctacaaacattatattacataaataaaaagaaaaagtttatatatatatataagtattttatggatgaaggtaaaacatgagataatttccttatgtatggaacaactaatattaaattaattctttaaggttgtatttatagctctcttatgcaaggagaataacttaagcaaaatagtacaccagataactgttatgtggtaatagagagattgaattaacactaaaatgtgttaaaacacatatatttataaaatagacttaaatttcaagaaataaaattaatactgttgaaagaagtgtagaaatcatatagtgactttaaaagtacacaagttcccctcatttcaaaggtgtgaatcttttgtgacttttatactagtatttaatactatataaacctcactgtttattctaaatattttattttattttattttattgtagagacaatgtctcactatgtcactcaggctggagtgcaatggcacagtcttggtcactgcaacctccacctcctgggctcaagctgccctctcatctcagcctcctgagtagctgggactacaggtgcatgccaccacacccggccaattgttttgtatttttgtttgtttgtttgtttgtttgtttgttttgagacggagtctcgctctgtcacccaggctagatggggtgcagtggcgcgatctcggctcactgcaagctccgcctccggggttcacgccattctcctgcctcagcctcccgagtagctgggactacaggtgctcaccaccacacccggctaattttttgtatttttttagtagagacggggtttcaccgtgttataaccaggatggtcttgatctcctgacctcgtgatccgcccgcctcggcctcccaaagtgctgggattacaggcgtgagccaccgcgcccggccttgttttgtgtgttttgtagagatggggtttcgccatgttgcccaggctggtctccaactcctgggctcaagcgatctgccctcctccgcctcccaaagtactgaggttacagacatgagctgctactcctggccaatatttcttatttatttatttaaaatatttagtgagtgcttacagaacgtgccggctacttttctaggtactggggtgggggcagggagaaaaagacccctggggtatatagtctacttgggttagtgttagagtagaccattgataaatgtatttgttttgtaaggggatgggggaagccacattttctagttttcaatatacctttataaatggagcatttgctttgataaaattgcaattctgttaacgtctcttaaagtattttgtttctccacaagggattattcagtattaatcattcaatgcgtacgatcagtgaaatcttagcaggccaaggataactcttgtgatactcgtaaaacaaccagaacagataccactttacaaataaaggacggtgtggggatctactgtggtggttagaaaagccctgaatatctgatttgtgactaaaatgtggagagggaggggaagaaaaaagggagaacatgagggccagccagagttaaagaagactctggaattacatttttaattgttaagtcattggtttaacgacaagagaaaaaggcatgttctggctggtaactgacttcagaagcctagggcttcttggacagaagatacaaaggaaaaaactaagagaccaagaaggaagagagtgaacatgatcgttcatagtggtaacatcgatggcttgtagatattaaagccatcactggcagatgcaaactagagatggtggtaacaattttctgatggactttaggagtagtgaccaagctagttggatggagataaatgtaatgaagacatatgtagaagagctctttatttcagcaggtcaaggagtaaccaggcccaaagggcaaggtcacaaggcattgcctctgtgagttttcaacatgcagatgagtgatgtcaccagtttgagaagcctactcaccctcctcccagtcttgattctgaggacagatacttgtaacttgaaaaagttctctcccttcctcctttgggaatcactcctctattctgtgggttttctgactgtatagaaaaatctgctggtatcttaaaataactgctaaggatattgtgtgaatgtagaacctgtaacacacactgttcggtcatttggccctagttaccatccatctgcatctgaatatcccaggcatatctatagcagattgtaacatgttcagatcactgggaggtataatagtacattgtagacagacagagacatattttaacctaaaatcttaaaaatagatgcattggaatggatactctgatctccccagaatattttattttcctaaaatgcctcattcttttccgatctttaggtaaggaggtattttgctttatcaatctgctttccagctgtttgggatttaatattccacatagatgcatgcattttctttgtaaataatgacaaagacagattacataattacaggcataaaattatctcatcttgctaaaaataatacagtaacaggattagtatgtgtatcatctgtatgaattaaccatttatttttattaaaatactaagatccatattatgaccacccttatgtgttcattgtctacttgtttgaatcaagaaacattctggcctttgatttcttgtagttatagatatatggaattggtaatgttgattgaaatataacatagtccctttagcttcagtactttaggaaaaggttcctctgtccactataacatttctcaaacccatgtaaaaacagtagtgtaaatataagcatacacaattaaatgagtgaagtaaaactcattggtgtgactatcagggctttaaaaaagtgtgcagtttgaaaaaaaatgaaggtgattatatagtaaaacaaacatctgtctctttcctactatccctgcactatgtataggacttgcttaattagaaagaagaagacatgatggaatatggtccaaaagtttgaagaacagtgaggggcatcagggcctggatgataaagctggacttcagtggattctgtgttaactgtctagatactgaattattgtgtagtaaatcatcaatgcagagtggaaaccttggaaatgttggctggaccttgactacagttggagaatagcaatttctgtaaggctggctgaatcatagtcagatcatctcagaaaagatgagcagcagtggttaagaaggcaatctctggagtctgtctgcccaggtctgaatcgtggcaggctgtctaatcttgcttttctcatttataaaatgagatgacaaaaatagtatttatttccaaggtatgttgtgaggattaaatgtcagccattgctattgttgttgttaggaggggagttaaatggattttggttttggacagaaaaaatggatttggtttgtaaaagtaatcaaatataagcagaaatatctgctaagctattggagagactgaatagatactaggtgaaagggaagagtaagagttgttattttgtgagtccttgtttttgtttgtggttctatcacagaatacctgaggctgggtaatgtataaagaacagaaatgtattttctcacagttctggaggctaggaagtccaagatgaaggtgatggaatttcgtgagggctctcttgctgcatcctctggagggtgccacggacaatgccatgtcctcaacatggtgaaaggtggaagggtaaagagacaaaaggtggccaaacttgccttttttttttttttttttttttggagacagagtttcgctcttgttgcccaggcacgatcttggctcactgcaatctgcgctcgcctcctgggttcaagcgattctcctgcctcagcctcctgagtagctggcattacaggtgcctgccaccatgccctgctagttttttttttgtatttttagtagagatggggtttcatcatgttgcccaggctggtctcgaactcctgacctcaggtgatccacccgccttggcctcccaaagtgctgggattacaggcataagccaccactcccggccccgaatttgcccttatataatgggattagcctacccagtgggacatagcacccagagccgtatcacctcccaaagttcctacctcctaataccgccacaatggcaaccaaatttcaacatgagctttggaggggactaacattcaaactgtagcagtccttatataggagccacaacccaaaccttagaaaattttgagctccctggagcaaatggaagagcagaggagaatgtccttgaggactacagggaacaagtagatgagtagggtcaagtagaaactttcacaaggttaaggacacctgtgtatgtttgaaggtagagttggagaaaccaagggaggtaatccaaaatgtgattatacccacaggcccttttccacagaaaggtactgagagtcccctgttgccatcagtgaaactttacactattatgtagtattaaagttatttagtgcagtagtagtcaagaatttggcagctgaaatgagctaaatgcccccttgataacctgtgaagatgttactatcctactgtaagtgctcatctgattaccagggagtcatgaaggtactgtggagaaaggggcttcaggtaattagaacttggaagtagccatgtctgttgtgaagagctgggattgtaaacacattttgcaacagtataaaaactgataacaaatataatttagttattctaaatgtaattgttactacagcggagataacagatgtatttagatcagcttctgtttgtgtaaagaaaaatgtaaactattgattccaatttaatgagcactcacaatggttatagctgtgttatttacatagctatgtaacagaggaaacaaatacctagagaagataaatgagagaaccccaaactgaaacacctctcactgggctttactttcactgctgatgacactaatccttttactttactccagcaataatttaatgttttgttttgcatactagaatccttctagtattaggaagaattcaaaaggtaagggagaacccttgtcaatactatataggtaattgctagtaaattttcttttaatattgcctatgccaaattttagaaaatgtaataatcgaagctagtatgcaagcagtagcttctgtaataaaataactttatattatgtaccgtgatgtaaaccttattgcttgctttgatttatatgcaaatatttctttttcttatagtttatactgctttcagctgctatcttagtttttgtgctctagacagtctccattttttccgtgattaccacaataaaataggcaagcaggaaaaattatggctacttcctgtctaattttgtgtatttgtttcagtagcagtaccaatcttttaggcaaccagtgttgtcgatgccatgaatttacagtaaacctgtggaattcacgtatataaaacatagatgtcatgctggtgaattcaacttacaaggcatggaatagaactcttgcagtgaggctattagtttcaggtaatttaaatctcagtgggaaccaataaatggattttgaactaatatatttttgaagtcttcaaagataggagaagattgtaatattctgagtaaagaaaaaaatcatgggtgatttttttaaggtaaagaggtttaaatttaatgaagtgattaaaagtaatttcaagctttattttccctctataaacattgtttttagttgatttaaaggaaattggttaaaaaattaggcttcttttcaatataatgccaaatagaactaaacatatctttcaatgttgagaactttttctaatgggaggaatgtgaaatgacatatttctgaggacctacacagagcctaatgtaatttattcaccaatcccattgttgattaggatggtagacattactcttttctcttttttttttttttttttttttgagacagagtctcactctgtccctcagactggagtacagtggcatgatcttggcttactgcaacctccgcctcccgggttcaaacgattctcatgcctcagtctcctgagtagctgggattataggcacctgccactacgcccagctaatttttttcttttttttttttattttttatttttagtagagacgggtttctccatgttggccaggctggtctcgaactcctgacctcaggtgatctgcccaccttggcctcccaaaatgttgggattacagacataagccaccatgcccggccctagaaattagttttaaaggatattttacactagtttttcatcaggaaaagtatatcttgataaaatgtttttctaattttagaacttaaagggaaatgtataactacattaaagtataggtagtagtaataatcttatagctaattttaagactctgccactaaggtgttataattcttagctccttctcacacatttgttttctaacataaatgatgtgtaacggcagagatcatgagttacatgttcctcatttgccttgtcatatcacctagtgcaaacttctcacacctgtaacctggaatgataataatttatttacttctttgtctcttttaggacactgtgggatatttgaaggttagagcttggtttctatttctatgccagacaaatcttacatagggtttgatacttagttgttagccagtaaaaatctaggacggctcctacaagaaacatttaaagggtttggcaagacctagggccaaccacctcccaacccgtccccaccctccaaaatgttttgaggaaaattaacacccctattattattagggaagcatgcaaattgtgtaagtaaaattataagtcagagaaaatcgaaatgtccatgtggaatagttaacatctttttgtttctgttatttcagggactgtcatatccaagaggataatttgttactgtgtgcatgttctattagtactgtaagcccctttatacaaaggatgcgtttaatttttatattcccattatgtctgttacctagcattgccaagaatacaatagaggctcattaaaatcttgaatgtatgatcagtgtatgttgttgccagcacaccctcccaactctcccattagatgacaagcaatttgaggggagcacccaagtatttgtcatttttaaattcttctctctttcacactcaacacagtgccacaggtatagtaggcgtgtgtgttgaaggtttttaagagcattcccactttgggggatttgttagaaggactcacaggactcagaatatcatttcactaatggcgaagatttattacagtgacatagtagagatgcacagccagatcataggggaaaagatacaggcggagtttggaggaatctactggtgggctgccttatgctgtgtccctcccacgaggggtcacatagaacactcttttccttcagcagtgaaaatgcagcaatatatgtgtgatgcacctgcccaaggaagcccattagagagtcagtgcccaaggtttttattgggggccggttatgtagacacactctgtttagcatgtaccaagatttcagactccccaaagtaaagcagatattcaatatagactgcattgtttgtacaaacaggcatagtaaaccatccttatcagctaaggagcagtggggacactccccaaaatccaggttcccagataccagccaagggccaactttgcatgcaagcctttctataaatagcagtagtaggcttgctatgtccacttttctgcatagcatggctttgtatgaatactgctttaggcgggagaaggaaactgtatggcatttctttcagtacttagtcttaggctcaatttgttagggagattaaggtttcttttctttgttagaggtgcttctaatgtcttggttgttttaagtgcctgttcgtcgacttgcatcattgctgaattccttttttgaactttatgaatgtaccaaacatacctgatccccactcccccaactagagcttgaaagcttgctgaaagtacagggcttaaactccacgtctccttgcaaatacagtatctaggcatattctctgttgattcctggtttcaggtagttgtttgagttccatataatattatgttggcttttattcagatcgtgcaattttctttattttggttggtgggctggggtattcatagtgcaggacctaagaaagcagtaaagcaaagaaaaaagtgagaattccagaaaatctgggtatattattatagtatcacatgtcctaaaatgttcaaaatttaatttcttttttgttttttgtttttttttttttgagacagagtttcgctcttgttgcccaggctggagtgcaatggtgcgatcccggctcactgcaacctccgcctcctgggttctagtgattctcctgcctcagcctcctgagtagctgggattacaggcatgtgccaccacgcccagctaattttttgtatttttagtagagacagggtttctctatgttggtcaggctggtctcaaactcccaacctcaggtgatccgcctgcctcggcctcccaaagtgctggaattacaggcatgagccaccatgcctggcttcaaaatttaattgctgagctgtttagatgaatccctgatagcatctccatggtgattgttagaaaatcatctttgattactgcttcatgtgtttttctgtaataacacattttctgattgtaaaggtttctatcaattggtcattaccttgttgcttttggaagaacaattatggctgttttatattcaacagaggcccccttatcagaaacagtattgtcttcactttgcaaataattgcagtattgtcttcatttttgcaaataaagagggaaaaaaaatcctatgtatcttagagaattgtgggtgtcaactcaggttctcacccagttaattgtacgttttgaaaatttaaaaaaaatgaaagggctattgacagtgagatgtgacagctaacaggagaaggaggaactataaaaatatagtagtcttcagttgtttcacagagaggaaaacaggcccaggctcttcagtggttttggagggcagtgctgtatgattgcgcagaatagaaattgatcttgatgaggtattatcaagaggagattcaatgtactcctcatcagtgctgtctgtgtgtaatattttcaaaaagttttcatcgggaatggttagctttctccccccttttagttgttatacttaaagagatatctttgacgtacacagcacacattcatggatcactgattatgcctgataaaggactcattgtattttgctctctttatgaaaactcatggaaaaaaataggtatctataacttatttagcacttagtataatcaacaatgttatgggtacaacaacagagaactacaccaaatgaaagagggagtttccagaaatatttagtaaagtttggagcatgtttttcatgctcaccatttccccacattaatatttctgagattaatttccaaagaaaataattggtcaccaaatatattgttttaaaaaatgtttcatgtttttgctgaggcaaagaagtcttaacactttgtggagaaagggaaggcaattaatcattgaaataagataaaagatacttcagccacttgggaggctgaggcatgaggattgcttgaacccaggaattggaggctgcagggagctatgatcatgccactgtcccccagcttgggtgacagtgagactccttttttttttttttttgagactccttaaaaaaaaggattaaagatgcttgaaccttggtgccatcccatggggaggaaaaaacccctatttttcagatttctgcagtgcagttctttggctagctggtagttgtacttgattaagtagaagagggatgatgctggttttattacataatggtctatttctgtcctagcatgttcggtaggcaagcctccaataacgtttactgaccacttactgtgcttgccaggcaatgtgataaatgtttttttttggatgacctcatttaattctcaccgtaatcctttggggagatcatttttatctccagtttaggaggcggctgaaattcagagaagttaactaacttacccagggttagttgtgcctgatgctcaaccctgatgtcttaattgctatactgtgctgcttcctacccaaatgtgctctttgagtttcatgatatggtatttagtaggtttgccccagtctctacagggaaacagggaagattgtagacgtaagaatatacaagaaatgctaagtggctctttattcttctgagagtttctagtaggggaatttacctataataaatgaaatatagacctatcattccttacttttatgttccaaattgtgaaacagaatgttgttttatgatatttacagatctctatatggttttgtacagttatacttcctggattgttttgatactttcttacaagcagtccttgattgctccttttatagacggtttatgtaacctcctgaacaagaatgcatggccaccataatgctggagctctcctttgttgtttttagtgtcctagtgctaccaaagctggaatggtggtcctctgctcctgacaaacaactccattttcagggtttcctcttgcctccatccttccctgccagcagttgcaaggggattcagagcttagtacttttattattatgggagtatttttcaggatagctttactgcttaagcattttatttaaacttacttttcttgtgaaatatgtcccagagggttttattttttattttttgccaactgatttacaaatagactttagaatacaaaccacttataaattgggactgcttgtataacacatagaggtttgaggatactttttctatcagattagattgaatattcttattaatttgaatcctgtgataaatatgatattgtgtatgctgcagttagtttaacacttcagttgctataaaagcataatttcaatagtatgtaaatttaatgtaactttggagacttagagttggtttgttcattttgatgttaatttatttaaattttagatattttaaaataagtttgtgtaggcctggtaatgtattttattccaatgtcattatattttgaaattaaagttactttaaaataggctccaaggaggtgttagttaaattactagtaatgcatttggatgctctgaaaaaagtatacttgtcaaggaataaacataatgggatggcagtagaatccctttataatgctgctgttacatggacactatctgttatgaggactgattttgctatatcattttactatatagagtaataatttcaagagcaataagttttttaattttttattttttgagacagggtctcactctgtcgcccaggctagagtgcagtggcgtgacctcggctcactgtatcctctgtctcccgggttcaagcgattctcctgcctcagcctcctgagtagctgagtagctgggattacgggcatgcgccaccacacctggctaatttttgtatttttagtagagactgggtttcgccatgctggccagcgtcgtctccagctcctgatcacaggtgatctgcccacctcagcctcccacagtgctgggattacaggcacaagtgaccgtgcccggcccccttccactttttaaacaacagaaatgaaacttattaagtaggggccttcgatctggaggctgggaagtccaaggtctatgtgctagcatattccttttttggtgagggcccttttcctggctttcagactgttcccttctcactgtatcctcacatattaggaagaggaagctttggtgtttcttcctcttataagggtgctaatcctatctggggtttccaccctcatgatgtcatctaaacctaattacttcccaaagatcccacctcctaatacaatcacattgcaggttggacttcaacatttattttgcgggggacataaacatagtccataattggtgttttcataaaaagaccatatatcaaacagtagtgtggtgcacagtaaataagtgccatgggcgttcagattagagaaaaactattgaggtgagacagctagtaaggtagaaagacagacaatgtgttgttcatttatgtatctggcttaatctgttcaggctgctataacaaaataccatacgtggattagcttatacacaacagaaatttattgctcaaagttctggaggccaggaagtccaagatcaggatactaacagatttgatgtatggtgaggacttactctatgcttcatagatggcaccatcttacaaccttcttacctgacaaaaggggcaaacaagttcctttgggtctcattatgtggcactaattccattcatgaaggttccatcctcatgaaatagttgcctccccaacggccctaactcttaatactattacattgggattaggtttcaaaataaattttggggagacataaacattcagaccatagtagtattcttagtgccgagtacaatgcctgaaacaaagtaggcattcaagaaaggtatgctaaattgaagaattaaaaatcatggaaatagatattttgaattggcaggcatcttacaaatcaggtagtccaagttgcccagaccatttcaactccgctaggaacattaaaataacacaaagccattttacactcattaaattgccaaaaaaaaaaaaaaagtctgataataccagctctcattttctgctcatgagactgtaaataggtaaaatcatgttggagagcaaattggcatcattaactgaagttaaagataactctatcctgtgatataacaaatctcatttaatatacagactctagagaatgtctcacctatgtgattgattgtattagttttctggggctgccataacaaactaacataaactcggttgcttaaaagcttagaaattcattgtctcatagtcctggaacccagaaatctgaaattaaggtatcagcttccctccctgtgatggctctaagaaagaattcttccttacctctttcagctttggatggatccagagattccttggcttctggctgcataactccaatcttttcttccaaattcgtgtcatcttctgcttttcctagtgtaactcttctctgtatgtcttttataagtttatttgtcattggatttagagcccattcagataatctaggattgatctcattttgagatccttaattatatttgcaaagatcctttttccaagaaaagtcacattcacaggttccatgagtttgaatatggacattttttttggtggccaccattcaacccactatttcagcaaatatttaaagcagtggtctgtaccaaaactaactatgacctccctgtcatttgttctggtcttctagttccttgtaggtcacaggttatctcactgcaacttcagtaataaaaaaatttgagggaaaagtgatagtagctttatttcattacttatatatttcttgagactagttttatggcctggcatatagtctattctggttaatgttccaggttaatgttccagttatgcttgaaaaaaaaggtatagtctatatttggttaaagcatttcataaacatcatttagatcaagtcagttggtagtgatgttcaagtctcctatttttttaaaaactattttctgtctacttattctaccaattattgaagaggcacagcgaaatccccaattataattatggatttatctatttttagttctatcagtacatttgcttcttgatttttgaaacaccattattatatacacattgaagattatgtcttctttattaaatgatcattacataatcatagattgtacttctttatctttggtcatattcgttgtcctgactctgttgtgtaattatttacctactctagcttttttattattatgatttgtgtgatatatcattttgtatccttttacatttaacccatttttatctttatattaaagtgagtcaggtagacagcatatatttgggtaattttttaatgctttgtgaaaatgtctgccttttaattgatatggttaatgcatttacatttcatgcagtgggccctttgtgtctgcagttttcacatctggagacacaaccaacggagaaatagtggatgcagaacctgtggatatggagggctgaccatgagggacttgagcatgtgtggattttggtatccaagaggggtcctggaacaaagcccccatggatacctagggataactgtataattattaatatgactgtatttatttctaatttcctttttttgttttttatttttttatttttagttttgttttgttttgttttgttttgagacggagtctcactgtatcactcaggctggagtgcagtggcgtgatctcagctcactgtatcctctgtctcccgggttcaagtgattcccctgcctcagcctcccgagtagctgggattacaggtgcatgccactgcacctggctaatttttgtatttttagtagagacggggttgcaccatgttggctggaatggtctcaaactcctgacctcaggtgatccacctgcctgggcctcccaaagtgctgggattacaggcgtgagccaccacgctggcctcttatttgttttctatcctatctgtcctttgttcctttaactctttttttgccacatttggattgtgtgtcattttaactattccacttgatctcatgtattggcatattagatatggctctttgtttagttttcagtggttactatagaatttatattatgcatcttaacttatgacagtctagctttatatagtattgtatactttttctataagcaccttgcaatagcatccttatgtttgcacccccatcttttttattcttctcagacattttacttgtatatatgttataggtctgaccatacatcatattaattttttctttaaataatttgttttggggaaaaatagactgtaaacaatctcttatatattctcacactctatttcacacacatttctggcactcttcattcctttatgtagatctcagtttctatctgatattaattttctttagcctgaagaattttctttaagtatttcttatagtgcaggttttcttgcattggattttgcactgtatattttcagattatgtttgtctataaatgtatttatttcaccttcattttggaaagacattttcacaggttgcagatttctaagatgacagatttctctttttttttggtttgttttctttcagaaatttaaagatttcatccattgtcttctgagttccattttttttttcatttagaaaagacatttgggccaggtgcagtggctcacgcctgtaatcccagcactttgggaggccgaggcaggtggatcaccgggggtcaggaattcgagagtagcctgactaatatggtgaaaccccgtctctactaaaaatacaaaaattagcaaggcatggtagcacatgcctgtaatcccagctactagggaggctgaggcaggagaatcgcttgaactcgggagccagaggttgcagtgagcagagatcatgccactgcattccagcctgggcaacagagcaagactctgtctcaaaagaaaaaaataaaaagaggtttaattggctctgcagaatgtataagaagcatagatacttctgcttctgtgggggtcccaggaaactttcaatcatggcagaaggcaaaggagaagcaggtacttcttacatggaaggagcaggagcaagagacggagggggaggtgccacacactttaaaaaaatttacaacagtcttttttctttttcttcaatttttaagttaaagggtagatgtacaggatgtgcaggattgttacataggtaaatgtggagttgcattgtttttgataagaagtcaccaatcattttaaactctgttcccctctttgtaacatgtctgtctttctgactgctattaatattgttttatcattaggttttgacaaagtgattatgatgtacttttgaggtgtttttaatttttacaaatgtttatagtcagctctctgtatctgcatctgtggggtattggtgcaggaccccctgcaaataccaaattctgcagatactcaagtctcttacataaaatggtgtggtacatttggctctccatatctgcgggttttgatctgtagttggttgaatctgtggctgtgaaacctgcagatatagggagccgactgtatctcgtttgggattctttccgttcttaaattcgttggttagtagttttcatcaaatctggaaaattatgggccattatttcttcaactatttgttttgatctatcccttcaacattttggaaattttttctgtagtagatcactttatattgtccatatgtcactgaggctctgatagtttttttagcctttttttccctctctgtgcttcagattggtagttctttttaccattatcttaatttcactcatcttttctattgaagtgtctaatctgctggtaagccatacagtgaaaatttcatttcagatatggtatttttttcagttctcgagtctcatttgatttctttttttttgtagtttcatttctcttatttatgttaatgttttgctttatatcttgtatataatactaatatctgttttaaagtgcttacctgctattcccatcatctctgtcatgtctagatttatttccagtaagcaatctttttctgcttcttcaattacctagtaattttttgataggatgctagttattagaatgcgacattgttgaatgttggaatttggttgtcttaaaagagtattaggctttgttctagcaggtagttaacttacatgcaaatcaacttgatcatattaagacttgtttttaaactttgcatgaatctaaagtagcatttactctggatatggtttagtcctacttctaacatgtgtcctttttctgatttccaaatgctcaatgaagtctctcccctctgactgatcagaactcaaatgtctctcggtcctgtgtgatcttcagtgggtatttattcttctctggtagttcttctgatagttgttctgtgcccattctcgtggagtctcctctaaacttgtacggattgatattcagccagactcaactagactccactgcagatatctggaactgtttttttttttttctgtggggattcctcttctctggtaatgtgccctataaatccaagctgccactgccttcctgatctcccatctctcttttttcagttctgtaagcctgcagtactctgcatggtttgtcccctccctgcactgtaatgtgtacttccacacacaaaggctgggtggctatagggctcacttaatttgtttcctttctctcagggatcacagccctttgcagcctgttgcccaatgtctaaaaacagttgtttcatatattttgtctgattttctagttgtttacagatggaggtctagtctagtaccagttacttctttatggccagaagcagaaatctctaaatgtagcttttatagatggatgaggtgtgttcggttgtctttctttagttaataggcccttgaatttgtattcatttttatcttgggcactgcattttaaaagtaacctttcttggccgggcgcagtggctcacgcctataatcccagcactttgggaggctgaggcaggcggatcacgagcttagaagttcgagaccagcctggctagcatggtgaaaccccgtctctattaaaaatacaaaaattagccgggcatcgtggcgcgtgcctgtagacccagctactcgggaggccaaggcaggagaatcacttgaacccaggaggcagaggttgcagtgagctgagattgcgccattgcactccagcctgggtgacagagtgagactccatctcaaaaataaaataaaatgaaataaacctttcttaattctagaaaattttacatatattattatatataagattatatataaaatatataaattaccatgggttaatcctataagtttaatcagtaatgtagtgatccttgttgtttctacaaaataattcttatatgtgtgagagacatttacatgctgaattcgtaggtagtctgtttcaagtaaaagaaaaccattacaattgtgacctacttttttccatttgattttattcactaatagccatgtgttttgatagtgtataaagcaacattttattagtttctcaaatcccttgctatgctcttttgcagaatgaaatttttcactatttatgtcatactggagaatatagaatgtgaaaatataattgtccacttctcttaactgcaattatagtcgaatagtctcacaagatacatttttttttccccagatgtaagtgaagcctcttttgagttcagagctaaaattaaggactattttagattgagtccccaggacactcagtttttcattctaggtagcactatctcatttttacatttcctgtgttgtctctgtagatggttagaaaagcatacttcatcagaacgatgggttactgccagcacccctctgtgagatggttattaaaagcatgtcctttcctctccaattcagagtgcaaggttttcactgatgttatatacttgagctcttctgacacaagggagaggatagctaaaacagctctcaaagctgggtttatagcctttcctatcatttggcatttcactgaactaggtgaggtggttcttaatctttctctacctctctatcattaacatggttgatcgtcagtgagagctgcagtcaaacaaaaatggaaactttgtaatttatgtatagctttaaaaaggcaaagaaatgaaggattattgcagttggtgcaatccccgatacaattaatatcaaatgcatataaatcctattagagatctgtcatgggtgaaaaaggaatatgaaaaatgcgtgacctatctttattagattcagttagagagagaccatacagagctaaggagctttacgaactgcatattaatcataaccagtcttctgagataaacctatttcttgtaacttatcaaagccatacagaagattagtcattccctttggtaaaggaatgttttacatattgttctgagttttgaacatcacagctttaaaagctgattaacagatattttaatactaaaatatatctcattgaattatatagcttaggcagctattatcctgtaatgctacctcaatagggagatgggctctttgtcaaaacctctgcatcattgttttgttgcatattgaacaagacactctagggagttgtattagagaccagacaaaagaactttgctacagcaagcaatcattaaatcatgcagaaatatttctttcttaaatctttactttaagcaacaattggtagatgccagcaccattttttaaatgtcactttcaattcctgaagtcttttatctctttgagaaggaggggaattagcttaaggggacggttaagaccatcatgttaatacacggtattactaaagataggggatgtattaacagctctaatctgacaaagataattaagattgtattttaaaaatgtgagagagggtttcataagattatgaaacttttagataaaacataaagactaacaggtataaaatggattttgtattactgtctcacaaaacttagagatgttgagtgatataagcatttagtttctgacctcctgttaccacttcagtgcccagaatttatgtcatgtcaataaaaatacagaaccatctcatgatgaagatttctatacttgataatatataccattttatatatttgtttttatatttctaaaataataatcttgtttaaaaagctaaaaaatactgaagtatatgcattagaaataaaatctccccaccctacatggtagaggtactactattaataatttggtatataatccttctaaatattttttaaaatacatttattgaagggatacatacacagaaaagtacacaaaccataatattacagctcagtgagttatctcaaagtgaatgcacacatataaccaatacccagttcaagaaatagaacaatactgtctcttcccaattcctactgtccttgtcctccctaaagacttccagtaatttgacttggaacagtacagtttatttctgcctattttttgagttttacataaaataaatcacagagtatctacttctacctatctggcttctttcacccaatcccatgtttgtgagaatcattcacaggcctgagtataactatagttttaaattttgttcttctgtagctggggttgggcaccttattctaataagccgtaaatattttaggctttgtgggtcatatggtccctgacacagctttcgtaaaacaaaaacatcaatagatgatatgcaaatgaatgtgattttgctctattaaaactttatttgtaaaaataggcttcaggctagatttggcctatggactgtagtttgccatacatgcaataaataaatagaatactctagtatactgtagtatttcattgtatgaatatatcacaattagctgagccattcaaatattagcagacatttgtgtttttggtatgaatgcccttggaatgtggttttgtataaatatgcatgcatttctgtttggtatatggaattgcctcatgatagggtatatatatagggtaaacttaagtagtattgccaaatggttttccaaggtggttgtattagtcagcgttctccagagggacagaactaataggataggtgtatacatgaaggggagtttattaaggagtattgacccacatgatcacaaggtgaagtcccgcaataggccatctgcaagctgaggggcaaggaagccagtcggagtcccaaaacctttaaagtctggaagctgacagtgcggccttcagtctatggctgaaggcctgggggctgctggcaaatcactagtgtaagtgcaagagtccaaaagctgaagagcttggagtcttacattccagggcagggagcatccagcacaggagacagatgatggccggacgactccgccagtctactcattccaccttcctctgcctgcttctatcctagccacactggcagctgattagatggtgcccacccagattgagggtgggtctgcctctcccagtccactgactcaaatgttaatctcctttggcagcaccctcacagacacacccaggaacagtactttgcatccttcaatccaatcaagctgacactcaatattaaccatcataatggtagattaatttacacccctaccagtagttatactcatcatcacttgatattgtcaatcttattaaaagatgttttctttactaacttagattatacataataaatgataattttatttttaaaattaaagaatgagagaccctatatatcaatttatgtttgcctgctcagaaaaattcatacagaaaatctgatatgttagcccctaatttaaccaatatgttaaatcttaactagcctttaatcttaaaatgataaagaatctccacagcgtatattatgtaatttatatactgaactgattttcattctcaacagttgcctagtagtaacattagtgtagctatgcagaacaaagaaagaatacctaagccctagataacaatttctgcacacatactctattaatagcactttccaaaattatctacgatctttttcttagaactcaaatccaaagtccttttttcaaatgtaatcttcaaacttgttttggcatttgataccacctactacccattctttcataaaattcctgtgctggctgggtgcggtggctcacgcctgtaatcccagcactttgggaggctgaggcgggcagatcacaaggtcaggagtccgagactagcctgaccaacatggtgaaaccccgtctctactaaaaatacaaaaaattagccgggcacggtggcacgcgcctgtaatcccagctactcaggaggctgaggcaggagaatcgcttgaaccctgcaggcggaggttgcagtgaaccgagattgcgccactgcactccagcctaggtgaccgaaaaaaaaatttcctgtgctttctacttatctgtaccctgcttctctgttgtctgtgtcctagtatctcatctccctgaccggaataattttgtctgtttcctgagtttttgttcaaggctgtttgttcttctcctattaaaatttgcctggcatcttgagttcatattatcagccttatttggatgctcctaaatttacatcttcaatccagacttctcacctgcctaatggccttatattttcagatacctagaaggtatcaccttttatctcattttctcaaatttaaatatccaaagtaaaactcaaaatgttgatattcattttctctctctgcctctgccatcctctctaccaccctaaagtcccaacattccccattctccatttagcaaataaagatagtagaaagaagtgttttattaagcattgataagtagcaaaagatagaataatttctattgttggttaaatgaaagataagggaaggaatgacacattttatataacgcttattaggaaagaaatgtgctgtagtccaagtaatatgaaatattattaattttaatattcattcaccaaacaccaatcattttacagtgataatttgggatagttaggcaagttaattttggaaaatagtgcaaaagtagagctagatcattctaattgaacaatgataatagttcagttcttttagtgttccaaaaataaaataataaatatatgctaaaatttaaaaataatttattcagcataaataaatgataactatcatcttgaaaaagtaattgctctgggtagtaacaaaaagcctgtctttccagtgaggcactaatgtcctctgaatctaaatggagttattttcaaacttttgagaaaagcatataatttatcagggtgtcatttttaaatgtggaagcccttaatctcataaggaatgaggagagccactgaaattctttaatattctctaacatgcaaacaaaaagtagggtaatactgaggtgagttccctggtgataaccctggcaacttattagggtttaatataggcaaaataatgggaatgcctagatgttccaggcattattctagcagattatcagtacattctagtaggacagattaaaaaaatgtatgtattcatgcatacatccatatacatacacatatatatttatacacacacacacatacacacacatatatatacacatacatatataatcataggtgtaagtgctatcccgaaaagaaatagagcagagtaaggagtaccatggggtgggtgttgcaattttaagtaggatgatcagggtgggccttgtggagaatgtgatacttgagcaaagatgggaacaaggcaaggtagtgagccaagaagatatctggtatggttatatttagtaggtttttttttacttgtttctcactttactcctgaaaggattcagtgcctgcattatttaggtggtcaaaactaaataaaaacttgatatattaacattttattcctttggtaatatagggggaccatgctaaagagaacttagtccactctggggaagtgctacgtcaaacttttgtttgactgtcagagctctcactggggtacctaccatgctgccacggggtggagtatttcactgtaatgtttctataccttatgaaattgacttagattgaaaatatcccaccactttagcccctgagcctgattctttttaagtgcagattttctaatctaaaaatcaaataagagagaatatgagaaggttcaatggaaaatcctaggtaatgtatagctgtgtaacagtgactctttggaaacgtttcttctgatgttattatctattgagtggaataatgctgattatttctggttagataaaggggaaggcagataagaccttagggtagcccataaatcacatagtataggaaattaccttttccaattatgtagaagctgcccttgttgctgactttccccattattcaccatcactataattgggaaaaccagaaagcttggcaagagaaatttgaatagcgagctcttagtttgttatgttgctgctatcactggtataaacacaggtgtagttttacaggatgtttggtgattattctatgcagaaacctaatagtcgtgtcacaaatttctacctcagtatccagaatcctataatctgttttgggaattttccttttacttatatgtaattttacagataaatcctcagttttctagtatggcatttcaccactgatgctgaaattagaacattgagggcttgtaatttgaaaatgtaaagattagaaattatatttcatagtcgggtgtggtggctcatgcctgtaatcccagcactttgggaggctgaggtgggcagataacctgaggtcgggagtttgagaccagcctgactaacatggagaaaccctgtctctactaaaaatacaaaattagctgggagtggtggcgcatgcctgtaatctcagctacttgggaggctgaggcaggagaatcactgaaacctgggaggcggaggttgcagtgagctgagattgtgccattgcactccagcctgggcaacagtagtgaaactccatctcaaaaaaaaaaaaaaaaaagaaacaaagaaattatatttcatttgtcctgtctatatatgatccaatgtacttttgctttctggcttctggtttctgcattttttttttttttgagacggagtctcgctcggtcatccaggctggagtgcagtggcgtgagctcagctcactgcaagctccgcctcccgggttcacgccattctcctgcctcggcctcccgagtagctgggactacaggcgcccgacaccacgcccatctaattttttgtattttcttagtagagacggggtttcaccatgttagccagggtggtctcgatctcctgacctggggatccacccgcctcagcctcctgaagtgtagggattacaggcgtgagccaccgcgcctggccctggtttctgttaaactggacatgccactttaacattagctcattctttatttgcttagccaattatatacatttttacccttgcaacaaagaaggataggcatagatgttctggacttattgttgaaggagaatccaggttaataatctgactaggctagtggacaaatttaagtaaggaaaggaacatagttaactatcataggtctgatacacacgtttcagtgttaaagaggaatcactaatagtctattattcacagataaactgaggtacatgaaaatgttaaagagtttattttagcaaataaactcttgaatccagcaatcccagatgataagtggctcaggagttccacccaagaaacatgaggtgaagacttttgtcagatgaatacagaagcaaggcaaagaaaatagtttgattggctaacgtggagcggtagccttatttggatcattcaaatgaaaagtccccagttagagattagtttcgaattgattacacttaattttcgttttcctaaaatgtgattgttacactgagttgggtttcagtttgcttacataggatcccaggatgctgggtcccctcagtcttatggcctcctgattaattaattttaacactaggaaactgggaaacagaatctgggactgaagaagagggtctgagctaagaaaaaagtcctaaacagaggtcagagacactaggcaaaggaaaaagtgtgccaggaattcaataaacttggtgtggagctaaagcctttacaattatgggctttcctactgataagagtagatcactgcaggaaggacactcagaggacacctggtctatgaggctattggggaggatggaactccatctaccacaagtgagatttggtattgtagaaatagcaaaaaaaaaaaaaaaaaaaaaaaaaaaaaaaaaaaaaaagtctccttgtgatccttaaaaaaagatttgagccctgtttgaggttgatcttttatatgaattaaaagtaattatatctcaaagaatcagtgtaaaatgtatgtattgtttggtttcatgaccctttgttattacttaccactctaccactgcagttcctaggtactttaattcagttgccatccttcccactctctctgagctccataatagtgctgatttaacaaatactcactaaatagacaaaaccctacttaccattaattatgaactgaaatgaagcataaatgtggaataaataaaggatataatgagaaaatgtacaaaatgcttcaaatgcaccagtacccattatatatcactctaaaaattaatcattatattaaagttatagtgacaaaatgttttttactaagcagaagtaaaatttttgtgcattctttctctatcccacctcatattttgaatatatctgcaaagctggtttaaatcttgcttaaaattttatgttaaaaaatgtatgcacatcacataaacatggtaatgctcaattgtccattaaggaagacatttcacattttcaacatgaatgcttttctattctaaacatttttattaagccatttattcaaccagaggcctgcacagtaagcaatagtgtagttgtttttcaactagtactctgtcaggaacttagatagaaataccacattgagaaaaaaagtctttaacagaaatctaaaaacaatcattggtgttggactgtaaaattagtttagagttggattttatgactttttaaggatactacctgtaagttcttttactatttttaccatttctcttaaattttcttctattgatggttgttttaaattacgtgatgccagagattgtatttgtatcctttttctccactcggaaatgctttttatactgccttgaatagtaccatgtatttatgtattttaaaggtgttttaagacatgcttggtaaagatgttattaattgcttatgcatatttcactgattgacatatacaataaaatagtaaattattaaactttttaaacacccagccacaaatattgtttccttgatattgcatgacaactttgcatagtgctctattaagtatttaatataaacaagatatctctctctccacccacttttcctctccgtcttctctccattgcaacttttctggaaacttcttcctagtccagtagtagctggaagagaattcctcttattccaaaaaagtaatctccctatttcaaagtacaaataaatcaatatgtttgcagatcccagcttcatattgtatggcggtctttaaaaaaaaaatgtggttaaaaaaaaaaaaacataacctgagatctaccctcttaagaattttttaagtgaatagtacaatattgttaacgacagatataatgttgtataacaaatctccagaacatttacatcttgcatgactgaaactttatgcccattgcaccacaactctttttttttctttctttctttctttttttttttaatcatactttaagttctagggtacatgtgcacaacgtgcaggtttgttacacaggtatacatgtgccatgttggtttgctgcacccattaactcatcatttacattaggtatttctcctaatgctatagctccccctgctccccaccccatgacaggccccagtgtgtgatgtgccccaccctgtgtccaagtgttctcattgttcaattcccacctatcagtgagaacatgcagtgtttggttttctgtccttgtgattgtttgctcagaatgatggtttccagcttcatccatgtccctgcaaagaagatgaactcatcattttttatggctgcatagtattccatggtgtatatgtgccacattttcttaatccaatctatcacagatggacatttgggttggttccaagtctttgctattgtgaatagtgccacaataaacatacatgtgcatgtgtctttatagtagcatgatttataatcctttgggtatatacccagtaatgggatggctgggtcaaatggtatttctagttctagatccttaaggaattgccacactgtcttccacaacggttgaactagtttacactcccatcaacagtgtaaaagtgttcctatttctccacatcctctctagcatctgttgtttcctgactttttaatgattgccgttctaactggtgtgagatggtatctcattgtggttttgatttgcatttctctgatgaccagtgatgatgagcattttttcatgtgtctgttggctgcataaatgtcttcttttgagaagtgtctgttcatatctttcacccactttttgatggggttgtttgtttttttcttgtaaatttgtttgagttctttgtagattctggatattaaccctttgtcagatgggtagattacaaaaattttctcccatcctgtaggttgcctgttcactctgatgggagtttcttttgctgtgcagaagctctttagtttaattagatcccatttgtcaattttggcttttgttgccattgcttttggtgttttagtcatgaggtccttgcccatgcctatgtcctgaatggtattgcctaggttttcttctagggtttttatggttttaggtctaacgtttaagtctttaatccatcttgaattaatttttgtataaggtgtaaggggggaatccagtttcagctttctacatatggctagccagttttcccagcaccatttattaaatagggaatcctttccccatttcttgtttttgtcaggtttgtcaaagatcagatggttgcagatgtgtggtgttatttctgaggcttctgttctgttccactggtctgtttctctgttttggtaccagtaccatgctgttttggttactgtagccttgtagtatagtttgaagtcaggtagtgtgatgcctccagctttgttcttttggcttaggattgtcttgacaatgtgggctcttttttggttccatatgaactttaaagtagtatttccaattctgtgaaaaaagtcattggtagcttgatggagatggctttgaatctataaattaccttgggcagtatggccattttcatgatattgattcttcctatccatgagcatggaatgttcttccatttctttgtgtcctcttttatttcattgagcggtggttggagttctccttgaagaggtccttcacatcccttgtaagttggattcctaggtattttattctctttgaagcaattgtgaatgggagttcactcatgatttggctctctgtttgtctgtttttggtatatagaaatgcttgtgatttttgtacattgattttgtatcctgagactttgctgaagttgcttatcagcttaaggagattttaggctgagacagtggggttttctaaatatacaatcatgtcatctgcaaacagggacaatttgatttcctcttttccttattgaataccctttatttctttctcctgcctaattgttgtcctggccagaacttccaacactatgttgaataggagtggtgagagagggcatccctgtcttgtgccagttttcaaagggaatgcttccagtttttgcccattcagtatgatattggctgtgggtttctcataaatagctcttatgattttgagatacattctgtcaatatctagtttattgagaggttttaggatgaagggctgttgaattttgtcaaaggtcttttctgcatgtattgagataaccatgtggtttttgtctttggttctgtttatatgctggattacgtttattgattttcgtatgttgaaccagccttgcatcccaggatgaagcccacttgatcatggtggataagctttttgatgtgcagctggattcggtttgccagtattttattgaggatttttgcatcgatgttcatcagggatattggtctaaaattctctttttttgttgtgtctctgccaggctttggtatcaggatgatgctggcgtcataaaatgagttagggaggattccctctgtttctattgattggaatagtttcagaaggaatggtaccagctcctccttgtacctctggtagaattcggctgtgaatccatctgatcctggactttttttggttggtaagctattaattattgcctcaatttcagagcctgttattggtctattcagggattcaacttcttcctggtttagtcttgggagggtgtatgtgttgaggaatttatccatttgttttagattttctagtttatttgcatagaggtgtttatagtattctctgattatagtttgtatttctgtgggattggtgctgatatcccctttatcattttttattgcatctattcaattcttctctcttttcttctttattagtcttgctagtggtctatcagttttgttgatcttttcaaaaaccatctcttggattcactgatttttttgaagggtattttgtgtctttatctccttcagttgtgttctgatcttagttatttcttgccctctgctagcttttgaatttgtttactctcgcttctctagttcttttaattgtgatattagggtgtcaattttagatctttcctgctttctcttgtgggcatttagtgctataaatttccctctacacactgcattaaatgtgtcatagagattctggtacactgtgtctttgttcttattggtttcaaagaacatctttttctctgccttcattttgttatgtacccagtagtcattcaggagcaggttgttcagtttccatgtagttgtgtggttttgagtgagtttcttaatcctgtgtcctaatttgattgcactgtggtcggagagacagtttgttgtgatttctgttcttttacatttgctgaggagtgctttacttccaactatgtggtcaattttggaataagtgtgatgtggtgctgagaagaatgtgtattctgttgatttggggtggagagttctgtagatgtctattaggtctgcttggtgcagagctgagtttaagtgctggatatccttgttaacctgctgtctcattgatctgtctaatgttgacaggggggtgttaaaatatcccattattattgtgtgggagtctaagtctctttgtaagtctctgaggactagctttatgaatgtgggtgctcctgtattgggcgcatatatatttaggatagttagctcttcttgttgaattgatccctttaccattatataatggccttctttgtctcttttgatctttgttggtttaaagtctgttttatcagagactaggattgcaactcctctttttttttttgctttccatttgcttggtagatcttcctctgtccctttattttaagcctatgtgtgtctctgcacgtgagatgggtttcctgaatacagcacactgatgggtcttgactctttatccaatttgccagtctgtgtcttttaattggagcatttagcccatttacatttaaggttattattgttatgtgtgaatttgatcctgtcattaagatgttaggtggttattttgcccattagttgatgcagtttcttcctaccatcgatggtctttacaatttggcatgtttttgcagtggctggtactggttgttcctttccatgcttagtgcttccttcaggagctcttgtaaggcaggcctggtggtgacaaaatccctcagcatttgcttgtctgtaaaggattttatttgtccttcacttatgaagcttagttcggctggatatgaaattctgggttgaaaattcttttctttaagacttttgaatattggccccctctctcttctgtcttgtaggatttctgctgaaagatccactgtcagtctgatgggcttccctttgtgggtaacccaacctttctctctggctgcccttagccttttttccttcatttcaaccttggtgaatctgacaattatgtgtcttggggttgctcttctcaaggagtatctttgtggtgttctctgtgtttcctgaatttgaatgttggcctgacttgctagtttggggaagttctcctggataatatccttcagagtgttttccaacttggttccattctccctgtcactttcaggtaccccaaacaaacgtagatttggtcttttcacatattcccatatttcttggaggctttgttcatttctttttactcttttttctctaaacttctcctctcgctttatttcattgatttgatcttcaatcactgataccctttcttccccttgatcgaatcatgtgttgaagcttgtgcacgcgtcacgtagttcttgtgccatggttttcagctccatcaggtcatttaaggtcttctctacactgtttattctagtcagccatttgtctaatcttttttctaggtttttagcttccttgcaatgggttcaaacatcttcctttagctcggagaagttggttattaccgaccttctgaagcctacttctgtcagctcgtcaaagtcattctccatccagttttgttccgttgctgtctaggagctgcaattccttgcaggagaagaagcgctctggtttttagaatttgcagcttttctgctctgatttcttctcatctttgtggttttatctacctttggtctttgaaatgggtgacctccagatggggttttggtgtggatatcctttttgttgatgttgatgctattcctttctttttgttagttttccttctaacagtcaggtccctcagatgcaggtctgttggtgtttgctggaggtccactgcacaccctgtttgcctgggtatcaccagcggagactgcagaacagccaatattgctgcctgatccttcgtctggaagctttgtcctggagggtcacccgcctgtattaggtgtcagttggcccctactcggagctgtctcccagttaggctacacgggggtcagggacccacttgaggaggcagtctgtctgttctcagagttcaaacctccgtgctgggagaaccactgctctcttcagagctgtcagacagggatgtttaagtctgtagaagtttctgctgccttttgttcagctatgccctgccccccgaggtgggggtctacagaggcagtgggccttgccgagctgcagtgggctctgcccagtttgagcttccccagccgctctgtttacctactcaagcctcagcaatggtggatgcctctccccctgccaggctgctgcctcgcaggtcgatctgtgctagcagtgagcaaggctccatggacgtgggacccaccgagccaggcgcgggatataatcttctcgtgtgctgtttgctaagaccattgggaaagcacagtatttgggccagagtgtcccgtttttttaggtatagtctgtcacagcttcccttggctaggaattggaaatccccctaccccttgcacttcccaggtgaggcgatgtcccgccctgcttcgtctcgccctccgtgggctgcacccactgcccaagcagtcccaatgagatgaaccaggtacctcagttagaaatgcagaaatcactgtcctctgtgtcgatcatgctgggagctgcagaccggagctgttcctattcggccatcttggagagctctctgtttttttcttttttttgagacagagtctctctgtcgccaggctggagtgcagtggcactatctgggttcactgcttcctcctcctcccacgttcaagcaattctcctgcctcagcctcccaagtagctgggactacaggtgcacgctgccacatccggctatttttttttgttgtattttagtggagacagggtttcaccacgttgcccaggctggtcttggaactcctgagctcaggcaatgcgcccaccttggcctccagtagtgctaggattacaggcgtgagccaccgcgcctggcctgaacaacaactcttgtatttctctctcaccccatcacctgtcgacaaccactttgagttttttttgatgagtttgactacttgaggtataaatggactcatgcagtatttgtccttaagtgactagcttattttaattaccataaagttagctatgttcactcatgctttagcatatgatagagcttccttattttttatgactcaataatattccaccgtatgtatgtatgtatgttttctttatccactcatccatctatggacatttagcttgttttctcctcttggctacaatgaataatgctgcaatgaacatgggagtgcagatatcatttggagatactgacataaattcttttggatcaatacctagaagtgggtataaggataaaagggtcaccatcttgctgttgtcattcccttatttgtctgtcttttgcatcagtatatgaagtaatagaaaattaattgaagaaggagagagatgcatatgaaaagatgctcaacatcattgatcatcagagaaatacatattaaaattacaatgaggtatcatctcacccaagttaaaatggcttttgtctaaaagacaggcaataacaaatgctggtgatgatatggagaaaagggaaccctcatgcactgttggtgggaatgtaaatcaatacaaccactatggaaagcagtttggatgttcctccaaaaatttaaaattgagctaccatatgatccagcagtcccactgctgggtatatacccaaaagaaaggaaatcagtatattgaagggatatgtgcactcctatgtttgttgaagcactatttacaatagtgaagatttggaagcaacataagtgttcatgaacagatgaatgcataaagaaaatgtggtacatatacacaatggagtactattcagccataaaaagaatgaaatcctgtcatttgcaacaacatggcaagaactggaggacattatgttaagtgaaataagccaggcacagatagacaaacttcccatgttctcacttatttgtgggagctaaaaaatcaaagcatttggactcaaggatatggagaatagaatgatgattatcagtggctgggaagcgtagtgatggggaagtggggatggttaatgtgtacaaaaaaatagaatgaataagacctagtatttgctagcacaatagggtggctatagtaaaaaataatttaattgtacattttaaaataactaaactaactaaacgtgtataattggattgtttgtaacacaaaagataaatgcttgaggggatagctaacccatttaccatgatgtgattattatgcactgcacgcccgtatcaccatatctcatgtagctcataaatatatacacctactatgtacccacagaaattaaaaattgaaaaataggcacacttccaggatcaaaaaaagaaggaaaaagatggcttaattattgtgagtttccaaatcatcagataaatatgccatatttaaatgcaaacaatgtcatattaactttttatatattggaggctattttctttcgggctgctataacaaagttatgttaatatgtcacccaccatagactgggtggcatatttaacaaaagaaatttatttctcacggttctggaggctggaagtctgagatcagagtgccaaggtggtcgggttctggtggtctgggttgcagactgctgacttctctttatattttcacatggtagaaggagggcgagagaactctctggggtccctaataggggcgctaattctattcatgaggtctctccacccttgtgacctcattacctctcaaagttccccccaatcacattgggggttaggatttcatcataaggatttgggggcacacaggcatttagcatttttgtaacaaaggaaaactatatactgtattcccctctgaaaattagtgaagtgtgttagctgttgaaacttctaagaagtctttggtttaactttctttcttttttttttttttgctttttttgagacggagtctcgctctgtcgcccaggctggagtgcagtggcgcgatctcggctcactgcaagctccgcctcggttcacgccattctcctgcctcagcctcccgagtagctgggacggcaggtgcccgccaaaacgcccggctaaattttttgtatttttagtagagacggggtttcaccgtgttggccgggatggtcacgatctcctgaccttgtgatcagcccacctcggcctcccaaagtgttgggattacaggtgtgagccgcggtgcctggtcagtttaactttctttaaacccagcatttcttaaatctctaggatgatgcaaaagtaattgtggtttttgccattaatggcaaaaccattacccagcaacctcttttggggttacccaggaacctcttttggggttgggggaatagtatccactaagtatccacttgtcttctgaggcaaggcactgcttttctactgcctacagttaggttagtgctgaatggtatatttaagtataaagtaaccccaggtcacatatggctacttaaatttaattaaaattgattaaaattattcagatcatcagtcacattagccacatttgaagtgctcagtagctgcaagtggctagcgactatttttattggacatatccataagaaagacacatattgggatccgttttgtcacctaacatccctacccccaaagaatttactgatttgttatttgtttttgtgattttacattaactgaataatgttacaaaactagtcttaaaaaaaatctgttgctgctttcaatataacaatgttgtatagcaatggtcccccaactttttggcaccagtggccgattttgtggaagacaattttaccacgggacgggcggggtgcggggatgtggggatcgttacaggatgtaattgttccacctcagatcatcaggcattagttagattctcataaggagtgcacaacctagatactttgcatgtgcagttcacaataggatttatgctcctatgagaatctaatgctggtctgacaggaggtggagctcagagagtaatgctcattggcccgctgctcacctcctgctgtgaggtatggttcctaacaagccacagtagtggtctgttgcccaagggttggggacccttgttgtagaggacagtgtgcactgttattgtgttttttgtatgaaaactcctatgagcccttttatttggttctaaaagttagaaaatcctttgcttctttgaaaagtaactgattatatttttatttccttttatttgggcaccagaaaacagttaaatctttgtcctaacattctttttaatctcattctattctgatttatatttttttctattcctgttttctctcgatatttgttttcatagttttgcaaaatacttcaaattccataagagcaaatcaggtataactgaacattagtgaattacagtcttttttcacaattcatcataagtggtcaacattcttggctgtccatttttgcagggcatttgatagttgagccatttttccattacaagtgtttctagtatcaatggttaagttttctgtattgtctgtaagctgtttcttgctcaggtatcttataatcaatagtacatgatacagaattcctgagaagtaggaatagaaaatctatttgtagtctgtgtttctccataaggctttagaagtagacgagactaagcagctttgtttctaattcagtatttggaacttattgtatattcattcatttactctttcatttattcattcattcagtaaatatttgttgaatgcctgctatgcactgagcacttttctgggtgctgaagatgtagcaagaagacaagaagacaaaaaaaattccctccctcaaggaactgacattttactgagattaagctcaaattccaattcattaaactcttaatttttgagatcattaaaagaaaagattgtctcttattggcatctcctctccacgtacaccgaaagttatttcatttccatggccttatttgctgtggcagtaagagagataaataggccaaatcgaactgggaggcaggaggaagaactcttgtccaactttcattgtattcaagaattcaagaatatgagtgagaaaaggctgataagaaatatagtttgttgatcctaggctgagtgcaatggctcacacctgtaatctcagcagtttgggaggccgaggcaggcggatcatttgaggccaggagttcgagaccagcctggccaatgtggcgaaatcccatctctactgaaaatacagaaattatttgggcatggcggtgcacgcctgtagtcccagctacttgggggaccgaggtggggggattgcttgagctagggaggcagaggttgtagtgagccaagactgtgccactgtactccagcctgggtgacagagcgagactctgtctcaaaaagagaaaagaaaaaaagaaatacagtttgttgatcctaaaatatttggagagcagatttatggtcaaaataagacatagtctctgagacctactctgttcttagaagtaatcaggaatatttatagttgattggttttcaaaacaaaaatgcaaagcagttaaatatatatttgctaaacttattgaacacttagtatatgacagtgttctgaatgctgaagatagatcaatgaacaaaacaacaaaactccctgccttggagcttgcagtaaagagtagaaaccatgagagcaagtaattgactaaggaagcaagacagtgagtgctgtggagagaaagtgctataaaaagaattaaaatggaaagatgtgatagtgatagactaacccctttatagcgatacttagaaaaggctttcctgatgtagtgatttgtaacctgaaacctgaatgatatgaagaaaccagccacatgaagatcaggaggaagacctttctaggctgagggaacagttaaactaaaagcctttaatattggaaagaacttggtctggtggcaaaacaataagaaagccagtttgggtaggaagtagtatgagcgccaagtgataggagaatcgatcacagagtgagggggaggccagatcaagtagagctgtttacttatgttaactgaactaaaactactatttgtctttaaagtaaaatgctttctgagtagccagtcctgagtactttccagctgctcataagccaaaagtcaatcacaatagtttaggcttcacttaaacacaggcaatctaatgttccattctttcatttcatttcattatttgttttatattctccttcactcttttttttctcctggtgaagcagcagaacccattgactttttgctgtactttggatttcagtctctgacttccttgcacatgtgcacacagaaggaaagagctgtgaaagagcttcagccaaggggttgggaagcaggagtccagaactttctagtttgctagatggatatgcagtcagtgatgatcacacccatgtctcactggtgattgattgaatcaaccatttaacatttttgaggttatttaaaaagttggaaataaagtgaaatctctaaagaatatactaatatttataattttgataatgaattttttttgttcttttaagttactttatggttgaaatgcagcttttcagtcttaaatctcatatcagtcaccttcccataattttaagactgcagtatttatttggttctattatataacttttatggcctttgaaagtaagagagtgaatgtaactgatagttttctgtcacttatactggtactggatctgacttttagctcttttaaaagttattttcactttggaaacactttaaagatgcattgaactctttttctacagctctataatccatttttatacacaagacatagtagcataaggctcccacatacaaggctcacaacaggcaaaattccatatgtctgcttcagatttgcctgctgaatacattgttgtggctgcttctaaaacattaaagacatacctgccaggttgtggatttttttttttgtcttgactttttgaaagtttctgcactattttttcttagattacatatagaatataaagtacagttaagtcctatgaaagatgagaatcttatagaccttctggccacaagaaaccatcaaatttacattaaactctacttctctgtattatcaatttctctcaataaaaatatgaaaataattattatggcatgatacagtaaaacacaggaatagtggatttagttccctgaatactgtattcctttcttccttcccttcctagtacccactggcttgctgttggattgtgcatgaaattaaaagaaacttgaatacattgtgccctggaattgtttgaatgaaagtgattgcattaattcaaaggtttggatgcctttaagcatacgttgtaaaatttttaactggagagataggtgaattttaaaaattagagacatttcaaatcagtaaaatgttactagagcagtagacaaagtggggggaaaagataaattgattccctatatcataccatttaccagaataagcttcagaacaatgagttataaatataaaaccatacacaaactaggcctgaatataggtaatatttacttgaaataagagcagctttgtgaaaataaaaacaaaagtagaagataaaagaatatatttttgactgtacacaaatgaagaacttttataaatcaagaacatagtatatactattaaagggcaaatgccgattttataacaattttagacaattttgataatggattaataactttatgagtattcttatatagcaacatgaaacatgtgtatcctaatagaaatatgaacaaaggtattgaacatagtattcataaaatataagttacatatatgatgtgcatggtgtatatggtatgtatgagtgggcttgtatgaatgtggatggctgtgcatatattcagcctaattagcaatagaagaaatgactattaaaagaatactgcagtttaatagacaaaaaggatctaaaataatgatctgatatgtgagggtgcagagaagcatgcactctcatttcatgatggttggtttgtagaatagtacaacctttctggagggcagtttagcagaatgaaacataagcaatgaaaatatttatattcatgcctagcaattccatttctagaaaattgtcctaatgaagcagatgtataaaaaatatatctgtagtattcacttcagaattatttctagttgtgaaaaattagagcataaatgcccaataataaaggaattttaaaataattgtatgataatttaaataatctatataattatatgggagatgtttatgatatagtaaatgataaagcagaatgtaaaagatatgtacagccaatagtatgaccccaattttctttaagaatatattgcacatgggaaaaatgattagaccaagtgataaaatatattaacagtacgtctctctatgtgagaaattatggtgatttttaaattttcttctcttgcattaactctgttttccaaatttttaacaatgaacttgtattagttgtgaaatgaggcaaaaggaaaaaatgataaaggagaaagggttcaattatattatctttattctctcagtgttgcaattaatgatagaattaataagccctatttttgccttgtttaccaactttgagtttagcaacaggaactatttgtattccattatgtttataaaagatggaaatatattttctgttttttcttggtggaaggggcaaagtaagccacagcaattcttttagttagcatttcttttagatattcaaaaggacaagtatgttatatactcttgatttgattaaaggaaaacatatataaagaaatataaaggtatatatataaataaagaaatatatatataaagaaagatgtataaagaaagaaaatagatatataaatatcttcacctttccctccacactctgatcattctagtcacatctggtcttaaactttagacaggacatcatattagtaatttattttcaccacatctgtaggggtcttttatttgtagattctatagtgataattaatttaatgggagttaacatttagaaatagatttgtagccaggttttgtgctcttttaatgggctgggaagctaaaaataacgccttgtaagggaaacaattgcaaacagatgaaatttaactgagcaccagacattcagagttgaagagcacacatgggggaaattgtatgtccttaaattatcaacttactggaaatgaaatgctttggtacagatgtgaagagtaaaacaaaaacaagtctggtagttggttacatcttcccgtctgctcttcgtattacaagtaggagtcccactgtccaagctcatgacactaagctcttaaaaaaaaaaaacaaataaatgctttacaatgtcagctttagataatatattcagaaagagatgataacatcatgtatagttgtaagggacaaatatgctagttcaatttatctacagatgttcattgggatgcttcccctcaaagtgtttttgattttctcaaaagaccaatctcaggagctatttaagaaaatgtcatttgatttgcatatgtaaacaatcaggtctatgaaccatatgattttatcccctaattatttatgtaagggtttaaagtgagcatacatcacctatcacaaacctatcctgcaaattagcaaatgcatacactaacaaagacaattgctctgcttagctatatctcttaaggtgagacatttaatcccttggtaagtggttgtttatatgtaactaaaataagcttttccctccttcaccagtattaatgtttttctttctttttttttttttcttttttgagacagagtctcactctgtccctgaggctggagtgcattggcgtgatctcagctctttgcaacctccgactcccaggttcaagtgattctcctgcctcagcctcccgagtagctgggattacaggcgcatgccaccacgcctggctaatttttgtatttttttttttttttagtacatatggggttttgctgtgttagccaggctgatcttgaactgctgacctcaagtgatccactggcctcggcctcccaaagtgctgtgattacaggcatgagccaccatgcctggccgtattaatgtttttctaatacttccttaatcagataaaaatttcaatttgaaaaacttgaaatattgatgtaaattgtttgattactacatgtgttttcttttttttttttttttttttactattttgctaaagaatatggttagttataagttgatactatgtatatcttcatggagatttttaagtaggtttttttattggccctgtttatatgtgtaggaaattatgctaaatcacaaaactggaaacaagagctatttcttgctgtgtaagtcagtttatcaaaaatctagatagctgtaataatctttttttccttgttacatgagaacattctgtattctctatcccttaataatgattattttaagttatacttgaatgttccactggcattttacacttattatatctaatatggactttgtaagttttcgttattacctactctagtcactcctcatctgccttctatgtagtccttattactgttaacatcatcattcactcagttaaacaaatctgggtaacctgtccctcattccttcactctattctccagggtcaaccactcctccttatctatcagttcctgagtagtttcctgaatcttcaccttcatcttctctacatcctatctctgaactcatcctccagaatgccttcagaattacttttataaagcttagtctcctctctaccacttttaaaaaatataattcttttaattttgtccagtgttcaaataaaacactcctagaaagagtatttcttcatgaattcctttttcttatatcactatttggctcatactttcactgcatttttgtaatccaagtccccctaacacaaaatgagcttaaaatatggttattttggccgggtgtggtggctcacgcctgtaatcccagcagtttgggaggccgaggtgggtggatcactcgaggacaggaattcgagaccagcctggccaaaatggtgaaaccccatttctactaaaaatacaaaaattagccaggcgtggtggtgcatacgtgtaatcccagctacttgggaggctgaggcaggagaatcgcttgaacccaggaggcagaggtggtagtgatctgagatcacgccactgcattctagcctgggcgacagaacaaggctctgtctttaaaaaaaaaaagaaatgtggttttaatggttaaagccattaaaaaacccttaattatataaagcaaataataattacaattaggacatcagagaaaaatgcactttactatcagttaccaatatgtgaattaccacccttttacgttatctgtgagagtcaaactgtataccaccatgtaagttgaatatgtgtacactttgccttggggaggagctctaggctgatgtttctaaatggtgaggaacacaccacacctgatttgtaaagtcagagaaggctagagctggaatcgatcatttagtccaaaaccctcttaaaattttttaaaatttattttatttttattttttagagatggtatcttgctatgttgcctaggctggacttaaacccctaggcccaagtggtcctcccatctcagcctcccaagtagctaggactataggcttatgccattgcacctggctcaacactctttttttaaagagggaaagggcagggtcttacccaaggttatatatctagttctagagctatattgctagttatagattacttaaatgtactatgtgaaatttaatgtttaaattatttggttgaaattattaaacatttgaaacacaattatttttaatgaagtgacaaatatgtattaagtttaaaatattttttgaaacacattcttgtacttgaacacattttcttgattaaatattggtataaagcaggaaatgatctattaaaacaaaacattcttagaaaacttagtagcagttactccatatcaatagttgagcctagattagatcataggtttaaagcatacttctgatattatctgttatctatctaacactttgaaatgatctgaatgtcttattgcaaaacacggggaagatattagctaaagatttaaagagaaaaagcaaaccaagggctggaaaatgattctctgagtagcaaattggcagagttaaggagtttattgcaaagaaaaaattattatgtctattatatagctattaaaccatagtccaggtgaagagagcatgttagattaaaaatagcattagcaccccaaaagatctggaaggctacttttcaaaggatagcaaaaccaattgtgttacagggacaaaccttacttagaccaataagttataatgcctttcaaactttttggtcttaggggccatttacactcttaaaatttttgaggaccctgaggaacttttttgtgtggttcatatctattgttattttctgatttgatttaaatctgagaaaattgtaaaacataagaacagtccatttgccgtcagagtgatgatgccattccaggtcatgaagcctctggaaaacaccactgtacacttgtgagaacacaggagtgaaacagacaaataacttttttttgttttggaccgagtttcactctgctgcccaggctggtgtgcagtggcgccatctcggcttgcagctgggactacaggtgcccactacctcgcccggctaattttttgtgtttttaatagacacgaggtttcactatgttgaccaggctggtatcaaactcctgacctcaggtgatccacccacctcggcctcctaaagtgccgggattacaggcgtgagccaccgcgcccagcctcaagtaacttttagtcttgttacaacaatagttttgaatttacatacacctctgacagggtcccaggaataccctggaatcctttgaccacattttgagagctgctgctcttctcacggaggtcagtgtatatggacccagtaaggacagcagtgaagcctgggacagggatgagaatgggcctgtattactagaattttgtcattttctcatctcctcttctcttaatggatcagctcattctctcctattggagagaggcttcttgatttggccgaagtcttagttatcagcagcaatgagagcaaacagactggctggacaacaatttctgtgtttcaatgccagtgcctagtgtgatgttatttgtcacatatgcatgtggaagatgtcttggccaaataactttgggaaattttgcatgctctacacctgtcccctccctttgaagaatcacaatgcacattaacatattaaattatctgaaatgtcctatggtagaaaaattaattacctttattgaactcactgtttccaaatcttaggtgatttcagagcatttatcatcatccatggatactagtgtctcacaaaagagtttagaaagttggatgttataaaatttttatttcatttttacattgtagaattttctactcccctttcaataccaggcaaatcgatgtgatttctgtgaataagtaagcaagccatatacatttatacaaatatgcatcatttgatggaaaggcagcacattgttgccagggaaaattgtatctaaatgatgtttagatttttgtttggaatataaatggatagataaatgaaattattccacttatacttttaaaatgccactgacggaagaaaaaaaaacccatattatctcaatatgtattgtcaaaaagtccttgataaaatttagcatgctttccgattataaaattaatacaataggacaagtacttatttccttaactggctctttcttgttattcaggtctcagcttaagtatcactttgtcaaagaaacctttcctaacttcctgcatgaagtagctcccactccctattgtattagtctgataaaactatatattgcaagccaaatggcactgttctgtttaatgctaaaacacttgaagaattcccatgtgaagagccagactaggatgttcacaatcactagtattttttaggcttttttccccattttttagagaggaagggggagtgtgtatctgccaatgcaattaaataagagagagaaggaaataaaaagatttagaaagatatatgtaattttttcacattatgtgactatctgataaagtatgtaaaaatcaatagcatttacatatatatatgtatatatatatatatatataaaacaaggcaaatgattgtgtgtgtgtggtttttttgtttgtttgtttttgagatggagtctcgctctgtcgcccaggctagattacaatggcactatcttggctcactgcaaccttcacctcctgggttcaagtgaatctcctgtctcagcctcctgaataagtgggattgcaggcgcctgccaagatgcccggctaattttttgtatttttggtaaagacatggtttcaccatgttggccaggctggtctcgaactcctgacctcaggccatccgcctgccttggcctctcaaattgctgggattataggcgggagctaccatgccaggcctaaatgattgataatggaataaaaagtcctatttagtatagtaataagagagagtcaatgacataccaatataatttcaacagaatttttctttttcttttttttttttaagaaattgacaacatgatgtgtatttttatctggaagtaaacatctgggaatagccaggaaaaaactggaacggaagtgcactgaaggggaactagttctaccaaatatatatataaaaaaaggttaaagttataggattaaaatagtttattcttgtttataacagagtcaaatagtagaccataatatatgcaggaatttactgtatgatagatgaggcatttgaattcagtaaagatcagttattcaatccaaaatttaatttgataaaaggatcataaagttaaatattacattacaggctaaaaaatatatttgcaacacatatggcaaagggctcattatcttaatatacaaagattttttacaaaataaatatgagtgggccaggcgtggtggctcacgcctgtaatcccagcactttgggaggccgaggcgggtggatcacgaggtcaggagatcgagaccatcctggctaacatggtgaaaccccgtctctactaaaaatacaaaaaattagccgggcatggtggcgggtgcctgtagtcccagctacttgggaggctgaggcaggagaatgacgtgaacccaggaggcggagcttgcagtgagccgagatcacgccactgcactctagcctgggcgacagagcgagactcagtctcaaaaaaaaaaaaaaaaaaaaaaaaaaatgagcaaatgaaaacccctattaaaaaagtggcagagcccctgaaaaggtagttcatagctacagaaatacaaataagcaataaaatgcatgaaaaaggatttaacttcaaacagaattaaataattggagatgaaatcagcaatgacataacatttgaaaaaaaaagtaacaaattaacaaagttttaaaatgttcgataatggtataagagagaatatggaaagaaagctcttccttctattgacacagtttttttcttttgtcatctttttggaggggcatttcgtgatatctaccaaaattgggcccagcagttccagttcttggcacgtatcctacacgtaatcctatacaaatatgtgaaggtacatgtaaaagaatatcagatgaaatattgcccctcagtgaaagactggtaaaatctgctgttactcttcccctggcttagtgtgctccaaccacagtagctttctatctctttatgggacatacccagtcttttccaccttaagacatttgtactagctattctttcctcttgggatgccttttccctaggttttttacgtgactttttttttcttgtcattcaggtctcagcttaagtatcatttcctcaaggaagcctttcctaacttcccactacaaagtagctcccatttcccatcatagtactctgttttattgtcatcatagtagctattactatttaatattgtcttctatgtttacgtattatctgtttctctagaatatggaaaggcagaataacttggtaattaaaagcattgactctgtagccatagctgggttcaaattttggctctgccatttacagtctgttggcacttggggacaattctaacttaatctctagtgctttcactttttaaaaaaaatctgtgcaactgtgattaagaatagaacctacctcacaaatttgtgataataaaatgaacttaacatttaaaacacagcactattgaggacatggtagacactcataaaatacttgtagatcaattgaattaaattatcatttattcatttaaaagaatattatgaaaccatctcagtgaatgaggtagatctgtatgttctgatatgaattttcttcaaaatgtagtgtgagtgaaaatagactgtgaaggtaacctcaaaatctgggtctttaaacaacagagactcatttcttgctcatgttacatatctattatgtgtcagtgagggtctctgtctcatgttgtcctcactagtgtcctgggctccaccatatggcgaaaggaagtagaatattcagagtggcattttagatgcttccatctagaagcactaccctccacttatcacattgcattggccaaaataagtcacatagccacacctaacttcaaggagtaggaaagtacgatcctactgtgaccttctaaggaggagaaccagaaatgttgatgaacagcaattattaatgagaatgtaataattgagaaaaaaggtacaaaagagtaggtataaagagagcctatttttcaaagatgtgtgtgtacttggatttatattataaaaatgtatggaacaatctgcaaaactaatagtggtctgctctgggaaatgggatatttactttttacattaaaccttttgtactatttgatatatttttcaatgtggacatatattacttccataactaaaaaaaaaattgtctcccaactgcctctcacatatactttgacaaagtgctattgcaaatactattacaactcagtaaacatgggatggcttatattgagagaaggaaactgattcacaatgagagaaaaggggcagaaatagataggttattttctgggtagagaagtacagagaggggctcctaaaagaccagtggcaatactaaagttctttataaactatctagtagagaggattgtgtggtagaaatttacaagctttctagtaacaaagtttcctgggtagttaagtgccagacagtaggggcagaccacaaaaatatttttatatcattttgtatttggatagaagaaacatattaaggataatatatttctgaatagatatcagtgataaatttgaagattctgaactattgcagaagactgggaaagttccctgaaagtctccatttttccatgatttcataaaagttgctgttggcaatgattccagggcttttcccaacttggaaattcttagttttcaaagtactttaaaagtaagatataaaattattttaagggaaaatgataagataatgttttatccaactctgcttgccaaattatttttagatatatatgaatatttgtgtatgatttgcgaacaatggaagaagtattgattttagataaaaatcacttctgttttagatttttgttatttgtagtgacaccagtgtgtgtgtgacaccaacacacacatacatacatacaacataattagatatatgtacacctaattagctcccttgtttttactttttttaaaattccttggaaatgcctactttttacaggggaggcacaaatatggaagttctgtatggaggcacagatttagctctaaagtatgtggaatggtaaattgaaaggattttggaattaaacatttattgaatcatctccaaagtagtataagatatttgtatacagaaaatgctgtgagagaatttgaagcaaaattttctattatccctaattgctctttgtaatatattttaaatattgatattaaatatttatttttaattagtgtgtatttaaaactatagttaaggtaggaaattatgatttagtgtattttaaatatgtatttttattcctttcctcagccttctgttaaaatgagttgcataatgcttacattttacataggaatgcaaacagtcctattttaagtctggtcagaatttttaaaggattaaattcaggtatttaaaaaaatcattacgtcattatataaagacaagtctagaaaaatcagatagattcacaggcctttttacttactcagtctcatgacttttctcaggggtttattttattttattttattttttgggactgagtctcactctatcacccaggctggagtgcagtggctcaatctcggctcacggtaacctctgcctcctgggttcaagtgattctcttgcctcagcctcccgagtagctgggactacaggtgtacaccaccatgtctggctaaattttgtatttttagtagagacaggacttcaccatgttgtccactagtctcgaactcttaatctcaagtgatctgcccacctcgctctcccaaagtgctgggattacaggtgtgagccaccaccacgcccggccaggggtttattaacatatatacatacaccatgagaacactatattttgtatctcacattcttgcatgatcatatttaagacaacaggatttgttcaacattcctagacacctagtatgtcaaggaatgtttctacataagtattatttattgaaataagctgcatttagactatgctactcaccatataaaggttgactatgcctaatccaaacatctgaaatctgcaatactccaaacctaaaatgaaatactcattagaatatttctgatttgggaattttgggttagtgatgctcaactggtgggtataaagcaaatattccagaatccaaaaaaatctgacatctgaagcagttctggtcccaagcatttctaacagggatacccacactggactcgggtggtaatctgcagcagctagtgaggtagcattcctgccaaacaatttgagatacattttgaagtatttggaaataggtgtcatattctccctttcctgagtttctagtaattataagcttttcacttcaatagttactcatgtataatcagtgagtttaagaaaattccagatatggtaattagatactaacacaatatggtgaaaaataggaactaatatacaaacttgcagattctttatatatttaatacagatggaagtccttgtttaaattttaatagtatgatacattaggagaaaaggacatatttggtaaatctatatcatatatagtgtcagattttacaggataacttgtaaggaagggatttatgagaaaaaaaatgttagcggggccaaacaatgtaaataaatacatgttggcaaatgtgctcaggagtattttgtaaggaaggagttataaacattgcctttaccttttgattgtatttgcaaaacaatgattcttaatggaaactaaaatttaaagtgttgagccatgagtgctcaactttcattgcatactctgtcataaagcatgctggaaagaaacaaaaacaagcctactagttgatcagttatttattgagtttttgttatttactcaacactacaattaagtgtggagaatacagaaagaaagtgtaacatatctttatttcagttaaaattttactgtttgacctgccgagagaggttaattggatagtcaaattggactttaaaggatcttcctgggagaagaccaacaagaacggaattttaaaaagtggcagtgaggaaactggctcaatccaaacacagggcatgtcctcagcaaataagggaataacaacaaaaccaacaacaataacaatggtgcttcacattaatcgaatacttattacctgctgaacactgttttgaagtgcctttagttcatgaactaatttaattctcacagtgcctccttccaaatagaggaaaaagagatctctcccctcttccatggctacctgggctgaccccaggagggcattaaaagcacctaaatattcttgggttggatggaaaatccttgtttgggattttaaagacctttccaaaagaggagtcaggggcattttgtaatcagctttcacctttccctaccctgtcaggcctaatgccaaatcggaaggaggagctttctatattttatacattgtaaacatttattgccttggaaatatattcttataagattttgttttagattttatgtttaaaggattttaaaaattgagtagagatttgcttttatcacaaagaatgctatttatgtacaaatgcagttatctgtttaactacaaaaaatgagttctctgtgttgtacatgggagggtgatgtccaagtatcacacttgaccaccagtctagttttaatctttttcttttacgttttttgaggcagagtctcactccagttgcccagactggagtgcagtgatgtgatcatggctcactgcagcctcaacttcccggactcaggtgattctcccatctcagccacccgagtagctgaaactatagatgcacgccaccacagctggctaattttttgtatttttagtagagacagggtttccccatgttgcccaggctgttctcaaactcctgggctcaagtgatctgcctgcctctggcctctgtcactgtgcctagccaagcatggaattttttttttttcataatttacataggtttttggagaacaggtggtgtttggttacatgtgtaagttctttagtggtgatttttagtcatttacccctcatccccctcccaccgtttctcctaagtctcttaaccacagaggtggtaagggccttgaaggctaggcaagaatttatggccaagtctttgccttataggattatataatctaatgatttagagaacttttgttatctagagtttaaggtactcataaaatgctgtttggttatagaatgaattttctcttgataaatgactgtactcaaaggcatattgatttccatataattatatagctagttatactctattttattagcaaaacagtcttgaattttgcataatttaatgaatataattaatgactaactattcttccttcctctgataggctaagtaatcaggctgacctagcccgattcattatactcattacagaatagaaaaaagaaaagctgcaaaatagtattttgcatgatggctctatttttctcagtttccaatcttagggacttgactaatttcattttaaagcagtacaggtatatatatatatatatatatatatatatatattttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcagcctcccaaagtgctgggattacaggcgtgagccaccgcgcccggcaggtatatatttaatacaaggaatagagacattctagccaaaatagtggtgaagtaaaattcacgtgtaaaatatccctttccttgcatgcttcaaagtaaagtggtgtcactggaaagatatacactggtgttttagatattagtttttaaaaatcatttaattattaggtaagggtgttttattttgtgaaatatggataaaaatctgaaatataagtcatattaggtaatgaccagttcccaaaggaaccttataaagagcttcatggatgaatgagtttacatctaataagatataaactcgctgataagtggctttctctctctctttctctgtctctctgtctgcctccttccctccctcccttcctccctccctctctctctctctctctctctctctctctgtgtgtgtgtgtgtgtgtgtgtgtgtgtgtgtagtactagtagtagtagagagcatagtcaaggaaataactacaagatgagatagtgaaaccttttgtttgatcaaaaaaagcaactctttgagcaattcagctccactggggcaggaactatgttttctttattcctccctctgtgcctagaattggtagatatttaaaagttttgattgtatcattgtaagtaaaagggggacttggattttggttataaaaacgtttatgccactttcaggaacagatatattgtatcataatgcgataattcttaattgaaatggcggcctttttgaactcttgtgggcacatcagaactattttactatatttagattgttcatgtgtggcttttggaacttatttcccatcgtgtaaatacagtgtattcatctgttgatcccctacttattaggcaccatgccgctactcttatagatgtcatcttatttaccagatatcttcagtatgtgtctgaaagcagatattttaatctcagtttttcaaattgggagatcgtgactcagaatttaagaatgctgcccagtaagttgcttggcagtaagctcttgggcttacatttgaactcaggttgtgtttgtcttgaatatccttgatggtcataaatctttatcttctaagaatggaaataatctttgaaaatagccaaaattttctcccttaaatttgatgaataagatgagtgactaaattgatcaaattctggccttaaaatataaagcaatgagacgtgttttattatttgggtggtaaactgtccctgaaggtaatttcttcagaatcaaaacagggatattcagcaatgttttcagcagtggcagcagaactatagtaagcatgtggcccctgagataactgtgatagtcaatacacattaggaagattaacttctgtttgttataaaacaaaacagaatagttattttatagtaacattttcatgatgccaaaataaatactttcatgtcattatctaattgtatacattgttttaagaaatgtaaagaaatactgtattagtacaaaattacaccatttatgttagtgtggaatgtttgatcattttatttctaagggaaaattacaaaactgtttagttcacctcagtttctataatgcagcctctaaagtctcatttctttaacagggccttgtgggtgttctaaaggaatgattgaaatgaaaagaaatgagagagtcaaacagtgtaccgtaatagatgaaatggaaagtaattatgttaatgttgactcattatgaagctctaaccatttttacctgctcatttctgtgtggaaacctgtgcagctgagatgctgaataagaaattcttgtacaaatgagcctagaggcatgtttctagtataggagctaggtctatgcagaattataatgaatttccctaagtcattatttaaatatgctatcagagtaggtgattctcctgccagaaaatttggcttctaatgtttatcatcaaatttttagatgtatatttgaatcttcattgctgcatgtaattctcatttgttaattagagagaaaaaaccctatattccacaatacatctatatcatatatagtgtcagattttacaggataacctgtaaggaagggatttatgagaaaaaaatgttagcagggccaaacaatgtaaataaaaacatgtaagtgcttaagaacgtgagatttggagtcagatgggctagattgaaaccaaatctgtctgactccaaaactgaagcttttattcatggtcagaaaattttgaaagtgtcactcccctaaatgcctataccattccccccattgcgcttaaatgtttctttttgccagtattctgtttctaaagcatgcatttttcagtcataatgtataataaagcttaatggtcttgcctcctatgactaaaatgtcctgccagtattctggaaataaaatattatagagaatctctctgattatgttaaattgctaacgatggcttaattacttgttagaaaaatggtacattgtcatttttaatttacagacacttaattttttcctatgctaataagtgacttctaaaacaattaaatccctgaaacaattaaatacctaatttttgttaaattatattcaacattaatttaagagtttaattaaagctaaagaacattttacctcgggcatgaactttttcccctttctgtcagatgtgaatgcttttaagtaataaacttaaatttcatgttcttaaaattaatgttggtgcttataatgttattttgtatttggtggtttttaatggcagtcttttatgtttggaatttcaatttttgtattatttcctacaaagatgcaagaactagttatactttacttttaacagtgaagtcttgatagcatagaattattacaccagaaggaatgtaaaaatttcatctagagcagagctgtctagaagaaatataatgcaaaccacatatgtaatttaaaattttctagaagccacatttaaaaagtaaaaagaaacaggtgaaattcattttaataatttattttatgtaatccaatatatttagtacattatcattttaatgtgtgatcaatataaaattaatgagatatatctttttattaactctccataatatgatgtgtattttacatttatagcacattttaattccaactagccacatttcaagtgattggttgccacatgtgactaatgacttccatattggacagtgcagatctagagtctcgatttatttcccatccctgtatccctgatgatatggcacactgtgaatagtgctattggcttatcaagtggtgcatacttccctagtaagggattattggaaaatccaggtgagaggagctgtcttctgtagttttggagagtaaatgcattcaatatgatcctgatcagcccataacctggggtaggggagcttacattctccactgggaatcactgatcttatttgacctctttatattctgcaagaggaaatgaggcccaccttcattccagggtccatgttctgcaataagcttggccctcttacatttctttctctcttgaagtagccttttcctgtgttgtttgttcattttgggatttttttttattattatttttgagacggagtctggctctgtcgcccaggctggggtgcagtggcgtgatctcggctcactgcaagctctgcctcctgggttcacgccattctcctgcctcagcctcctgagtagctgggactacagacgcccaccaccatgcccagctaatttttttttttgtatttttagtagagacggggtttcgctgtgttagccaggatggtctcgatctcctgaccttgtgatctgcccgcctcggcctcccaaagtgctgggattacaggcgtgagccaccgtgcccggcccattttgagatgttaatcagtttcccttctcttctagttttggatatctaatggaagattatcacatatcatgaatgatagttctgttgatgctatttctcttattaaatgttcattgccattatcttctttaaatctctaccatttaagtcacactgttgaagactcaactaatcagaaccaattgccttgcattttgaatgtgaactgcccatgaattctctggattgaaaaatattctccctcccctctattgattagtaatgtgttttttgttccttttcaacatatattctaaacgtttatagagtcctcttcactttcatgcttatgttatcctcttattaaataaagtaatgccaagcccatcatgtgagtgtttcttgggaattgagaaatttagaattgggaaaatagagaaagaactcagaaatcaaaggaacctggctcactgtgttcaatttgttcacatttcaacctcttaagtaatgaaatatcttctgaaataattgccttctcctctccattcccttcccacttccatatttttaggccacgacttttataagagcctctcagattgcactccttatgccttgaaagtgcatccagagttgtcattctaaaaataaatctaatcatgtgttcctttttgtctagcagtcatccagcatggcaagatccccagggttcttagaagcttggttccaaaacctacctttctaccagcactacctatcatttccttttgttctgctacccattccccactaaccagaacacccagcactctagcctgattgttattcataatttcccaatgcactgtaaactttctgtcatgcgtgtccctgtgaagagaccaccaaacagactttgtgtgagcaataaagctttttaatcacctaggtgcaggcgggctgaatccgaaaagagagtcagctaaaggagttaggggtggggcagttttataggatttgggtaggtagtggaaaattacagtcaaagggggttgttctcttgtgggcaggggcggggatcacaaggtgctcagtgggggagcttttgagccaggatgagccaggagaaggaatttcacaaggtagtgtcaccagttaaggcaggaaccggccattttaacttttgggattcttcagttatttcaggccatctggacgtatacatgcaggcttgggctcagaggcctgacactttcctgcctctgttcatgatgttcttcctttacagaatgccctccttccccaagctacactaaaggtccagtgccatttctgttggtgtaatgtccctccataaagagtaattagagttactcttttctttttattctcctaacacgttttcatttacaggtttcttgttttccactttgtgtggtaacttcatgtctcttgcttgtttgatagtaaactccttgagctggaaataaacgtagctggcatttattgaacatctaggtgctagacatcatgctaggtatgtttcctttatatttgcaactccagcatcagaatagtttatagtagatgtgcagtaaatatctgtggagttatatgtttgcatttttaaatatccattggaattcctttaggaatcctaacttagcatttccataggaggaggaaaatgccatgtataaaatacctactaggtgctttacaaatattatttcatttagtattgtcaataacactgcagttggagtatccccattttagagatgattaaatgaaactaagtaaagtggtctaattacccaactctttcacctagtaaatggcagaactatgatctgaatccaggtatgactgaagagtgtctccttagatttgaaagtacagatgtagagtaaagaaatatactttagtgggggtaggaggtaacagtctttgctaactagatcaattgattcatgcaaaatgggtattaaggtgcaggcatttccatctgatagcctttacttccttttcccaaggtgcactagtttagtcatgttacttaatgtttccattcacctgtgttggtgaatactaaattttgggaaggttattattggtaacatactgatacagtttggatgtgtgtccttgctcatctcatgttgaaatgtaattcccattgttggaggtggggcctggtgggatgtgattggatcatgggagcgtttttctcatgaatggtttaccaccaccgccctggtactgtccttgagatactgagttctgtgagagctggttgtttaaaagtgtgtagcactctccgtgccttactctttctccatgtgacatgcaagctcctggttcgccttccaccatgattgtaagcttccagaggcctcccagaagtagatgccagtgctttatttccagtacagcccgcagaactgtgagccaattaaacatcttttcttataaattacccagttttaggtatttctttatagcaatgcaagactgacctaatacatgtacacatgtgaaatttcagttagtaagacatgactgtggaagggaaaactcttctaagttagtaaaaagtctgaattataggaccttttcttgaaagtagagtggtcgggagtaggccagcatcattgctagcataggactgttgtaggaaaagctgggttcttgtcacatgaccaggaaaggttagactcacagatacttggaagggcaagacaaatggaatttatggggcgaaaaaagaaaaagaaaaaaactttaagcagtgcacttaggaagcctgttaactactctcgccccactacacaggaattcaagagcccagctcctccctgcggcaaaaggcaggaacttccttggctcaaccctgctctcccagtatgcatgctggtggaagattatccgtggaccctccccgttatctgcctcctgcatctatcaggaccttaggaagcctgttttactgaatgtatgaaagcttttagtaattagcatatcaattatttgtccataagaaggggcttcacaagtacttgagggcatttgaaaaggagtagaaaactagcataaattgagtggcataatttatgaaatcctcaccctatgtggtaggttaccagagatttgtaaatagaggctctaagaggttaaatcatttgcttaaattacaaagtaaataagtggcggaatagcatccaaatatacatttttctgacttccccaatgcacatactctttcagatatgctaaaatgtaatttcaatattttctctgtaatatttgatactccattaatttcattaacaagcatatttcataagtagtacaaagatgaatttcaaaatagctctagcaataggcaccaaaaatccacattcataattcttcactatacatgctaaatgaaaacatattttaaccatttaaaccaccatcaatcaattttttctttttagttatgcataagctttacataggtaaagtggcttatttttgtgttaaacaaacatgcttaaaagcacaatttaaaggtaatattcactgttatacctttaaagtgaaattaatattctttactaagtcattagtttacttttcctttatttttagatcaagtttttaattcagcttcagccaaaaggagataatataaaaataaattccatttaaaaaatggaaatagtacaactttcattgatttatacacagattctgaggatctaaatgcttaattgttttaatcagtccaatttccaaacccatcgtagtatatggtgatacttccgtttcatatatttttgtggataacggtaaacctgaatgagtctagaaaatttatattcacacacagagttttcagggatatttagcatattgcagaggaagtgttatttcacgtcaatacactaaacttctctgaacccccctattcatcgaaaacactgaacaccccattcattacacaagctagagctcttaagagctagaaagctttaacattctccttataattcagttatggttatgaaatatgaaaaataatattttatgatttattttaaaacactttgttaaggaaaatacatttcttcttagtctatcattaatctggctttacatatgggctggtctcacttatcctggaggcagttaatcattaaacatttttagtggcaaaagcctttccttatagaaagattttgtcttcctgtcataaatttctcatttttcttcctggatttttaagctagaaaacactgtaaatattttaaggttgcactgcaatttttctgccatattgaaatgatagctgtctgacatcatttttccttctttataagtggcatattgtttactagttcatgacgtacgtcttcagagatacttaggtactcaactctatgcaaatatacactgattacctttgccatagacactagatgactacttgattaaaataacattaagacgactagccaaaaccaagactaactgctagtgaaaagaagcagctatcagttaattgaagaacatctatatctttatttccctttaagtatttagaaagtcttattgatgaggtaccatttccatattcaaaagacagggatctgttaaccttttagtgaatgagacaattcataatttttccttgtttctgtctctgttaatcctaacacacaattactctatgtagggaagcaggaaactccatttacaatgattatttggggttaatttcatttaatggcattcttgacaaagatatgaatatggcaagaatatttttatattttacgtttaacctttgtaatttaatctttctaatttcatttgatataaagcgtaaatgaaagcaaaaacaccatttatagttgagtgtgaatttttttctttttttgaaaccagtctcactctgttactcaggctggagtgcagtggcatgatcttggctcactgcaacctccgactcctgggttcaagcgattcacctgcctcaacctcctgagtagctgggattacaggcacatgccaccacgcccagttaatttttgtattttttatttattttttattttttagcagagacagggttttaccatattggtcaggctggtctcgaactcctgacctcaggtgatccacccgtctcggcctcccaaccaaagtgttgggattacaggtgtgagcagctgcctccggccgagcaatacatttctttgtgtctctgcattagcgttatacttttttttttttttttatattgagagggagtttcgctcttgttgcccaggctggagtgcaatggtgcaatcttggctcactgcaacctccgccttctgggttcaaacaattctcctgcctcagcctccggagcaactgggattacaggcatgtaccaccacgcccggctaattttgtatttttagcagagacggggtttcaccgtgttagccaggctggtctcaaactcctgacctcaggtgatccgcccccacttggcctcccaaagtgctgggattataggcatgagccactgctcctggcctagtgttatactttaaatatttttatttgaatacctataattatgaaacctgcaatattaagcatagttaaactttcaaataaagcaaatgtataaatatatccaattctattcatattcacttagtccactttctcatttcacacatttaacaaagcaagcaatgataaaatatgcatgtcttgagtattataatttgcatttgaaactgcagaatcttctggctgaatgaatcaataatgcaaatatctttctaattagatatttagtgttttttagttgtattttgtaaaatctaaagttttgtgtacaaaatagtttttttttttttttttaaagaaatctgacagatcttttggtcctgtgtttcaaagtacattgtgaattttgactgaaatcacagttgtctttggtataccaaaattaagttctgcatagtacctattttagtgttacagtcagtgtaactgctggaatattcaggtctagtggaatcagtaattatgtaagcctttcttgttagaggatttcttggcttagatacatcccttatatgtgcattgccccttattgccttattgtcattctaattactaccactcctttgtccccatccccaccccatggccttcattctttgttgctatctttgtgagtagaaagacaaactataaggaaaacttgtatgtgagctgtgtggggggagcgggtgagttacagttatttctaatatctaaagagttgtgtagaagaattagacttgcttgatgaaggcacaaaaggaataagtagaaccaaggaataagttgctgtgataaaggcatgaaataattgataacccaagatgcctcgatttggacctgctgccttaagagatactgagttgaatgttaaggcagtgaagtgcaatggaaggaatctgtgagcttggaaccaggcagacctgtatttcaattttgggtctacttcttaaataatagctgtgtggtcatgagcaagtcactaagtgacagaaccttggtttctttatttctaaactgggagatgatgcttaccttgcaggttgttgtaaaaactaagacatgatgtgagtaaagccccttggcacagtgcctgtcatgtaataggtctgtctattattgttgttttattcattttttgagtgatcaaaggttgctctttaaaaaaaaaaaacaactctaggtttagtggtacatgtgcaagtttgttatataggtaaattgcatgttgagggatctggtatacagattattttgccacccaggtaataagcagaggacctgataggtagtttttgatcctcaccctcctcctacctgccaacctcaagtaggcccccttgtctgttgttcccttccttgtgtcaaagaccactctttagaaatgatgttgaaagattgtacaaggtagtgaactaatataatttgtattatcccgtttatcttgttgatatgattctatattacttttaaagatatatggttgactggtaatgagcattatccccttctcttgttattggtatactgactaggttagtaattcatttttatttttatctttaaaaattattattattattttttttagagacaaggtattgctctgttgcccaggtcagagtgcaatggcgcaatcatagctcactacagcctctacctcctgggcttgagggatcctgccatctcagcctcctgaatagccaggagaataggtgcacaacaccacaaccaggcaatttaaaaaatttttttgtagagttggggtctcgctttgttgccaggctgatcttgaactcctggcttcaagcaatcctcccgccatggcctcccaaagtgctgggattacaggcatgagctgttgtgcctggccaaggttagtaattcatggagagaaaatgggattgatgctttgctttccagacttccacaggctttttaagtgaaaatgcaagttgacatatgggaattttaaaattatcattttgttattgattgctatgccaaccaatactcttttgtttgtttcttcccttactaatttaagctatttgacctggaactatagttcatgtagatcttgtgggcattttccaagtcgttatttctacaatgcctattaatatgtgtcttctatatcaagcaatggcactttttttgttgaataaatggatacaggggttgagctgttcataatttgatgcattttcaggctgttgtaagtgaattgaccatttgctcaaaatcagtgaacattaagctattaaagtaattttcatgtctgcattactgatgttttttttggaaaaagtatgaaattgaggaggatcatgataaaatgcatttatctttattctgcctttttgaagagaatcttaaagggcacaagcctgttggcagagatattcttaagtgataaatgataatgacaagagtggcgatggttttttccatcacagttttggggatcaaggtgagtcagagagaatgatatcctaaaccttagcttcttcattaaatgacaacaaaactgtcatttgctgatttttggccatcagaagtattatctagatcatattatctatttataactttgggataatgggtttctgattttatgtaatgtacttctcagcccttttatttatttttttatatagctttgattctttgaagctggtatgtgaagcacaagctttatttatttacttatttagagacagagtctcgctctgttgcccaggctggagtgcaatggccggatcttggcttactgcaacctccgcctcccaggttcaggcaattctcctgtctcagcctcccaagtagctgggattacaggcatgtgccaccacgcccggataatttttatatttttagtagagatggggtttcgccacgttgaccaggctgatcttgaactcttgacctcaggtgatccacccagcttggcttcccaaagtgctgggattacaggcttgaggcaatgtgcctggccgagcattattttcaaagtgtgctcaactggagtgcttctttctcctaggatgcccactatttgtgtagggccaatacttaatgattgttttttcatgattgctattaaagatactatttttgttacccaccctgatgctcgtgcttcacataacagcttcaaagaatcagcgagcatttggaaatgtataaaatgactcctgtcttttgtcaggagtagaatatactgataaaatcctttctcatgaatgatgaagttgccagaaatttggaatacttttggactgacaacaattacatgataaaatattgtgaaaactatttgtgaataaataatgaaccaatactacttctgttcactcagaacaaacataatacagtggttcagaagagcgtagtaaccttcatattgcttaatagttcagtaaacttttaatgcctctgaaaatgcataatagttccttaagaaagcatggtaggataatcagaaaagactttttttttttaatttgacaccaaagggattcatatatgacatctgttcattttttccacttcccttcttctagtaaaatacctagaaataattattcctagagaccatgtgatatttccacctttagtgtctagcctgcaattatttcaacaaagtcctcttggtacagtaaatagtaaaccccactggaccaaatcctaatagtatagtattggctgccatagtgtaacacacatggtatgtttacattaaattggtctcatgtcttaaaaagcatttgtctttatatttagtatagatacaatctagagatagattaactggctagatgatgatgataataataatagctaatctttattgagcacttactatgtggcaaacattgttctaagtgtcttatgtgtcttaattcacttgttataacatcccaaatgaagtacgtagtgtttttattccactttatagagacctaaactgaggcacagggatttaagcaactttcccaagattacacagctagttaagtggatgtaatccaggtaatttgattcaagggtccattctcataaccattatgtgatactgcttcatagccattgtgtgagactttaagagatgctgcagtgctttctcctttttcactacttcactatttctcgttcatagccctttgttcacagggaaaacataggaagggaaaaactagaagctccttgagtttcacctgtttattccagatttttatctcgtggtgtctcccattgtataaactgagatcagtaagaactgttattatgccatatgtttctaatcatagcaattgcttcattctctgaggcatacaacacatgaaattattgtcagacatactgattttatacgtttacaaatgctcgtttaaatagccattgaaatacaaacttcagtaaagagagtaatgtttggtttgcatgatgtctgaattctaagatttggcaatggagtaaagattttgcctagatcttatctttttccccccattctacagtgaggtacaatgataattgttatcatagtgatgaccctgggagagcattaacatcttttgttccctagaatgtacttattgaagcaggaatgtggatgattatgtttatgtttgattttgtttgtttttgagacagggtcttgccctgtcacccaggctggagtacagtggtaccatctgggcgcactgcaacctctgcctcccaggtttaagcaatcctgacacctcagcttctggagtagctgggactacaggcgcatgccaccatgccaggctaattttttgtatttttggtagagacggggttgcgtcacgttgcccaggctggtcttgaactcctgaactcaagtgatctgcccgccttggccccccaaagtgctgggattacaggcgtgagccaccttgcctggccggttgcttatgttttagatgtacagttgtccttaggtgtctgtggggaattggttccagaaccacccccccttgccaaatcccttatataacatggtatagtatttgcatataacctgtgcacatcttcttgtatactttgaattatttctagattacttataataccaaatacaatgtaagtgctatgtgattagcagctatactgtattgtctagggaataatgacaaggaaaagagtctgtatatgttcggtacagacaatcatccatttgtttaaaaaatatttttgatctgcaactggctgaatccatggatgaggaacccacagccgcagagggctgactgtatttttactgacaaaagtttaaacataaaagcaataaccaaaaaaggtagtttagtcacaaaaagtttaaagtgaaaattaaattaactacaacatactgtaattcatgccaaacagttgttcctcctaatcaatatttgaattttgaaagagaagtaattgtatatatattgtaagaattccactgtagatgagtcacagagcagattgatgatcgtatttttttgctatggtagttaaaactttttattcagatttttatttagtgctaaatgagttcaaaatgtatattacctctctggaaaagctcttatgttagactgtcagctatctagtccattttatattttcaacttgaaaaatgtttaaaatgttaatttatttcaattaaaatttaacaggttgaaataaaatgaacatcagatttctcttttgattcactccaattcagaaaaacaacttttgaaatcttacaatgtggtaggcactgaacgtttcaaagactgttaggaaatggttcctgtgttttcaagctttttccagtggccagttggtcacatttatcaaatgtactaaaactatgtttttagacatactctttaatatattcatgtgaagtttacagaattatgtttgaacacaatcctttttgtaggtgttcacagtttctatgaggttttacttcactggttttcatgttatcttcataatagcattttaatgaatatttatttctacccaactccttactattacagctggagggagctgtgctacaaagagagcactctctgttgagagaaacttggaaagttgagttaacatattggcctgggttgctaatcccaaagaacaggaagtcttagggctagagtgagggaggagattgggtggaaggggtatagtctgaagtctccaaagcttagagctctgacagcctacagttttattttgcccttccaatccatccaatgtgactcttttgacattcttaaaataattgagaaaaaatttctgatatagcttgtaaattctgctaattgatcctttagtaaattgaccatttggcaaatagtcttttctgcgactacatcaagagtccctgttgtcaaagaaatgccttagcaaatggaagatataaataatacctttaccaagttacaggtaaaaaggtgccctattaattaagtctgattttcaaaataacccactgaagagtacagggattattatccctaattaatatctgtatttaatactggaagattcagagaggctaagtgagttgccctcagttaaaagataatgaaaatggaggaatcaagatttgactcaggcattctggccagtaagtgtatttccattataccattctgaagataatcactttgtttaaataatttcatttttcacattttgagggctagagagatggggacgggagatgaaggagtactgaagtttgctcacttgatgacatgtttatgtatacttttcctgtacttaggaaatcaatttcacaagacattgttttaagaaattttaagcctgttattatagacatgaattaactacacactgttaatttagaaattattgttagagcagttattatttttgtacatgacagcattagaaaataatgaagttctaatattttgatttttatagctcacatccctattctgggtctcctttccaagttttcaaacttagcaggaccacagaatttcttgttttagactgctaattatcttaagacaaaaagggatcatcctaggttctgctggttctcacattaaagagaaatttccattttccattaatgtattcaaatacattcactttaaagatacctatactgtactgctaaagagattaccctctatgtcttattctctattttaggacttcagctttcagaaacagctgtaaaactttcttaagcattatgaatataatatttctcaactcatcttaaaacacttactatttactatttctcttattagatatggcttctgaaatggtttaattgcacttcaaaactatagcattttattgattttattttttgaaagctgctttatgttctgtagtgtttaatggaggataagttactagtcacatatgatactgtgcatacgctagatttaaatgtttagtgcttacttttgacaactacgtaaagaagatctatatactagttctggatttatttttgaaatggaaaattgtgcttttaaaattattatgggtagcttcagtttgtatcacagtataccagcaccaatacattactggtgtcatcttacgtgatgtatgaaaatttgaggtactagagtattggtaaaatgctatttacccctatattcttactcatttaaatccaaagctaagtctttctactggtactaaatattttacatcgcaatggaaaattttaataacgttgtacaaaaatatatagagaaactaacaaaaatccaaatgacctcattcatcttttaagcagttaaaggcagtggaataaagtgtgcaaaataatgacatgcaagatgaaaaccacctaaaccttattttcctttcctagcctagcttgttctattatgggttttatatgaacatactttgaaatgaaatccattagttgaaaaacaaaaataaaattcttaaccaagtggcaggcatatacaatagtccccccttatccacagggaatatgtttgaagaccctccagtggatgtctgaaaccatggatagtacctaaccctttatatactctctctctctttctctctctctgtagtgtatatatataaaaaaccaagactctctctctctctcatatatatatatatatatatatatatatatatatatatatatatccatctgatagccaaggcagctaccaaatgactaatgagcaagtagcctatacagtgtggatacactggacaaagagaggatttgtatgccaggtaaaagagtgtgggacagtgcaagatttcatcatgctactctgaatggtccacaatttaaaacacatgagttttttatttctgcaattttccatttaatatttttggaccatggttgattgcaggtaactaaagctgtggaagggtaaacaaaactatggataagtggggggctactgtaacataatctttggtttttaggtatatctcagatgtatctgaaataaacattgagatactgaatgaatattttatagcaaccatcttttctttaaatctaagcatccttcttaactctaaaattatgaatctaatttgtgttacattttatattgctaatttcttatttttttattttatattttatgttcagtccatctttccgttgcttggaatatttttctgaggtaattagaaatttatatcttctccttagatttttttctgaagtcttgttacagtgtgatggtttttcttcatttaattaattagagaaactatagtataactaaattcatgattgaacacattttatacaaattacaattgagagccgagggactatcttcagcattaaaaactcaaacattcctaactttactgtaatgcccttcaaattaggattgggtttatttagcatataagagcaagggctatgcagtacgtaaatacaatacgtactaaaaaaatgttttgttgcatattcatttatttattcatatatattattacaattttattgaattttgtacaaaccaatgcagcaataaaaaactatggcttagtctatatcctcatgaagatgaggatagactaagatataaatatagatatagatataaatataaatatagatataaatatagatataaaaccaatattcattttaatcatcctaagtgcttaaagaaaacatccaggagattagagggacctagtttgggaggacagggaaggcttccctgaggaagtgatatttaagctgaatctttaaacatgaataaggattagataagcaaagagaataggaaattttttttaatatggacaaattagagcttaatattttaaaaatatataaatctgagattggatattccgaactaacaattcaagttatttaaacattgtgagctttataacaacatggaaataacaatatatggcagttttagaaccttgctgaaaaataaccttggtaaatctaaattttatttaaaatgaagctgtgtggcacacattgattcaaactgtctgtaaatggagtattgagaaggaatatgacagccagcaaatgtcaatggcgactttgattaagaacagaatgttgaaaaacaaatacctaacaaaaactaatcaattaaagtgtgtgtggagtggagggaggaatagctcaaaacacgaaagatgtttataaggagccactatgatatctaattctccatgccatttaataagcagactagccatgactgtgtacctgacctgttgaccccaataactcattattcaagtgtttactagataattttcatccaacagcaaatttcactgtgcctattctaggtaactgtatgctggggccctctgggtgataaaaggtgttttattagctgcttccagacaccccagttctcacaaggttaaataaattgtatgcctgctaaatgagttagcaggagatttaaaaatagaattcaaggttttttttttttttttcctttgtgctttcttactgtggttacactatctttaaagtttgtgttggtttttcagcagcacaggtctagattagttgcatttgtatacttccaaagagttgcatatttatttgtcctaatatatatatttaaaaaaaaagttgttcagagataaagggtaaacacaataagcttactgatcattcaaaactgcctgtacctactcatttgctctttcagcaagtgtttattgagtatctgtggtgtgtggtgttgaagggttatccttaggaaacccaagaaaaaaaaatgtggtcttggccgggcgcaatggctcatccctgtaatcccagcacttggggaggccgaggtgggcggatcacttgaggtcaggagtttgaaaccagcctggccaacatggtgaaaccctgtctctactaaaaatacaaaaaaattagctggacgtgttggctggcacctgtaatcccagctactcgggaggctgaggcaagagaatcgcttgaacccgagagtcagaggttgcagtgagccgagatcgatccactacacttcaggctgggagacagagtgagactgcatcttaaaaaaaaagaaaagtggtgtttgcacttgaggagtttttgatattactaatgttatgaaaggtctgcatattctcacaagacatgaagctgaaaacgtaaaatatccttctgaattctggggttttttgttttaaattagggagatttggaaaatacctgctatagtatttcatttctgctgtgttctatgtgaatataatgtgaatgctcactgaatgtatatgctataccactggttgaaacttctgcaagtttattttcacttttgaaggtgtatattatttccatttttacaggaaagagggagtaaatacactcaggactaatagttgcttatttacaaaaatgttcagaaattacaagtcattactttaataaaaagtttatcatagtactgagtgtttcaaaatattatttctagagatattgtttattttcagagaaacaatctgttgaaatgtagatttctaaagtattttctgcatttgatatcaagtgtccatagaaaaacgcagtatcctttaggggtaccaagctaactaataagtgtgtttcacatacatttcgaaagttatgttgcttttattataagttggaattttcttcccattggaataacgagcgttttctttaaaaaggctgttaaagagaaaaaaacactgacccaggagtagcccaaacacctggattgtgatgctttcagcgatatagctgcatgaatttcaacagcacagtcacctagcatgaatcttgttttctttgttgttatctgccctgcatgtcacacatggttgttacgaggatcaaatgacataatatatgtgcaaatgcttgtaagttacaacttgttgtataatgtaaggtacacctattttctgaaagctaagctataagtattttttatccagtagagggagtcaaccatttgcatgttataaaaaccagatctaaatttcttctcctcttaaaataatttattcttaaatcaaagtaaatatttggagtaaagtatatgtgtgtgagaattcatttttattgatagaacagtgataaaatatttgatgaatacatgggtatttaataatatattacatatattgacaaaactcatttgattcccttgaagtacacttttttaattttgtattccagggtactaggtaaaatcattcatggtggtcattggttgtttatgctagatattggactatttcagccttgatgtctactgtgaacactgatgtagtggccagtggtgacaataaagtaaattgacaaccatgagtcagaattttagaacttggttgaaccttccatgtggcatggctgtagatgaaatgaaggctcaaacagatgtggtgaaatggcattttatctggcctattgacaatatccaaggagtctgctctggtcatgagaatgcagctgcatgttctttcaggcagacctttggcagaattgtggttccaggagatcagtctggtttggagcaaaaattcttgccaagctttgggattcaccatgcaggatgctatattcaattcctagagggaaaggttagcataatgccaagttagctagtgttcaagtcaggttcctggcccagcaagggacgtttaccctaagtacctgggactcaagacttaggacaggaaagataaatctagatgtgacttacaggcaatactgtggatcctaactattttgagttcccttgtcataattgagcctgcagacagtaggtgtcattgcctggaagcagccatttgtgaggctggaggaacatactaagaaacacacagctgaaatgtgacagatatgtccgcttctctctgcttcttttaactgatgtgggaatttgattgatacaaccaagaaaaacttgttatttttgatacctctgaagacaatccctgtattagaaatttaaaagcctggagtcacatgtatttgtgtctcatgttccaattgaaggtttgaattttgaaagagtttaggaggaagataagtcaatggttgactatgtacctaaatttattaaaattttaaattaaatatttagtaaagtgatgtgttatcaataccatttccttataacaatagtagccagtttgagaacatgatgaaaaaggtcacattcataatagtaaacaagtataagctgattttaataagcttaataggagggtatataacctacataaatctacagcactttgagagctatagaaagcgactagaataaatacgaagacagtgcaattctagatggataaaggccataaatatataaaatttctcttgtaaatttatacatctaacataattataaataaaaacaggaattttagttgactttattgaatttagcaagattattatacagatggaagaggaaactggcaagaatgtaaaatgccattttgagaaccatgggcaatattttggtgatgggggactaatcctataaaaagatgaaggattcacatttttaaaaaagggagatattataatagcacacacattcatgtaaataagtgggaatagaaagaaagttcaataatagattcttatttatttatttatttatttatttatttatttatttatttattttttgagagggagtctcactgtgttgcccaggctggagtgcagtggtgcagtcttggctcactgcaagctccgcctcccaggttcatgccattctcttgcctcagcctcctgcatagctgggaccacaggcgcccaccaccacgcccggctaattttttgtagttctagtagagacggggtttcaccgtgttaggcaggatggtctcgatctcctgaccttgtgatccgcccgcctcggcctcccaaagtgttgggattacaggcgtgagccaccatgcccgccctagattatgtttttgcatatgtatattataaatatgaactatgttttctgtaaggatagaaaataatggggaggaaatatacattccaataccattcattaagtaatctgcctgtaaatctggctccataactcatattgtgtaccaaaatcatagacagattaaaagtaaacattgaagtgaaaatattgtaagctttgaattaattgaagttacaaaaggacagatttacaactttgaataaataaaagctaaactgtatagaatgctgtaaaatataaaacactcagaaaaatacctgcaagtttattacacacgggattaatattgttagtatccatgcactgcatagaatgtgatggaagcatctaggtttggatagataaatgtgcaaaaaaatagacaatacgtatgagtggaaataaaattagtaaaatgggaaaaactttaacataccaattgagaaatgcaaaatttgaaaatgaggtatcattttccatcttttcaattggaaatcttaaaatggcattgcctaataccatgaaatttgtgcattactgtattatgctggtagcattaaatctgtttgaaaagaatttgacggaatataccaatccttgtatctattgacccctgtgatttagtattttggacaatttaccctaaggaaattatccaaaagaagaaaaaagtatttatttgcaggattgtttatactaatggaaaattggggtgggcagaaaccttaattccaagagggcaatgcttaattatgagccatacactcaggagtattatcaggtagacactagaatgacttagatatgctgtgtagaaaatgaaaacattcctctgatacagtggttaaaagaaattacacgtgtcatatgatgtatgctttcagttatgtacaatgtaattatataatcgtatgttagatgacaatgtgaaaactaagcttctagtctggtgggatttttaatgacttataaaaaattctccccggactttatggggtaaaaggaaaatgagaatggcagagatttttaaggttttaatgttatgaatgctaaagtattctgctaagtaaaaatgataataacttttattgatcatgttctatggaccaggaaccatagagtgttctgcatttattctttcgttctgaaatgcttgaaaactgaaaaggaggtttaggcaggatatacttgtctccataagatagaagggctgtgataggatggaacaatttgaatagtcctttttcattccattggaggttaaaaaaatctattatcagtaaagtaaaaattataaggaaacagatcttaatgctaacaaaacaaaacaaaacagcaacatacgtgtccctttctttgctttctccacctcaggaaattgacattgccgtacttccagatgtctaaactagaaacttgtgtttcatacttgattccttgcacttcctcattctctacttccaatctgtgaccacattctatctattctaactgctaaaatatttctgaaactcatctgctccttcccattacccctgtcacctttttagtttaggccaccatcctcatcaccttgattacaatagcagtctcctaactggtctctttccttccatccttaccccctttcttctattcgctacacaaatctaaacatgtcactcaccagcttacaaaaatcctcagtgatttcacttcgctggattaagtccaaaccccttaatggggctttcaaggtcttcatgacttatatttacttcaccagcatctgctccccagcaaataaattcattctccctttcctgctccttgtccctttccccaccccatctctctcagtcacacacatgcaaatgtacacacaaatacatgtacacccctacagccataccgaacttcttccatttccatgactctgtttcattctctctcatcactgaatcttccacggtgctgtgccctccacctggaacactctccgttacttgtccaacctcgcctgagctttctcttatgatctcttgttcttgcttatccttcagttttcatattagacattccttctcctacaaaggctttttggacatctgggttgcatcctcctatgtgctaccctaataccccattccataccctttatacttacattactgaaaaataaggaccacctgagtagcattgtacctttggtttactaccatatccgtagagttagcagagtgtctggcacatagtagatgcgtgctaagtattcattgaatgaatttgtatggtttgggcctgtgttgtcaactacttaagatttatatttttaacttcaaatttgagcactgtcttcttggtcatcatattattaacaacaagcacaatgccaaacacggtacattttcagtaatgattggaaatgaatgagtaactcagtaagtatttgaatgaatgatcattgtaatggtgacacctcactgagattaatgagcattcatcctttctttaagttccctgaagggaacttcatttgtctctgttttacctaacatagtgtcttacatgtagtagacactcattggataattaccttcaattcccaagactgaccactatgtacagagttccagctagtgctggcgttaattaggtgatcttgaccatatctggaatttgaacttgagctggatttctctgtatatttgtgtatgtgtgcctgtatgcatggtcatgtcaacatatattttttaaagacatagactggttttgtattatgtatacagtgaccattaaaacaatgccatcacactacaaccagtcagagttctcttcttgttgttggttgttcatttgttttactgtggttgtttttgccttggactttgagagaatcctggactgtaaacttttaaggcaaggtttaagtcttgtcctaatcattcactgtgtagtcaacaagaaggtgttaggacttgagaaaaaaaattacctgaaggaaatatatatgagaaacgctttatggggaaatttttttgtcttttctgcttgactgtagaacttcaggtgttgtgtaatacgtattctttcacctccacttccctctgtaaatgtgctttactcataaatgtctgtctataaagatgtgtcctgggtctttaacaagtaggaggtggtacatacttgaataaacatcctctaagtggttgaggttgaaaaggtgcaaatctttcctagttgaagtaggagaggctgtacctgctttgttatgagtcctttctttgtgttctcattattcctttttttttttttttttggttctacatttttttcctgtactattttgtacagctcctttcttatttttttctttcacctctcaactctttcattatcactcttttttcatttattgaaaccatatatccatgttttttgagtgactttgaccagaacagttggttcagctttctttttaaaataatatttaatgtatttcaattataaaagtaacaatctttaatttagaaaatctgaaaacaaaggaaattttaaagaagagagtatgtatctaaaatcctcttacttaggtataattatcattaacattgctataaattactatttagattttttacctaattgaaatcattctgtacctagagttttttttacctaattgaattttttacctagttgaaatcattttttacctaattgaaacattaggtaaacatttttacctaattcaaataattctgtacctagagttttgtatctcattttaaataatattgagtcaaagatgtatttccacatcattaaaatactttaataggccagacacagtggctcatgcctgtaatcccagcactttgggaggccaaggcgggcagactacttgagcccagaagttcgagatcagcctgggcaacatggggaaagcctgtctctcttaaaaatacaaaaaattagccgagcatggtggtgcgcacctattgttttagctactccggatggggaggtgggaggatcgcttgagcccaggaggtcaatgctgcagtgatatgtgatcacgccattgcactccagcctgggagacagagtgagaccctgtctcaaaacaatttttaatggctgcataatattccattttaaatagataaagcttacctctttatttcccgatatttgcactgttcaatgtatttacaagtttctctgatataaaaatgatgtcatgaataacttagaacgtgaagtcctagctacagttcagattgtttcctgtgaaagattcctagaagtagcattatcaggtcaaaaataagtcatactttttgaggcactttttttttttttttttttaaccacatggctttccagaaatgttatgccaaatctgctcattgctatcagcattgtaaaagaatatccatcttaccccatgggtagggctttttagtttctttaacggtattgtagtttctttaacagaatattaacagaatactgttaaaaatggataaaaatggataactgtgtgaactgttatcaaattaattaaacaaagaatattatttggcatacatatttgaatcttgttctgaaggcagtgggtacatggtgtgttttcttacaattggaatgtcttgtgtgtgtgtgctgggttgttattctctgaaattgcattactgtgttaaatccccaaactaaagcagtgaatttttttgtaagttctgtatctttgtggccttgacaactgagccagtcctttggagaataagcaatcctggactgcattttaggacaatgagaactgccaaagtcatgagagagaaagacgaatggataggacactgaagtagaaatcagatgccctaggctttattcccacatccatttgtcattgtgtatcatggccaaatttgattaaagaactttcccaatctgtaaaacggggataatatgtctcaccttacagggatggtaaagggattactgaaatatttttttctaattcattttgtgttcttccaaaagagctctaatattcagaaccaaatactgaaatctatccaaaatctgaatggtagaaattaactattatactttcaagcattttaaaccccagtttattaagaacctaaccccttagtgaagagggacagatagtcaacagaagaataaacaaagaaaataccaaatagtaatgagcctccaaaagactaaaacattgagtgttcttttttgttaagatgccattttaacccatttatgccagaggctgcagattttttatgtgaacaatcagaccttggcgatgaccttgagcagtaggatataataactcccacaagcttagtgttccgatactggaacagtaggcataagtgggttagttgtgtgctgcatcatattggttggccagagaaggcctgtgcaaagaggggatatttgaatgatgggaaggagacaaccatgttcaaattcaggaaaggggccctctaggcaaaaagaagaacacatgcaaaggtcctaatgtgagaatgggttttgagtgtttgagtgccagataagagaccagtttggaagttagtaatttggggcaggggagggcatcagatgaagttgtagaaagaggtaggggaaaaattacccagggcctggcaggcccctggaaggagtccaaatagtccatagtttggatctctcatacttactagctgtgtgacctcagataaagttttttaacttgtgtgaatttttgttcccatttataaaatgtgtgtgattactgcttttcaagattgtttctaaggattaggataataaatttagtgagtagtacagtgaatggcacatagtacactcaagaattggatattgttgatgatgatgtttggacaggaaataaatgtccattgtgtacctaactatgtgtcaggcatagggccagacactttacatttatttatatttaaatcctcaaaacaattctataagatataatgaaactgggaaaaattgttacttgtacagttaaacagtggtcttaagtagcagactactggattcaaatcaaattttcatgactccaaaattagttatccctcactcctgtatcatatcgagggagtcaatcagttgtaatgtgttggttgcttttgtatgtaaatataatttgtgactagacgtgcttttagagatgaggccagtctttgaccttacatgaacagctcttgccaggtgggaagtttgtgaatgttcatattcctctcaatgcttaggatcatgcctcgttcctcctagaatttcttattatattccttgactaagtggatctgcataacaatattaatacttgcctgcaacatgccccaatttttaaaataacctaaggaatattcaggttttttgtttttgcaagatttcttatttttcccaaagacatatttcatatagcagtcttttcctttgagagtgttttgcccttaattgtactagttggaagtgtcagaatagtgcattaacctactgagctccagatggctgacttttttttgttattttatcttgtcttgtttaaaggaatatagaattggcagcagagcccactaactgatgtcagatttggttagcataaattgtatgtttaatatcaagtaaacatgcacttaaaaatcatatgagttgtactttttattctttgctgtacaaaatcttcactgaatatatttgataagttgaaaggctcattcattttgtgagaaagtttatgagattactgattatattacttattgaaaatatttagtatctatatcctactttgggtgtagaaaaaagaaatgaagccttttggaggtatgtgtgtgcatgtctgttgaattgttagattatactaattttttctctgagaagtaaatgacatgctagaatagtaaattgtataatgtggaccatgaaaaagtattatttctaaaataattgttttgaggaaacagaaatgtgtgtttccttatattcaaattcacaacttaggtccttagaggtaagaatgctaccagcagaaacagatggttggtaatctgtaaaagtaatgccatcatattgggtaatgccatactgctgtttctattggcataacctctaactatgacatgatatatagcacttatgggccagaacattgtttgtacttttataaaaaccctacaaagtctatacgctcaagtactagctcagtattcttatcaggttgggtttttgttttgttttgttttgttttttttagacggagtcttgctctgttgcccaggctggagtgtagtggcatgatctcggctcactgcaacctccgccacccaggttcaagcgattctcctgcctcagcctcccaagtagctgggtttacaggcgcgtgccaccatgcccaacttattttttgtatttttagtagagacagggttttaccacgttggccaggctggtctcgagctcctgacctcaagtgatctgcccgcctcggcctcccaaagtgttgagattacaagcgtgagccaccgcacctggccagattgttctttcaagttaggataggactttggggtaagcagtatttcgtgatattcactgtataccattttagaactgaaattggttcatgcagcaaagatgaattatttatcacaaaaggcttgaataacctatacatgcatcactgctatagaaaataaacacatatgtttgagtttgttaggtaaaattagtttattgaaatgaaatcccccaaaatcaactttcatatattttttgaatttatatatactaatataaacaagtcattcctcttttaaatattaaccagaggagtatcccactaagatactatttgatttcaaatatgtcagtgttaactttaaatattttaattatactgtttaactacgtggcaacatagggtacacactatagcagcatctcttatacaacttatcaaatatacatgttaaatacaaaacccataaaatttaaattaacattattttaagtaataaatcatttgctgactctaaattgccaattacaatgtgaatatactacagtgcgggcacttttgggttctctgtgcctaccgtgccgtaggataacccaactgtgccactagtgttctctgatctatggttaaattttgattggtatagcatgctgcgatgtcatttggtctttattttggtacatatgtgttttcacactaaggccatctcattagccagaggtaatgaaagttgtacttcctggtaacagtgtgaatatatggatgctgagactaattggcaggacttggttataaggtagttatctagatgatccagcttatgcctagctttatcatattaagaaatgaaacttcagaattttaacattaccttaccagactcagggatgattaaaactatgttcaaggatcccagtttgagtaccattgctgtgagctccaggtatattgatctaacaaatccccgaacatagcatgttgtattatgacccaatatttattgtaatttctaactgaaatagccttatctacctttggtgaacagtttttacagctgggcagaccttcttcccccgcatagagtcaagtcctttaaccttcaaactcccttatcaccccctatctattttgaaggcacatatcacattgacagtggtctgcatgttgttgcttaccatacctgaataagctctgctgggatggtgaggatatatcatcgcttatctctgtactctcagtgcctggaacctcatgggaactcaattcatgctgactggtaatattctaatacaaaaatgataccatatgcacagtaagagatagatgccttgtgtctctgtagtctattttgtgaagaaaccgagaatctgtataatcaatgtgtgtgcagagaatatagtgaatgtgtgtgcagagaatatagtgtccaattaaaattttatgctttaaagaagaaaagcttttgctttagtatgcatatagtggcatattccaaatcatagattcaacagggcaggacctttgggatcatctagctcagtgggtttaaaaccttattttatttaacataagagcagcttattcataaaaaatcatatgtgggatatgaataaattagaagataaatgtgtaaatgccctcatttttgggggagcagagacttgggaagtctccccaggagccttccttttttgcacattccctactcaccctccaaggcaacctggaaaacacctcaaggaattccatggacccctgtgaaaataatagtcttctcaggccggacgtggtagctcatgcctgtaatcccagcactttgggaggccgaggtgggtggatcacaaggtcaggagttcgagaccagcctggccaatatggtgaaaccccgactctactaaaaatacaaaaattagctgggcgtggtggcgcacgcctggagtcccagctgctcaggaggctgaggcaggagaatcacttgaacccaggaggcgcaggttgcagtgagccgagattccgccactgcactccatctcaaaaatactgctactactaccactactactactactactactactactactactactaatactagtctcctacctaaggtaagaatccttttccagcatctcagacctagtggcaggtctttgcttgaataatttaggtgaacagaaactaataacttcataacatgagcagtcaactaggcaattgttaacgaaagtactcactaaattaatgataaaataatgtataatggcaccaaacattagttaagtgcttattatataccagaccttatgtttgaccaggatccttatttcacccttatgacaagcctgaggagggtagatgctttattgttcccattttgccaataaggaacctcaggcccaggaagtcaagtaatcacttgactaaattcatacagctattaaggtaaggaatatttcagaaacttttgcctgcttttccctttttgttataatcctcctttggaagcaaattatgcccctttttaagatggttttgtactgtcctcagagggcgactctatagcctgggttctagccttgcttctgacagttagatatagtctcagacaagacatgacttctccgtgactcagttttcacagcagaagaaaaaatggttttagtaatattttccctgttgttagattcagatgaaatagtatgcaggaaaagttgtgaaagctgtttttgctatagaagtttaaggtatcctttatttatttattttttttcttgagacagagtctcgctctgtcacccaggctagagtgcagtggcgtgatcttggctcactgcaagctccacctccggggttcacgccattctcctgcctcagcctcccgagtagctgggactacagacgcccatcaccatgcccagctaattttttgtatttttttttttttttttttaagtagagatggggtttcaccatattggtcaggatggtctcgatctcccgacctcgtgatccgcccgcctcggcctcccaaagtgctgggattacaggcaatcccattcagtgctggaggcacacatccatttattcatgtgacaattagttacatttctttttatttttccttgttttcctatcctttggccattttactattgatgcactacctcccatcagcaggtagacaaggaactgataaaattcagtgtgttcattttgtctgatagcacttactaaaatgtttagaaggctagcgttttgaaaataatagggtaattttttgttttgtggaaggaatatttctttatttcatttacaatgtatagcttcattacctacttaaaatgcagtttatatctaggctgtaggatacatttataatctgcaaaagtattattaaacttgctttgttacactgtctaaagttactcttggaatcggatttacaaaatggtaaagcagagagggaaaccattttatttaaataccttcataatctttgccccaacacaacaaatgttggtaagtcttactgttgttcctatctttaaacagtacaatgaagagattgcctatgcgaaatacattggttatcctattgcacattatcattgatcaaatcctgcccattttttaaagtcactatttacatacatgaactttctttatttaaaatggtagtgggccgggcgcagtggctcatgcctgtaatcccagcactttgggaggccgaggcgggaggatcatgaggtcaggagatcaagaccatcctggctaacacggtgaaaccccgtctctaccaaaaatacaaaaaaaattagccaggcgtggtggcgggtgcctgtagtcccagttactcgggaggctgaggcaggagaatggtgtgaacctggtaggcggagattgcagtgagccgagatcgcgccaccgtactccagcctgggcgacagagcgagactccgtctcaaaaaaaaaaaaaaaaaaaaaaaaaggtagtgtactttttcttctgtcctaggacagtgggtggagtaaatgcagtgtaattccaaaatagaggtaacaggctactagaagggttcttactcattttgtgccatgggcccctctgaaagttggtgaatttatggggacctttttagaatcatatttttagatgtaaaacacaaaagacataggattataaaggaaaccaatcatattaaaatgtacttataaaattgtttttaaaaattatgacacattccagagacataaacacatatgttcacacaaaaacctgtgcatggatgttcatagttttattcatagtagacaaaaactggaaacagcctaaatgttctttaacgggtgagtggttaaataagctgtattatccatactatgggatactgtatggcaataaacaggtataaactattgatatacacaataacttgtgtgccttcccagggcattatggtgaatggaagaagtccatgtgccaaaaagttacatatagtatgatttcatgtaaatgacattcctttttttatgggtacatagtaggtgtatatacttaaggggtacgtgagatgttttgatacaggcatacaatgcataataatcacatcagggtaaatggtacaatctttaattgtacaataaattattgttgactatagtcaccctgttgtgctatcaaatgccagatcttacccattctgttaaactatacttttgtacccattaactatccccatttcccctccccacccacttcccagcctctggcaagtatcattctactctcttatctccatgagttcaattgttttaaatttttgctcccacaaatgagaacatgagatgtttgtctttctttgcctggcttatttcacttaacctaatgtccttcagttctatccacgttgttgcaaatgacaggatctcattcttttttatggcggaatagtacaccattgtgtatatgtgccacattttctttttcttttttttttttttttgagatggagtcttgctctgtcactcaggctggagtgcagtggtgtgatctcggctcactgcaacctccacctccctgattaaagcaattcccctgcctcagcctcccgagtatctgggattacaggtgcacgccaccacgcccggctaatttttttgtatttttagtagaggcggggtttaaccacgttggccagactggtcttgagctcctgacctcaggcaatccacctgcctcggcctcccaaagtgctgggattacaagcatgagccaccacgcctggcccctgtgccacattttctttatccatttgtctgtagatggatacttaggttgcttccaaatcttggctattgtgaatactgctgcaataaatatgggagtgcagatatctctttgatatactgattctttctttttggcatatacccagcagtgggaatgctggaccaaatggtagctcaattgttagttttttgaggaagctccatactgttttccatagtggctatactagtttacattcccaccaacagtttatgagggttcccttttctccacatcctcgccagcatttgtcattgcctttcttttggatggatacaagccattttaactggggtgagatgatacctcattgtagttttgatttgcttttctccaacaatgcatgatgttgagcaccttttcatatacctgtttgtcctttgtatgtcttcttttgagacacgtctactgagatcttttgtccatttaaaaaaatcagattattagtttttttcctgttgagttgcttgagctccttaaatattttggttattaatctcttgtcagatgtatgtatagtttgcagatatgttttcctattctgttgtctctttgttgattgtttgctttgcagaagcttttgaacttgatgtgattccatttgtaaatgatacttttgaaaaaaaatgatagaagtggagaataggttagtggttgctggggtggagggttgtgggaaggagatgggtgtggttattgaaaggccaacttgggggatccttgtggtgatggaactgttccatatcttgattgtggtgttggtatacctgaatttacacatgataaaactgcatagaaatgcgtatatatatacacacacacacacacacacacacacacacacatataaaaatatatatacacatgtatatatacacacacacatatataacacacaaataagtacaaataaaactagggaaatttgaataagatagatgggttttatcaatgtcaatatcccagttgtgatatcataatatagattaccaggatgttaccattgggggaaaagggatctctgggcattatttcttagaactgcatgcatatttccaatatctaaaaatagtttgattaaaaaattgagacacagtaattgtagttctttacaatatttgttaaataacaagataaagtggcaggttgtataactcaagtaattttgaagaagtgataagcataaatgatagttaaggtattttcacaagtgcactatgtgtggtataacaggaaaataaatgtgacttggtgaccaagttgcaggggctgctaataccactgtaatctgtttcctatattcatagttgaaagaagtactagatttaagtaagaggttactgaaaatatgttttcctttccaaattcacataccccctaaatttagaccccaggataagaacccctgactttatatctttttacatttcattatctgttatatctcaaaggcctctgtcaaataaaagagaaacataatgtgtatttgttttgcctcaaataccatggataatgatgggggctcatagaaaatactagtggacacacttcacagttttaatgatttacttgctattactcacccatatgcccattgttcaccaaaattgcttaacactagttttaaaagagaagtatatgtggattttaagtatagaataaactacacattattgatatgaaaaagaaatatgtcaaattgattgcttattatccagattgactaatattgactatcattaaatattttaatttgctttcgctaggaaatcagttaatgatggtttagccttcaattgtccgtatctctgagagtatctagatcaaatgaggctattgttttataagaaaggaaggttagtgttttgggattaatgttctactttaaaatatcacctttttgtttcctctaatgttaaaatctaaaattttttgaatatttgagtaattatttgaaattattatgaagtatttcctctatactctattggttaaatatgtctttcataacataagaagtaacaatatggacacagaattaaaaactatgtttagagtttgtgtacttgacatttctaatacaggctgagcatctctaatccaaaatcgaaaatgctccaaaatccaaaacttcttgagaaccaacatgatgccacaaatggaatattccacacctgacctcatgtgttgagtcacagataaaatgtggccaaaactttgtttcatgcacaaaattattaaaatcattgtataaaattatcttcaggctatttgtatgagttgcatatgcaacataaataaataacatgtttcaacttgagtcttgtccccaaaatatctcattatgtatttgtaaagattacaaaattggagaaaatcagaactctgaaacacttctggtcccaagcattttgaataagggatactcaatctgtaatacaagtgctcaaaaaatcatctaaatatttgttctgtgatggtctaagagtctgtaatttgggagtgaaatgcttaattgatatttagtagacagaagcttcaataagggaacaataaatgatttcatcatatacaaccttatacttttctttcattaaacattttagctaatcatattttagtaaacttatttaaatttttttgggaaaaatggcacatataatctgaagaattatgatgcttatacattgctgtagaaaagcttttatcacccctgccctataatttgcggtatattctcttgttttgcctattattttcatcctctgaaaatgccttagttagaaacagtgtttcctgcaatgggaaatgacacaatatgaagttaacctgatgacagtaattttctgtgtaggtttttttcttatagacttcaattgataatatgtagtatcttttaccctacatttttttgtgtggttaaaaaaaataaattaaaaaaagacttaaaggttagacctaaaaccataaaaccctagaagaaaacctaggcaataccattcaggacataggcatgggcaaggacttcatgtctaaaacaccaaaagcaatggcaacaaaagacaaaattgacaaatgggatctaattaaactaaagagcttctgcaccgcaaaagaaactaccatcagagtgaacaggcaacctacagaatgggagaaaatttttgcaatctgctcatctgacaaagggctaatatccagaatctacaaagaactcaaacaaatttacaagaaaaaaacaactccatcaacaagtgggcaaaggatatgaacagacacttctcaaaagaagacatttatgcagccaacagacacatgaaaaaatgctcaccatcactggccatcagagaaatgcaaatcaaaaccacaatgagataccatctcacaccagttagaatggcgatcattaaaaagtcaggaaacaacaggtgctggagaggatgtggagaaataggaacactttgacactgttggtgggactgtaaactggttcaaccactgtggaagacagtgtggtgattcctcagggatctagaactagaaataccatttgacccagccatcccattactgggtatatacccaaaggattataaatcatgctactataaagacacatgcacatgtatgtttattgtggcactattcacaatagcaaagacctggaaccaacccacatgtccaacaatcatagactggattaaggaaatgtggcacatatacacaatggaatactatgcagccataaaaaatgatgagttcatgtcctttgtagggacatggatgaagctggaagccatcattctcagcaaactatggcaagaacaaaaaaccaaacatcgcatgttctcactcataggtgggaattgaacaatgagaacacatggacacaggaagggcaacatcacacaccggggcctgttgtggggtttggggaggggggagggatagcattaggagatatatctaatataaatgatgggttaatgggtgcagcacaccaacatggcacatgtatacatatgtaacaaacctgcacgttatgtacatttaccctagaacttaaagtataataataaaaaaatttttcaatgcaaattgcatattaaattattttaagttttattataaattgattttaatatattttttatattttttgatacataaattacataactgtattactctcccagtaagagatggctttcttacataaatggagagaagccatctaaaggttctgcactatatagcattctctgttcaaaccaaatataccgctatcagaataaataaatagattcacttggatagggcacttattttgtgtttccctttcctccttgaactcaaggaactgatggtgatgaaaatggcattttgatttcttatgtttgaaagttataggagcctctccaagaacaacagtatgaacctttgtagatataatcccaaatatgttaatctatagcattatattttcagagaacatgatgatagattagaaacttatttgattaaaatagccaaagaaatggacttcattagggtttgtaaatcatggtcaataacactaacaaaattactgttttcatgaaaatattgcccatcctatttgaagatgacatccctgatactaattgctatctatgtgcatgctgtatagctgaaaagacctgtgtacaatcaatagttctgtctagtgtctgcagcaagatacctttacagctaagaaccataaagccttttcccaagttgtaagtaagtctgtttttacattaaaaaatgacagaccatgctcagactaagtccatctaaactcagaagtgattatctccactgcaaactagaagtgttctttcttagaatattgcttctctgctgttgattttaacatttcatatcagagcaaggggaatctgtgactattaaactggcccaaactaccttttgattatttgtgtactgtcttaaaataatacaagcccagtcacattgactagtatctccatcctaatgattttcaaattaaggaatggcttcaaattaggaaagctctttgttcacctaggtttggaatagcatgatgtatgctaattgctaactttgtctgcattattttttaaagatcaaatgggcacagtggtaattttcattaatctcatacagagcagctaattaaaatttccattattacccatccattatctagttgtttcctttgttcagtatcagaacaggatgttaataagccattcttgtcttacagccctattaagtattatgagaattaatgtattgcactattttgtttttaggtgattttaaaaatattttcttgcaccatattgattatactgaaggtactttgacaccttgacattttgtaatagagatttcagaattaaatacttgttgctttaacgttttattcaatattgagcaaaagtagtatatagtagagacaggagctatccaaggaccagaatatttgttttagtctcatactcttactgattatgtgaacttaggcaattacttggattcctcatttttgtaatgaggatattagaagaactgatctttaagggccagtccagccttagcttgctatcatattttcataattttcaaatatgaacttatgttaaaatctcaaagtccttctaagcttggtaaaaagcatctgttctataaagttatatattctctgtcatgctctagtagattgtttgcttccattccttataaccagagaggatcctaaattttataatttaagcttgtttctaagacttgggtggggagtgagccacaaagtgatgggctggctcacttgtccacaaggagtacctcggccataaccatatgtcccaattagactaatcctgtagggaatcaattagaaaaagggaaccaacattttctcagtagattattctgtgtccatgagatgcccaatataaaatacctctgagctgtcctcagcataccatacagtgtctcagtttacctgttctatattcagcatctctgaatatattacaactgaaagtctcagaactataatattctgaagcaaaactaagcttagaatcttcagcatgttgaaactcatcactcatctacccttttgtttattctctatccatccatccacccaaccatccatccattcattcattcaggaaatatgtattgaatgcttacttaagcactgtcttaagatctgaggatatagtggtgaacaaggcaggcaagaatcctgtcataagagcttatgttttagcgcagaagacagtaaacaactaaattacaaaaataaattttcatagaggtaatactgtaaatgatatttaaaatggtgttgcgatgataactagaatgtggggtggggagaagactatggagctgagattaaaatgatgggagccagcaatggagaggttgggataagggtcttcaaggcagagaaaactgcaaaatacaaaggtcacgcaacagggttaaattccatatacaatcctctaggggaagattagtggtgcctttttatatattaatttagaaataactttgaggattatatgaaagcggtatgtgactacagacttgaaaattttaattcgttttactagtagttttcagactggcacatgtagtaaatagatcccttgttactgatgaactttgtgttgttgtagaaagtgagttggccgagcaaaaataaaactataattttgaatttgcaaaattatgctttaaatatttacttgctattattccttgtgaaataatagatggataaggaagttacaggaatatggacatgatctctcggtgatggttttacttactgtgccatttaggtgatgatgattcatccagtatacttttttatttgtggaggagacggagtcttgctctgtggctcaggctggagtgctgtggcgggatctcagctcactgcaacctccacctcccgggttcaagctattctcgtgtcttagcctcacgagttgctgggattacaggcatgtgcctccatgccagctaatttttgtatttttagtagagatggagtttcaccacattggccaggctgatttcgaacccctgacctcaagtgttccacccgcctcagcctcccaaagtgctgggattccaggcatgagccaccgtccccggcccatccagtatatttttaacgtctactgtgtctcataacgaagcaagaaataccaagtcagtggccattatacaaaatatgggagctcaaagtatgaaatcgtattccttgttctgcagttattatggagaagttcaataataacacacttttattgaagctcactaaattcatgaccggtgttagttatgtggcatagatggagttcccaatgtagaagtgagacagacacaaataatgacctctaccacaatattttaagtgctataataattataatattgccacagcgctaagggaatagagttcccctatatgttataagcctttatcagactttaaaaatttagcatctaatgggatttttgaaattcagaaattaagaatgattaacactttctacattgaggaggcattctcaataaaaacccaaatagtgtgaaatcatagggaactcatttctcattattaacatttttttaaatgtcatatcctctaatgataatacctctacccaatggggaaaaattcctttccttatgatctccttataatattatatttcctatgatagtatatccttatgatgttattttatagtaagtatccttagatgcttagcagaaactgagtgtaatttttatgaacctgtaaaatgggactcaagcttggagtcttaattcagggatatacatttacagtataggaaaggggcaattatgattaggtacgtctagaatgtgaaactatcagttgttagtatagtgaatgtgttgacaatattttcctcccagccttttccctgaactacttatatagttatagcaagatgatgaagttaaggagctgtgatgagatgagttctagaaacaactccatctatattgaaagttaagttaaaaactagtcactatcagataaatgtatttaatgactttttaagattaatctacaacctgagagtaccagaaaggaataattgggaactggtgaatgctttcaactgatttgattaattaacatgctaattggagactatattgttttacattttaataactgttttcacttattttttttagaaaggctgatactctgatatctttcaatagatttgggttatgtataatggtatatattaaattttatttgctggattttgtggaattgaatatacatatcttaactaggaaaattaataagatgatttttgaatgcttatcctctgggttaaggaggactagctaatattaattctaatgcctgaattgtaaatttaagcacccctgtcaatgacactttatgtaattcaagttcatattctattcaggtcatgagcaccagcactgtaattttttttttaaatgaggttgaggaaaatgttgagatatatacaacacaattttactatatcaattctgtgatcaagaatttttaagtgtgtagcactctgcacacatttttatataacaaaataaatattctatgcattattttacttaaattttttttgaaacattgtctaaaatggtctctttgtttattttatagggtgggctgaaaaacagcaaacatgaatgcaccctgtcttcacaagaatatgttcatgaattacgatcgggtatatcagatgagaaacttcttaattgcctagaatccctcagggtttctttaaccagcaatccggtcaggtaagtcgttcttatcatttcggtatgattcatacaatttgtagtgcatataattgtttgggaatataataagttttgttatttaaacctcaagatttcctgactaaaaatctgatgttaataaaacagcagcatctgattgtgaagtcgtaaacttttaaaaatatatttagttagttggatctctagtaatgtacaattttaagaatacaaatgttaacatagagccagaagttaaatatccacatttacatggaaatctatttgtgggatcagataattattatatatttatttataaagcaaattaagtatatttgctccatgattttattcttttttttttttgtgagacagagtcttgctctgttgcccaggctggagtgcagtggcacgatcttggctcactgcaacctctgcctcccaggttcaagcaattcttctacctcagcctcctgagtagctgggactacaggcacgcaccatcatgcctggctgatgtttgtatttttagtagggaaggggtttcaccatattggccaggctggtctcgaactcttgatctcgtgatccacctgccttggtcttctaaagtgctgggattacaggtgtgagccaccgcgcccggccgattttattcttttaaaacttgaaaggtatatataactttatgttcttctataagttttagatatactcttcacatatttctgtaattttgagatagcaaaaagtgaattattttaaccagtaaaagaagtgagagcattaataaacttctcaaaactctactaatttaggctattaactaactacaaaggattgttattaggttacttgccaatggtggattccagtaactgtggttcctttattaagcctttaaatcaataacacccaaaataaaatgttttataaagaaaaataaaatttcaataaaatatcaaaacattcttggccgggcgtgggggctcacacctataatccctgcacttcagggggctgaggcaagtggatcgcttgagtccaggagttcgagaccagcctggccaacatggtgaaaccccgtctctaccaaaaatacaaaaaagtcagccaggtgtggtgatgtgcgcctgtggtcccaggtattcacgaggctgaggtgggaggatcacctcagcccgggaggtggaggttgcagtgagcccatatcccgccactgcactccaacctgggagacagagcgagaccctgtctccaaaaaaaaaaaaaaaaaaaaaaaacaaaaaaacaaaaatccgggatctatttatgtaactactagaatcttaagttcagaatttactccataagagtatataaaaaacttactgtgattttatccatgtttttcctaatatataataggtctaagtcttgtacttttctgtcctgtccacagagccttgaaaataatttagagctcagtcattcagtttggatttatgtataaattgaaatatattaattacttatttatagtgcacttggcaaaatgcccagaaaattacaattttaaaacaacaaaaaattttttaaaagccagtgttaagatgtgacttatcttagagtatgataatcgttgaaagacgattgtcttgccatttcttccaaaatgctcctaggttttttgttttttgttttttgtttttttttttgagacggagttttgttcttgtcaccgaggctggagtgcagtggtgctgtctcggttcactgcaacctctgcctcctgggttcaagcgattctcctgcctcagcctcccgagtagctgggattacaagcctgcaccaccacgcctggctaattttagtatttttagtagagacgggatttcaccacgttggcaggctagtctcgaactcctgacctcaagtaatcaacctgcctcagcctcccaaagttctgggattacaggcgtgagccactgcgcccggcctgatgctcctagttttaatggtttgaatgaacaggggacgtgagttcttgagaacagtaactacggtggtgcatttttcccccctgcacgtaacgtacagcactctaccgttttgccaagcactttgtgctcctaaaatttctgttgcattgttgtttgaatgaatgaataaatgagtcttttaaaagtaattgtagaagttgcagcattaagaaataaagaggggggctagtaaaaatgcatttttatagagatgttgggaaaggcttgcttgaaattacacgtgggacttttaatagataggcgctttgaccagctaagcaacagggctcccctcgtgtgggacttttagaatgtagcaaccactgacacacagggaaggattatgcgatcaggtgagaaggtggccgaccctgactggctggaagcagatgcattctggtagttgattggtccacaggtagcgtgacgcttgtcacgtcctcagcctcccagcattcaatcgtagcctttcggacagctcgaagccttctgtggagagctcgaagccttctgtggagaactcaaagccgtccgtggagccccagacgagccaaagcccaccttctcctcagcctgagctgtcttgaagatgagtaagagtgggtttgggagctatggcagcatttctgctgctgatggagcgagtggaggcagtgaccaactgtgtgagagagatgcaactcctgctattaagacccaaagacctaaggtccgaattcaggacgttgtaccgtgtaatgtgaaccagcttctcagctctactgtgtttgaccctgtgttcaaggttaggggaattatagtttcccaggtctccatcgtgggggtaatcagaggggcagagaaggcttcaaatcacatttgttacaaaattgatgatatgaccgcgaaaccaatcgaggcccgacagtggtttggtagagagaaagtcaagcaggtgactccattgtcagtcggagtatatgtcaaagtgtttggtatcctcaaatgtcccacgggaacaaagagccttgaggtattgaaaattcatgtcctagaggacatgaacgagttcaccgtgcatattctggaaacggtcaatgcacacatgatgctggataaagcccgtcgtgataccactgtagaaagtgtgcctgtgtctccatcagaagtgaatgatgctggggataacgatgagagtcaccgcaatttcatccaggacgaagtgctgcgtttgattcatgagtgtcctcatcaggaagggaagagcatccatgagctccgggctcagctctgcgaccttagcgtcaaggccatcaaggaagcgattgattatctgaccgttgagggccacatctatcccactgtggatcgggagcattttaagtctgctgattgaggcagggaaaacatcctttcatttttcgaagacccttgcatccagctgtgagtaattttgacctgttgactttttaggaagtaggactaaaaaaaaaaatctcaagtggcattctttgtcaactcgctgcttttctaactgctttgaacttttcggattttctgtatttgaagctcagagagagacggtgatggataaattgacaactctgtaggatttactagcaagctaatggaaacatgattttcggggaagaaaaactacagaaaatgtagaaatttattatttaattgtgttggagcttctttttccaaaagaaaaactagttgcagtcagggagccagcgaaaagacaaaaaaaaaaaaaaaaaaaaaaaaagtcttgcttgtttttatgttagacttattttccgtgtttggatttagcttattataatgatactgttatctcttgctcaatatagtatttagtatttgattaattcaaatgagctgaagatactaatttgtgaattctaatgctcagttcaaacatttatgtgtgatttgctcttattactatgaatttatgttttcttaaaataagattatactgtgtttaaataaaccatttttgccaggttatctttgaaattttttaaaatgtggtgaagttcaatgattatttcatatatgatgtggtatttggatgaaattacaatttattgtagttgtatggtaaatggatgccagagtttctgtaagtttgatgtgctggtgtattatttattttactaaatgctctgttttatgtataaaaaggtaatttttaggacgttagggaaacagctcataggaatatgaaacttactgagtttaacacaaatttattcaaatgttttattaaagtagtttacaaaatcttaactttcctgtgtgatttttttttctaagtacatttgaaaaagcctttttgttttatatccttgaggattaatagtttcacttatccagaattttttcttttctatatataaaatacccagaacatatgctatagcctagttctaacaatacattttagtgtagattatataaattatgtgagacttttaaataattgaccattaacgaaagccctcagttacctatacactaaagatggtgtctttcaagatgctaatttttttacattagaggaaataaaaaacatatactttttaatgaatatatgttatattttatatatgtatattcatatataatatacaaatagaagaacattatttgtcaaattgaatcatgaaaactgcaacaaaaaaaaaatctcttaaatggaacattgccagtactccgtactttcaggaaaactttcagaaaatggcctgtgtcagtggccattagaaaaaccactaattcttgcctaagctttgtgatgcatatttttcttccccttgaaagtaaagaaattgtaaatggcactcttgaaaagcacagatgaataacatactataaacctgttacttaaattatcagacattttgaaaattctggtcttcataaacctaaaatattcggaaccactttttgttgaaaaaggttacctgtcctagggaaaatcatactgggggagaggcaacaaggggcatatatacttggaattgtggagctgaaagagtctagcagatacaatattcttttgtgacattaaaatctgatatttatgagtataattataggtcactcccataattgcttgagctgattcagctggccagtggatgcgtagccacttgtttttcctatactaggagcatgcggagggggaaaaaaactcttttttttttgtttgggaggccaaactgcttttgtccctgcaaactgatacactgagatatgtacacctgaatttaaggcagaagaccaacctctctcccatcctgtgaggggaaatgtcctctatctgtgttcgttggggtttttttaggcttttaaaattactcctcccaacgcttattcttctgaatggaatcgtgtgctttagtggattctgctgcaggtaagagatagcagtggaaaaatagtaagtaggtctagatataatgtcagtggaaataaaacacttttaggcagaaaatcactggattgttttatacatgtatatttagtccatgttaaaggtagcagatttttaaagttcattttgaacacccacctggcatgcatactttttcaattttgtttagactgggaatgacttggctaatatcccctttctccaaggtcctgccctgatagttagccacaccttttgaggataagatacaaatcctggggacatactattgactattttgggcagggacatttaagcctgaggaacctgaaaaacataattgatgattataatccacccaaggttttttcctatggctcacaggcttacgaaatgtatgtatttatattgaggttgattctaaattaactatgaataaatatatttgaaagtgttttcaaggccaatataataatcttactatggtcataattattagtgatcattttgttacttttacctactaaatttagtaatatttggagtagaagctgaaaaacataagttcttatattttttcaatttctgtttactttttataacagcaatttaaaaaatgtaactagcaagaattatgtttgttcctgaaacctttattgagttcctactatatgcatttaagtgttaactttaattttgataagcttaaattttattgacttctgaaatgcttattaaagatagtaatagttaacattttaacatttatttagtatttattatctcccaagtactgttctaagagtaggagttgtgtgtatgtgttgtgcgtgtgtgtatgtgtgtgtgtgtatgtgtgtgtgtgtatgtgtatgtatgatccctgtgatgcgtagatttacgttttcagctcagacctctctgtttctctctctctttttttttttgagacagagtcttgctcttgtggcccaggctggagtgcaatgtcacaatctcggctcactgcaacctctgcctcccaggttcaagtgattctcctgcctcagcctcctgactagctgggattacaggtgcccgccaccatgcctggctaatttttatatttttagtaaagacggggtttcgccatgttggccaggctggtctcaaactcctgacctcgtgatccgcctgcctcggcctcccagagtgctgggattacaagtgtgagccacccacctggccagacctctcttttgaaattgagactccatctccaaatgtcttattggatgacatataggcatttttaatacattaaaaaataatgaaaaattatgtgtgatatgtgttttttatatatatatataacacagatatatatctctatatatgtacacacagatacatatatctatatatatacatacagatatatatatctatatatatacacagatatatatatctatatatatacagatatatatatctatatatatctatatatatacacagatatatatatctatatatatattaccatgtatatacagatatatatatatctgtgtatatattagtatgtatatggcatttactacccctgtgcaatgttttaagacctttaaatgtacatatacaatcaggataacagtattgttcgtattttgtagatgaacttgaggctcagagaggttaagtaatttgcgccatattaaagttgcatgcccagcaagtgtcagtgttaagatttaaacccaggctttgtatctctcgagagcctaggcctttaacaactggtttgtacagtgtcacaataaggaaagtctattaaaatagtattctttcactgttgttagtattctttcactgtcatcacatactgaatattttgactttctttcattaatatttgtctgatttaaatgaaaaagaaactatgaaaactttcagcaaatgtgtagaagataatataaaaacacctttgtactcatctatcagcttaagagacaaaacattattttttgctgtggtagagaacttagttgaataacttgggagtttttttatgatatcgtaataccatttgggcctatattttcattgatttaaaagatcgtctgaaattctacattttctctaaatctatgcatgtagtttttgcaatataatatcttaagaatatatatcagtgtattgaaaagcctatttttttttctgatcacatagctgtgtgtaaattgggacttctttgccctatccattgtggatgatacttctagtaattctaacaccatctctatgatatttattccaatttgccatcatgtgataaattacgaaaacaattttttaacattaagagttaatttcctttggtaataccttaaattggagaagttcaataaatagcacttaatattatgtggtttgtttttacatatcacatggataatcctacaaaggaataacaaaactaaattccccttgtccatatggggcttatatatatggagcttacattccagtacaggaattcagacaatttttttaaaggtgtacatcaaatatcaggttgtaatatgagctgaggaggagatgttgctattttatattagatgatcagtgaaagcctccctgactttaatgacatttgcacagaggtctaaaggaagtatggcagtgacctatgttcactggaggagtaatgttgttagaaacggaaaacagcaacagcaaataccaaagatgggagcatgcttggcatgttctaggaatgtcaaggaggctagcatgctggaagcagataatgtagagccttattgaccattcaaaggactttggcttttactttgagtgagctgggacactgttagagagttttgaggaatggaatggcatgagatgacctacatttttaaaggatagccctgggtggaagcagggagaacatgttgtacattactcaggcagaaggtgccactggccacagaggtttctagctggtgaagtgacaccccaggatcctgtgacaatatgataaatcattctagttcttgatcactcctctgtggtgaccttggtccagtcaatggacctctttggtcctcagtttcttgatatgtaaatgggattggagccttccagctctaagcctctgtgttctgtattttcttttgcttagttttaatcctcttacctttgctattggaactagattagtgtttaggtattattttgaagagtgagaagaatgttcctctataaggctagaggatttcctaatgtttcattattttttgtatttataaatgtatttaaccacccccagacagatatttataatttcctttaaatacggatgaaagcagttcctaaaactctgttgcataactgtttttgaaacctggtgttcattagaacccacaccgttgtcctctcgtgggtaattctcctccctaccacagttttaattggtttctttttgttcagcccctcgtaaaatttaaaaatatatataaataagtgtacacacacacacatacgtatacatactaacagttttaccaaacatcctcaaaacagtcattttggaatattaagtggggtcatgaatttcaaattcacatggtatttaatcactcaggtgataaaggctctaagaaagtcattttggtatattattttctgctaaagcaaatacttaaaaatcccttttataagccctcattaactggtcctatctcagatcactctgttactgtacatttccctcaacatttattttttactatatacatttacctgtgtctgtttatactctgtaatagtttcatgcatgcatgtctgtttttctcatttagattttagtctcctctggggaagggaccctcttaccctcttatttgtctcgtggtggctggtactgtgtaatttatatatactaatgtgtgatttgatgtagttattgacccaccatcaataaaaacctatgcttctccaccagtgggaatgaatttgcattaatcggcactattttgtggccatgcatttttagctgtaatcagaaaaagaatgaagctaacttcttccacataagaatgaaaccttggtttgaatcatattcacaatccacagacaacatagcatgctttacacaatagccttgttacagttgcatggtgaattaatgaaattgaatgtttacaactctatttaacactctaaaaatccatgtgctttgaccgtaaagtaaatcccaatctgccatcacaaattgcattagactttgcacataccatggtctatgtgtgatttagaatgaggactctgttatttagagatttttgttcatatctctttactaaagtttatgaaaggaagcagtgcctgctgagaaatgaccaatgagtttggacagttttattcccagccaattcattgcaagatgtataggtatttggcaatacattttatgaagatccaaagaaatacgtagcaatagatcattgtcactaaggtttcccagcacatgacaaaaacagcaaatattgctttgaagaatagtatcacagaattgtgattgcctagaattcttgttagagttgttgctgaaattgcctcacagctttaggggtattttaccccacgaggaaattgttttttctgtttggttgggatccacttatctgccaaactcatggcatagtgtctgtattcacatcctatgatgatagcttcctcagccaatatttccaagccagtgaaaacataaaatatcttttcaagttgatacatgtgcagttatttgcattacctctggaatatttgtgtttatttgatgctatcttccctttagatttaaacatatttttctagtgtatttacaaatgtgcattttaacataatcataatgaaaatagatggatcttgacaacaatacaaattaggactagaaagcactttctgaattgtaggtcttaataagtatttaaacaacctgtattaaacttattaaaagcttggcaaagcggccaacagtacttagaaagttaatataaaggtaggtacagatcaatactcttagaacattttgcaggggactaactatgaaagatggaataataaggatactttttacaatgtagaaatgtgaacacggcttaaaattgtgagcacatctcataaagcagcattatgtgcggtattactaaagcaggtttttaaatattggtatttggaacttctttgctttcactttcaaatccataaatcattttagaatagcactagtatatttatacatacaatacgaaatggtaaactcattgcagttgtcaatttatatgccttttgttaaaatcttggtcaacaattcaaattcgtatcaagtatattcaggctcatttgactaagttgataccatatatattaagtgacatggaaattttaattatatactattagcttcaaaacataattctgacttcggcacatgcaatgatattacctcttaatagaagcaaagtagatttatgtgtcatacattattttaaaaaagaattaggcacagcaaatactcgagtttttgaagtattattaggagaaaatgctacaggcattaggataaatagtggttcttgtgttggatttattttattactatgtaagctccaccaaggcaatacattttctcgtttaaatgatgtgttttaaactagaaagccaatttttatataataatcatctaaaataattagaaacatgtaactggtcatataaaggtatgtataatctagcagcagaatctaggcacactgattatatggatttctgagtagaagcctaacttccctcttaaaacacttatatgcattttctacttattcaaaattagtcttgggaagaaaatgcttataaatatgtcatttgaaatatatttatttcgagttatatgaactaatttaactaaaggtcttgggcacatactagagttttaatacttctctcattattttgagaatattgtaaaagtagttgcagcttaaaataaaagaagcagatattctacttccgtaagacaaaggtaaaaatgccaagctccaattaaatgaggaaaggaggtggaacttttccaaaaacttaggacaatgtcaggtaatgatttgagtataatgtagatccaagtttctttgtgtggagtggagaggggtcggggggtgtttatcaggtaaacagttctgtctctcagtaaaagtctctcaataaaaagagagacatagctgttacctgataaacgacattgcatctcttttgtgttgttgtttgtttgtttttcaggagggtcattcttcctaattctgaactcattttattttgtggttctttaaatgagggatattggacaacaacagtagaatgagtccttgatagttttccataaagtacagaagatttctatgaatgtccatttcctgcatttagccaaaaagtaaaaaaatcaaggttatgatatttctacaatgaccaggaataatagtactggaatgcagctttctagtaatctaacctgctaccaaggtgtacttgagaaatgcccctgaggctctccccttggactgtctatcatctcagctggacttttgatagaagttggatagctgacaactcacaattaagatgccagctggcacctggagtgcaagtagtctgtatagttgattgaaagaagatccatgtgcactagataacagtatttgctctatgaccccagctgttcgactggtggtagataatggacagctaatttggggagatttgccacctggtcagcaaagctgtaagtgtatagcctctcacaccaggcagtttaaacctggaatcttctgttaagatggaatccatgaaggcagaatatagaagataacataatgttatagtacttctaaaaactaaaacatcttcaaatgagacagttttggtgacctcttatatgaatatgaatttcaagcctttcatatacccgaaatcaacctactcctgttaggtcagttctgcagcatccagtgttattgaacatatgcagattgactctatttctattttggaggatattgcctgagtactgagtactgctacagtttttttttttttcttttatgtggtaccatacttcccttgataccagcttccaaaagaatttcctggagatcatatcttaaattggtacgttcaacatttattcatcaaaaactattgaagattggagtgctgtagttaaacacatttttaaaaattgagttataaatttccatatgtgaattaatatctgtcaaagaatatcttgaagtggatacagcactaaaactatattaagtattaatgaatttttcttcgatatagagaatgcttaagaattttatagtgcctttgaggttcgcattatgagcatttattaagatggtataatactttaagtgtaagtggtgtgggacatcaagctgggggtattctctgaccttgtgatatgctttggatcttcaaaaacttttctgtcagtttatgtgcttgatgagcaatgatgttgctttctcctgggaaggagatgggttattatgtgggtttatcattaattttggtttctgttaccatttttgtattgtttgcaaattataatgatttatctgttgaaatcatgtgtcttaatttgctgatgaccatagtttgattcaagtattcaccttattgcatttcacaatgtgcttagaaagttggaatgataaaagttaagaataaatcgctatagaggagttcatttggggagcaggaaaaaatcgcatatacagattagtttttcttaatttttttttttttttttttttttttttttagtttatttgtttgttttgagatggagtctggctctgttgcccaggctggagtgtagtggcgcaatctcggctcactgcaacctctgcctcctgggttcaagcgattctcctgcctcagccttccaagtagatgggattactggcgtgcgccaccacacctggctaattttttctatttttcgtagagatggggtttccccgtgttggccaggctgttctcaaactcccaacctcaggtaatccacctgcctcggcctcccaaaatacggggactacaagcgtgagccactatgcctggtccagactggtttttaaaatacgtgactggaaagttctgaatcatattgatataaaggatattagataaatgtgaattatcaaatagcactgtggagattacaagcattatgctggacacatactgcagaggtctatataagcatgatattgggcttattaatctgtgaactcacagctgatttggaatcacataataatgttccactatttaaaataataatccttagtatattctttgtcttagaaaactcatccatgcattcaggatcttggctctgatccttgtgtgtatgatttagcatctttgatattcctcgtatgtcacatttgctcattttttcacttgtgatatctaaatggcttttacatttccattggcaataatctagctcaggcctcactccatttggagacaaaaattgatagaggaagtgattggtctggcaaaacatagttactgggtttattgaaaattcagtataaccaaagtgaataaggtaaagtgcaaaaggataatgaagtcaaggaagttagtaggaagcaaccccaaaatggctgaccaatgtctttcatgttgagtatggaagcaaggaagggttaccaaggactgttattcccaaatgaaaggcgagtggctttattttttcaaactgattcctaatatttgtgaagtattttgtgtcagaccaaataccaactaatagttactacattttttgaagtgggtatttacaggtatatatcattgacatgtctacagccaatagtcataaattgtaatatgatagggctcagtattttatctattggtacatggaaaacagaaagaaagtatattttttggacatctctgatgtttttattatctaaagtatcctgtgccttgatgatgcaacccaaaattaataattaaaaagatgaaaaccacctcattggtattgtttttacttctacatataaccattggtgatatttttaatatattaacttttatccaatatttgttcatgaaaggaaaataaaatcttgtaacctctaattaatgatttttatgttgttgataatatagtttaatgagagtatataagaattgagaagtgctggattctattgttttactattaggaagctctgtattctaagataagtcactaaccttctttagtttcttcatctacaaaatggagtaacttattttatttcacaaccagaaaagctactcttattggtgtgagttctttcatggaggtttgtttgtaaatgaagaaaaatccatgtttttaattaaaattatttgtttgttttggcttttaactgttccaattaaaaagagagtctttgttattttgaataaggccaaagttatttcagcaattaagacgtgctttctttacaaagcatttatatgtttgaaaagctttagcaaggataaatgcatatcttttaggtgtagctatatttctagagttttctgaaaataggtacaagtcaggttgacaataacagaaggctgatatctcttagggactttatactgcatttagtcctacaaatgctttgtttgtatgtcatgtatatatttgttatttttgtgttgttattgctttagatggtttatttcactataatataagaaaaataatagcagatttggcttattttgtcttggataaaagccttaacaagttgtttagtgggggattattaaggattttgaatattcgttgtatttatgttggtcaaaggatacaaaatttcatttaaacagaaggtgtaagttcaagagattcatcgtacatcatggcgactgtagttaataccaatatattgtatacttgaaaattgctaagagaagaaatttttaaaagattatttttaaaatttcaatagttttgggggtacaggtggcttttggttacatggatgagttctatagtgttgaattctgagattttagtgcagacatcacccaagcagtgtacattcattgtacccaatatgtagtcttttatctctcacccacctcccaacatccgcccacttactttgagtaatgatggtattttgatggaagttgcaatgaatttatagatagcttttttttttcaaacaggtcttagtttattccaagttttacaaagtcaaagttgcataagtcttacaaagtcaaagttgcataagtcttacaaaattaaagttgcaaagtgaatagtgaagcaaatcaagaagatttttttagatcatataagaaaaggtagtaatcaaaaagtaaaacccagttgctgaatttaggttagttaatataaggcatgattatgtaaaactgactgtaaaattgagatccagtttttaaaaatccaagttatttgtaggcaaatgttaaacaattaaaaaaaattttttttcaatttttttaaattttattttattattattatactttaagttttagggtacatgtgcacaatgtgcaggttagttacatatgtatacatgtgccatgctggtgtgctgcacccattaactcgtcatttagcattaggtatatctcctaaagctatccctcccccctccccccaccccacaacagtccccagagtgtgatgttccccttcctgtgtccatgtgttctcattgttcaattcccacctatgagtgagaatatgcagtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgatggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccgcaatggttgaaccagtttacagtcccaccaacagtgtaaaagtgttcctatttctccacatcctctccagcacctgttgtttcctgactttttaatgattgccattctaactggtgtgagatggtatctcattgtggttttgattttcgtttctctgatggccagtgatggtgagcatttattcatgtgtcttttggctgcataaatgtcttcttttgagaagtgtctgttcatgtccttcgcccactttttgatggggttgtttgttttttttcttgtaaatttgtttgagttcattgtagattctggatattagccctttgtcagacgagtaggttgcgaaaattttctcccattttgtaggttgcctgttcactctgatggtagttcttttgctgtgcagaagctctttagtttaattagatcccatttgtcaattttgtcttttgttgccattgcttttggtgttttagacacgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttctacatatggctaaccagttttcccagcaccatttattaaatagggaatcctttccccattgcttgtttttctcaggtttgtcaaagatcagatagttgtagatatgcggcattatttccgagggctctgttctgttccgttgatctatatctctgttttggtaccagtaccatgctcttttggttactgtaggcttgtagtatagtttgaagtcaggtagcgtgatgcctccagctttgttcttttggcttaggattgacttggcgatgtgggctcttttttggttccatatgaactttaaagtagttttttccaatcctgtgaagaaagtcattggtagcttgatggggatggcattgaatctgtaaattaccttgggcagtatggccattttcacgatactgattcttcctacccatgagcatggaatgttcttccatttgtttgtatcctcttttatttcattgagcagtggtttgtagttctccttgaagaggtccttcacatcccttgtaagttggattcctaggtattttcttctctttgaggcaattgtgaatgggagttcactcatgatttggctctctgttcgtctgtttttggtgtataagaatgcttgtgatttttgtacattgattttgtatcctgagactttgctgaagttgcttatcagcttaaggagattttgggctgagacaatggggttttctagatgtacaatcatgtcgtctgcaaacagggacaatttgatttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattgttttgagataagtcccatcagtacctaatttattgagagtttttagcatgaagtgttgttgaattttgtcaaaggccttttctgcatctattgagataatcgtggtttttgtctttggttctgtttatatgctcgattacatttattgacttgcgtatattgaaccagcctgtttggcagcatggtcattttcacaatattggttctacccttccatgagcatgggatgtggttccatgtgtttgtgttatctgtgatttctttcagcagtgtttcgtagttttccttatagagatattttgcctccttggttaagtatattcctgagtgcttttttgtttgtttatttgttttcgttttgcagctgttgtaaagagggtcgagttcttcatttgactgtctgcttggtgccactgatttgtgtacattgattttgtaacctgagactttactgaattcatttatcagatctaggagccttttggatgagtctttagggttttcttggtatgcaatcatatcatcagcaaacagtaacagtttgatttcctcttttccaatttggatgctctttatttctttctcttgcctgattgctctggctggggcttccagtactatgttaaatagaaatggtgaaagtaggcatccttgtcttgttgctttcaacttttacccattcagtatgatgttggctttgggttggtcatatatggcttttattactttgagggaagtcccttctgtgcctcggttcttgaggatttttatcataaagggatggtggattttatcaaatgctctttctgcatctattgagatgatgatatggtttttgtttttaattctgtttatgtgatttatcacatctattgacttgcttatgctaaactattcttgctaaactattcatccctgggatgaaacccacttgattccgatatattatgtttttgatatgctgttggattcagttagctagtattttgttggggatttttgcatcaatgttcaccagggatattggtctgcagttttcttttttgttacgtcctttcctagttttggtattacggtgatactggcttcatagaaggattcagagaggattccctctttctcttttggaatagtttcagaaggattggtaaaaaatttttctttgaatgtctggtagaattcagttgtgagtccatctggtcctggagtttttcttgttgacaatttttttttattactgattctatttccttgcttgttactggtctgttcagagtttgtgtttattcctgatttaatctaggagggctgtatgtttccaggaatttatccatttcctctagattttctagttttcgtgtgtaaaggtcttcatagtagtcttgaatgatcttttgtatttctgtggtatcagttataatgtctccagtttcatttctaattgaggttatttgcatcttctctcttctttctttaattaatctcgctaatagtctatcaattttatcttttcaaagaaccagctttttgtttttttaatcttttgtatttttttttgttgtttgaatttcatttagttctgctctgatctttgctatttcttttcttcttctagctttttggattttgtttgttcttttctttctgtttttttttttttttttttttttttttgagacaagggcacccaggctggagtacagtggttcaatctcggctcagtgctgcaacctccacctcccaggttcaagcgattctagtgcctcagcctcccaagtagctgggactacaggcatgcaccaccatgcccaactaatttttgtatttttagtagagacagggtttcaccatgttggccaggctggtctcgaactcctggcctcaagtgatctgcccgccttggcctccgaaagttctgggattacaggtgtgagctactgcgcccggcctttgtttgttcttgtttctctagttacttgaggtgtgacattaggttgtcaatttgtgctctttcagactttttgatatagacatttagcactgtaaactttcctcttagcactgcttttgccatataacagaggttttgataacgtgtgtcactagtaccattcttttcaaataagttttaaatttccatcttagtttcattgttaacccaaaaatcattcaaaaccagactaatttccatgtatttgcatagctttgagggttccttttgcagttgatttccagttttattccattgtgttctgagaagatgcttgatctgattttgagtttcttaaatttattgaaacttgttttgtggtctatcagatggtctgtcttggagaatattccatgtgctgatgcgaagaatgtatattatgcagttgttgggaagaatgttctgtagatttctgttaagtacatttgttctaggatacagtttatgtctattgtttctttgttgactttctgtcttgatggtctgtctcgtgctgtcagtggaatattgaactctcccactcactatgttgctgtctatttcatttcttaggtctagtagtaattgttttataaatctgggagctccagtgttaggtgcatataaatgcaggattgtagtatcttcttgttggtcctgagagaggagatttttaagtgttctcataacaaataaaatcaagtatgtgaggtaattcctgcgttaattactttgatttacccatttcacagtgtatgcatgtgtcaaaacatcatgttgtacagtataaatatataccgtttttatttgtcaataaaaataaatataaatttaaaaaaacacatatttaaccatggttaagaatgtatgtatgtgcacactgaagaacatataatctccacggtatctttctcagcattaggaggaatggattttaaaatattatataaaaacaagaaaagactaaagcagtacctgttacagataacattctgaggaaaaagaacatttggacttgctaaaatgtttttgacatctacattgaggacccaagaaaatgattttctttttaggtttggtttcagttatcttgtgctaaaaatgtctgtgaacattaaatttctttgatctttgtctacgtagctatcacactctgtaataagtctttaattatatgtttttggcactgcacctggtaggtgagaaggactgttgcatttctgttgttcactcatcaaatagcaattacccttcaactctccttacccctgttactgtgaaaaaaaaaaaaaattcaccaatttctctgctgcccactagaatcagatagtataacatacaaactggtttaggagaaaagaatatgtacaggtggtatatgctaatgcctctatgtttcttcattgcattcaaataacttcttactttattcatgacataaacttggtatgagctctgtttcatttgcagggcttatggattgggaatgtgattttttggaatacgtttactttaacaaaattccacaaaactaaatgaaattggacatcctgtggtgtgcatgatagaattttaactatattacttatcttaggaaaataaaccaatacatttttcttgtggaagttaacattttattataagtttgactggttatgttactaagaaggcatctttaataagtgtcctaacataattatatctactatttcaaacatctgaagaagatagaaaatgtgagtagcttttacttgaatatttggaatactctttcccttcgcttcccttattgaccgtagattgaagagtctattttcattgtcattcaaattttttggtaattttttcctcatcattactttggaacaagaccttctcttatacttttctaccaataatgtttaaaggaaggtggggaggaaaatattcttgattgttagcctgttaggcattcagatagatttgggcataagccatttcttagactatctccaaagtaacttagacagcttatgaaattgattttaataaataaggaacttttatccttttagagagtgtttacttatactgttgccctcaagagatttttatatgtaactagagcatttaaaattattttgtaaatatgtaagaggaatttgtctttatgcaatataaacagctagaaagaatgcacatttcctactttgtaaggaactcctaaaaatggatgagaggcatgaaacatagtaggatttttgcagtaagactgatagaataaacgcagccagagagaaagatggaatgtcttctttggtgtttctaaggcaattgtaatctatcacaacattgaagtcaaaaccactcagaggtagaactggtaaactgatgcattcaaactttctatgagtcacatgaaataaatgatcagtgactgtcaggcttcgaaggtttatgcacaaatgtctgaaaatggtagtgttacgtcaaatagatattttataattggtcagagatatctcatggattaatctactatgatgaatagtttccaaggacattcaaatgcccaaagctattgtgtttgctttcatgtagagaaacctgagtggacgtatatgtttttatggatctaagaccaagtcagttgtagtgtacacaaatccacgtatatattatacatgtttatatattttttagtgggtatatatattgacagtgaaactgtttatgatgtttatttagccgaacaaattttccttttaagatgcggaaaatactaaggtttacttggttactgtttatgcagatttgatccatggactgaatatgtgatactgtttatgttgggctacatactggttttaatcacatggaactctttctttccttaagtgtatgcaactaaaatttggttttagttgcattaaaaaacattacagtagcaatattggtgtttaagtgagatgttttcctattttaaaaaaaacaaaccaaaacccaccactcaagataacatttaaagtctcctcaaccttttgaattagttgtttcacatgttataattttaccaaatttctgaattcccccaagaaaccctgaactatcattcattttatttgatgttccagtgattcaggttgtagtttgagattacacatgggaatagaacaccattagagggaaataaaatcctttgtacagaacacataaccctctatactagcctttagcactgcacaaacagtgataaagggatgacatgactaatattggactccttcacatgagaccaattgcctttacagcttatgggattcagtatagaagtttctaattttagctttaactcttttgaaagagatgttaatttggataatctaatcattgatggacatgcagtcactattttctattatatcttcattgtatatagcatactgaactcatctgttcattacatctttggttttacattatatttaagtgaaatgtaactaaataattcagagtctgaatctcaaatttatgggagaaaggttgaggttttgggaaactgtgaaatgttgtcctttataagaatctatgagggagcacagtcttattccctccttcaataggtacatttatagaaaattttcctcgttttgctttgccctgaagagctagagaggggagaatcttgctttctcttagatttagggttaattgaatcttctgataccttcattaaatgtaagattttctttcctttgatcatgctgatcagtataagtgggtcctttaaaaataatgaccttagaagttctaaaggcttgagataggtttctgttttaaaacttcaatatatttttgatataattctgtcaggattatacatgaactaaaaattctctccccctcaccattataatttccatatctattctgatgtgaattggccagcactaaatacaattagaattaagtatacacaaaattggatagtgaccagttaaaacacatgaggttggctgggcgcggtggctcacgcctgtaatcccagcgctttgggaggccgaagcaggcggatcatgaggtcaggagatcgagaccatcctggctaacacgatgaaaccccatctccactaaaaatacaaaaaattagccgggtgtggcggcaggcgcctgtagtcccagctactcgggaggctgaggcaggagaatggggtgaacccgggaggcggagcttgcagtcagccgagatggtgccactgcactccagcctgggaggcagcgagactccgtctcaaaaaacaaaaaaaagaggtaatatgagtaccaaatatttaaattataaagtctggcctcaaactcttgggctcaaatgatgcccctgtttcagcctcccgaatagctgagatgacaggcatgacactgtgccccagtcttatttttaaacaagtcaatagagtaagtttagtataattttagtcatctgcatgttttgtaaaaattaatataattttcattaagtgattaaaagttgtgttaatactgtggaaaaggattctttaatttatgcctaaaattcatactgcattttggactagaagattcaaacaacattcagatttttggtttttaacattttccaaaaatttcttaatggctttattgtgatgttttatatacattatttcatttaatagtcacaaagacttcatggggtataggtagtattctcatccctattttgaaaatgcaaaaacaagcttagaaaatttacgtatattatcaaaagtaacacaactagaatatgtagagatgagattagaacctagatctgttttcctctaaagcttatgcatttagccatgcagctatgtggccccacagcataatccaatgatggatgatggaatattttctttatttttgggtgaacttggaaaaaagtctttaatttttagctttttgagcagcgtaacagatattagcctccctgatagatacagccaaaccttttttacatagggttggaagatgctgtctcactgtgattcagacctcttgttcccaatataagcttcctggcttcctttttagtctccagatataatcttggctgctggttcactcaaacattaatcttcctgactggtctattgtttttgtttgggtggttcatttgttccacttggtctcctgacatgtgaccacaaatgtcaacttggatgtgtagcatgttaagacagttctttaacttaggtaacttataacacaaaatcaccaatatgttaataccttaaaaagtgagatcgtggacttacatagcccatccaaaaagaaatagtataagctacattttggccctattctttctgataaactaccttacctaaatgttgactgaaaattttagctgaagtctccagttatctgtccttaacagtattttgtagatttcttatgatgctcaggactttacttatcctatctaaataaatgaactaagctgttaaataatgaaacgtatgtttgtctgtctaggcatagatatgtagatataaaccgttctgtaacaccactaattcttcttaagcaaggtattagagctattagctagatgttatagaaaattgtgtaccggtcctcttttagtaatttctaaggatgtggttgaaataagcatgtgcttaagagtcagatatggatttgaggcctagaactgctacttacttgttgagtgatgtttgggaagtcacttaactactttgcttctcagtttctttacctagaaacaattttcagaatggctaaacttaaaaagactgacaaggatttggggcaattagaactgtgatattttgctgaaggagtgccaaatagccactttggaaagcagtttttaaaccgttaaacatctacttaccataagacccagctgttccactcctagatatttttttaacagaaatgaaagcatgcttacacagataacttacatgtcaatgtttgtatcagctctattcataatcatcaaaacctggggacaactgaaatactcatcaaataattaatagataaacaaattgtggtatattcatacagtaacaaggaatggaatactaatacatgcaacgaaatggttgaatatcatagtattcatgctaagtaaaagaagccaaacacaaaatttgaaaactgtacaattcttttataattatattctggcaagcacaaaactatagggacccaaatcagataagtagttgccaggatgctgggagtagggaaaagggattgactgcaaaggggaataagggaatattttagggtgatgaaaacgttttatatcttatttgtattggtggttacatgactatacatttgttaaaatgataaattttactatatataaatcatacctcagtaaaaaggaaagaaaaaataactcatgtttgggttggttatgaaaattattaagagtaattttcctccgtttttccttctgtttggttcttcattattctctgcctgttctatgtccctcataaatgtaaggtccatgagaaatgtcagtttcttatttcagggctgagatagtacagaaaaatttatgtctttgtctgtaatctctgagtaagattttaaatcaggtcatcaactgtattcttatcattctagatgttccagttagtactaaataattcagagctggaatttgcatactccatgaaatataccaaatatatctgtttcaactggattccttttttttgtttgtttgttttttttgagaccgagtcttgctctgtggcccaggctggagtgcagtggcgcgatttcagctcactgcaacctccgtctcctgggttcacgccattctcctgcctcagcctctccaagcagctgggactacaggcgcccgccaccacgcccagctaatttttggtatttttagtagagtcagggtttcaccgtgttagccaggatggtctcgatctcctgacctcgtgatccgcccgcctcggcctcccaaagtgctgggattacaggcgtgagccaccgctcccggccctcaactggattcctgatctgtgttctgcggcactgggagggcacagtatggttgggagggcatgtaaagcagccttgagttctgagcctgagtcttgcctgagaaaggcttcccctgcttctcagcaatccattgttccctgccagtggttctcaaacttgagcaagcatcagattcaccaggagaattagttaaaacatacacttctatcttcctcccagctactgattcagtaggtctgaggtagggcacaagcattttgatttctaacaagttcccagatgatgtcaatgctgctgatttggagtgcacactttgagaacccttgatttatgcttacttctagtgtttcaatgtcagaatttctgcccacatgctcacatacaggagccaacattttgtttttaaactgcctcctcatttcatgaccacttttgtattggctgaaatcagtatactctatgtatatgagaaagggaggctgggggaggggggtggaggagaaagagagaaagagaagcagtaaaacagtaagtgcttggctggagttcacaaagtgtttgatgtctgaaaggcagagaaatggtggtgctggcaagagaaaaaggaaacaaagctatgtctagccacacctccttccttttaacctcttgcgcatcgtcatcgttcgtaattattttatccccttagcaacgggctcatttcaggctcccattctctctactttaaaagttttaaagactcttactaggcctcctctgcccattggcctaaaatattctcatttaagacttttccctgtctagcttgtaataataggtcctgcctcctcacacttaagttgtatgattgtatcttattttttttaagaaaaatagtaattttccctgaataaaaccaaagtaccataaactgcatcatttgaaacaggggatgtgtgggcgactgatttcaattgaacaaatatgaatcatgttcttgtgaatcatgcttccctacaccaagaaagaaataaccctaataattttaatagcagtagacataaagagaatataagtaaaattcagaattttagaaacaatttgtggtaaatttaaagaaatcatggattatttcatcttcccaaataccaaagcggatattgaggactatatataaatttgttcagaattcctattatgtaaaggttattgcagggtacagtgtgctgtagtgatatctgctgatttttctctgtgataaattatatattacatattatttaagtatattatacttaaagctgatgtccctttatccctctaccaccacctcactgattatcgaggctttagagaaaatagctggttgcactagatgattacatgcctcaattggatagtagcttgttgccaattatcattacagtgccatattgattttttttcttgtttccattatggaaattaaagcagaatttgtttaaaatgagcttctatgtatattgtggatggcgattggttctgaatatgagctattttaaaaatatattttcttcagtggtgtgatgtctctgatattcccttaaaaatttaggtctctgctttgttgataagatttaccttaggtagctatgaaatggataaagactggaatggaatggtttaaatatagacagcatagatgttattatttcacataagtctatatattgatttatgtttatgatgttcttgggtagtatgagattgcttattctattaaccatacagccagtaaatttaattaaatttaaattagcaaatacttacttagtgttggctctatttaatataaatatttagtggctatatatgagctaccttgctaaacactatgaaacatagaaatattaatgaaatgatataactatctttagagaatttacatgccaaaggggtaggtaagacatggcaagaatcattatgattatgtcaagcagtaagagataaatattacatggagattttgaggaaaaggaactcatttgatcggaggaattacaggggaaaacattaatgacttaaaacagccaattttagttttaaatagttgggagaaatggagttgaggttactttctgggaagaaagaataaatgagctaacatgaggaagtgcaaggtgggctccagcaatgataatttgtctgattttattggcacatgtgtcttaaggcctgaggctggaaaggtagattgaggctacatcagaatgttgagccaaatgatttaaaatgtattaagtagtccagggaaaatttttggacagaaaactttggttgagggcaatttaatctgtcattttataaaatgattaagagaaaagaatgaagttggggaatcaccaattgggagtctccaggcttattaaaggaaagataactaggactaaaccagaatgttagcagaggcattggaaaggaagaaaggggccatttggaggaggcattctagaagtagaagtagaagtagaagtagaatatttgtgaataatgctctacattagcagtgtttcagccttctgccacacaggagaatttatgtccagccaatctcctaaacctgcgtactcagctcctgccacatgggtctcctcacagttcctggaacattctaaacacactagctaatgcctcatgacccaatttgcccttaatccttctacttggaaagtcctcactttcagagttctgctgaaatacctaaccttatcaaagaatctttcctgatcacacaatgaaaaatagcagcctgccactcctttcattctattttccaaggtttatttttcttcattgcatcaaagcaattattacatttattatatagttagttatttgttcactgtctccctatctctagatagtaaagtccatgaggctagttgcttagttttgttgcttgttatgtatctctctcacctagaacatgcttggaactttgtagacactcgacaaatatttgttgactgaataaatagaataaatgcaaaggtgaaagaaatgggtcatcaaataattatgccagtatttcaagtctgaagaattaaaagggtagtgatgttattaataaagtatcaaagagtggaagataagttgacttaggggtatggagacagaggaagatgaattcagcttgtgaattcatgcttaagtatgtcatgctggtgaaacaaccaaggcagtgctgtgtaatgggcaatctaaaatgtggagaagtctaggattgaggcaaagatcactgagtcatcctcatagagtcaatacttgaagcagtgggaattgaaaaaataatgacaagcaatattgagacagaattatcagatttgaaaattaaaattttattttggatatttaatgttttaaaattactaacttacttatacatctaattttttgtttatttctcagctgggttaacaactttggccatgaaggtcttggactcttattggatgagctggaaaagcttctggacaaaaaacagtaagaataaacactgaaattaaaatcaccaaagggaaaatgtttcagcacaacataatatacatttttcttttatttaggcaagaaaatattgacaagaagaatcagtataaacttattcaatgcctcaaagcatttatgaataataaggtaagtagtatttatttctgcccctgtcacaaaaggtgggaacttgcccaacactatgaaagtatgaaatgaacaaaatatttttttattattttttttaatttccagggtacatgtatataggcgaacatgtgccatggtggtttgatgcacaaatcgacccatcaacctaaataataaacccggcatgcattaactcttttccctcatcatcttccccaccccgtacctattttttacttatgtttctgctgtactaattaattgtagactagttattacaggcttataaataataagtgtttataaagttttacagtgaggttaaatacacatttgaaaccatatataaaagataaatttgatgtttaattttccaaaatgtgagctattgttagttttctcgatttttttttttttatttctatgctgatatttcattttaaccaaagaagtcctcacagcatccagaggatttcagggatgatataacttctgtagatctaaatcttttaaaaaatggagccctattccaatgtttcttctattcaaatatattgctttcatatagggaagatagataaaacagtactttccattgtctatgctgctaatttcctcaggagggtgagctagtcaatgaaacaaacaaaaaaaatgattggaaaaagtgtatttgactcttgtctataatttagaaatgctgtgtctgattcttattctgtttattcctccaataatttctttcatgtgaacagaggtctttttgattttatagtatactaaatgttcagaaaacataacaaaaagaaagaaatgaacaaaatagtgagtgcttgttcagtttacaaaagggtctttatgatgtaaatccttataatatttaagtaatacttacatgaaagttatactttgcttcacaaaatatttattggtgggtttttgaaatcatgcaaatgaattagtgttgttcccaattttggtaataatgctttttctttaatggtagtaggaaaatttaaatgtcgtttgttgaatatgtttccacacagagaatttctgttctattgaaaaggaaaattatagggatgggttgacttatttgctaagaacattgtaagattgagatttctctttcttttatgttttattaatgtcagcaagtttacatacatataagacatctctgaaaaattgcagggctttttatgtatatgtataatactagttgtattataagggaccctgtgaattttagacaataatttttcttctaaaaatagactttactcaggttatgaagttacagtattttttctataaactattttttttactgtcttagaaatgacctcttcatacctatagataaaatactattgactaattcacttaattacctaattccctttacatagtattttaataatctcaaaatagataatagaaataattacaacaacaagtagaagtttgccaaatgtaaaatatggctattaataaccaatgcaataagattatatattaatctatagacagtctcaagcatatggaaatacatataagtatttatatattatacatacatgtatcagcaaagaatgttactgtatgagcatatgcaatgaatgcttgctagtggacatgagactcctgaatatgctagttgtactgtttctggaagtttcttacagaaatattcccatcactactagtacagattttctcaaaatctgggctcttagtctttggctacaaagttaaacagaatctgatgcccaacaaggaaataatgagcattgcttcttcacagctcaagatagatctctttcgtcaattgagggaaacaatgacataatggaaagataacacagttctagaattcaggagatatatatagttcatgctttgttcctaataagttgtgtggcctttggaaaattacttgacctctctgagtatcagtcccctcatctgtaaatttagctataggacactttgttctaaattcttattgactcatgttgtcaattgtcgtggcttttcaggatgctaagtaattttaatcaggacagtcactagagagagtcataatagtaagattcttatagagccctttttttttttaacagaacatactttgatttgtcaacatttagtttcttaagagtttggcagtttcggaaagcataatgatttgacttagattattcgaaattgatgtttttagttaggccacgttaatgtcttgcacataggtgctcagagcatggattaatggatcttttgaattatagacatgtgaaacaataggcataaaatatgccttcagaatagaaaatatgcagtgatcttttcacttcatgttggaataaattgtccagatcaaggaattaagcttttatccaaaatgacttacacatcaaattttttggccccatggagtttagattacctacttcaaaaactcctttcttttatccaatacatgtaacaataggatcataaaaagcaacccattgtttcttaacttccagtactataatattgctctgatgtttggattaatgattttccagatatatttttcatgtcttcttttttatttttgatgtgtctctatatattaaaaactacttataaacattaagtaaaatttttaaaacctaatgatttcactctcagtctcaatgactcataaagctattaagtttggtaattgcgtggtcattgtctctcagttttgcaaatgtgtttttcactaatattcattacttttaatcatctactggccacctttatacatacttatctattttgtttttgttgcttctttcaagacttgtttcttgcattttctttttttttttggtcttatctccatatattttcctatttattatgacctgtgataaactcacatttaagagctttagctatgttccccatctgccactcggagttcttttagaaattaaattagggctgatggaactattcatatggttggtaattaactgaagtttagctgaaatggaaattttgctccgatgaaatatccaatttcaccattagactgtaaaatgaagcaaaaatattttataagaaatctgaaaaatactttgtgggacaaagataaaataatatattgctttcttaatgtaatgaaaactcaagttttagactttcattagaatttctttacttatttattaagtgcgtgcatgcacacgcatgcacacacatattcatgcttagaaaataaatgaaaatggtgttttctctccttagttgacttgtgacacttaataaaacccaggtgccatttctttaggttcacagcttttgtagtgcagcacagctgtctgaatcagggaggataagagagagaaggcatgggaatatccatactgaggcttatactggcatatagtattcaaaagagccttttaaaaaaaatttctctttttcttcaccttaatttttcatacaaacatattggacaatttaaccacgaattccagacatctccagggagacccagtgacataagtagaatcttactttagaaaatcatatcagtatgcgctttatatgttattctttgttgaagaaatactgattgttcccatatttctccaaatttatggaatttttagggcaggctaatggagatatatctgatcaaggagcaacaactccaagatgcagtgatttcatataaaaaacaaagacagataactgcatttgaagaatattcatataattaggtagaacctcattgtgggggtatgggtttttggaagatcattgtacgttgcttttttaaattaaagatatattccatagacattctgaatgaaggttttttttttttttttttagtttggattacaaaggattctaggagatgaaagaagtcttttactattggcaagagcaattgaccccaaacaacccaacatgatgactgaaatagtaaaaatactttctgctatttgcattgttggagaagagaacatgtaagtattgctatattattatatttgctgcatggaaaatgacacttaagaaattaataagtcctacttttgttctctttctttggataactttcatgaaaacagtattttagataatttttgattgaaatttttatcttgcctgtttatattttggcttctttgttgacattatagaaactcagtttaaacagataaaatcctagtgggaaattcttgaaagttggattcaaagtgattgagcagaattttgttttgctggaggtacagcaatcattagaaagtggacaaaaatcagagagttattttggcaaatacacacacatacatacacaaatactgtgctgcatatcacacaatttgaatagatgcctttattttacattatcttataatagtattttactttatatgccatggtaaatgaaaattatttgtaaagtgaaataaacccacctgttagaaaaaaacggttgttgataattattcaaagtgtatatgtgccaccaaatgcagcaagttgttgctgaacatgcatttgatcacatcttcttatggaaataatattgaatcagaagcaaactttcagatttgatgacattaataagtctagtttgtaatgaacccttgtgataaagaatcaaatatctgctaaggacccgaaccaaaatatttccttggaacactttgcgtgacagtaataatgtcaatttgagtcagaacaggactatgcaaagatttaaggatgttggaatatgttgactttctcataactgttagagtaaaatgagatgttgcttagtgttagctactgtcctcagaaaccaaaagacaaacactaaacaaaaatattatcatattaagtctcacctcaatgataacaaactgagaatgagataacatatgtaaaagcaaggatccttaggattttattttttaaaagtcagtttatacatgtgtaagaaatattttttaatcacttagattttcaatattcataaaatacaatgtagtccagtataactgttatgatttaattataatttcagatataatttgataagagtagtatactatatagagattaatttgttttaggcattgtgtggagataccaatatttttggtcaggttaataagtttcttgtgctagataattatacattcttctttaatcacctgggctttcctttttagagtcttttttctttttccattgtcaaaaaatgttgattaaaaaaattctttaaaaaataatcactctttccagaactttattataaaattacaatctgtttatgctccaataaactgttaacaattataggtgtcatattatgtttaagtgatattaatgttaacacatgaaatatcaaaacctgaaaatttaaattttaatgtttatcacttaagtattctttttttaatgtcacccagaaaagttactttccttaagatttttaaaatcgaattttccttttgatgccctaaaattatttagagctatcaatatttgccttaaagaaatatacggacaggaacacaattcctatattgtaatggtctttcagttagactggaggaatcagttcaagaaatctattttatgtgatagtgactgtagttaataacagtgtgttgtatactcgaaatttcctaagagtgtatgtagactttaattgttcgtaccacaaaaaaatgtaagtaggcgaggcaatatatgttaattagcttgatttagccattccagtatgtatacatatttgaaaacatacaatttccatcaaaaaagcaaatgataatttttaaaaattctaatggtatatataaacatcaaataccagaaagaaaacagggaatactgaaaggaccggtgctcatagtgtctgtataagaagtatttctcatttctgtttcttcttttttctctacagtctagataaacttttaggggctataacaacagcagcagaaagaaataacagggaacgattttcaccaattgtggaaggtttagaaaatcaggaagccttgcaattacaggtgagttagttttgtcttaaattgcttctagagttatatttagagtactcattttgtatgacatcaactccattttagctggcatttaagtagtatggaatgtaaaactaaaattttttctgttgctagtttgtgagaattgcaatttgtttaaaattaggaaaaatacttttgaattattataaatgtggcagttatggctgtcattgatatttagacaagaatttagtaattaatgtaataaaccagggaaattgaagcctcagcagtaactaaggtaaaagggcaagcagttcagccaatgccattatcctaacaagtgttagtgaagtcggtgggcttgtagaaatgtaagacaattaaacacatctctctttgtgccattcagacaatattcaaaggtgtgactcaccagaatagaagggattgaattgcaattcttaggttagcgttaatttgatagccctgtgtagacacaacttactaaatgcctcctttagaaaatgacaaaactcactatctttacctagatggtttcaggaaatgatccattttatgaatagctctgttcttgagggatgagaatgcatatttattggctgaacttatggtatgaagtcctgcactaaacattttaatttgcatatattatttgatttaattctcacaacaacctagatatgaaggtattgctatagtatctttgttttgcttatgggacgaataagttgaatgagattaaataactggtctaacgtgacacagtttttaagtgtcacagtcggaatttgattccaggtttttggtctctgctaatctctcttttagacaatgcataccatttaatgtaccatggaaaattctctgaatttttttttagttctcatattgttgttcaacaaagagaaggtagtttccacatttaattttatcaagctacttagcatcgaatgtttaactcttcaaatttcttgcttgatgtgaaacaaacacaattaattttttatgtattatgaagtattttttgtattatgtattttatgtattatgaagtatttgtatttttgtttgccagagtttgaaacggcatcagatagatgaattggcttgtctaaagagaatctgtaatgttacaaaattgtaatacctctccaaatgttgaaggatctttgttaatcatgacttctactccaactatattgaaaattttggatcaacttttatggtgtacttttatgtcaaatgtattatttatttatttatttatttatttatttatttattaagatggagtctcactctgttgctcaggctggagtgcgatggacgtgatctcagcttgcggcaacctctgcctcccaaagcaattctccctgcctcagcctcccaagtagctgggattacaggcatgcaccaccaagcctggctaatttttttatttttagtagagatggggttttgccatgttggccaggctagttttgaacttctgacctcaggtcatccgcccactttggcctcccaaagtgctgggattatattacatattttaaagattagtatattttttcccagtgttttttaataatacattgtttcttataaaatttaatcttgataaaattttatacctctactgaaaggttgaaaactgccttttttagatgactttgaaagttttgttcatgttcctgtggttgggcttacctaactaaatttcactggtttttcagatatatgtgtatgtttgtacttctcttcgaaagtttgttgagtaggaatgaactcttttatttatattcaaagttttcattacattgatatatttttaaaatcttctttaaataaatttttagctacaactctgtgagttatgtattattacctctggtttactgatcagggaattgaattggtggaaggcactccaaaatcacccagctgtgtaagggatagagctgtaatttgaacccatgtctttgtgatgccagaatttgaatacggcattgcctatactttgaagggatgcctctgccaatgagtagttcaccccaaacaatgagatgggaaagacatttgctagccttcaggaagctggacagaatggaatgataaagtgacaaattgttaacaagtaacatatggaagaatcatagatgtcttgttaagtattcaataaattgttgaatactgattatagatgcaaacatatgcagaccacaatttaaaatttcacattttaatgagctacaaaattagtaatttgttatatacaaaaactagtactctcacaagaattgtgaagtgagtttgtttatttagactatttaatgtgaatgaaaagatgtcctctaaaagttcaaaaatacatgcagaatacagaaacaaaaacccaaaagtttaaatctgttgtttaaaaaatataattagtgttgtattttaacagaatgacttttctatttctgtagtatcctgagacttcccaaaatgttattacagtctcgggaagtaattttgttaaaatacaggactaattattttttaaataacaactatatacattttcccccctttttggggttttaaaaaaggttattaacttctcacagattttttttcctagcttttaaagtgaaattttgtacctatgataggattttcattatcttcaggagttcaagaaataggtggaagataaatcgcatatcttcatacactctctcttcattgactttccttcagcttagtagcattctccggtctcttttgcaaagcacagattatacaccagcagcttcttttgatctgacttaaccttctaactagcctcttgtctctctttttcattttaaagtccatgcctctagaataatccatatttgttttctatgttttctaaattaccttttacaactctattacagttctcaaaaagatttacagtgagtgactaatttcaaaatccaatggcctctttccaatcttgatcacttggcactgttgatcaccttcttccttgaaaattttacttcccttgactttctaggcaccattctctcctttgttctctacctttatggtttttttttttttttctgtcttcctaatgtatttctcctcctcttacttcctgggtattttgttccctatgttctatccgtggtcctcttttagtatcattttatgtacatacattcatatgcacatacacgtatctacatgtacatgtatatacatacagacacatacttttttaaacaattttgtccatgaatgttctgaattgcttatctagttttacaatccaactgtggtagtgattcttcagatttatacatccagctcagtgactggtatcataaaattaagaaattaaaaataacatttacaacccatatgccggacagtgtttaaaatactttaatatgttatcccatttaaacctcgcagcaattgattgagagagatagaagtattatccccattttatagataattaaactgaggctcataaaggttaaataacttccctagggtcacagtgtgaatagaagggaaagcacagattatacaccagggagtctggctatagataacgtgctttaactactaagctgtaactccttttatattaaaacttagcttatatctctttctgttaacctgatttttcctaagtcttctcttcttcctgtgtttcctattttcggttatagaggtatcatcttctacccaatctttaattttcctcaacacttctttcttttttgtcccctgcattcatcatcaagtcttattacaaagtatagtattgactgtgaatctaacccattctacttccactgcctttatcttctcccaccaatattatttcaacaatttcctaattagtacccatactgacatgttttctctccagacaataccctacactattgtcagttatctgtaaaaaatgagtccaattctaatacattatcattcttaaaaatctatgctcatgacccattgctaactttttcattgtggtcctaacttaatattctggcctttgagcctgtcattctcccaaatgtaccatatgtttgcgccatactacatttggtgtttcccagatatgctgtagacttttaaatgctctcaaacattttatcatgcggaacactttgcctgaaatacctgtatttccccacctatatctgtttcttctgtgtcttgcataagtctgggaaggcttcagtaatgaggtgatattttaactaggcctcgaaggacaagtaagcatttttcataaattatctttgctgatagagaagcagtactatggtaggatgagaggtgaaaagggcttccaggaggtaaaatagaggccagaatagtctggcagtcacttcataaaaaacagtgaggtaataccagcatccagttgaaactgctttctagatagccaggtaggaaaacctaaggtatactgagcatgaataatggtttatagaacgggaaagtagtatagttaaaatacaatgatgtactatcaaaacagccccagtcttcacaggctgctgttagtttgaaaggtgccatgtttttacaatatttcaatatatacaaagaagtggagtagcataatttaatacatttaaaaactgttttctaagatgctgaaaataataatgaactctgcacattttgtaattagatatggtacacaaaaacagagctgtaaatatgccctttcctgatgtgtgatagcttcacttacccagtcctcgcctatttaatagatttgtcctttggaatacaactgagaactaaaaaataaaacaaaaattaaataaaacaatctgagcagcctacaaatgtcaccagatctatcaagtaagcctcatggtgagaacgactttttggcctttaatgagagcctatttattctcttttcatatgttatctttacgaacccaattatctgttttacatccacagcagactagaagtgcaggttggaaggttgggagagagtttattccagaatcgtacactggaatcatcaagaagtgacaactgataagctggcagcaggggaggggtagatagaaatgtaataaaagactgaaactggaatgcaaatgataacaatagacttcacagagcgcagaggctagtagccctgcacacttcagtacctcccgagatactgagttacaccatacctcactaactcacatatttagtgatgaccctgactcaacaggaaattgttaaattatatctagtttattttgcgtaagaatgtgggaattatataattcatttcagagagtgtcccatgtgaaacaagatgttgatacttaaatagataaacagatatatggaactatcctatgtggcttgattctttccacagtggttcttgagtgttgagattttactgcaagcatacttgtaaattagccattaatgtactcagaccatcacatatgagggagtagctttggacaaagtattaatcatttgtcagtgaaagtgcatttataagaaaacaaggcatcgaggcttatgaatatggagaaaatttgtggaaattagcatttataaagtgttgaatgactgcttgatattacttaggaaacttgttctatttattgacagttttatattattgtcatttagaaaatagattactataatgggaggttgtttagagatatttgtacaatgtagtcatttttggtattgacacaaaactaacttctgacttaaagaaggatgcctttattttaaatctgtttcaacactgaataattgtcaaacctatcattttcagtaatagagggttgccagtgacctccatgatataaaaaggaacaggctgcttttgaagtcattatattagcttcctcagcactatttggcactattgatcactcctttatcaaagctccctcctcccttgacttccatgatactaaactgtattagtccattctcacattgctataaagagctacctaaggctgggtaatttataaagaaaagaggtttaattgactcacagttccacaggctgtacaggaagcatgactggggaggcctcaggaaacgtacaattgtagtgggaggcgaaggggaagcaggaggaagagagagaaggggaaggtgctgcacacttgtaaacaaccagatcttatgagaactcactgagtatcacaagaatagcaagggggaagaccgcccccatgatccagtcacctcccatcatgcccctcctccaacactgaggattacagtttgacatgagatttgagtggggatacaaatccaaaccatatcataagctctccttgtttttccttcacctatgtttcatttaaattctcttatttctatgcttgacccttaaatttgcagattcctagagcttgatcctcagtcctttggtactttgcttttctcatattgatgatccttgggcaatcgcatctatcctcacagcttcaattaactaccactcatatgtgatgtctttatctgatctcttctcttcctcccaactcacagaccccatatgttcagctgcctcctgactagatttcaaattcaatattgtccttaaatatacttatcttccttttaaaaaaaatccttctccctactctaatcctctctccagccttgacctgcatttctcttgtattcccaatcctggttgaccttagtattacctaccaattagcatatagcagaaacatactagtcatcttagaatctacccttactccatcttccattccattagtcaccagatcctatcaattctatatccttaatgttatatttcccttcctcgacatggtatccttctctctccaccctcactgccatttttaatttcagagcattgttacatctcactgttttatcctttccctatgttctattcttcattatggccccgtttaaattatcttccccaatgttgtctttctgaaatgcttttctcagaaatgcacttcagaatgcttaaagtccagcattggcttcccatagttcactgcttaaagtccaacaatggcttcccacagtctccagaattgcagtctagtcctagcccaaacaaaatacttcatctggctgttgctttctctttcgcctcatattccaccacccttctacatatgtttttagtctagtcatattgtgctttgtttcctatagattttatgctgttttatacctctaccttcatacctttgtacatgacttccgttggcttggaaagtactccacttctcaattaactcgctctgtacattcacatctttcttctctcatactttgacttaaatcatctttgttcctaactcctgctgggctaggataaagaaagaccttgttaatgtcaacagagtacttaataaggtcaagtgtggaacagtgtcaataaaattttaaatgtacaatttgtcacagataatggcaatatggataatctgtctgagaatgccctggagttgtcaattattgtaccccatagctctgtgaattgtgattaaatagatagatgtttgtatagttttcaagcctgtaagttaaagtcagtaaaaggttctagcatttttccagtaattttatgaagatatttgtgttcaaatatttccctttctctgtcacttaggtaaacaacaacaacaaaaaaacttaaatttctttttgtaatgctatgtcttatgccaataaaattggaaatttttaaatgtcattcacttactatattttaattattttatttgggacagttaagtgttacaaataaaccctaggcatatacagatgagctttgccttttgaaagtttatcatctgttttataatatttcaccctttataccataccaccccagaatgaagacaacagcatctggtgactaaagaatgtagatgattattgtagaaataaaataaattgttatagtaaaggaaggatcttaatgtggtagaaaactgataatgattcagtgtagtatataattatacatgacataaatgattggatactttatcacatgcacagaactggtagtttttaactatgtatgcttatgtattcatttaataggatatatatgcatctcatgttgaaatcttatgacatcactgaatgaaaatgcaaatatagaaaccaattgtatttactaattaaacatcagaattgtggccctagcatatgtattaataatggagaaaattcactgattttttgtgactttaaaattttgatcctcatggaagctgtatttgtaacaatagatatggcggaccattttgaaacatagccattataaagacactaagcaacagagcaactctggataatggactttgtgatattcaattcaagggcatttgttttctttctaagatcaggagaaatgatatcaagcaagatttgtgcgatataatgtggtagaaaaaatgcaaggctaaaggtcaagagagctgagttctagttgtatcattggggcttattagttatgtgatcttgggcaaatcatccaatctttctaggttttcagtttctttacttttaaatagcatattggaccagagtattttatgttctgtctagctttaaaatctcatgattattttctgtctctggagttgaattttttttttttttttttttggaaagcagattgattttgcattgttagaggacaatagagtacactcatctcttaaagatttatatacttggaagttgagcatatgaattttgaaattttcattattcagcaatgagttttgtagttctttgaagtgaaggtttcagagattaggccagatctctttttttctttaaaatctccagtgtagtgctattcaatcaaactttctcccatgttctatatccctgctatccaatgtggtagctactagccacatgtggctgttgaacactggaacaatggctagtgaaactgagcaactgaatttttaattttatttaattgtaattaaattaaactgtgataagtagctcccatatagaatagcacagtactgtagagcgtgtgtgtgcgtgtatgcatgtgttcacatgcatatacatgctgagtgtggagtggggtggcagaagtaaaggagaggagtggtagaccattattttggatgatgggatgccatttatactttactgctcaggatgtacatgaagtggaatttaacccactccaagaaccattttctacttttgctttttttctgcattacattatatattatgatagtcactatgtgtactagacaacatattgtttatattattgtatgtttttctaattaacctatagttttaaagctacatatccccagtatattaagcatgttgcaccagttaaattttatcatcttacccatccttaaaatcttttgttgcgagaatctataaatggagtttatgagacctttggaatgtgctggaaattatatttgtagtaaaattatatcatttatagtcatgagtttcctccttgctgtgtggccttatataaagttattctatctgctttgagcctccacttcatcatctgtaaaataaggataacagtaatactaatcttgtgtggtttttatgaagatgagattagatggtgaattatgtaaaggacctaatacattgtctaataactaataataataatggtgataatagtttgggatttcgtatttagctatgaattcaggatacacagaatgggtttgtcatgtttataattaagtagtaatatattcttccctttaagctaatttaaatttaattttgtatttgtaaatagtgacaattatttcagttttgaatttgagatatcgtttctattctctgaaaagggcagcacttgtgtaacggcataaaggaatagcaaaaatttagatgacctttttgttttccacattcatattacaatatacatatttctgtaaaagaatattattttatcagcttatgttggaaaatgacatgatagcatgtttattcatctgttatttgtaattaattaaatatctattagaatatgatatataataaatggtacattgttaagccagtacctttaccattttaaaactgacttcacaatatctcctaattgttgtgtactatagtcaatggatggaacgtctttgttttcatattaaactatatgttcatacattgtatgtaaagtgagtatttaatatattgaaacattattaaagttatattgatacattcattaattttattgacttttattatctttattgtctcctgatctgaatacttttatttgtataaagatacaattgcaggactcattaacttgtttcttacagaaatgttctctttacttgtagggtattaatacaagccattaagctagaatttcttctggcaaaaacaatcctaacagatggcaacttttctctctattaattttggattggacatgcactttggcttgtttggtcatgtcatagttgtaacataacaagagtcattcaagcaaatacaatgataatatagctgtggacatgtacagtatgcaaatttatagcctagcctatcaaaactatttaaagatttacatgatttcctgttgtaaataggaaggttaagtaatccattaaagcataagcttcatactaacttatctggtatgtctttaaaggtaatgccaaatgtatggcaaatatttagtcagttgcctaagtgttttatcttgatacttgaatgttcatagaaattagactatattgttgtatcattcagatatctggtcatgttagaaacaaccttaatcagcccttttaaagcatgtaacttttgatttttgaacatagatgtgaggcagataggctaatctcccaaaaagcaacttaaatatataagatacagattcaaaagtaaagcataccttttaatctcttctccctattttggaaaaaataactctatcataatagatctgtagatgtcaagtcaaaatacatttgaaatatttgtctttcggtaatatatttttcccatgctaactattaatttatttgtgtctgcttctataaatacttagtatctttatataatatgtttttttccgaggattccccttgtagtttgccctttgagcactcttctactcattgcattctttaaaaataaaaaaataataaatttaaatggcatcttttcagttaaacaattagccagttaccttagatttgagcagcattttccaaaaatgctacttaggaataatttatggaatacctggcacttagcattttgttgattcccttctagattaaaattaccagcaaataagttcctttttataatagggaatctcaaaatcagaaggtaagaaaagcaaaactcatttttcggtatcaatatatttaatcaaatactttacttgaaaacaagctcttacatatgctttattatgaaatgtgcattagtattagtctcccagtgccttctaattgatcttaattcacttccattattttttcaaacctagtaaattaattcatcttaattatatattttaatactttatatattttgtacaaatcatcccattaagaggatggagagagtttaaatcaatgtaataatttatctaagttatcactgttccctgtttaatattagggtacttttatatctttgatttattttagaagtgtttataaccctgtagaattgaggccaagtgtactgtgaggaccactggacatgaaagatacattttgtgatcttttcaaagggctctgtctgcccacttttgcaatttgggtttttcagagggagtttaatatttcttcatattatttttaaaagcataacatacttggtcatcacatctttgttagaattattttggacattatacactttgtcgttaattttattgtttataattaaagtcataatcattatacttctagaaatatttgcatttcttattttatcattatgtgtgtatgcctttagtgaatatattatcttaatgcattatttcattaatttaatgtgtttttttaaaacaaaatttgctttctaattgcaggtggcctgcatgcagtttataaatgcccttgtcacttctccttatgagcttgattttcgaatacatttaaggaatgaattcctccgttcaggactaaaaacaatgttaccagtaagttgaatgtatacatttattatgctgatgaattttaaaatttttttcacttccacaaaagtacttgaagcagagtaaataaatgtgctttgctattttgttttgtaaagcattagacattttgtaagcttttttgtattccagtaatagcattctctacatacaaatgatgattcagaattcagctaataatgtacccagaagcgatgtgtttttgttttttgttgtttccctcaagtcaaaagggacttcttttctttgaattttgaatattgaaaacatgagactttttttttggagtttcaattttcatttaaaatattctgctttcctctttgataacctagattgatttcattggtattcaggataagcatgcatagagttttgattagcatatgctagacacattgcttaagaatgttactcttgttacaaggctataggaacttttcagatcaaaaacaatttgtttcttaaattaaatgtgaatatttgctgtaattatgatagtgttaaaaacatttttggaatgattttgtatgctgaatctgaaataaatgagcacacttatttttataaatacaaatacaactactgtggttttatattttattaagtatattaactgaagagtgactattgcagactatggcattgttcaagacaagtaaaattctgctagtgtctttaagctactcagaatatacctgagagacaagaagtaaaagtaaggaagtgagaaaaaagcactaaggagagaaaaaaacaacaacaacaaatgtcattgaatgtgcatgtgtgtgcgtgtgtgtgtgtgcccatgtgtatgacctagtctaccagaaatacccaaattggggacatttcctggtgaggaatcaatatgtagcataaatttgtaacatatggtgggatacttttaactgaaactagttgaaacccatcataataagttgtgtgattggacctgttaaatccattttaataagatgtatgattgggtccacctggttttggaaatttctatgtcaatcccacctgaagcagttctttcattcttgacacttaaaaccaaggcattggttgcagagaatcaaagcaacattttaagtgacccatctagagattaactgtgcagttaacttaggcatattcaccaattatagttagtgtgacatgtgattattcttgttttttttttcactaattttcttttcatccaaagcctgtagccttggatagctaaagataatcgtatggtcttgattgtagtttgcttttgaatttccttcttgttggtttccatgcttgtttttactgggctggttctctgtttatagtagcatctttgaagacttgctggctgcaagggctctgtagcatcctctactcgtttattaatatgccatgttttctgccatagttgttgctcttacttttctctctttcattcccctctatttataattgaacattcactttctgctttatactactgaatggctagtcaagagaactgtgactctcattttaatttattttagtcctcatttttcagaaaaggtatggtattgtagctcttgtccttaaccttttgcacttttgtctgggtatattaatctctgctgggctcagtggcctcatgttattcatttggttacacagacagctaagattatgtgtctgtgtttctaagctacacttttccattggccatatagccctatataaaactttttgtggtaccatgtgcttcttaatttatatattcttttttaaaattaaaaataatttttaattatggatataaaatagttgtatatatttgtgtggtaaaatttatattttgatacaagaacatggtgtgtaatgatcaaatcagggtgattgggatatccatcacttcaagcattcatcatttctttgtgttgggaatattctaatcctacccttatagttattttgtaatacaaataattatgaactatagtcactctattgtgctactgaacactagatcttattacttctatcaaactgtatttttgtatccattaaccataccctattttcccccacaccctactaccctttctaacctctggtattcttaatatatacttccaattagacttttctttatcacatctcttcagtatgccctgcttctcagatctcagtgattcttcagcaagataaaagtgggaagagaaagttttggaatagaacctacaaggattctcataatttttttttcctctctaagacagtagagctaaatatgattaaatatgactctgattctcaactaagaggttgggcatgtccccctaaaatcttactgtattgaggatagggcagacatatttggttgggaaaaaaaaaatcctccgcaggtatttcttttccttttccttttcctttccatttccctttttctttttttctctttttcattttccttttccgttttctttttcttcttttctttcttttttgagacagggtcttgctctgtcactcaggctagagtgcagtggcacaatcacagctcgctgcagcctcaatctcctgtgctcaagcaatccttccactgcagcctctcaagtagctgggaatacaggtgtgccaccacacccagctaatttttgtgtatatatatgtatatatatatgtgtgtgtatatatgtgtatatatatatgtgtgtgtgtatatatatatatatttatatattttatatgtttatattttttttattttatatttatttttgagacagagtcttgctctgtcaccaggctggagtgcagtggcgtgatcttggctcactgcaacctctgcctcccgggttcaagcgattcttgtgcctcaacctcctgagtagctgggactacaggtgcgcgccatcatgcccggctaatttttttttttttttttttgcatttttagtagagatggggtttcaccatgttggccaggatggtctccatctcctgaccttgtgatccgcctgcctcggcctcccaaactgctggaattacaggtgtgagccactgcgcctggcctaatttttacattttctatagagacagggtttcgccatgttggccaggttggtcttgaactcctggcctcaaatgatccaccccagcctcccaaagtgctgggatcgcatatacaagagtagaatcattattcaggcagatagaccttgagaagattagcgatcatatatttagaaccgtagatttcactactattgttttagtttatcacaacttgggagcaggacagaatggtcatgggttaacatatactacatacctcacatgtcaactactatctaacctactaatgaatgaaatatttaaatttaaaccactggaatttatagtaacattacatatcctttacatatgcagtgaagcttaataatatggtcatagattgtctttaaaatccttacgttttcttctatttattcttttttttatatccagttctaacaagaattccctaatattctagaatacagtatattcaaagcagcaaattagatgtgactagggctaatattaattgttggtacatggatgaaaaattatatgtatctagaaccagtatgagttgggaaaaactagttcttagtatttcagtaatccttgagatcaacactgtagtagagtgaaactttttttcataataattatcagaatcttcaagacaacgaatttttaaattatattctttaaaaatttattttcaaggttcctctcatccctatggttaaatttagatgttgaaaaatagtttgtatttcatttatatggaatttcacgtctgataaatttgctttagtaatttagaataaatgagttgttacaaactctacagtgaattttaaaataggatttttttctgtacttaatttacattgatttcttctgaaattttccccatttgccttttatttagttaaataaattaagaaaatattagttaaatcagataagcgaaggaaaaacatagtaagaaatggtgttggtaggcagtgggcatacttttatctctttaaaagtctgagaaactctttcttgttttaaagactcaattttggttgtttgactgttaatcagcagtgtactggcaatggactttgatttcctttgaagtgcactatgttatagaaaattacatatttcaggaattctgcaaaaaataattttagatctataccgcatgtctttttaaaaaataacaagcatagagtgtttcacataattaataacagtgtgtttcagtaactttgtgatagttcacgttttaaaatataaaacttcagtgatagatttccatttacttttataggatacccatcttattatttgtactatgtaaaaatttttattcagtaaatgattattttatcaagaatttatgaatatttcaaggcttgacattttgctggaaggaagtttcataaagataaacatatatatgtgtatgtatatatgaatatatatttacagtaagttcttagttaatgtcattgataggatcttgcgaactgcaccttgaatcaaaaccatatacagtaggtccttgaataatgtcctttcattataacattgatgagaaaagaaaattggttttgctatacgtattttgcttcaagttgcagtttccaagaactactgaggacaattaaatgaggactgactttgataggtctggagcattattaataaagaatatttataaaatactgcatttacacatgtctaaattttatattgtgctatatgtgctcatatactatgtatattgtataaataatgtctgggcctaattaagaactaaattgcacatttaaccagttattttcactgaaagcattttaattatgctgactgattttcatgttttgtaacgttctatgctaattaaatggcagtacttaaatttttctgtttttctgaaatatttgaaagtgtttaagttttatgatgaatttctgagagagaatatgtggtgacaagaataagacatactgtaaaatgcgtgacaggttgtttctgcagtgaccagtgtattgggtttgtctggcttatgtaattttctaaatagagttcagaaatcacctgataatatgacccagcaatgttagatgattttgcattctaataaatttcttcattccatttcaaactggaaaactagagctaaagcaagttattactaaaaatgaaaccaaatataaatacatttacttgttatgttttatatgaaattgtgtagaaactaattattttcatatgctctgcaggtaaattttcaataaattattatgtatgtgagtgttagaaaaaaaagcatctagaaattgctgaaatttgtttggcttcagtaatagccattacatctctataatagttctattgaataaagatagaaacaagaaatgtatcccattttgttttatcgacctaatttgaagtacaccatgcttgcatttccttttagagttcaagctcagctctgaaaatcctagtcccactttcggtatcacccttgagcatccacagttgtgattatcgatttgggttttgaaagctgcaacttaatggacacatattaaaagatattccaggtgatatatattgagcccaacaatctctagtgtggcatgcttctaaattttttatactattattatgaaaattatcagaggtttgtaatgcatgtgcttataatgtattacaaaaacataacttttatgcccaagttggtattttgtgatttagctaagcaaaaatataaggtgggggaggaggttagatgtacagcttaataaaaagtccaaacgcctttttgctttaaaatcacaaaatagcttttaaaataaatgtgtttatacatcttttcaagccatacttgggactgttgtgcttgaatatatccttgcatttgttcttcattaatacaattgatttgtatttgcattttttgccagaggcatatgtgaatgttctgactgcatgagttcttttgcaatctttgattagtgtgtttagtcaaaatgacagcatttaatttgggttgttagcaattagtttttttctgttgtagaactgatcgttaattttttaatgtgaataatcaaaatgtagggcatggaaaaaatgaagtgaatgcaatgaggtccttttatgttgaaacagaaaaatttagctacaattactttcagaaaaccaagtgcccgcataaatatttgaaattgcttctgtgtttataaatgaataattgtgttctgccctttattacctaaatatgccgttgtcaaactgttattcatgtgttaaattttatgtttatatattaggatctaaaagaaaaagagaatgatgagcttgatattcagttgaaagtatttgatgaaaacaaagaagatgacctaactgaattatcacaccgtctcaatgacattcgagcagaaatggaatatcctttgacaaaccacaaaacaattttgtttgcattgtgagaaagggatttgtgggcgattttgtggaacattattagagttcttgtctgccctcccaatttatatccatttatttatattagaaccttactatgatgctgtccttgagattcatgttgaggaattgtcaggctgtcttgatgatttacacagagtgtattgaaatctgcacaatggctcacagtattatagatatactctactcagtggtcttgaataaagaatagcataaggcaatatatcttacatgtaaggatttttttggggaaaatttcactgcgttcatatgtgactataggtgaaatacttattcagtttattaaatcaagcttcagtgacttagagataaaaagcaattcaaataaatgtcttattctgtattcaaatatttgtgtttcttaacaataacaaaaatgtttagatgcaatagaatctgaatatagcaaagctatgtggtagaagcatctgagtcaaatacagctagcatataaccttccgacggcagcaattttatataaaatgattttagatctaagagatggttgtcacagcattgctggccatttgtttcgcacctgttatgtttcttacttaatggattctggtgaacctgggaaacatgtcaaaaccaaagtgacctttgagttggattttttctcaatgatgttttcttccctttcctactgcttgcccccactccccaaagctggaagtaatattcccctccttgaaatacccaaagtaccttgtttgttctattttatttatgtacacttctgtgcccctgtgagattgagggcagaaatgttatgtttaatcttttttccttcaatgcatctatgaaagtcttacacataggtattggataaatgtgtgtgcaatgaataacaatgttattattttaaggaataatttctagtaatttttattcatcattagtggtgccagtctactgtggcttctataatattaaatgtttttcatatcaattaatatcttgctttacatagattcctcttataatcaaacttcaccataaaactatttttggatgcattgtgtagccatttaaggacctcatgagactttagcacaacactcttatgtggggtctaagaagtaagccatcgtatgcttaattctactttggagaaaatgttgacatttcaggttattttaggatattgaattacatcttgtcttttatctttattttaccttggttttccaggtcctcacttttattacaaaaatggatccatttgtgaaatctgatttctagtttactaaaagcatctaaatttctgcaactctatatcttgtctctactttccattttttatcaaataatgaaatacaaatgaatgcaaacaataataatttcagatttagtatttcatctggataacataaaactgattttgtgacctcttagcagtttacagcatgctcatttgccttctatcttatgtggcagtgaaaatagagtagtagtgatttgcatgaataatataggtcctctatcacaactacagggagatcaaaaggaaaccattttcactgatggcattgctgttccaatggtaccagctataatctggactttaaaatatgtataacggatcatttaagattttgacagtcaaatggtcttggacatgctcttgaggtctgtctctctagttaaaagatcaaaatgattccatagaatcattactttatgcagatgtttaaatactggatcatagagttgaaggtttaaaaacagtaatggaagcaagattataagtcaatgttttaaaaagttaaactcctttgttatgaatgagacttccatcaaggatctttaatatttttcctttactttctactgatatgaatgaagtctaccatcttctatataatatgctgaaggacactgctgctgaaaattacttcttatctattctacaacattttttgcttatcagaaatgattattatatcaggtaagaggcagttctgagagtactatatttataatttgaatcggatattaaaggaaaatgaacaatgtagtggggcctaagcaatatatgcatatgtgtgtgtatgtatatatatatgtatatatatatgtatgtatatatatatatgtatatatatatgtatgtatatatgtatatatatatatgtgtgtgtgtgtgtatatgtgtgtgtgtgtatatacacacacacacacatatacacacacacacacacacagggtataagagtttgactctttaggtaacattttttttttttttgagacggagtttcgctctgtcgcccaggctggagtgcagtggcgcgatctcgactcactgcaagctccgcctcccgggttcacgccattctcctgcctcagcctcccgtgtagctgggactacaggcgcgcgccaccatgcccggctaatttttgtatttttagtagagacggggtttcaccgtgttagccaggatggtctcgatctcctgacctcgtgatccgcccgtctcggcctcccaaagtgctgggattacaggcgtgagccaccgcgcccggcccaggtaacattttttaaaaggtgttcattttttaaatttggccagaagagacagatgcacttgtaaaaatggggtactccagcgacaggactttggtagcaatgaacccaacagattgcactggccctgcaatgaattttctttgctagatagtgatatcacagaaaaagcactgaagattctgggatagaactttaaaggttttatcttgtgcatattaagtaaggttttactgttatttctctttttacagtatttatctactaataaatgtgatcttaacatctaagaaaataaaagtgctaatatttcagttttatgtctagtagtgtcatccttcaaaataaatgagtatgaaaataaccattaaagttaaaagttttagaatctagttaactgggaatatatcggaaaaccacaaagttatgaaaaggcttctgagtgactgaaattatccacagactggtgaccatgatgttacatttaactgttcaagagactcttagttgttcttcatactctgatttgcgtgaaattctgacaacctaggttctttgatttctcaaaacctgcttgattaaatggaaaaggaaagctaccatgaggtcagcacagtctcaacaaaaattacaactgtaaagcagcatagagaactattatagttcagaccagtacagtaatttgttgggcatcgtgacattacagagagataaaaaatgtttaaaatattaaattgtgtgctgttttttaagcaacaaggctggttatacgttaaaaattattgttgtatttttaattaagttctaacaaatttaaaaggggtactgtgcccaaaggtactcagttacctggggaacatcatttatgtgaaagtatccatttctcagcaactatgaataaataagaagttatcctcatatggcatgtttttcatcctaagaacatccatgtgaggcagaagtgtgacaagcattttattccacttagggatgattaacctggccccagctgtgttttccttatttaaccattgactagactgaggttataatccaatattatttactctagacccgaagatgacttgaaaaaaaccagatttgtaatatgtattactatttattcttattcttgggaccagacccattactaaagacatagaagagcaattagagtctatttggcttcatttacaaacttttagtaggttggctatttatcagcacactatatttagggaagtttatatcataatttgtctatagtcgtacttcttactactgatttttctctgttgaatttattatcctttgacaaatactaaatcttacccaaattttaatgcaaaagtgccttttaaaaaattttgcagtatgtgagtggtcatttttaaggccagaattacgctgatggattacagaattaggatatgttttaaaacctctgacactttaaacaaattgaagcaatagccatgcatattaagtgtgtatgcttttataaaatgggtcttttaaaatgtgttgcataaatagatccttggatagtcttgtaatataagtggctctgtccagttttgtaagctgttatagctatcttgactaaaagtgctgtagtaaattcaagacattgcttgccacgtaatgtgaagaaactcatcccttattgaaattgagaacctgtggatgcgtagaaccatttctgtatccatgaatgtaggactaatggctcatttgtttttattaactttagaaacaatagcataagtaaatagaaaaggttgataagtatctttcaacacaagcatgaatccctgcaaactagattatgaagtcactagatgtagttgattacatcacaatgggtttggtactgtaacacccagaccatccttaagcttaggcatgcttgtcctaagaaagtgtagtggctgcaggattttttaaaacaactccagaaaaaagacctagttcttctaatatgttgaatgttttctaaagcaaattgatctgcatggttagaaaggcattcatgagtactttctctccttttcaggccacaatattataaaataattgaggaatgtgtttcacagatagtgctacactgcagtggtatggatccagacttcaaatacaggcaaagattagacatcgatttaactcatctgataggtatgtatcataatcctcattgtcctctgattgtgttttgtgccttctgtattataagcactttttaagtgaagaagttcagtaagaagcttcagttcttactgaacttctattcatatctggtaaatcattgtgtctctgggcactcaattgctgtaattgttaattataatgatcatgagagttctgcctgtgtgattagaaatattaacctgtttaataagttccaacactcctggaggtagtttaagcttagtgttccacaaaaacccattacattattatagatgaatgcattactatttagaaacatgactctgaaatcttttcattttatactggtaccttagtggtcttgtagaaatcatgtatacaatggggtctcattatagttatgttattaatgcccaagttttagaaaagaaatacaggctcatttcaatagcttgagaccttctaagggtatcaaatggatcaatttatattttcatagaccttagagttagaaagaatttgaggtgatcatattcatctccttagattgctgaggaaatgactttatatcatcctagactggtagttagcagtacttttcagaacaacctctgaaggatgatctgaaccttcccttgtgaaatgtgctatgctatctagccttatggctaagcagtcttatttatacttaattggaatcactattgttaaggtttaagcatgaactcatttgtcttatatttaaagaaagaaaacaactattatatgccaattatatattatttttgactccacagcacaaggcagatacacagtaacattcaaagatggataacttattatttatgtattatttctgttttaaatgtaatgcatacttatttcaggcaatccagagacttacataagtgacaaaccaccaatcacattcgtgatcgctcccttttcagcttggtacatttccttatatctctttctctatgacctatctatctctctgtatgctgatttttcttggaactttatattatgagagtttttccacattaaccttcaaaatgtgacttttaatgtctgtataatattccattttgtgaaataccatagtcgttgtaaccagtcctttctttttgtgcgttcataattgcttttagattttcacagttataaatgaatgtgctgtcaacattcttgtatataaatgtttggctttttctcactatttccttaggattgatttctgtaagtgagggtatgaactttcaaaaagccaaatgcttttcagaaagcttgtgccaatttacccagaagtgattgtgaattttagcctcattgcatatttttcaatgagtttgaaaaacaagtttattttgcattttgttgagggagtcataagggactattttcaaatatgtatattagcttataatccattatagaccatagttaggacacatacactattgttgattttgatcttattaatcttaaacatggagtcattgtcacctctcacataataaactatagttttttgaagtattttatagttgaaaaataattgaatacctataaaaaataataatttagtcaagtagtattcagtattcaacagacgtttgttttgtgtactgtgtaccaggtacttatgattctttactattaatcaaaagtgttgggtgaggagagacgaacggatcaggtgagagaggatagtcagcatcataaacccattgtgatgttatccacatgtcatctctgcgactgtgaacaaatcatttaacttctctaggttttagtttcctcaactttaaaattgaataagtcacatatatgagtggctcttaatattttatgttcaaaatcctttgtgagaagttgacaaatacttggaactttgattagaacacacatatgttcatgtacacaaaaaattatcaggtgcttcaagaacttctaggaaacccatggatctgtatttcaagatgacttggacctgaagagattagtctcttgtaatttaacaattctttgagtctgatatctttcataaatcagatcgtatcagatctctgcctgaaactctctgatgcctttccattgaaatttaaattctaaatcattaccagccatggctaggacagcttagattcggctgttctttgacttcgtcatttcctactttcctcctcagttgctttaaacaaacaaacaaacaaaccagctttattgaggtacatttgatgtaagaaaaactacccatatttaaggtatacaatttgataaattttgctattaatatagacacttaaaaccatcatcaaaatcaagataataatcctgttaccccctaactgcattgtccttttagttctttctttccatgtctaccacatcttcccatcctgggatattactgatctctctcttactagttacattttatagtctctctcattagttgcattttttaaaattttataaaaatagaaacatacagcatatatactttttgcctgtcttcttgccttcagcataattattttgagattcattcatgttgttgtattgcatgtatcaatagttcattcctttatattgctgagtagtattccagcttatggatataccatagtttgtttatgtatacacttgttgatggccatttaggttctttcgagtttgggattactataaataaaactgctgtgaatattcacataaattctgggtactggtatatgtttttatttctttttgataaataagtgtggaatggctagatacagaatagagtttatatatacataaaataatgagagatacaatattgcccaaaagttgtttatattctgaagtgtttgatttgacctgagaagtttgaagttagtttccttatgtacatgatacattttgccccagatcagaagttaagtaaaaatcttttcatgaagaagcctgaattatcgaatgttattctgtctctctctagcttttttgtaggacaattttgaatcttgctaagactattcatatcttattaatattattaaggttacacatggagtctttgccacctctccacccataataaaccataggattctgaagtgttttgtagttcaaaaataattgaatacccataaaaataatttaatgaaatatatttttagatgcttggttttgtgcctccacaatactatcagtgaattcagtttgtatgctaaagaaagaatatatgatttttatgttttatgtatagtataggtcaatttccatttaataagggttgacataaaaatgatagtctgcattgcagagttataggctagaagacgtcttttgtctagtgatctcatgccataatttcgaatcacttttgtttgatcttaatagattcttgtgtgaacaaggcgaaagttgaagaaagtgaacaaaaagctgcagagttttcaaagaaggtaagcttataaaatattagccataatcgttaggttaataatttaatcacagtaatactctaccttctttattaatatgagggcttctaaatgtttcatttatgtagtactttatacttttgggttcaaacatagccgtggaatattgatttatttccttataaggtaaggttgctattgttccctcatcatcatgtttaatccattatggaagaaaaacactagccacattatactaaagtgatacatgaaataaaattacattgctgaaagggtatagttggaagcaatcaaccaaaataaattctccctttgctttcttgcagctgtcgcttgcaataggtagctctttggagaactgtgagatgtttagctagtcttttctgttgtggtcttttatgtcagtgctattgatagtaccaacatgttgcagtgttttctctctttctcactctctttctctctgtttagacttagcttctttgaatttcataattatcattttgtaagtgatgctgctacttcatgtaggcctggtggaatttgaggatcccttttctttctgtgttaatgtcttaaatgcctttgagtaaatgccagctttgtgaatatccgaattgtattcagatctaagcttgtcttttccttgtttcatggaagcatagctataattttattagcttctaccacaagtttctctttttttgttctagagcctattaagcattagtatagtatttctgtcctgttgtgtgcagccagaaggattgaagcacatgtctaaaagctctccagttttcagccttctctcagcaagataatgtgcttacatattgctgtctcttcaaagttatgacttaccttggagattagataatcacttttgctatcactctagaaattatagagtattactgaagaagttacttcagggcatctgaagaaatatctttgctcttttagttactagaatagattctaagagcttgagcataaaatgtttgtgtggagctgtcatttttattggtgaaagaaaatgcatgctttttgattaatagaccttcatatttctaatgttcttgttttaagtagcacatttaaaattccctttgaaaaaccttagaatctccttaagttttggctggcactgtgattagacactgcaagactggagcaaattgtgattatctgtctggtaaagtttttttgtgagcatatatattatggaaaaaggagtcctaaagtaatagaaaagaaatttcagtgtttgatgctttagtgtcatcaccaacatttagaatgaaaacatgtatggtctcccagtggttagctacatgcatccccttgttctgggtcattttaagaggcagtataaagtcattttttaacaagtactagaatgagaggcagtagttgtgagatctgatctcagcttttccactaattagctgtgactttgggtaagccacttactctctttagatcttagtttcttcatcattaaaaggaaagaataaaattagcggacttgtaagaagacctcttccagctcacatatttcaggcttctgtgatccccgtttgctgtgtttgcagattaaggtaattttaaattaaaagcagaaacattgtgtgcctctcctccaacatactaataaaccatttttagaggaaaaaatgtgtatagtgtgcttgtgtaggtgccatgatttagaagcacataggagaagctaactttaggagtggggatgggagtacagattgagataaatcttaacacggatagtagtaaaggcaaacaagctcacattggaggatatccatcttcttaatgaagtaggaaaacgaggtcattgactgaaggatatatggatccttcactccaaggatctggggtaggtttgaaatttaaagaaattagagaatatttgggccaggatctgtgggacattttcccgggattcaaggagagatgaataaaagcatttcaggttcgacccaaacagtattattatccagtttgctcacccactcttcagacttagatcagaatggcattttataatttccaaaggtcaaagctactatgaggatgaatatttgttaacagtgaacatacttttgcattgttccacaaactcttaagatggttttgggcagtagatgtatcacttttagaaacagaaataacattgttagaataatgtatagacttctaaattgacttgaaacaacattgacaataaagggcaaataaaatgttctatagccagtcccaggcagtattcactggaaatatgcaggcaggtttgtgcctgcttagagccctgtctgaggtaagggctaaggcaggatacagtgaataaatattaaccattcagtctttttggcttagcaccccatattttaacctctagtttttcctctcataacatgctatacaaatgttttggttaaccatctgaatgagactgctattagggcatcctactgtcagagtttgtgaagtactgctttatggattctagacaactaagattgtaatagaaacaattccaatttgtattaatatacgtacatttgagcattctaaaagtgcaatttcttttcaagattaaatatagttaaggagttgaaactgcttgatggtttatttttagatttcattttctaattcattaaacttaaaagtatgggatgaggctgcacatggtggctcacgcctgtaatcccagcactttgggaggccgaggcaggtggatctccagaggtcaggagttcaagatcagcctggccaacatggtgaaacccatctctactaaaaatacaaaaattagccaggtgtggtggtgcgcacctgtaatcctagctacttgagaggctgaggcaggagaattgcttgaacccaggaggtggaggttgcagtgagctgagatcatgccactgcactccagcctgggtgacacgagtgaaactctgtctcaaacggtatgggatgaaatatttttaaaattattaattctaaaattgaattttcattaccaaaacaataaaaatgttcattatgtgtgaagagagacttttcagtctacctttttgtctttgtattttttttcagaagtgaaaatgtgttttcttaccttgggtagggggcatatttcttctttactaccccacctccacttggatacttaattgttatgaaaataattacaagctgtgattttctgagtgatctgggaattcaactaagtaaaaaccactccacttatttaatacataatgttctttaaagcgttctgaaaactatattattaactgtacattgatggtgatcattgcagttcgatgaagaattcacagctcgacaggaagctcaagcagagcttcaaaaaagagatgagaaaatcaaagaacttgaagcagaaatccagcaacttcgaacccaggtaatgaaagaagatatagactttgtgtcatgtcacaatgagtttgatggtagaaaattatcttgttatatagaaggaaaaatgtgaccagaagcagactttttggcagttttacattttcattgaaataactatacagattttatattccagggcaataaatcattttaatgcttggaaaaaaaataaagcattagttgctcaaatggccctgaatatttttaatagaatatattacacaagcaaaagtgtttttgagatgaaattttcgtgatgatttgaaaaattgggtacatgctattttctttcaaaaagaatgtagaaatagtcattaattgtaattatcccaaaagcttcttgagatctctttgaatctcaagtaaatttccacctacatttcctatggtgaaaagctcccatatatacttaaaatttcaattagggtgtctaaactttcaaactgattgtgtattctcctcaatatactttatgtcttaaattaatattaagaaattgaagatgggccaggcatggtggctcacgcctataatcccagcactttgggaggcggaagcgggcagatcacgaggtcaggagatcaagaccatcctgactaacagtgtgaaaccccgcctccactaaaaatacaaaaaaaaaaaaaaaaaaaaaaattagccgggagtggtggtgggctcctgtagtcccagctactcgggaggctgaggcaggagaatggtgtgaaaccaggaggcagaacttgcagtgagccgagatcccgccactgcactccagcctgggtgacagagcgagactccgtctgaaaaaaagaaaaaaaaaaaaaaagaagttgaagatgatgtcttaacatagtgggtgctcagtagatatttgttgattgactaggtctgtttccaccagtctagtgaacgattacttcaaaagtcaccaacaaactccataatacccaatccgggggccttttcctacccttagcctgtattacttatctctaatatttgatcatttcttttcaataaattaatctctttctctgtctgtttccctccctctctttttcttggacttctttttctacatgtttgagaacttagtttctccttattttttcatcctcaaatggtgaccttccacaatattctgtcctctgctcttttcttttttgtgtatatttttgctgtactgttccattcagtatcatacattcacatatccccttttagtaggggtcaagtctcttgagtttgtcttctagttccagctcgtgattagctacccccataggatggtcctgttgcatgttgaaatcaaacccagttttgtggttttgtctctttcctcaaaccagtttgttgtccatttcctgtttaaattttactaccaattttaaagatggtgaagctggagttttctttcccttttccctgccccacccactgacaaattaagctagtcagttttatgtctgttctttcttcaactccactcatactacacctcttcgcatcaaaccccagaaacctccaggtcccctctcttatgatgtctcgcctggactattacaattgttgcctaacttttctccctcctcaaattcatcctttatgtcagtggcaaattaatcttcctgaaacaattccctgattattgttactccagcctttaatatgttcacttgttgcctgttgcagacaggattaaataaaatctccttaccaggaatgttaagaccctctggcatgagtttttcctcctttatctcccctttgcagcctaggctctgactgctcccctaactacagcctctgttgcagctaagtcacctttcctcccttcacatttggaaattactgtctccatacttaacccttctgccagcatttcccagagattagttacagaaatggcaataggttgttcatgacgaaagcattccatagtccaataaattgagtacgcatgaaattctcatcttagagattcataatactcattagcatattaaaggtcccagatattttacactgaagaaacctgcctacctctttttcatatagatttcccatactcatttgaccacagcaccctttatctcagagcacccttcaacatctcctggaaatagtgttttcatagagcttagttgagaaatgttggcatacattattctctgtaagaaattccctcctttgctcatctgtgtgtgtgaaatgtatcctttaaggagaagctcattaagacatcttttggaaagcttcaccaaaaactccattagcgaatttctccgaactttcatatcacttttctagaccactcatgggatatttgtgtgcctgctctatttcttctgctagagcatagacaccttgaggacagtgtgtttcttattaaaggccccactgtacctagcacaggcctttaccgcacagtgagtagttgcttacttatggttaaattaactgtaaaaagtgcagaatcacgaagcattctcaactcctggcctcaagcattcctcctaccttagcctcccaaggagtagctgggattacaggtgcaggcacagggctgtatactttctagtgtgcccaaaataatgtcaaatactaaattattcatttaccatattcaatttgcaatacgatgtggtagcctaatttaattattcaattcctaattgttcatgggagggaaaggaaaggctgatatgatttgatttttaaaggctggtagcatttaatataaatatttgagattccttattaaatctgtaaaatatatatttaacttgagtaaaattttatttaaataatagcattttgtggttgtataaaattcccaaaataaatgtgatctaatagaggtgaaaaattgactgatgtttacaaatgtatattactttgaattatgttgtccattaattaaaaaatgggaaacgacacacattttgcctttcgaagtatgaaaaatatcatgtcatacacaaaatttgtaggataaattactaattttctgaacctttaattttgccacaattacttttatctcagttaagactataaaatgagactgttttccatagttttgctactttcaaagtaaaattaaaataattttacatattttaatcttgtctttctttctaacctcagagagaaaattgcattccaggagaggatggttatttgctaagtatagaaacactttagttgtatgtatgtatatacatacattaacattcatctatgtgaaaaaactagtgtgagtgaatattatgggtaacctttccatgatcttgtctacctatgagtgttagttttaatatttttgtaaataggtcagtcctttcaactggttgttccaaacatttgcttcagcttactttctaaagatatttatggctgtgcacagtggctcacgcctgtaatcccagcactttgggaggccgaggcgggcagatcacgaggtcaggagttctagaccagcctggccaacatggtgaatccccatctctactaaaaatacaaaaaattagccgggagtggtggcaggcgcctgtaatcccagctactcgggaggctggggcaggagaatagcttgaaaccggaaagcagaggttgcagtgagctgagattgtgccactgcactccagcctgggcaacaagagcaaaactctgtctcaaaaataaaataaaataaaataaaataaatgaaaaaggtatttataaattcagttagaagaactaaataatccaagtagaacatttatattaataatggtgagagggctaggcacagtggctcttgcctttaataccagcaatttaggagaccaaggtgggaggattccttgagcccaggaatttgagactgttctgggccacatagtgagaccccatcttaaaaaaaaaaaaattagcctggggtagtggtgcatgcctgtagtcccagttagtcaggagactgagatgggaggatcacttgagtcctagaggtcaaggctgcaatgcactatgattttgccactgtactccagcctgtgcaagagcgagactgtctctgaatgaatgaatgaatgggtgaggacaaaaaggacactatcccaagaaatttaattagctttttttgttgttcactgaaaatttgtttattaagttgttaatgttttacagagttcgttcaatattttatggaacttaaaatcctgagtttcccctcaataatacagatgtctgtaatacagacatttgtacaaactactacaattactgatgccttatataattagacttctataacttccatttgtcaggtaaataaaacacctctcaaagttaccacaactttaggagttcacaaattcctatttctgcagtttttcattagtatattttaaactttcataaaagaggaaaccaaaacctccaaatcaaaagccttaatatgaaccaacattgagaaacagagtaatgtaagaagctcttttattcatcacggagaacaaaaatacagaatatttttactaatttattttccactaaagagaatacactttgtatttagataaataaatgtttatttactgggagttgcttttggagaatgatccataattgccctatcaatggtcacatattgataccagggtccatctcttctcttccacattaatcttcgtacttccagctcctttatctgcagttcagccttttcagtttcagtgtgaaggatagccattgttctttcgtaattattttcaggatcatcatagaaagtatggacaatccatctcaatataggatgcttataatatgcccattgttctgggatatagccttctggaattcctactagttcagtttcaccaatgaatacattcactagagtttctccaattgccactggaatccctataaacaaaatatagaatttcagtaaattaaaaaaacacccattgtagaatccagaaggtttcatgataaatagtctttttcctatgatctccactgtgttaaacaggagtgacagctttaacaaagccacgggtgaggaagcccctgaatcccagtcgagcgtcaaggcactggccagacagctgtcactgcagtgactgaggcctgttgcaaaaaactcatggctgccttggctgccttaattagttttaaacgtttcattctgttaatctaatgtcgtatcttgattaaaacagatgtgtgttcattggtagtggtttcataagaatgtttataatgaacagctctacttttcatatatatttatctagcaaagtgagccattgtgatcagtactggtttaaggaaatggatatagattaatcatctctaaaaagaacatgatatggattgcagtgttccctttcatctgttatccattgtcattagagaatgagcttgaagttactttctgatagaaatgttatatcctcctcataatcctatctatttgaattaattgtcctcattgtaaatggcacccattcatgaaaagacagtcttttatattgggatgaggatggtattagatgtaagaagaaccacattgaaattctaatcatgttcagactctgaaacttttggttagtcatttaactttttctgcagctaacagtttcctcatctttaagcagtgaaataaaggtgagataataatgccctatctgtattacagggttataataaggatcaaaagaaataataaatgtaaaaatgttgataagcatatattactatggaaatggatgctatttagtatttattattggtgttagaagccagctaagttactagagccatgaaacagactctttgtatgaagctaattagcccccaagggaatttaatccataaccttgtatttattatcccatattcaaaccaactaatctaactggcccaagccatacactgtacttcttttgtacatatatttataaagaaagttaatttttcattattttagaggagtatttcacaaaatctttgaggatactgtattagtccgttctcacactgctatgaagaaatacctgagactgggtaatttataaagggaagaggtttaattgacttgcagttttgcagagctggcgaggcctcaggaaacttacaatcatggtggaaggggaagcaaacacatccttcttcacatggcagcagcaaggagaagtgccaagcaaaaggggaaaagcctcttaaaaaaccatcagatcttcggagaactcagaattatcaattattcattattcattattcaattatctccccctggtcccgcccttgacacgtggggattattacaattcaaggtgagatttagatggcgatgcagagctaaaccatatcattccacccttagcccttcccaaatctcatgtcctcacatttcaaaacacaatcatgcccttccaacagttccccaaagtcttaactcattccagcattaacccaaaagtccaagtccaaagtctcatctgagacaagttatgttccttctgcctatgagcctgtaaaatcaaaagctagtcacttcctagatacaatggggatacaggcattgggtaaatacacccatttcaaatgggaaaaattggccaaaacaaagggactgcaggccccatgcaagtctaaaatccaatagggcagtcattaaacctcagagttccgaaatgatctcctttgactccatgtctcatatccaagacatgctgatgcaagaggtgggtttccacaaccttgggcagctttgcccctgtggctttgcagggtgcagcctccctgctgattgctttcacaagttggtgttgcgtgtttgtggcttttccaggtgcatggtgcaagccatcagtagatctgtcattctggggtctggaggatggtggccctcttctcacagctccactaggcaatgccccagtggggactctgtgtgggggctccaaccccacatttcccttctgcactgccctagcagagattctccataagggctccacccctgcagcaaacttctgcctggacatccaggcgttttcatacatcctctaaaatccaggcagaggttcccaaacctcagttcttcacttctgtgtacctgcaggctcaacaccgcttggaagttgccaaagcttggggcttgcaccctctaaggctatgtcttgaaatgtaccatgactccttttatccatggctgaagtggctaggatgcagggcaccaaagagactgcacacagcgggagggccctggacctggcacaggaaactatttttctctcctaggcctccaggcctgtgataggaggggctgccatgaaagtctctgacatgccctggagacattttcctcattgtcttggtgattagcatttggctcctcatcacctatgcaaatttctgcagagggcttgaatttctccccagaaaacggatttttctttactactgcattgtcagtctgcaaatgtttttaaacttttatgctctcttcctcttgaacgctttgccacttagaaattttttctgccagataccctaaatcatctctctcaagttcacagttccacagatctttagggcagacaaaatgccaccagtctctttgcattgcaagagtgacctttattccagttcccaacaagtttcacatctccatctgagaccacctcatcctggactttattgtttatatcattatcagcattttggttaaagccattcaacaagtctctaggaagttccaaactttcccacattttcctgtctacttctgagccctccaaactattccaacctctgcctgttacccagttctaaagttgcttccacatttttgggttgcttccacatttttgcatatctttacagaagcacccaactatccggtgccaatttactgtattgttgttctcacacaactatgaagaaatacctgagactgggtaactttttttttattttattatttctttgagacggagtctcgctctgtcaccaaggctggagtgcagtggcgtgagctcagctcactgcaacctctgcctcctgggttaaaacgattctcctgcctcagcctctcgagtagccgggattacaggcacgtgtcaccatccccagctaatttttgtatttttagtagagacagggtttcgccatgttggccaggctggtcttgaactcctgacctcaggtaattcacctgcctcggtctcccaaagtgttaggattacaggcgtgagccaccgcacctggctgagactaggtaatttataaaggaaagaggtttaatttactcagttctgcagggttggggaggcctcaggaaacttccaatcatggccaaaggggaagcaaaacacatccttcttcacatcgcagtagcaaggagaagggccaagcaaaaagggaaaatccccgtataaaaccttcaggtcttgtgagagcttgctcatgatcacgatttgggtgggaacacagagccaaaccctatcagataccaactttcctagcatttgtgtgttaacagaagtagtcactgtccagaatttataatgcttataaaaaatctacacaggcctttttcatatactgttaaacccttagatcttgctaaatatttagatattttagtaatatctaaaaaagtatatatgatcttaaaacataagataaataaactacaaatatctattgatatatatttcttcagttttttcaattatattttataagcatttaaacttggattatttatatttcaggcacaagtactctcaagttcatcaggaattccaggtcctcctgcagcacctccattgccaggtgtagggccgcctccaccaccacccgcgccacctctacccggaggagctcctcttcctcctccaccacctcctttacctggaatgatggggataccaccaccacccccaccaccacttttatttgggggacctcctccaccaccaccccttggaggagttcctcctcccccaggaatatcacttaatctaccttatggaatgaagcagaaaaaaatgtataaacctgaagtgtccatgaagagaatcaattggtcaaaggtaatactaaaactagagtttttttactttgtctagcttttgttgatcattgctatgtgtacacattgtataatgtttgagagtatgactgctgactctttccgttcctttgtgggttcatcattttatgtccatctttcaatttaggttgtagataattggaaactctccagatagtttgacattgtgaagcaggcaaaaggaaaatcgaagtgatgtagagaataatatttgaaatataccaacaaatgacaagcaattttgattcttttaacatagcttttctttaaaaattttttattgatatgtaatatttgtacgtatttatggggtacatatgatttttgctacatgcatagaatgtgtaatgatcaagtcagggtatttaggatacccatcacctttaacatttgtcatttgtttgtgttgagaacattcagatcttctcttctagttattttgaaatatacaacatattgttaactatggtcactttactgtgctatcaaatggtagaacttattccttttatctaactatatgttcatacccattaacctatctctcttcaccctcccacctcccacacacacccttcccagtctctggtaactatcattctattctctaccttcatgatactcactttttaagctcctatatatgagtgagaatatatgatatttgtttttctgtgtccagcttttttcacttaacatagtgatctccaattccatacatattgctgcaaatgacaggatttcagtcttttttatagttgaatggtattccattatgtctcaatactatattttctttatccattcatccgttgatggacacttagcttgatttcatatcttgatttcatatctttgccattgtgcctagtgctgcaataaacatgagggtgcaggtatctctttgatatactgatttcctttcctttgtataaatactcagtggtcagattacagcattattgtatggtaatcctgttatttaggagcattattgtatggtaatcctattatttatatttttgagaaatctttatagtgttttccataatggctgtactatttacattcctaataacagtatatgaaagttcccttttctccacatctttgccagcattttgtctttttgataatagctattctaactggcataagatgccagtaagatacctcactgtggtcttgatttgtatttccctggtgattaatgatgttgagcacattttcatatatcttggccatttgtttgtcttcttttgagaaatgtctacttaaattatttgtctactctttaatgtgattatttgttttgttgctattgtttgggtttcttgtattttttggatattagtccattgttggatagtttgcagatattttttcccattcaacagattgtctctttactctgttaattgttcccttttctatgcggaagcgttttagtttaatataatctcacttacccatttttgtttttgtttcctgtgcttttcaggtcttagccacaaaatctttgcctatattagtgtcctggagcatttgtcttgttttcttctagtagttttatagtctcaggtcttatgcttaagtctttaatcaatgttgagtccatttttatatattgtgggagatataggtcaggtttaattcttttgcaaatggatgtccagttttcctatcatcatttattgaagagggtgtcctttccccattgcatgttcttggtacatttgtgccaaatctgttagctgtaaatatatggatttacttctgggttctctattctattccattggtgtatatatctctttttacattagtaccatgctgttttgactactatagccttgtagtatattttgaagtcaatgtcctgctttgatctttttgctcaggattgctttggctattcaggctcttgtgtggttccatatgaattttaggattatttttcctattttttgtgaaaaaatgttaatggtattttgatagggattgcattgaatctgtagattgctttgagttgtatggtcgttttaacagtgtaaattcctttattctatgagcattgtctctttccatttgtttgtgtcctctttaatttctttcatcagtgttttgtagtttttcttataaaggtcttttacttctttggttaaatttattcctaggttttttatttttttgtagctattgtaaatgagattgcctttttatttttttttccagcaagtttattgttcagctatagaaacattaataaattttgtgtgttgattttgtatcctccaacttactgaatttattaattatatgagttttttgtggggtgtttaggtatctccaaatgtcagatcatgttgtctgcaaagagggacaatttgatgttgtcttttccaatttggatgtcctttatttctttgcttgactgatggctctggctaggacttccagtactatgttgaataggaatggtgaaagtgagcatcctagtcttgttccaattcttagaggaaaggctttcatgttttgtccattcagtatgatgttagcaatggctttgtcatatatggcatttattatatggaagtatgttccctctctgcctaattgttgagagtttttattgtgaagggatgttacattttatcaaatgctttttctacatctgttgagataattatatagttttcatttttcattcttttgctgtgatgtatcacgtttattgaatggcatatgttaaacaatcctggcattcatggggtatatcccattgattatgatgtattatcttttggatgtgctgttggattcagttccctagtattttgttgaggatgtttatgcctgtgttcatctgggatattctttaattgttgtgtccttgtttggttttcgtattggggtaatgctggcctcgtaggatgagttaggaagaatttcctgctctttagttttttggaatagtttgacaagaattggtgttagttcttttttacaagtttggaagaattcattagtaaagtcattagtcctggggcttttctttactggggggactttcttggtagattgtatgtgtccagtaatttatccatttcctctggcttttcagcttgttaatgtatagttgtccatagtagtctctgatatcttttgtatttctgtgctatcagttgtaaggtctcctcttccatttctgattctgtttatttaggtctttctttttttttttttcttttcttggataatccagctagtggtttatcagttttatcttttcaaaaaaaaaaaacctaactttttgttttgttgctcttttgtattatatttttaatctctgtctggctcagttctgctctgatctttattatttttttccttctactgatttggggtttggtttgttcttgcttttttagttccttcaggtgcaaaattaaactgtttatttgacatctttccattttttcgaagtagttgtttattgctatgaacatccctcttagcattgctttccacaggttttgatatattgtttttttaattttcacttacattaatacattttttaatttttttcttaattttttaattgacccagtggtcattcaggagcatgttctttaagtctatgtacttgcatagtttctgaaatctctcttattattgatgtctaattttatcccattgtggtctgagaagatactcgatatgattttgatttttaaaaatttgttgagacttggtttttatagtagcatatgatctatccttgagaatgtttcttatgctgatgggaagagtgtttattctgcagctgttggataaaatgttctgtaaatgtcttttaggcctgtttgttctaaagtgcagtttaaatccaatgtttatttgttgattttctgcctagatgatctgtctaatgctgggagtagggtgttgaagtccccaactattactatgttagagtgtacctttccctttagatctaataatattttctttgtatatctgggtgctccagtgttgggtacatatatattttgacatgttacatcctcttgctaaagtgatgcctttctatatatatatacatatatatatacatatatatatatacatatatatatacatatatatatacacatatatatatacatatatatatatacacatatatatatacacatatatatatacacatatatatacacatatatatacacatatatatatacacatatatatacatatatatatacatatatacacacacatatatatatacatatatatatacacacacacacacacacatatatatatatatatatatatatatacctactttgtctctttttactatttttgacttaacatctgtttgatctgatatacgtatatttactcctcacttttggttaccatttgcaatttaatatcttctattttcagcctatgtgtgtcttgcaggtgaaatatgtttcttgttggaagcatatagttgggtcatgttttttagtacattcagccagtctatatcttctaagtgggcaatttaattggtttacattcaagtttattattgataggtgaggagttattcctgtcattttgttaattgttttctgttcattttgtgtatccgttgtttttttctttctttgttattgtttatccatgtggtttagtagttttctgtagtgttaacatttgagtcctttctctttctcatttgtgtatctgctctacatgtgagttttatactttcatgtgctttcatgatatattctctttcagacacgtaggacttccttaagcatttcttgtagggcttgtctagtggtgatgaattccctcagtttttgcgtgtttgggaaagacattatgtatttctccttcatttttgagggatagatttgttgggtatatacaactggcttctttttttctttttttcttttggcactttaaatatagtgtcccattctctcttggcctgtagcctctccaatatgctgcaccacgtgttcctgggatgtaggacaccttgtgggctagagtgctgggacctggtctcattgctggatctagccagtatcacaccactgcagtcatctgggtggatgtggggagatttcagtgggctccaaggatgtggagatagagtatcattcatccccagggcaggatgtagtctggttgggtttgggctctcaatctgttaccatactgcacctgctttggtcttggtggcatgtgtgggatccagtgtgaatgctcattctagagcaatgccattgcacacactgcagctcgctttgtatactaaagactagtttcagggcctgtggaggctgagtggctctcctatggctagaatcttcagagttcacagtgggaatctggaccactggggatatgttatttacccttttcccacattgggggagcgtctctgggctcccagctaatcacagccaggcttgctgcctggattcccgctccttccgtgcctcaggtgttttctgtaacttccctgccaaattccagtgtttttacatgttgtgattatctactctcttttttggccttttatggaggatatgagtgccacctgcctccagtcagctgaagcctattccccatttttcttgaataaaatcctttttattattgagcctttttatcttacttgtttttcttagtgaatgactttttttttaattttacactttcaaatagtgtggaataagtgacaatattcaatattgatataccttaattttttttgatgtatgaaaatactttcttctgaatgttgtttggctttattattattagaaaataatatgtctgttttaaaaggttattatgtagattgacacagtcctcattcactgggaactaattttctaatgaaaatccatttacccagacaaccatctggggaaatgtgtcatccaataacatatttacagtattagacagcatctatgtagtaagttggtttaaacagaatgatggttaaatcatttttcaatcttatgcatatatttatgctttgctcataagagtaaacttggagtaaatggttttagaatgtagttttctttttaaaaaattaagtacaattcatcaaaattcaagattacaaagctgttgcctagttatcttcctgtgttaatgtagtcgtatgcttcctaattttacaatttagtatacggtgtaatggtagttatacatcacaaaacttcatggtgtattggaagataaagttctaatcttgggtagtagttaagaccacagtcctctggagcacttatctaggtttaaaatcccagctctgccatttactaatttgggcagccacttaaactttcttgggctgtgtttcctcatcttttaatgtagagataataacaggtgaaaaaattattacgaggattaaattagttaatatatgcaaataacttaagacagtacctgacacaacgtaggaggcgtgtgtcagctatcattatggttgctaccttaaacctaatgagtgaacaaggggaattcacttttctaagtctgagtttccctgttttaaaaaacccaggaacaagaagattttatgtgagttggggttaggatttcctaagttatttttaagactccttccagtagaatagtttttaaggtgcaatttgctttgtggtctatttctattgttcaccatttcgtcacataattctgaatttcccaatgaatatttactttataagtattatttagatacatcctgaaattgacttagaggatagaggaataaaggaactgtcattcaaccttgctgaaagttagttccttgaaaatttaaatatgaggttataatttagaatctattctttgttatttttgtttcagattgaacccacagaattatctgagaactgtttctggttaagagtcaaagaagacaagtttgagaatccagatctctttgccaaattggcattgaattttgctactcagataaaaggtacatttttaaaaataaaatataagttcccgattcaggtacaatttaatttagtgctttgctaaaaatttctagtaatgggtatatgtatacttttcccacactggacagggtgaaacataaatagattgacatttaactatattttacctagtaaataaagaaggaaatttattttacctttgaattttattatacataaatgttattattcttctgaaaatacaggttttatttttattgttaaatatgtgtgttgcactgctccattataaaatagtcgtttttactgagaagcagggaagatgaatccgttgattcatcatgtaagagaaaataatgtaagagaacactaaagtctcagaatttttcatgaaattgaaataagattggtcccatagtcttaaatagtctttcctgtcatgcttgtattacttatcaatttggattcctaggaaatgttatagtttttgctataattagatattttctattaatatcaaaatccagtaccttataagtattgtttactgatttgataatagagtgctttgtttatgattagatcctttatttatttgcttgtgaatttcacagatgattttgttactatacaggtagcttctcaatctcataatagatcgttatggttcattaatttttggtattttatttcaacatgattatttcactaattattgtagaagtgatagtttagttgaggatattactttttgtctgaatgagtccttgcagttgaaaaatggaaataatccatactctcatgcccttggaattagcacctttatcattcatttgtctgatttgtcacattatgccttagaatatgagaatataaattttggaagatagagaggtgtgaaaattagtttcttttttttagattatgtacactggagattgttgtgctgtatttgttgttctttgtaaattgaagttcatatgcacacacaaatctggggtgattagactattctgaagaattttgacatttaaaaaaagttactactattaggcctacctttcttttttctcatttgatatcgcagacctcacatttaaagaatttttcaatgattcaagtgattgccatttattataatcactgtttaacgttaaaaaattgcttgtagcaaagtgttcatgcttatagcaaattattcatatagtaaaataaggtagtttaacaaatgtaaatctcccttcaatctcagacttacagcattttgcccagataaaatcattaattctaatttttcacattttctcctagaaatagtctatgcctctcaacacatatgtgcatttatcattttttgttttttattccttgctgttttcaccaactgtgcctaaagattattctgtaggtgcttgtgtttatctactgtgttctttttacatactgcatagaattttgtgtatgggcctatcttaatttaattaatcccatatcaatggctatttagattagttctagtcttttgcttgtttaagaaatgctgtggtgaacatgactccatatatgctgtttttcacaaattctacaagtaaaattcctggataaaatgctgtgtacatttacaaattttaaagatagtatgaaattacattctgatgagtttgtatcagtttataatgtcacaaagaatatatatgaatatctgttttcccaaaatctttgcccacctcagaggtgaaaatggtaaatcattgttgttataatttttgctttttgaatatggagtgagattgagcacattttcttatattcacaggcaattttattttactttcattttaaaaaataattttaactcttattctgtattcagggggtacatgtgcaggattgttacatgggtatgttgcatgattctgaggtttgggacgcaaatgatcccatcatccaggtagcaatgagcatagtacttgaccattagttttttaatccttgccctcttccctccctctgttctctattagcccccagtgtctattcccatctttgtgtccaagaatacccagtatttagctcccacttataagtgagaacatgcagtatttaattttctgttcctgcattaatttgcttaggataatggcctccagctgcatccatgttactgcaaaggatatcattttttatttttatatttatttatttattcattcattcattcattcattcattcatttattcattttgagacagagtttcggtcttgttgcccaggctggagtgcaatggcgcgatcttggctcactgcaacctccgcctcccgagttcaagcaattctcctacctcagcttcccgagtatctgggattacaggcgcccaccacccttagctaatttttgtatttttagtagagactgggtttcaccttgttggccaggctagtctcaaactcctggcctcaggtaatccacccgcctcgacctcccaaagtgctaggattacaggcgtgacccaccatgcctggccaggatatgatttttttttaattacggctgcatagtattccatggtgtatatgtaccacattttctttatccagtccattgttgatgggcacctaggttgattccttgtcttcgctattgtaaacagtgctgtgatgcacataaaagtgcatgtgtcttttgggggaaatgatttcttttcttttggatttgaacctagtaatgtgattgctgagtagaatggtagttctgttttaagttatttgagaagtctccgaactgctttctatagtggctgaactaatttacattcttaccaacagtatataagtgttctgttttctccacagccttgccagcatctgtttgggttttttttttggctttttagtaatagccatgctgattcgtgtgagatggtatcttgttgtggtttcaatttttcatttccctgatgattagtgttatgagcattttttcatgtttgtcagcctcttgtatgtctttttatttttattttatttatttatttatttattttgtgacagagtttcgctcttgctgcccaggctggaatgcgatggtgcaatctcagctcactgcaatctccgcctcctgggttcaagtgattctcctgcctcagactccccagtagctgggattacaggtgcccgccaccatgcccagctaatttttgtatttttagtagagacgagttttcaccatgttggccaggctggtctcgaactcccgacctcaggtgatccacctgcctcagccttccaaagtgctgggattacaggcatgagccaccatgcctggcccatatgtcttcttttgagaagtgtctgttcatgttctttgcccactttttaatggggttatttgtttttttggttgttgatttctttaagttccttatagattctgggtattagacctttgtcagatgcatagtttgtgaatattttcttccattgtgcaggttgtctgtttatcctgttaatagtttattttgttgtgcagaagctctttagtttaattaagttcgattcatcaatttttgttacagttgcttttgagaacttagtcatgagttatttcccaaggcagatgtccagaatggtgtttcctaggttttcttataggattttcatagtttgaggtcttacatttaattctttaatccattttgactttttgtgtatggtaaaagagaggctttcggttttgttcttctgcatatggctagccagctatcacagtgccatttattgaataggtagtcctttctccattgtttatttttgtttgactttgtcaaaattcagatggctgtaggtgtgcagctttatttcttggttctcttagtctgttccattggtctatgtgtctatttttgtaccagtaccatgctgttttggttacggtagccttgtaatatagtttgaaggcaggtaatgtgatgcctctggctttctgcttttcgcttaggattgctttggctatttgggctcttttctgattccatgtgaattttagaatagttttttttttctaagcctgtgaaaaatgacattggtagtttggtaggaatagtattgaatctgtaaattgctttgggcagtatgacctttttaatgatattgactcatccaatttatgagcatgagatgttcttccatttgtttgtgtcattcattatttcttttagtagttttttgtggctctccttgtagagatctttcaccttcttgattagatgtgtatgcctaggtatttcatttttttttttttggcctattgtaaatgatattgtgttcttgttttggctctcagcttgagagttattagtatgtagaaatgacactagcttttgtaagttgagtttgtattttgaaactttactgaaattttttatgtgttccaggaaccttttggcagagtctttagtgctttctaggtataggatcatatcgtctgtgaggagaaatagtttgacatcttttcctatttggatatcttttatttctttctcttgcctgattactcatccaagggcttccagtactatgtttaataggaacgatgagagagggcatccttgtcttattccagttctcaaggggagtgcttccagctttcctccattcagtatgatgttggctgtgggcttgtcatagatagctcttattattttgaggtgtacctagtttcttgtggatttttatcgtgaagggatgctggatcttattgatggctttttccatgtctatggagatgatcatatggtttttgtttttaattctgtttatgtgatgaatcacacttatttatagatgttgataaacattgaatcccagaaataaagcctacttgatcttgccagagtaactttctgatgttgtgcttgatttggtttgctggtattttgttgagaatttttgtgtctatgttcattagagatagtggcctgcagttttcatgttctgttgtttctttgccaggttttgctatcagggtgatgctggcttcatagacttatggaggagtccctactcttcaatgttttgaaacagtttcagtagaattggtaccagctcttctttctatgtctggtagacttcagctgtgaaactgtctgttctgggtgttgttgtttgtttgtttgtttgtttgtttttgtcatttttttttaatttaaattactgatttaattgtggaactcaatatttgtctgttccgggtttcagcttcttcccgattcaatcttgggaggttgtgtgtttccaggaatttatctatctcctctatattttgtagttggtttgcacagaagtatacataacagtctctgaggatcttttgtttttctgcaggatcatttgtaatgtcacctttgttgtttcttattgtgcttatttggatggcctctttttttcttttttaatctaggtagcggtccatttatcttgtttatgcattcaaagaatcaacttttggtttagttaattctttgtgtggatttttgggtatcaatgtcattccgttcttctctggttttattcatttcctatgctagcttttgcattgatttgctcttgtttttctgcttcctctaggtgtgaagctagatctttaatttgagatttttctaactttttcaggtaggcctatagtgctattaacttcccttttaatactgcttttgctgcatcctcaagattttggtatgttgtgtctcttttcatttattccaaaaaaatttttattttctgtaaaggcataaaatttctttttctgtaaacttccccctccatttctttgcatattttctattgagcatttacgcttttgattatggacttatttgaattgaatgctacaagaatcatagattttataaaattttagagttagtctggatcttagaagttattaaacacagactctttgttttaccaatgaagaaactgaagtaagagacaatgaggtaagtgtaaaacccattaaagatagcgtggtatagtaggaaaagccagaggaaataaattcacacatacttgcattccagctgtgatacttgtaacctcggagactgaattttctcatacataaaatgaataggctaatgtttacctggtagtattgtgagaattaaacaaggttatatatttaaagcactcagcacattggtatccctttcatttaacttgatgctctgtgtgtgtgtgtatgtgtgtgtgtgtgggtgtgggtgtatgtgtgtgtgtgtcttagttattgatgcttcagtacaactgttaattcagcaaaatttactgctcttcttttcagcacttggtagagctaatcagtcagaattgaagcaattcttactgcagctgccaaaacctaatcaaaccaaatcaaaaccaaacaaaattcatacaaaacctctcatgtatgtattgctgagaatgctttattttcattcctcttaacgttgattctttgaattttctctttcacgctactatgacttccctaattgtggatatttaagtagaaatctggacagtatcacctttcagaaccattacttttactaaaatttacttctgaaaggacatatacaggatcaattatgcatcatagcctatttcagacatgcacaccatagctaaaacaaattttaatgatactaaactgccattcttttgtaacacacagtaactattgattgatgttactgtaactgctgaagttccttgtcattcgcagtgccttgattcatactgtggtcaataggtggcaggtttagtaagaaatcagcaggagggtctgctttcatgaaacttaaacttcaccgcctgggttttcttttctctagggcacctttttcccccggtttgctgttcgttgcagctcactcagctgcattctggaaggagcatcattcctgtttttgctaatagctgtttcaaaacctcttagaccagtgttctaaaacctctgattatttttcactactgcaagaacataggagagctcatgcctctgtcctcactacgtgtactgtaaagcactacaagtctatttttcaggaacttgtttaagagctaaataggagctttaaaacacactagttctcatatctataatatttaaatgtttaaatatttaatatgtgaaagtagcataaaattatacttcctatttaaattagttttagagaaaattatttttaatgttttatttaaaaacagattatttctgttgtaggaaagaatggatgtcttgtttcatttaggttaagtttgtagagtatctattatgtgtgaggttctatactaaatgggagggaaagaaatgaataagatcttgtccaggcaccagggaactcacaatctactgagagaggtaggaggatgcccagtatacttagtcaagttgtagtaaatgttagagtagatactttttaaaaagctactggggtacaaaaacaaataattaattttgagtagggtcaatggagatcctagaggtagtataattagagttgggacttgaaattttaatagaatttctatagggaaagaaggaaggaaagacggcattctagctagagaataccatcagtaaaatgttaaaagaaaaacttgagacaaatcaaattttacagaattcatttgagcaaggaatcattcattaattggtcagcattcagaaccagcaggatttcagtgtgagcatcaacctttcatagtatgaacatgggaacaaagtagaaaagtcatctaattgtctacggatagtcatttatctcatttgggcgtggtgtgatgagacatttgccttgtctgggaataggctcatccattggctgcctacagttggctgaagtttcgctatttgtgattggctgaagctcagctgtttaaaatatacagttggcgtctcatctctgtgtaggcctctgcacccatggattcaaccagccatggacagaaaatatttgaaaaaaattaaaaatataatacgctgagcgtcgtgactcatgcctataatctcagcactttgggaggccaaggtgggaggatcatttggactcaggactttgagaccagcctgggcaacatagtgagaccccatctctgcaaaaagtacaaaaattaactgggtgtggtgatatgcacctggagtcccagttacttgagagactgaagtgggagggtcacgtgaacctgggaagttgaggctgcagtgagccgtgatcgtgctcctgcactccagccaggatggcagagtctcaaaagaaagaaatgtaaaaaatacagtataacaactatttacatagtatttacattaatagcagaaactgcaattccttttgcatcaacataatatttaggtattataactaatctagagatgatttaaagtatatagggggatgtgcatagcttctatatgaatactatgccattttatagcaggcatttgaatatttgcttttttttttttttttttttttttgagatagagtttcgctcttgttgcccaggctggagtgcaatggcgtgatctcagctcacctcaacctccacctcacgggttcaagtgattctcctgcctcagcctcctgagtagctgggattacaggcatgtgccatcacgcccgactaattttgtatttttagtagagacggggtttctccatgttggtcaggctggtctcgaactcccgacctcaggtgatccgccctcctcatcctcccaaagtgctgggattacaggcgtgtgccaccgcacccagccaaatatttgtatattttggtatctgcaagggctcctggaaccaatcctcagttgatactaagggatgactatactctttctttaggtttccatttgttaagttggaatgtaaagtttggagacagtcttgggccaatgatctgctgttcatttaatttattaataaggaggggtgaaatgcatactgccttgaaggcacgggcagtcagccttgggtcaggactctggaatgaagagactttgtggcgtaggtggcaaggaaacttcacgctgaagaattagggttttattctttaagcattagtgatttagtaatttggtgattagcccttgaataggctttttgtggacagataggtgatgggaatatatggataggtgatgggaatatatggataggtgatagatcattgattgtgagtaaatatcagtagactaggtaagatatgatgatatcctgactagtatgaattcttaatctgcatctctaaggtctattctagttcccaaatcttgtaccttcatgcttatgacatttacgttctactcacaagccataataatgtcatattacaaaatatgtttcaaaatactctctgaattcatgaaatatatatgttagaaacagctggagaatatcctgttagtagctttgaatatgtatcatatatgtaagtgttggaatttgtatatatgttctagttttgtttattattcaatttgatgatatttgggggcatagaatcatcaaggctagaatggtagtgtcactctcctttaaaaactatagtaattatagacaataatgatattatataagatttaaagtaatgatggttgatattaactaaatttgaaataataataaaatatgtagcttataactgctaattctaattagaatttctagggttctctagaggcttcaggaagaacaaagatagtgtgggtagaagttgtaagcaatttctttgcttttaatgttgcttggaggaaatacaagaaataaacataagagcttaataaaatttagcttctttaataatatatttctatagtgaaatttagctttaataataacagaaaattgaggtgttataaatatttgaaatgcatataaatgtcattttgcagtgcttgaaatattggacatagcttcaaccttatggtgtaactgagattgaagttgtgtgtatgtaaaagcactttttctttaggatcatattttaatgtgtgtttcttagtctaagaatcaactggctgcttctgaagacacccacccttgcttggttgctcaatacagtcttctatatttagtgaactaatgaaaagacaaaagagtggtaaagtgtaattcatctttgccttcataatatagaaattcttgcaattgacttgaaattaatgagatgtcagtctcagagtgcacagcccttgtaagatggtgctaacgtgtccagagagagttcgtgtcctaacaaataatttgtcatcttaatggcacaacatgcatccttctgtagtataagctttaatgtatatggtaacaaaccaggaaggcttaattctttcaggcagcaaactaaaaaccatacttaactatcttagtgtgtttgggctgctatcacaaaataccataaattgggtagcttataaacaacagaaatttatttctcacgcttctggagactaagaatccaagatcaaaatactggtatatttggtgtcttttgagggcctactttctggattatggagggtagcttctttctgtaacttcacatggtggaagtggtgagctgtctttctgaagtctttgttttaagggcactaatacaatcatgaaggctctgccctcgtgacataatcacttctcataggccccacctcctgataccatcaccttgtgtgtaggttggaacatatgaatttaagggggacataaaccttcagtccattgcaatacctgtacataatttcttttctttccctccctccctccttccctctctccctccctccctccctcccttccttccttcttttccactctgtaacccaggctggagtgcactggcatgattacaactcactgcggcctcgacctcccagggtcatgtgatcctccaacctcagcctccctggtagctgggactataagtgtgcaccacgatacctggctaattttttgtattttttgtagaaatagggtttcaccaggaggcggagcttgcagtgagccaagatcacgccgctgcactccagcctgggcgacagagcgagactccatctcaaagaaaaaaaaaaacaagaaataggatttcaccatgttgcccagggtgatctcaaacttctgggctcaagcaatccacctgcctcggcctcccaaagtgctaggaatacaggtgtaagccactgtgtccagcccataatttcatcattttaattatatctaaagttttttggatttctaaatataaataattgtttttgtatatcactttaccaaagtgttttttttttcattatggacattttaagtgtttcaacttatgatgacacacattaatttccagttgtcattttctagcattaatcacctattttatgtaaaagaaggaacaagggatgtttcagccagagatacatgacgttgtttaagtataagtcaccaattgtagagagaaagagagtatcttctgccttctaagcaaatagacttcaaaatagctccgtctttacatattgacaatatgtggtgagtgtactacttctattaatataataccatctctacaacatctagtaacagcaataatagtaataattataattaaaacaataataaatttattaaacattatatcccaagagcgattataattattttaaattcatatcataccaacctcataccaaccctaggtacttgtattgttgttttgtcggttaagaaactgagactctgggagattaagcaatattttgtttacatatctagtaagtggcaaaatggtgatttgagcccaagtttgttcttaatcttaatcacttctgtatgctgtaacaatgacttttaatggcttctatgcccttagtaatttgtgcattttgttgcactgttaactgatccctttttcatatggttaatcatatagttccacatatattgtattatcttgtgaaatatgtaatcctattatcctggcactaaagatagttcttcagagctcaaaccaaaactaggaagctgtacgttatccatggaaagaaataaggttctttctataatttagatttttttaggcattttctatgtagaatctgtcagtggtaaaacgttgccgtgacttgaagtctgtcttttctaataatgagggaaggaatgtggtcttcatgtcattaggcatttggtaatgatatattaatatagttgagatgcataaagtaatgaaatcaatttttcactttgactcttttgaaggtagcttcataacattacagacaccttgtgttattttaatatgacacttttagctatgagttaatgagactgcctttccccatttcagtgatttttgctgataaatatatagattaagcacaataacaagtgttctgttaatagcatttctaagtcatatagcttctcattcatatttggaatcattattctaagttaattagttttttttcttttttttttttaaacaaagtgttgctctgttgcccaggctggagtgcagtggcataatcttggctcagtgcaacctctgcctcccgggttcaagcagttctcctgcctcacccacccaagtagctgggattataggtgcacaccaccatgcctggctaatttttgtatttttagtagagacggcatttcgccatgttggccaggctggtctcaaattcctgacctcaggtaatccacccaccttagcctcccaaggtgctgggattacaggcgtgagccaccgcgcctggccagtagattagttttatattggcaaatagaaattatttacattgaaatccagtgggaaattgtaacattgctgtataaaactacaaagaggtgtgctttgttcttactggatattaatggcagttaaactagttccagagtatatcttgcatgatataagaagaataagagatttgtctgatttaagaaattaatttagagaggttcaaatctggtagcttttctgaagcattctatacaggtaatcttccatttagtcaattaatccttgttggtgagaaaaatttaatgcattcttttcaaaccgtatttcagtaatttgtgttcattactcagttttgcctaatttaaggatagccccatttatattattattattattatcattattacagtaatcactaatgttctttttagaacaatgcttatcatcttgtaaagtaggtgtgctgattgagcaagctaaattttgttattaggtgtctggcaaacacctaatgggagatgtcccaggaaattcaaaattataacagaaaaatatctcgtctattttaatgcatgcttctaggaatacagctgcacttgaaaacagattcacattttgtgtatgactattatgttgaaagaactttaactttttattttattgttgtgaataatattaattattaattattaataaatattaatattaattatggctgcataacccaatatccccaaatttagcaattaatagaacactcatttattttctcacagattcaggaatcttggcagatctcagctcagtcctctgtttcaaagttcctcacaaggctgcatagaagatgttgtcagggttgtggtcctgtgtgaaggcttgactggtgaatgatttgttcctaagctcattcatatgattggcaggattcagttcctccagagtgattggactgagggccttcattcttggatgtttgttgtccagaacccacccttggttccttgatcatggacctctcagtagggcagctcataaaagtccatttgcttcatcagagtgaaagccaaggagtgaagacaaagaatgaaagcaagtcattcataaggaagtcacagtcttttatagcctaatttcgtcattaataacatgtaactaggttcaacccttacacactgataggggaattactcaagggcatgactaccaggatgcaggaaacatttgggagtcatttaagaagctgcatactcacatggatatatacaatttgattttaacaaatgttatgatatctctttctttgatgacttcaacagaatcctaattggtctttctgccttctctcctgttttgtgataatcatggcattcccatgtttggaacatttcactgactacctcttcaggaggagattgaaactccttgtcatgtgtttcaaggttatttaccttttcactcccactaaaatgtacttagactgaactcctttgttcctggaacagagacacttaaaagacttggagacttctccctgaacacagtttaatttaaccaattcttcatttggcttgtatttagatgacacttccatcagaatgcagccttcacaatttactatcgtcttgactcattcacctccctcattagacactgagcttgcaggaaggaggaagcatttctgtttactattgttttctcgcatgtaccacagcttctggcaaatataagtatgtaacacacaaatgagttacagttatatatacttagtttcattgcactaagacaagtacaataaggtatgagtactaacccataattatttagtcacatagtaatgaaacaggaaattttcccagactccttcactggcggaaactggaatgagggcactggagctagccagctgttttggctggctgcaattgcttggatctgctgcactccacaccttgcaggagggggagcacagctgagttggtgcaggagccagggtgagtgcttctgagtgtcagcagaagcaaaactctggtgcgggccctgcagcagcatctagaggggagtacccacaacccccgaagccccagaaggagtgttacaggcaaagcgcttatagccatctgcagatggcttaagtgtttaacagctcagtggaccctgttccttttcacgagggcagagagtcagtgtaacagtcttctgtaacctgaactcttgtctggcatccaggaaaaatcagttcacacaattgaatttaaggatagtaaatgtaggggatgttattgccaatggaagtggctcttagccggaaggaaagctgggaaagggatggagcaggaaggtatttgtcccctgaagtccagctgtttccagctggactcttttctaaagtcctgccaatcaagccgtccctctgaagtcaagctgcttctctccaacgttcagctgcttcttctcatctccctttctctgctctcagccagtggaacctagggtttttatgggtacaggatggggggcagggtgggtcagagttggttttgggaaaagcaacactcaagtgggaaaacggggatgaaaagttttcactgtgggccatggttccaggcttgaaggtggagccctcgccagggaccctgcccttttctgcctagagcttatctgtctcctatccctatcagtaggaactcaccatctttagtaattcattcagtgtgtgtgtgtatatatctatgtatatgtatagaatatgaacctgtttcttgaaaaatccttctcattactcattaaataccagagatctatataattgagtctggctgtggcagtttgctaatgttaatttgtacacttatgttcccgtgatttagtaattcactccatttgggtgtttttaaaaaaatgtgtacatcaggccaggtgcagtggttcatgcctgtaatcccagcactttgggaggccagggtgggtggatcgcatgagaccatgagttcaagaccagcctgggcaacatggtgaaaccccatctctaccaaaaaaaaaaaaaaaaaaaaaaaaattggccaggcatggtggcatgcacctgtggtcccaactacttggtagactgaggtggaaaaatcacctgaacccagggaggttgaggctgcagtgagctgtgatcatgccactgcaatgtagccttgatgacagagtgaaccctatctcgggaaaaaaaaaaattgtatacataatcacatattttctttaaagttttcaaatgtgaaacttagatttttttttgtttcaaaagtggttgtggttgatttagtcaataaagttttaaaatgtatggttggcccacttaaataaacaactttagtgggctgacatatatgtccatttcttgatttgttgtttcattctaagtaaaatttttaatttctttttgtctgtttaaaaaataactgaaatacaataataatcaatagaataactatcaaaaggttttatgagaatgaagataaatatatatcacagattcaaaacaaactgacaatttctgtaattatatgttaatatttgttgtgccttcactatatgccaggtactttgtgaagttttgacatggattattacattcaattttgttttctaccctatacagtaggtactgttattgaaatcattttgcagatgagcaaagtggagcttgaaatcaagctcaagcagggtgattccgtagcctacatgctacattactttgctgtgtttacgacataaacaaagacttggaaattgaatgtattagcacaatcctgaatccacagcttgtgcttttaaacactactggatcactctgtagtataactgtgcctatggctctactatcaaaaatctcacttcaagatccctttatctgccccacaggacaagggtaagggtattaatacatgaatttgtaacctctgaagtaccttattcttgcctacccgattctacctagtttatgtagagtattaatacatttctattaattggacccagtaaaaatgtacccacaaaagacagaactgaatgactccatttgcccactaaatggtttacaacatattgaaacatgtctctcaatataacaccaatctagaaagagtgaaaatatattgaggttactaaccaccctagattaagttttccattgtgtgcctggtctgcctttgttttatccatggccacatattaatactattctgatttccccctgcttcctggcactgtttcctcttgttctttgtcatctgttgatactggcttaaggatcattggatggctgttaattaaattaattttgtaggagtctaagcaaaatatgtgatgcattcaaatggcaagtacaactactgtgaattaacaatagttcctccgttagaatggcttactgagagctgactgtgcctggcttcatgtgataagaataaactgataacttgcttctggcaatgtgttaggaatgtgttgtttcctagcatgtaattgcttttaatagtaggtaacaaaaagtaactactctgtgacatgtgatgctattaggatatttgtaattttctttgaaaagagaagctggtgtgattaggtaccttttgttctgctaacagcagtgataaagatgctatcactcctctcataggttttacttactatttgctcttgcagaatcagatcacatccctattaattattggcattttggttctattttacatgcttttgttttctgaatgctgacaatttaagcattttaatgattgactgcattagcaaatattaatatagctgcatgatagatcagcatatggttctgaaatctttgtaatatagtgtatagacattcatttttaacattttcgtaatccatttccgggcataaactgaacacatacacagactcatcagaaatttcttagatttgaggcagggttttgggacacaagcgatttttaaatacttcagactgcggcaaaatttagctaagggattccttgttttttagcagttcctgagaagacttgcaatcagccatattttggggggagtgcgggttcacttatattctatgaaagcaatgggattttttttctttagtgttttctacttgaaggttttttggtctgctaatgttgtctattatctttatgtaatgatgatgccaccccctctaattagtagagcataatactgttttgatttttagtaataatgtttttttaactgatcatatcatccatatttgcttaatatttcctgtaactagtgacactttttttatgatgacaaggggctgggatagagtttgtggccatggtgcaaaacaaagctgactgactcagtaagcattgaattcatgaccttagtgttatcagcatagtgctctaaccaacttaaacaattggccacaggtaaataatatgtgatgacaaaaatagctaaagttttcagccattttaagctgataatatttgctttctgcagtagcagtgcctgaggcagcttcatattatagctctcttaaattgtttaataatgaagacttttgaacatgctttttaaatttagtgcctacctatatcacaatataacaatatataattgatcttatatttttttcaaaaggcaagtcaataagttgttgattttgttatttttagggacacaactaaatatattttaactaaggtttattgagagagagagagaattacttgtacaaagtcttttctgcattgtatcaatattatggtgtcatttgcattttgttccagtgatagtctccatttcctccaaccctcagagacattaaggcaattatttattgtaatcaactctttccaatttaataacgtttttgaaaataccattatcactttccttggtgggcagtttatatttgtgcctcagtgtttatatattgcataatatttccctgaaaattattaccaagaactaagtttaattaattaggatggaccctagttagaatctaataaagtagtggtcttaagagtttgttctggtttttatgaattttgcaaatggttataaatgggtaatctctttttataatttagtatttatgtggtatatgtagcttctttcagttatctgttttaatagaggggaacaaatgtacagaactttgaaggtatatgtggaagggaaaggtaattaaatgtttttatggtaatattatttttgtattttagtatctttagctcagatctatttatgttcccctagactaggagtaagaagcaaaaggagtagtgagaacaatcaacctctggtcagatatttagggattgtttagagatcttttcaaagatcatctgtaccttttggcagcaaagcaaaaaatgggctctaggcctttgggaaatttgctatgtaggtccattcttaggccgtaagtttcctctgggccatatgttaaagaaaacccagttatctcgtattgaattcctttacggtcaaaagaattactagggacttatgctattgggggtgtaattttaagttgtgaaactctttttgttgattgtctgaattcattatctccattatttgtctcttgcagcaacagtgatattgctggtcagggtccaatgtctcaggattaatatggttagaattgcaacaaatatatataaaatgaattaattcataagctgtgctagatttgttttggtctgtggtcattctgttgactggttgttgagggttctgcacgttccttagccgctgggcaatggccaaccagaaatatacatgtgagctggaaattcagctgtttatttaaacaggagcacagatagcatagacagaaaggagttgattcatatggtatttgttatatactgtacattcttctgaacattttatatatattaacccatttaattaattctcatggaagaaaacctgtacgacaatgttgttatcttcaattatataggggagataactgggtcatggggagattaagtgacttagctaaaggttacaagcgtaacagataagaaagctgagttcccactcagtgctcttaattagtatacaaactgccagcttccaaattcatttacacgatgtcagttgtataactggcagtctagattccttttatatatttatgaagtatataccatattgtagaactgtagtcttatttcactggccttatacatgccctgacgggtctaaagcttatctgagtaccaggatgggtgtgacagcagggaagagaatttgtctggatcagtgatataagctccagtagagtttctagattatccacatttctgtctctctgagttgcttctgagtctgagtagtattactcattcttggcatctaagggttctttttgtagaatcaagtcttgaagatgacatttgcaattttggaaggacatgagaaaccctaacagaagttgctgctgctgttttaacccctccaattttgtgtttgtaccaaacacaaacattttttcagtctttcctattgatacggctatataaacagatatattccttatatactgttatataaggaatgattcagaattcctttataagcaattgctatgttttgcaagtttatttcactatcatgtaaaaggccgaggattctaaaccaatattactgtctttcttttgatatgtgtattgatcattattccctaccatctacccttactgaaaggaggggccatatgggattagattgtcagtaatgtttttatatcttccttgaggcctctagttcatatgactcttagaaatgctgtaacctaagtacctaaattatattatcatgcctgttatgtaaatattaatgctttcctaatagtctttgaagtgtggggttttgagttccaaggtcattttcaaacatctcctaagaggtgactgttagcaggggcaggcatgacagcatgcttctttgactgaaaggaatcgatatgtcaacttatcaaaatatgttttttttaatgctgtttcaaacagattgcttttaaaaggtcttgaaaaaatataaaccaattaaaagttgtggaaagcttaattttataataatttttgtcaaattcgttattaaattgaaatcatactgtgtcacttttattttttgcatgaaaaacacctacttatttataagaatcattttatttaatgcctatcatactggctcactaaacgtttggtgttcataggctttcttttctaattttttgcactttccagttttgaattagagtcagggattatatgaaatattttaaatttgagtaatcaaaaaggaggttatataaaaggactttgatgcatggaaatattaacaatgtgcatgtatattaattgttgaacattatgagtaattaaacctatcaatagttacttaaaatttgtttgattttaatatttctgaacaaactttagcctgaccactgccattgaggaagttgactttaggaccaaccaactttccatgtaggaagtaacagagttaccaggacattagagtttgtgacatgactgtttatagaatgtcaatattttacttatcacattgaaattcatcactgatatctttgtagaggaaatgaaaatatgccctgctttattattcatatttacataacagaaatacaagatttaaggcataaatgtgttaataatgccttgactcttaaggacatgtaccctgaaattaataggactaaagcaacctctttcccttaccatgtagagattgacaattggggcacatgaaatattagacatctctttgccagtcaaaatacacaatactttgatgtactgataacttttaatgaaggcaccagctatgcgttaaataaaccattcaatagacttaatactaaccaatgttcagaatttgctggttgtggaaaatacatttttctagaggtatttaatgctaatctcctttactaagcagtgattaaagattttttgagaccaaattttaatcaaagataaaattttttttacaaccctttcaggtaatatcataagcctaaattcagtgtaactgaactttagaaaatagtccttttgcctatttctttcagaaatacacacctcccttctctcaccagacccagacacctgcataatcaacatagggataaatttactttgtttcacaaatcttatatcaattgatgtttgggtattaggagctacatttctgtgtataggtgttaataagaaatgatggcctacatagagactaatttgctgtagaaatgagataacagcattattctagcaattcttccaagcggccattgaggctgtcctcctcatcttatttgctcattcaacaaatatgtattgaatttctatcatatgccatacactactagtttttacagaatggttattactccattagacctatgacccatggaatgagtaactctgaattctctgtggtagaaatggattttgtttatcttgttttgccatgctagtatctctttctttctgtattttaggccctgcttgcttacttagactcaagataactatttcttcctcctcctttcaggaatctcctaggatccaaattttgttttgttgttatttagagatgcttaaactgatgtgtattaactgaatcattgtgtactatgatacacagtgttttccaaagcccttctgcttattgtcttatttctagcctgtttttatctgagtcctctcattgctttgtaaactcaaatatcaatatgatcaaaaagatccagtcaactttggggtcactgtatcttgaagtttagaaatgggaatagagaagacaacagttgagtatccaataagagaaaaaccaagatagtgataaaaagtattcagagtagtggaatatgcttgccacctcagtaggcatttggtttatagaattactaattaattttttgttggagaaaactgcttatattttcttggaaatgtattttttattttcaagaagtatgtagcaaacagtctttccagaaagtatgggttccttaataatgttcagtaaattcattattctatacattcttatatttagaaatatatatatatattgaggatctgctctgtgccagatgctagtctaggccttgggggatatagctgtgattaaggcgatgtgatcttgactgttttagaacttaaagtctaacagtaaaaatataataataaacatgtaattatattactgtgagtttcagatagtattggtgctctaaagaagataaaatacagtaatatgatgggaaagtacttaggtgggggcttaagtgtgatggttatggaaaataactttaaaagcatatgagttgggaaatttgaaaaacataccctcagaagcagaatccagcaggacttgttgacggattggatgcagtactttttttttttaaagcaaagaatcaagatctcttttagatttggggcttgagctgaacatagtactgtccaataagtatcttattgtagccactgaatcagaaaaggctgaagaggatagtgttgacagaaaaagtggtcagaggattaaaacaatgtgatcatctagaaaaaccatctgtggatgtactataccaacattttcaaaggtaagaaatacagtgaagctcgaattagtttagtgttggtacatggaaataaattgtatggctttatcattaacctttgcttcaactctagggatttgtgctttgtttgattggactgtagagacaatctttacttttctgtctatgtttaactatttagtcaaatgaatattgcacctctaagtgtttcttttgatttactgtaggctgaggtcatactgtgtactaggcgtgaattaattacaaattgaacaactttgctctagtgaagagagaattttattctcattccaactaaatctatgatccaagaaagatctttatattctttgtgtgtccgagggggactgaaagtatactcataaaaacctgttctgattttaaaaaaagaagaaatgaccttcatttcttttggatcttctactaaatggctttaaagcatcacatcacaaagtcctcttccccatagaaataatattctctatccaggaaattttaaaaggtttgcattatcttgttcttgtggttgatagtaaatttagcatttattaattattgacaaactgccaaaatggatcatacatatgttacaaaaaatcttttgtataaatttcaaagtattcttaatgtggctttattgttatttatgatagatcactaaggtctctctcacttatttcttcgtgctccattcttaagcagccatttctctaggaacttagtcctacagaatgagtggaattggtaaagtaattgtgatcgttgatgatttcctcatctttttaatccagaaaagttagcaacaaacctgaattcttagtgggttgtctgagctttgcaactttatccaggaccatggaagaatattccaactgtactattttactgtatttcagtttggcagagaggtattttagcaccattataataacctcatttatgaaagtgttggagaattgcattctataagataatgtagcttctctgtatgataatgttttcacacagtgtattagtgcatgtggaagtatattggaattgagatttgctaacctgcatctaagatagcttagtttatttgattagtgaactccaaataaattattttggagggcccctgggaagtatataagaaatttaaaaaccaactccttcagaccactagtttcccttctgtttatgatgtttatcacttcacatttttaattagtaaagtataaaatgaatcatacaattatagtagtggagttttttgtcttctagaagtgacatcgtaatagttattttaaaacatgtagagagtcatgcatatgtatgtggaagggtaatcaacattgttttaatgtcttatgctaagttgcacatacaaacacatcttttaatttatggaagttacttacatttctacataaaatctcagctgtttgtacatgtcccagactatactggattctggtttgctcagttattccttccttattctgagagtttagcaaagggaaaatgtcaacctcaccctagagaaagtagagagctaagcagtagaaaaagctatttgtgccaggcttggaagaccccagtctttccatttctgcctttcaaagaagctctttctaggggcatagtactaaagattgagccagggcttttgttctggttattcattgcacaagggtgccttgctgatggtttgattaggggctgaaatttgacacgggttctacttgtcaagctgtgtagccacaggcctatttccaactagagtgcgcatttccgattttcacaacagtatcatatagtctggagacagcccaggcaggccatagtatagacagccactgcacctggctcttattcttcatagctccctcaaagtgttttctgcaatacttcctgctctgtgctcctctaccctgttttttaaatttttttttcgaaaaagttttgtttgttttttattgatacgtaatagttacgcatattttgggggctacatctgatactttgatacctgtatacagtatatagtgatcaaataaaggtaattgggatctttctttttcttctgagccttttctttgctgagaggaagctaataccactaagggtgcttaattatttatctttgttggaataaggtaaatgttaccttgaagagttatatttgctatcattatcaatatcactggagtctggaatatatcttagtactttctctcttttctcagtaaccccttccttcaaaatgcagcatcttaaatggtagtttgtgtactttctgacttctcagtgaatgatgtaattttgttcattaaaaaaaaattcaatttaaataaacttgcaggtggaaggtggaaaataaatcatgataatggctcacacatagcatttactctgtgctaagcattgttgtaattgtcttacatgcatcaactcattttatcttctcaataatcctttgaggttacttattattagtccctctttttttttttttgagatgaagtttcgctcttgttacccaggctggagtgcaatggcacgatctcagctcactgcaacctctgcctcccaggttcaagtgattctcctgcctcagcctcccaagtagctgggattacagatgcacgccaacatgtctcgctaaatttttttgtattttttgtagagaaggggtttctctatgttggccaggctggtctcaaactcctgacctcaggtgatccacctgcctcgccctcccaaagtgctgggattacaggcatgagccaccgtgcctggcctattagtcccattttatacctgaggaaaataaggcaaagagaaattacataacttgcccaagataacacagataataaatggggacatagtgattgaaaccaaggtatcctgttttatggtgttttttttttttttttttactatgttataatttatgaatttgctaattgcttcaatattattttctctttaacttttcatcaagctttacagtaaatcattgcttatttgttttcctgctattcattgaggataaagtagcatcacatcagtagctttaagaggtttgccgtttaatctgtattgcttttagaggttagcacgttataaaagccccatttccataatggatgactggaaaaaccaggttgctgtatatatgtgaacacatatataactaacagtttgttttctctgtctctaagcttgtggggtggtataaacaaacttcagtgtactttaagtgcagttactgtgcttcaactcataagcatttctttagaaagaacatatactctgaaatatctagcatgcattgatgaagtaatcaaaatcttgatctctaatatcttttcaaagggtttccttcactgtctctttcccctggaatatattatgcatctctaggtggtcaaacacattgagacccataccctgactaaattttcataatccctggggttcacaattgttatttaaagttcatagatgtatacttcacaagtataggggaatatccttgatatgcatactgctagaccactctctagcctgaaatgttaatatgatgattatagaggagttggatccatttagaactattaggaagattattgacagtaatattttgactggttagttggcattaaacctcaatagaactgtgaaaaggtgattgggcaaagggcagtgataaaaccaagataatgaaagcacataacaaaagaagatttaccctttgtctttttaacacaagccatgttatttgtcatagtccctttaatactttagtacttgctcctaattaaaagtatttctggaaagagatctggaacagagctttcctgacaaaaatcagataatggatgatgttttgtaatactgagcatattatatctcataccaacatatttctttctcttttaagccacaggcatgatatggaatgacctgcccattctctccctgctacttccccaaatagttttcctattccttttatttaaggtattattccgatgtttgtgttagcaggcaatgtgcctttgctttgcattttgtatatccaattaatccatgtgtgatgatcacaactgattacagctcagggaataagatggggtgatgatatgactaatgcatacaggtagaattaacaagagacttttctagaaggtgttcaaagggcagaataaagagactatctttaagtggggaatcagtaaagaagtctacaaacttgcttctagctgaaaagatggtgtaagtgtcaattctgttgtgttctctctctcccaaaagacctggtgggatacaaacaagttacaatgacttcattctagagaaaacatggaatccactttgttttgttaaaaagttcttgaatcaaaaatttcaacaaagtatttacaaaaataatattctgtgtcttactttaaaactgatgatatcaatatcacaccagtgtgacaagacactctgattgtggtccactggagaatgttccatgttaatccagaggaagaattacttcttgtcataggattattggtgaagaaggccagtagaccaatatcttgactttttgggagagagttttataccttaggccctcttggcagctagagatactaagatgaataagatatggtttgcatcctcgaagaggtccttattttcaaaagagaggatgtgtattagttcgttctcacactgctataaagacatatgtgagactgtcatttataaagaaaagaggtttaatcggcttatggttctgtgggctgtacaggcttctgctttggggaaggcctcaggaaacttataatcatggcagaaggcacagtggaagcaagcatatcttgacatggctggcaggaaagagtgaagggggaagtgctacacactttcaaacaaccagatctcgtgagaactcactatcatgagaatagcaagggagaaatctgcccccatgatgcagtcacctcccaccagctccctcccccaacactggggattacaatttaaaatgagatttgggtggggactcagaacgtaactatatcaggcagatatataaagtaattgctatactacaatgtggtaacttctataaagaggcatggaggaataatattattaaagaataattaaagatgaattgagatgtttgcagagaaaaataatatttgaactgggatttcagggctatgtagatttttatttccaaaaaacagaagggtcttcagggcagaagaaactacatggacaagggtatgataaagtgtcacatcatggggagtaaggcatggaatgtttggttggagaatgtggtatgaaggacaggagggaggtacattggagacaactggtaaaggatctttttactgtaacctatgggtaaccttaaatgtatttttaatcagggttttgtgatggtatgatcaaattgcattttagaatgattgcttttggtaggaaagtttaggattgatgggagaaaattaggagttttttaaacaagtctcaattggacactgtaatgacttgaactaaagcagtagaagtgaggatgtaaagggggagctaaatatttagaaagtgaacttaacagttaattagtgacatattaaacttggggaagtgagagacaaaggggaagcagaagtctaatatgattcccacgtgtcttgctcatgcagcaagttggatgacagtgctacttactgcgatgaggatgaatgggaaaaacaaaagttaagcttcagacataatacatttgagaaataagatagttaagtggctataggctactgtcttgtaggcagtcatgtgtagaaagtttgtagctcagaagaatatatggctttgagggagaggttgggagtccatccacgtatgtatggaatttaaaaccatgagaatgtataaaattactgtattagtccattctcacattggtataaggaaatacatgagacagggtaatttataaaggaaagaggtttaattgactcacagttcagcatggctggggaggcctcaggaaacttacaatcatggcagaaggtgaaggggaagcaaggcaccttcttcacaaggcagcaggaaggagaagtgccaaaagaagcaggaagagccccttataaaactattcagatgtcatgagaactcactcactgtcatgagaacagcatgggtgaaactgcccccatgattcaattacctctacttggtctctcagttgacacgtggggattatggggattacaattcaagatgagattttggtgaggatacaaagcctaaccatatcaattacctgaagaagaactgtagaaagagaaaaataaagagggcccaggattaattgctgaatgctaacatttgaagggccaatgggaggaagagcagccagcaaagaaaatgccaacaaagaagtggcaaaatgaagaacaatatgatataataaatgccgggagaagaaactgtttcaggaagaaaggagggactagtttcgtcgtgtagattattgcttaaagtcagataaaggcagcaaatatattttaggtttggcagtatcaagaatgttattgatcttaatgcattattttctaacacttagtgtagatggaagccagattggaattctttggagtttaggaccattggaggtatctgttgatgtcagtcattgagataatacaggaggaatgtaacgtttgttaagagaaagaaagaatgaattgttaaatcctattgaatatgataagcagctggagatgttcagcaactagcaaagcatatgatctggaactcacagaccagtctgggctgaggctaaggattttgaaggtattcagtagttgaagcctcactgggtattctcagccacatttcaaaataaaattgggtccaatttattatggaaaattggcaaattttattaatatataataccttacagcagtacacacatcacagtttacaaaggagacagttgacaaatgaatgaaatgtgttagtttagccctctctaaagattaattatttgaatacactctaatattggttaaggcagttaatacctgaagagtatattttctttttttttttctcagttaagtggctgtaggctactgtcttataggcagtaatgtgtagaagattgtagctcagaagaatatatgaagagtatattttctgagtctgggatcctagttaatattaaaaaaatgtgacatcaggcattcatataaaatccaaacctaatcaaagcagatagtcctatttaaataactaggcttgaaaaaaagaaagggttaacaactcaaatcttgaatttgtttccattgtatttacaccctagatttctatgaagtgccacattacattatatgcttatttatctctactcttcacctagagataaaatacagtcagacaaatagctgagaatctgaaattcaaagcagttcttttgaaagttaattctccagtaagtttctccagtaagtttcatcctcagattgcttcattcacaatggagtataatggttggttggaaatgtggaaatgaccatttttgatttaaattacttttgtcacacagtttttgatactagcaaagaaaacattgaatatgattgacctagttaattttaatttcatacaattcataaaagttatgttagtaattttacagagtaaaacctttatccatttatgcttctgaaaaatgaccttgtaaaatgtcagaattgccatggtatgcttttgaaaaatacttaatgatttgtgcttgatgcatttaaactctttattgaaggtcaaggattctattagggcatttttgtcagtaaaatgttgacagaaatgaactaggtagttgaattctcactgacaatactgtcacaattgttaagaaattgtctaatgataaggccagattttgctcattatttttcttagtaactaccactagttcattaaatattgccttaattagagtgtgtgttaagtgtcaaaacttaatggtcacagtcacaatccttatttaatagatacttagtttgaattgctatagttatattattctcaatgactgtgtatatatgccatgcatttggatgagatggaattgtgtgggtattccaaaagcactgatgattatgttgatttcagtgtatttttgatattcgatattgagcttagatacccacagtttgatctgtgaaatcacattccaaactagtaaagccacaaaataaaagcaatgaagtaaagctgggatatattcttattttcttatttataactctttcctatcacctaatcagtgcagtatattttgcgaacagtcagatttgttgccacctaaaataagagttgcagttgtttcatggtgatagtttttctcacctctgacctcgttaaggagatggttataaacacaattgttttaaaggcctaataagacatgtgaatatagtgtaaaaaaaatcttgggattatctcttttatttatgtcagtgattacttgaatggaaaattcctaggttagtctgtacaaagatcacattcctctgtgtatttttgttatctatacttagaggtgcacatatttatgttctgttgatatagcatattgagaaatgtttttaaatgtatgcatcctagagatgctatcgttgtagtatctaggagttgtataagtatggtgaaattagccctcagaatttttttgcctcagtgtgtaagataagcttggatggtatgtacagcatcattcccccatacatcgtgctccgtggtaaaaatgaccttttaacttaggtttttgaatcacatttagcaaattgatgcatatcctatgactccttgggtttttgccaagatttttcattgtagtattcaattctgttaaactttgtatggcatacaagagtcatgcgacttctggttactaatgattatagatatgtctcagtctcaaagctctgaatacaactgttcttcatcttatgagattttgtgagtttcataggtcttatggaagaccttaagtcgtcattgccctttctctaggcaggactgtattcatacctccatctcagtaatcatcttcattttgttaagaatcttcaatgtcttgtgtactttgttggattttctcatttcatcagatgattgtgatcacgatcattttgattatattaaatgtcacacttttaatattccttatttgaaaagatatttcagtggatagcataaacattaaaggtgaggtggtgaatttagtgcaaaatgtgtaaggtaggcaaccagctatcatttgtataattcatgcttttgttacaaatgccattgtccactaatgctgactttttatcagcttaaattgtgggaggctatattcgtagttaattgacagaattttatagaggcagcaaatgctttttatttaaaggacatccttagcttctatatcctgtgatataactcgtgtattttgccagtcagtagaagtagtaatgcactgaagaaatgtatatattgtacctcaataaaaatagtaattaatatttacctttaacttctgtggcattttttaggatatattaataaactccatgtcacttatcacaaaataaggagaaaaaatacctaaaatctatttcatattttctgtcatagtttactgagcagatttttgaattggggggagaaatgacagttgtattagaacaaactcaatttaatgatccctctatttttctttctataagaaaaaaaatgataatgctcagtttatggaggacacattaatcatttttagtttgaaaaactggattcttttcatattattaaaactttttgatgttgattgaagccaaatacgttttttaattgtctttgatgatcaaaatgagggattcatgtacctgcatttctctgccaaacgtagccctttactatagaatatatattagtgaacttcacttgctttatttgttctttatgctgatctgcaggaggtcattataaaatgtgaaccaaagacccactagcaaatagcgctgggttagagaagcaggattagagatgcaggctctggagccagactcgttgggttcaaaactcacttaaaccacttcgtaactggtctgatcttgggtatgatgtcatatctcagtctcttcatctataaaatggggataataatagtatgtaccctttaggattattgacaattgagttaataattgtaaaatgtttaaaatggtacctgctgcatattacagatggtattcgttgtaatcgtttttatcactgtcaataatgtccacttattatagcagcagatatttttgaatccagggatgtagtcaattctttgtcatctgtcttcagggactgtgacctacacctttgacaattttgacagtattactacctgctcagcttccctatagtgtctgtgagctggctagcaatttagtacactgatcttatttggtagatgaggaaactgtgggccagtaataaatttacttatggttataaagctggtaattaagagtctaatttcgattggctgggcacggtggctcacacctgtaatcccagcactttgggaggccgaggtgggcatatcatgaggtcaggagatcgagaccacggtgaaaccccatctctactaaaaatacaaaaaattagcctggcgtggtggcgggcgctggtagtccagctactcgggaggctgaggcaggagaatggcgtgatcccgggaggcggagcttgcagtgagctgaatttgcaccactgcactccagcctgggtgaaagagtgagactgtctcaaaaaaaaaaaaaaaaaaaaaagagtctaatttcgaatatagctcttctgatgacttgtgtggtagtacttgtacttcatggcttaagtgtgtctatgtatttttctttcatttttgaataatgagttccttcagggtaagaaccatgaagtaaatgtacaaaatgttggtacatgtatccattgtttttggttttccagggggctaaaattaacactgaaatgcaattgatatagtttggctgtgttcccacccaaatctcatcttgaaatgtagctcccataatctccatgtgttgtgggagggacctggtgggaggtaattgaatcatagaggtggtttttttcccatgctgttctcatgatagtgaataagtctcacaagaactgacgcttttataaagagcagttcccatgcacatgcactcttgcttgctgccgtgtaagacatgcctttgctcctcttttgccttccaccatgattgtgaggcctccccagccatgtggaactgtgagtccattaaatttctttttctttataaattagccagtcttgggtatttcttcatagcagcatgaaaatggactgatacaacaatttatggaattatctttctattgatatctgttatgaaactatgtatttatacacctaaaatgtgataaaagtcacactcgagaatggaagagaatagggttaatgacaaacaaaagaaaaagacgcaggcattggctttaaccactgtgagtacaagacataggctaaaaaagaaatcagtgataggaatacattatttcccaattgtccactttcaaagtaaaggcctggcaattgtggaattgaaatttcttttatcttcagtaaacagagatggctaaaattttcacgactcatttaatcccgcagcttttagctaaatagtgttcattcatctctcttgattcttaatttagtgattcagatttccataaacatgagtttctgtaaaacatttataatatttgcccatgtgccagtagtcctagctactcaagaggttgagatgggttgatcgcttgagccctggagttcaaaaccagcctgagcaacatagcaagatgccacccccacatacaaatgaatacacacacacacacacacacacacacacacacgtatgtctactttgagttttgtaaaattatatttcctttaaatgaaaaatgtagcactagtgattatgaaaacaaaaattagtattttcccaaagattaatctgccattgttatccatcagttcaccatctaagccccattgctctcaaattcaatgttcagtgtgtttgaactgtacccttgcttcaaccaggccaatttgttttttctcacttatccacactgtcacactgtcagcccatgtgcctgtcacataccacttccccaaataaaatttctgatacatttgactcaactaatcactgaacttactcctttacagtctcctttatttcttctaattattcctgataccagctttgagaatactgaagagagttaactatgcctgagtggagcctttcattttcttaatatgcattccattaacatgagcattttgttcctaaatgcccttgagttacttttaaatgttccctttggtgtcctcaacctgtttctagctttttgaaggtaagaaacaggtcatctgtttgttttgttcccttcacaacaccagtgggtgttttgttcaagctatttcctgactaacttcctcagtggggaaatgttcagggtatgcaaatttattttcaattaacttacataatacaaaactgggtaaatacaggagttgaggtgatttatgattgctttaaaacacaaagccagtccaggtgcggtggctcacgcctgtaatcccagcactttgggaggccaaggcgggtagatcacgaggtcaggagttcaagaccagcctgaccaacatagtgaaaccctgtctctactaaaaatgcaaaaaaaattagccaggcgtggtagcaagcgcctgtaatcccagctactcgggtggctgaggcaggagaatcgattgaacctgggaggcggaggttgcagcgagcctagatcacgccactgcactccagcccgggcaacaatgtgagactccacctcaaaaacaaaacaaaacaaaacaaaacaataaaacacaaagccaagtgtatttattattagtatggagtgtatcagtgttgaattctctctgtatctttttttatttttttatttttaactctaatggaagaagatcctagaaactttaaggattgtagattatatctgtagccttgattttttttccactttgcttgacaaaggtaatcctatttagcaatgtatttaagtgcctctgcatttgaaagaatgttgatttttccaaatagggtacgatattttatgaaagttttttttcttgaaaacagaatgagcatcccaagatcagacagagaagtaatatatagatataattagcttttctgtttaaaaaaaaaggtgatggacaaatactgtcttgataattcaagtcaataatccacaaatgtatattagtctcagtggctgagagtctgtgagtctgttgtcactcagtaggtcaaatctaatccgtgtatctatagtctcttaaatactcatttgcacattggattaactgtgtgtatttaagcattacatgtttttatatagctaagcttgagtatattattaaaagttttatccctttactttgcaatgaaaagaagtgataatttgtaatgaatatatatatatatacatatatatgtttgcatcagtgtcatgtggcccatccctatatagagtggaacacgtatgatcaaactatctgagtgcaaagcctcaatttcatttactgttgtgacaactaatgtttaatgttagcaaagcaacagataaaattcacattttactaaagcaagaccatattgattcatagaagactttagttgttaattcttaggtcaagatctaagtatgtttcccttttccttattatttttacttgctgtatcagactgaccacttctcagtatattattagttatgagatagaaaaatgaattatgttctaagttttcttaacatttctaattctttttaatttttattttcgtgggtccatagtaggtataagtatttataaagtacattaaatattttgatacaggcataccatgtgtaataatgacatcagggtaaatgtgatatgcaacacctcaagtatgtattcttttctttttgttatacacaatctaattataatcttttagttattttaaagtgtaaaataaattattgttgactatactcaccctcttgtgctatcaaatactagatcttacttatttcatctaactatacttttgtacccattaactatgccttctcactagacacctacctttcctagcctctgctaaccatcgttctactatctatctccatgacttcaattgtttgaatttttggctctcatgaataagtgagaatatgtgaagtttctctttctgtgcctggcttatttcgctccacataatgatcaccagttccattcatgttgttgcaactgacaggatcacattcttttttttttttactggctgaatagtactccatcatgtatatttaccacattttctttatttattcttctgttgatggacagtttgttttgttccaaatcttagctattgtaaacagtgctgcaacaaacataggagtgcagatatctctttgatatactgatttcttttcttttgggcatatacccagcagtgagattgctggatcatatggtagctcaatttttagttttttaggaaccttcaaactgttctccatagaggttgtactaatttactttcccaccaacaacaatatacaaggcttccttttaatccacatcctctccagcatttgttattgcctgtctttcagatgaaagccattttggctggggtatgataatatctgattatagttttgattggcatttctccgatgatcaatgatattgagcaccttttcatatccctgtttgctatttgtatgtcttcttttgagaaacgtctatccagattttttgcccattgtttgattggattattagattttttcctattgaaatgtttgagttccttatatattctggttattaatctcttgtcaggtgggcatttcacagatatttcctgccatcctgtgggatgctctttactttgctgattgtttcatttgccttgcagaaggtttttaacttgatgtgatccttttcgtccatttttgccttagttgcctgtgcttttaggatattactcaagaaatctttgcctagtccagtgtcctagacagttttcccaattttttcttgtagtagtttcatagtttgaggtcttataatctattttgatttttatatatagtgagagataggggctagtttcattcttccacatatagatatccagttttccaaataccatttattgaagacattgtcctttcccccaatgtatgttcttggcatctttgtcaaaaatgagttcactgtagatgcatggatttctttccaggttctctattctgttccatttttctgtgtgcctgtttttatgccagtaccatggtgttttggttactatagatctgtagtataatttgaagtcaggtaatatgattcttccagttttgttctttttactcaggatggttttggctattctcagtcttttgtggttccataaaagttgtaggatttttttcttggtaggttgtatgtgtctatatttgtgaagaatgtcactggaattttgatagggatcacattgaatttgtagattgctttgggtagcataggcattttaacaatattgaatcttccaatccatcaacatggaatatattttaaattttttttggtgtcctcttcagtttccttcatcgatcttttagagttttcatggtagagatctttcagttcattggttaattcctagatattttattttatttgtagctgttgtaaatgggactactttcttgacttatttttcagatttttcgccattggcatatagaaatgcctctgatttttgtctgttgattttgtgtcctgcaactttactgaacttgtcagctcttatagttttttgattgagtcattaggtttttccaaatataaaattatattaactgcaaatgaggctaatttgacttcttcctttccaatttggaggtcctttatttctttctgttatttaattgctctagctagggcttccagtattatgttgaataacagtggtgaaagcgggcatcctagttgtgttacagatcttagaggagaagctcttagtttttccccattttcagtatgatgctagctgttggtctgtcatataatagctcttattgtgttgaagtatgttccttctgtctctagttttttgtgggtttttatcatgaagggatgttgaattttatcaaatgcctattcagcatcaattgaaataataaggcttttatcctttattctgttgatatgttacatcacattgatttgcacatgttgaaccatccttgcatccccaggatgaatcccacttggtcgtggtgaatgatttttctaatgtattgttgaattcggtttgctgttattttgctgaggatttttgcatcaatattcatcagacatattgcctgtagttttcttttttaatgtgtcctagtctagttttggtaatattggccttatagaatgaatttggaagtattccctcctcctctattttttttttttttgaatattttgagtatgattggtatgaattcttctttaaatgtttggtagaatttagcagtgaaaccgtctctcggatttctttactaggagacgttttattttggcttcagtctcattacttgtttattggtctgttcaggttttggatttcttcatgattcaatcttggtaggttgtatgtgtctaggaattttattttatttttttggggacggagtctcacttctgttgcccaggctggagtgcagtggcgtgatctcggctcactgcaagctccgcctcccgggttcacgccattctcctgcctcagcctcctgagtagctgggactacaggcacctgccaccttgcccggctaattttttgtatttttggtagagatggggtttcaccgtgttagcaaggatggtctcgatctcctgaccttgtgatccacctacctcagcctcccaaagtgctgggattacaggcgtgagccaccacacccaatcactgattttagtggtttgatcttgctttcctagttcattaaaatgccttgttatttatttgaagtttttcttttttttttttttttttttgatgtaggaggttatagctctaaacttctttgtagtactgcttttgttgtatcccatcagttttggtatgatgtgttttcattttcatttgtttcagcaaatttttaaattttcttcttaatctctgtattaaccaactggtcattcaggagcatattgttcaatttccatgtttttgtatagtttccaaaattccctttgttattgatttctagttttattccattatggtcaaacattcaagtttttttaacgttttaagacgtgttttgtggtatgtccttgagaatgatccatatgctgaggaagaaaatgtgtattctgtggtccttgcatgaaatgctctgtaaatatctattagatccatttggtctatggtgcagattaaatctgatgtttctttgttggttttctgtctggaagatctgtccagtgctgaaagtggagtgttgaagtctctagctattattgcatagggttctatctttgtctttagctctaataatgtctgtttcacaaatctgggtgctccagtgttggctgcatatatattttgaatcgttatatgctcttgctgaaatgactcctttaacattttataatgaccttgtctctctcttcttacagttttgaaatctattttgtctactcctgctctttttccattggcatggaatatctttttccatccctttattttctatgtgtgtctttataggtgaagcgtgtttcttgaaagcaacaatgcattttaatgaactataaaagcaagagctttttttaaaaaacatttaacccctctatgtcttttgattggagaatttagtgcacttacattcaatgttattattgataagtaaggacttactcctaccattttgttatatttttctggttgttttgtggtcttctctttcttctttcctttcttcctgtcttccttttagagaagatgattgtctctggtggtgtgttttcatttcttgttttttattgtctgtgtatcctttgtatgttgtttatttgaggttgtcatgaggcatgcaaataatatcttataactcattattttgaactgatgctaactaaacactggttgcataaacaaacaagcaaagagaaaactaataaaaactctacactttagcctcatccccttgctttttaactttttgttttttctctttatatcttattgtactatgtcttgaaaaattgttgtagttattatttttgatctgttcatcttttagtgtttctactcaagatatgagtagtttacacaccacaattacagcgttacaatatcctgtgttttttctgtgtacttactattaccggtgaattttgcaccttcaaatgatttcttcttgctcattaatgtccttttctttctgattgaagaactttctttagcatttcttgttgatgaaatcccttaacttttgtttatctgggaaagtgtttatttgtccttcatgtttgaaggatattttctctggatatactatctcggataatagttctttttcttcagcactgtatatatgtcatgccactctctcctgcctgtaaggtttccactgagaagtgtgctgcccgatttatgggagctccattgcatgttatttgtctcctttcttttgatgattttaggatctattctttatctgttacttttgggaatttggttgttaaatgtcttgaggtaatcttatttgggttaaatctatatttatattctatatttcttgtatattggtatctttctctaggtttggaaagttttctgatattatctatttgaccttttaaggctgttttctttttttctttttttttttttttttttgagatggagtcttgctctgtcacccacgctggagtgcagtggcatgatcttggcttgctgcaagctccgcctcccaggttcacgccattctcctgcctcagcctcctgagtagctgggactacaggcgcctgccaccacgcccggctaattttttgtatttttagtagagatggagtttcaccgtgttagccaggatggtctcaatttcctgacctcatgatccgcctgccttggcctcccaaagtgctgggattacagatgtgagccactgtgcctggccttaaggctgttttctatatctagtaggcatgcgtcattctattttattcttttttcttttgtctcctttgtgtatttttaaatagcctgtttttaagcttactaattgtttcttcagctttatcatttctgctcttaagagactgatgcattcttcagtatgacattgcattttctaacttcagaatttctgctcgattatttgtaattatttatgtctctttgttaaatttttctgctgggattccaaattccttctctgtgttatcttgaatttcattggatttcctcaaaacaggtattttgaattctccatctgaaaggtcacatacatattttcctctccaggtttggtccccgatgccttaattcatttattgaggatatgttttccttaatggtcttgattcttatggatattccttggtgtccgggtgttgattaattaaatatttattgtagtcttggcactcggggcttgtttgtacccatccttcttgggaagacttttcaggtatttgaagggacctgactattgtgatctaagtttttggtcactgcagtcgtatcttcactaggggcatcccaagcccactaatgctgtggcttttgcagacttgtaggggaactgccttggtggtattggataatatctggaagaattctctgtattgtcaggcagagactcttgttcttcttccttactgtctcctaaacagtctctattctgtgtgctgagctacctggagctggggaaggggtgatgtaaatgctcctgtggcgaccaccactgggactgcgctgggtcagacctgaaggcagcagaacactggttctcatacaaggcgtatggtaaacactgccaggctattgcctgtgtttgctcaaggccctagggttctacggttagcatgtgccaaagccagccagggttgtcttcttcccttcagggcagtgagtaccctttggccttgggctgatccaaagatgccatctgggacccagggcctggagttggtaaccttagaaatctgcctagtgcttttttctgagagccgagctgggtcccaagccacaagacaaagtctgtcccacacttccctccccttttcacaagcagaggaggttctccgtgtggccatcaccaccccaggcctgcagcaaatactgcttgactactttgatgttcattgaaggccgaagggctcttcaggcagcttgcggtgaatgcctcctggcctgggactcacccttcaggtgaatgtgctcccctctggcacagggcaggtccagaaatgtcatccaggagccaaggcctggaatcagggaccacaagagcctgcttggtgttctaccctgctgtagcagagctgatacctaagctatgaggaaattcacccttactcttccctctgctttcctcaagcaaaactagtgtctccctgtaggcatcaaagctgtgaatgtattgggtcacacctgaagccagcatatccctgactgtcattcaaggcccacagctagtatttcctggctaccactgctaactacttagtcagtgcccaagggctctttagtaagcaggtgatgaatcctgccaggagtctgtctttcccttcaaagcaatgtgttcccttctggaccaggatatgtctagaaatgtcatctggtagttagggtctgcagtgggggctttaggactcttcatggtgccctgtccttctgtggctgagctggtatccaagtggcaaaacaaagtcctctttactcttccctttcctctcctcaagtggaaggaaggggtctctacctaagctgtgggctgcactgcctgggtggtggtggggggctgacacaagcactcccttggctgaccctaatggtatctcactaagttatatgcccccaaccaagtccactgactccgtgcccaccacaccaggaggagttgcccaggaatggcagttcttgtggccgagactgtgttataagttgatttaggactgcagaacactttagcctgtggtggtgaggtttgcagtgaatcaggtacaaattgctggcatatgccctacctctcttggttagggcttatctaaatgttccctctgtgggcactggctgagttctaccccatattgctttctgctatgacatgtcagcattgggttacaatgcaaagtcccacaatcattgtgctctctcttcccaaagtgcatagaatctgtctccatgccatgtggccactgccaggaggtgtatgttgggggtggggagtggtgggatagggatgggggggatggtgttggtgattcaaaatggtctttcctaccttcttcactgcttcttttcagtggtatgaatttaaaaccaggtactatgatagcttacctgatttttggttctcatgaaggtgatttttgtgtggatggttgttcaatttggtgttcttgtggggaggatgatcacagtagacttctatttggccaccttgttatgcttgcctcctgtaattcctgtttcagtttattcatcctgaaattaagaagtagaagagaagaatggcagatagtggctttcctagaggaaaattttatatgacgtttcagaacattatttttattgttatgaaggaaatttagtacttgtaaaaattatcatactgaacagttttagatcaaacctaggtacaactacggtatgatctaagatgacatatagatctttcccattgtacttttccaatgcaaaccacacctctttcctgtctttatttttgtttctacattttcctttcccttttatttcccgtttccaggcttctccctatcttctctttttcctttagtctgttctacacaaatgtgtgcttagcagaaaattacaacctatactggagaaggaaacaatctaaatctttatatctttcaaaaatttaccccacataatattattcatgatcatgatgaaattttcaaatggttttgttttacttcaaaaaggaaactcaagaaaagaagcaaactcttaattaattgctgtaattcccatatttgcctacgtgtatatgttcctgttatccttttaaattaaacacatgaatatgtgaattacactcaaagtattcttctctgtaaaaattacagtagtcataactatttataaatgataacctgaagcccagttacttcatagtcctttaaattccatttgataagcatgttgtgtattgtttagtccttgctcgcttcatttgttcatcagccattcatccaaaaaaattttgaggatctgccatacgttatgttctgtttgggctgggctaagacaatgaataaaatgagattcctgaagtggaattcacagtccaattagagaaactggtgtgcagatgaaccgataagttatactgtagtgtggtaagtattacagttgaggtgcaagaaaactgccctgggaatcttaaatttgcctgttaagatcaacatttgagaatgttttacattggaagcaattttgtttttcaagaatgaagagggatttgtggcctgttgcagtggcacatgcctgtaatcccaacactttgagattccaaggcgggtggatcacttgaggtcaggagtttgagaccagcatggccaacatggtggtgaaaccccatctctactaaacacaaaaaaaattagccgggtgtgctggcacatgcctgtgataccagctacttgggaggctgaggcacgagaatcgctggaccctgggaggtggaggttgcagtgagccgagatcgcatcactgcactccagcctggttgacagagcaagacactgtctcaaaaaaaaaaaaaaaaaaaaaaaaaaaagagggatttgctagttagagaagatagtaaagggtatttccagcagagggatttatatatgcatgtaaggcactgttagagaatgatgttacaaagttgagtaagatggttcctgtttggaaggaacccttcttgccacttgggagatggacatgaaaacaattagccaccactcattttggatagtgatattgtaggttaagattctacaggaacatagggagatagtatttctcaatttgtctcaactggaaaagctttataggacatacaatcgtagtgctgaacaaaatagttcctgaggtgaatgacctcaatgatcacaagataatagccactaacatttattggaaggttactctgtgctagccactgttctaaacacattacatgcattctctgatttaatgttcacaaccatctgaagtagatactattattgaagcctagttaagggaaaaaatgttgaagctccagatggttaaataactcctctactctctcatggaaatgacagaactgggtgttgagctgggacagtttgactctagattctttgtccacatgtatatcccatgaaaatggaacttattaaatggcatattgtcattttatataaaatttgaacagttttatcctcacttccatttgtcacctctttaagtacatttctcactattcttcagtgtacattttctaatccaaactgactaaattgtacactcttttccaacgttatctttgtaaacttactacctctgtgcatttaatagtaaacaacctaaaatatcaagttcttcagtattttgaatagttaactgtacacatttctttatatgggtgtgggattatagaaaatttaacatttattgactgtctctcctagcaaaggaaccatagtgggtggttcttcatcacaacattggaaaatacatattattaaagaatgttatagctaagaacagtgcaaataaaccatttgtccaagttcacacagcagaatctacatctacagtttcttcacaccactttttatattcttttcctttgcatatcccacctctcaaactaactggaagccacaggcaatcttgctgcctctctcaacttagctaagtctctcccttgctgttgctcttgtttgcctgctgatgctggaaggttcaggcatccacactaattcagtaatttagaaatgtatttaattcagtaattaggatttctttaatgccagcacttaggcctcaactactgaggtatggcgtgttcactgacaaccacatgaagtgacagctgacagcaagggagaagacaaaatacctataaaaagcagacagaaaaactattaaatgacagcagactgggaccatgagcctttcctggtattctctctgtgcatttctctccaactgaaaactgacaagcaagagcagagcagctgtccacccccttttctccatgactattttctgctcattgaacacagaaagaaaaagtgggggagggagagttatttctccaggcctttcagtttgctctgtgtttagtccatgactgcttctttttccttataaagatggctgtacaacagaccaaggcaatgctcagctctcagcaactttgttaaccaattcaaggtggtttcccaaggaggcttccttacggcatcattctgttcttgcagactgcttttctgcagtgaactcttattcattctgccaggttcaaaggctactttttccctgttgctttccctggtcaaatgggtcttcaaaaacaaattctggagatgagatctctgactaacattaggaaatcttggtgcacttgcagggtgatgtttgagataacaaatctggcacctggacatggcactggagtgggagaagtttggggcaggggcatgagctatatgactgttttagcaaccaagaagtaagataactaaaacttagaaactattaatagctatggacatacaagggaaggaaggcggaatcagtgagcattgatgttggagtcaaaggattgactggctgataagcctaggaaagtagagaatggctctgatgatagaaaaataggaaagagcctctttgtgatgcagtgtattatttctatctttcccatgtttattttcatgacacagtgggatgtataagtagtgatgagttttaagcaacagaaatataaatatggaaagatgagctttctaagattgtcagtgaggagagaggaaccagaaatacattattgcactatggggttaatgacaaaagaaggaagaggtagaaaagaagggatggtgatcattgtttaagtaatagttcaggaagatggataatggaaaggaattcgggggaaatttacaggcaaagtgggaatatctgcgaaccaggttgttgggtcctaaggagggaatgtgatttgtttcttggctttgtttcttagattttattttcgtaaaatttgcctttttgttttggatttctggagttaatacttctgttgcgtacttttctttgcctctatttctcctcatacttgttttccactcttcctcatgaaacataatgtttttatctgtttttcctaatcccagtataaatcttggcatccacctttacaacaccttgaaccagataaattctacagcttctactgctctgagaactatagacatttgtcagaaactgcctgtgagagaccatcagcttttttcagagtgggtaggagaatctgaagctctagtgtggtgcttaatggcaatgaaaacgcgtcagtgtgcttgatttggaaacaggcactgccacttactagctaagtgaccttaggaaagttatctaacctcttacatctcaggttccttatctgttaaataggaaggacaataatattacctcatagggttttcatgatggtaaaaataaagaaaatatttagtggtctagtccatggtaaatgttatatgagtgtttggtgccattattattgttattgtgttcttgttattctgatgtatcagtatatagagttaaaacatgtgtatcgcttaggaatatatccaacttttagacctaattttattttttagtatatttgagaaagttatccttaaagcagttgcttttattttaaaaataaaatgtttaattctgtctctgtaaagaatggataatgattacatgaaaacatatttcagaaagaatggggataagtagcattgtttaaatctaaaaattatataaataacatgaaagatacatggggaaaaaattaggctacatatagtgttacagtcatcaaaatgtaccatatttagcttaaaatattctgcaatactaactgttatatgggaaccaattaaaaaggcattcttgaggatatttcatttcttatcaggtaaataaatgctctgccctccataaatctaccactatttcattttggggaaggtcttgttttgattttcattgatgcacaataaaaagtgactcaagtcaattgtttccattgtctttcctatgtgtattcatttgtcatttattctttaagtgacctgccttctgacaatccttccaagcttcttatagtagcaagtatccaatatgctgaccttacatcaaagttactttttctattgtttgatgttattatctgtgcttaaaaaatgactcgtgtaaatatgtgtcggtgtacatgttaacatggcattttctaaattgggtggctttgtaacacatcttcctcaatttaagcaaatactgcctcaaaatatcttttaaaaaagcctcatgtatggaggttgcagtgagctgacattgagccactgcactccagcctgggcgacagagcgagacgccatctgaaaaaaaaaaaaaaaaaaagcctcatctagcagtttacagcagatgatctgtgtaagacaaaattaatagctgtatctggagtactctaaatgtggatttatacactaacctatatattgatcaattcctctatgcttgctttggttttgagcaaattatatttaaataagtttgttgctaggaatgtcttaaaaagctactcaccctttttgttagaagtaagtaaaatgattatgtcaggacctgccattaacttggtatagtacgaatatatcctcagaatactgataaaatggtatgtcttgaaacaaatcacaaactgtcaatatgttggtgatgaatttcttctgttttcatttggatcagtaggtggggcagttcaccaagtgtgagatcgacatttaatgttttcatgaaatgcaaacccatcagtggctaatttgtgaaaaatagatgttgggcttttcttaaggctaaattgttcccatttgttttagagaacaactcacttagcctatgagtttatgcaatttggcagaaagtgaaaacatatttggaagtattgaaagtcactcattgttgatcttttatattggaatgccaaggttgcatcatcagagtgtcgttatgaaaaaaatcaaataaaattagaagaaagaatcagccttctttataaacagagagatactatatattttaggctactgatctttactgtgtctgtataaaacgttggtcatgttgatggagtttatgctttctctcttcaggttcattctgacatgtcaggatatggaaagtccttttttccccccttaatagtttgagactgtagccactgtttccagaatggagtgctattgatacctttgacaagttgcttgccacaaagaaaattgctcaaaaggagctgcccaattcttagctgctatgtatttaactgttgtcacggcttctgttgtttccaagctgtcccaccataatgtaatttgttttaatctcttaaagtatatcattgcttacatcattatgcccatctactttgtttatagctgcctcagctcatgctgcaagtcttcatggttgtgtgataagaaagagaatatatcagtttcacggagaaacgtggtggtggtctagtcttgctggttaatgttgaatgtgactattttttaaatccttggcacgactggcagtctgtgaggtgtgtcacgggcctccatcatggtggtgggtatgaagctgtgcactacttctgtttttaacaccttccttggagctgcctgaagaaaattgcaggaattttttaggcacatctactggaaagtgcttattttaatatttgtcaacataattaccagaaaacattaaccctgaagtgtgtctctcaatacaaacttgataatcactaaatatttttaatataggcctttgaggaaaacatcgtaaatatcattagtcttatttttctctatgaattttatttactatacattagttgtttagaattatcttttttctcctttgtttgatggtagtgagagaagaacactactttttggaagattataaatagtacattaagtgaaaggtcataaatactgtaaaacttcaataaagcactgggcaacaacatgaattcacatatgcattgaatggggaggaagagttaggaagtgaccctcaagaatttgggaccttctttgttcattttacagtcatatatgttcaatgtaagttccactgtccttgttttaatgctttcatgagatgatatagataaattgaaatatatggtttttaactaaattcaagataacacaagtctccattttatgtaatttaattttttagactccacctgtgatcttatggcgcagctcgatggcagttggaggtgcaagtgattcccaataatgaatcacctttcaaatgtttcaatgatgatgtgatagaaaagacagctgcagtagtgtgacttaaaaagaaattacctgactgcccttttttcccaattactggcacaatcttcatgaaatccaaataaacttaatagaaggaggaaaagccatgtgagtggagctgacctgccacaaattaattatacttagtactttgtgccagcatggcatggtggagagccaggactcgagagaaacacataaatatagcaggatcttagttgcctaggtgagcaaggaaattgctgcttgcaaaacatgttggaagttattagttagcataagatgttttagcatttgcatttattaatctgacttatgcatttaaaatatgtttctgtattttacaagaccagatctggaggaggctaaatgccccaagtttcctttcacaccaacatcatatgctcatatatattcagttgattaattattttaaataaagtgcagctgtcttgtcatgttaacaggcctctaattttatttgcctattcatatgtgaaacaggagaggctagcatcttaaaaattcagtgtaaaagtttatatgtacatgtttattttataacattttggggtgatttttaaaaattatttttcagacattgtcaaataaggtagtaaaacaagattcaggtattattggttcttcatttttatttttatgagaagtactgcatttgctttgctgctattgcgacagcattgccagtagaccaacatataccacatatacttttgcttttaaatcctgcttaagatacattgattttaatagaggaaattagtgatatattaaaaacccatgagcttaattagccattcacgaatgactagtgctatattctatttgttattgttttaattaacagactactttttaaagagcattttaggtttactggaaaattgcatggaaagtcctatgtatatgctcatctcctccctgctctccagtttcccctattattatcttgtattagtgtggtacattttttacacaataatcaatattggtacattactaaagtccatagttcagagtttactctctgtgttatatagttctatgtgttttgacacatcatgtatctaccattttagtatcttacagatgggtttcactgccctaaaaatcttccgtgccctacctattcatgccttcattcctccctccaaacccctgacaaccactggtcatttttctgtcttcatggttttgcctaaatctttccggattctttcactgagcttctgcttctttcactgagcatttaaggttgttccatgtcttccaatggcttgaaatctcatttcttttatcgttgaataacattccaccgtgtggatgtaccagcacctaccaaaggacatcttggttgcttctaagttttagtaattatgaataaagctgccataaccgtttgtgctcaggtttttcctgtgtgtgtggatataagttttaaactcatttggataaatactaaggagtatgactgctcaatcatggtaagagtatgtttatttttatatggctggtgctactttatccctatccctccagttttattttgttttgttttttgatatcggattaatagaattgaactaatcacaatccctttgttcttaacccactcttatcattgatttgagggtgactttttatttaattagttatttatgataatatagtaagtacttctgacctcaccacccaatacaaaatctagatccttgacaatcacatatttcttaagtgtgtgtactcctttgcatattccttgcctcccctaacctgaggccagtgctattttagttttaaatttaataatgtttccatatatatattctacatatatggatggaattctaatatatatacggaatatatatattctaagagttcaatgattatttaagacatacttctctagaataatcatccaaataatttaaaacaagattttgcctctgaatatgtaataggcattaatagattttcacttggattttctaacattagtttttatccattttgatgccattcctagtattaatgataaatttttcattggcaatataaaaagaaagtcttctgctaaaaaaactaaggctgttagtgaagttataaaaatcacaaaagactaggattgtcgcatcattatgtgaaacagatccttgggggaatacatcagattgtaatgccacgactcctgtattttaaatctacctgcaccctaaagctaatggcaataatgccatttcaactgaaacatcaactggattaaaaaaaatcctaaaggacaaggaaaattcaagctcttggctatgcagtgctgcagttgacccattcacttctctgttcaggtaatctagttaacacaggcttcagtatcaattcattttaacaaaggatggttaatgtcattgtttgtaacattttctagtgagaataaacctgaagcatactatataaataagcccttgcttgcgctgactcaggaacacaattcttaatttacttagtgctctctgcagctacttgtgtatgtgtgtgcatgtgtgtgtgcatgtaggtatatcttatggaacttgcttctaattaacaatacattagtcctcgctacttctaattagcaatgcggtagccctgccttatccacagggggatataaaacccacaatgaaactgcggatagtaccgaactctgtaaatactatgtttttttcaaatacgtatgtatttacaacaaagtttaatttgtaaattagccatagtaagaaactaacagctataataataaagtagaacaataaaaacagtatgccagcatcactactcttgtgcattagggccgttataaaatagggttacttgaacactagcatgttacctctacagttgatttgataaccaagacaactactaagcgactaatggatgagtagcatacacattgtggatatgctggatgaaggaatgatttatgttccaggcgggatggagcaggacactgagagattgtatcatgttactcagagtggtacacaatttaaaacttatgaattgtttatttctggatttttccatttaatatctttggactgcagttgaccatgggtgactgaaactgtagaaaatgaaaccatggataaggagggactattatagttaacttttggacatgtggtgtttgtagtagcaaggtgattttgcagttgtactcattatcacctactgacaaatattattatatataaggaagattatttaagccatccaagaggaagttgcaagtaagatggacattactcttggtttcttcagatgttcttaactctttgagaagtaaaaagtctgtctttactccagaaggtaagatcttgctggatggggaccatctttcattcctcttagtgtccttagggacttatgcaaagaaagacttttttttttcctttttgagaggggatcacactctgtcacccaggctggggtgcagtggcacgattacagctcactgcaagccttgacctcctgggctcaggtgatcctcgcacctcagtctcccgagtagctgggactacaggtgcatgctaccacgccctgctccttttggtaatttttatagatttgggtttcaccatgtcacacaggctggtgtcgaactcctggcctcaagaaatccacccgccttggcttcccaaagtgctgagattataggcgtgagccaccagcaagaaagtcttaagtattattgctgtatgaatggatgttgagagcttcgagtaatgtgtttagacttaatattacaaaagactctcctaaagagcaaagaatataatgtgaatgacgtaaaggtgtataaatgaaattaataattaataaattaatgaaaagtataataattttgaaatataaggaatagttaataagtagaatagtaatagaaatgattagggaaaataagtcattggttattaatatgtgagtacatttgataaagaaacacgctctgaggcttggtgagtggaatgtactgtatgaatttacactatagttcccattcaggaaacagtgactaagcacttcctttgtgcggagtactttcccttgttctggggttacaaagaggaaattatatgattattgtcatcaggaatcttatagtataatagatcatcgtgcctataaagaaacagtctaataaaacagttgttataatggaagcatttgctaagtgtcaaagcaatgggaataacagggaaagaaaacctaagtctgcattactggaggtgaagctgtgaactactgatagagagtaggatctattactggactgggaatcagaagaccaatttataatcccagctctgtactttctagccctgacatcaagcaagtcaatttacttctctgaacctttttccttcaatgtaaagtaaggataataatattaggtctatctagttttaggattatattcaggataatgagtaactgtgaaaatggttagcctataaaatgctatgtgcatttgcatataagctgctttcactgttgacagtgtgtggtgttgtccaacctgaccacctttgtttggaagatggcgtggtactatttttcttctggtaggtggaatagtaaaagttcagctgtgaaggttaatttttggggaagaagacctgcattaattctccaggtagatgtctatacacaaatgtaagctttttatttacaatgtaagttatttacattgttagctttttctctgaaaatgtttcaaaactattgatgagcattttatttttagtaaagttatttcattataaaattaatacttagttgtggaaaatctggaaatatcattggcaaatttggaaaaaaaaattgtatacatcaaaaaattattgtcatctggaattctgacatcccaagataattatttttaacttttaaataatattctcaaaattcatctcatcagagagatttatgttccttaaaatgttagtatgttgctgggcatggtggttcacacctgtaattccagtgctttgggaggctgaggtaggaggattgtttcagcttaggaattcaaaaccagcctgggcaacatagggagaccccatctctacaaaaactttaaaaattagccaggtgatgcacgtctgtagtcctagctacttgggaggctgtggcgggaggattgcttgaggccagtagttcaaggcttcagtgagctatgatcacaccactgcactccagcctgggtaaaagagtgaaaccctgtttctttatgtactatagggatatgttaagtatttggcaattacaaattttattcacatctagacatttatttgataatttgggtttctaactcttattagtagtttgaaattatttattataatgttttgtcattggaaataatgcagattttattttcagactttaattactttatcttggatattagacttgctattcttattctttctttgtttctaatattttctttctgtttaacttcattcaaaatttcatggtttgggtatcattctgtacacctatgaattgatttagattattttaaagagtataccaataatacttacaaacacatatctagtgcttgctatgtaccagacactgctctaagtgtttaatgcacctggactaattctaacagtaacccaatgaaaactaatattttcctcattttataaatgagaaaatcgaagcgtaaagagcttaagtaaattaaccaaggtcacacagctagtaagtgggagagctagagttcatacccacactgtctggattcatagctcagactcaactctttcatcataatgcacctcttgacttacaggacatttcgttagtgacaagaatttccaaatgtggcatttcattttctgttctaagtattttttaggacagtatattggaagcagatttgcattcatacctatagaagtaagaatgtagtcattaagggaaaagattataccatgttgctataagagatattttagattccgtgttttctttgcaatttaccttttacctatataaatagttcaaataccttatcttagcagtgatgctacacataaaacatgttttattaaaacatagctaaagatgacaaacctgcttcaatattaccaaagaaaatcagattacatttggaataaataatcaacaggcattcaaaaatatgtaagtacatagttcagtcttgcaagttatagtctatctaaaaatatataggtaagtagtagtctgggaagaaattatagccatctgcaatacagtgagatggatactaggggttttcttacatatcaactcatgcaagaagatactgatattgtttctttagattatatgggctaatcaaagcaaattagaaaactttacacttttaatttacatttaaggtattttacctggaaaaatatttcgattttatgtgtagattttgctaaaaatatgatattgcatttaatgttatcagttaatgttaccaaactcttctaaatggagaaattctgtgagatccctggtgtctctaaaacatttggtaataccttcaaatgaacatccagcgtattcatatctacacatattccagagccagtgtctctaaaacagatagggattcagatcattcccacatcagagaaagacatgctttagtctgtgtaggttagggaggcaagagtcaccctctttgtgtgtgtcagtgatttatcactcttccacccaaaagaaggcttgtcctctttccctcaaccctgttagtgcttgggggtttgtgttcaaacataaattttgtcatagctatactatagtagcagacatgaatagattcacttatatttccatttatttctcctgagtatgatctgattagaagaggtaaagaaacaaagcaactagccaatatgaaaggcatatcattaaagccagaataaaatctgactgttcttgatttccatctcaaaataactgatgtctttcctaagttgagaatgacctgatctgttaaaaacagattaactcatcaattctgaccaaatcttcttaagaaggctaataggcttctgttgactagacaccattccctgtttcatttttctgatatcctggatgggggtcggagtgttgttattcctgagaaaatcgatatatcactgtattggaaacgtttgcttgtggtagcaacagtcttgatgtttgatcatgttaggttttatgaagtgttgatagatttagctccagacttaagagttacctacccaggctgggtgcggtggctcacgcctgtaatcccagcactttgggaggccgaggtgggcggatcacttgaggtcagaagtttgagaccagccttgccaacgtggtgaaacctgtctctactaaaaatacaaatattagctgggtatggtggcatgcacctgtagtcccagctactcctgaggttgagacaggagaatcgtttgaactcgggaggcagaggttgcagtgagccgcgattgagccactgcactccagcctgggtgacaaagcaagactctgtctcacacacaaaaaaagagttacagccgggcgtggtggctcaagcctgtaatcccagcacttcgggaggctgaggcgggcggatcacgaggtcaggaaattgagaccatcctggctaacacggtgaaaccccgtatctactaaaaatacaaaaaaaatagctgggcgtggtggcgggcccctgtagtcccagctactcgggaggctgaggcaggagaatggcgtgaacccgggaggcggagcttgcaatgggccgagatcgcgccactgcactccagcctgggcgacagagcaagactccgtctcaaaaacaaaacaaacaaacaaacaaacaaaaaaacaaaaaaaaagttacatacccagagatcaattgagaatgcaataatctctaaaataaatcattactttttagtagtctagaaatcatgtggtaatattaatttttataagtggtagaacagagtaataaacagtttcagccatctttctcctaagtctcagttaagagtttctcctccattgtgaaagctgaaaatgggaaagaacctattcttcctgtctaaatgttgatatccttggactctaggatccagtagagacttaggtatcaacaccaagtatggcattaccttacaacactccaaacagaccctgattcataatagtctgtgctcttgcctgaaaactttatatatgaacatggatatgtttatttgaaggtatgtttaatatgggccatgaggacattatggttacctaactgaggatagagataataaaagcattttagaatcattgtaatccaaacttgaaagtagaaacttcactttaaaaagcaagatagtttatattttgatagtgctcccaaaagttgaagattgttcttatggggactcatattgttgcatagttgttagtaaaataccatttataatacaagttctgttgccatttggttaggaaataaaaagtaaccaatgtagtaaatgctcaataaatatattttgattatttgttgaatgcattaacatataattgtaaaaaaagtagaaagcacaaatcttagatggaaaggatcatagaactgaaaacataatataattattttgcagtacatctgagttatattgtgatgtactttcctaaccaagtccaaattaatcaggagctctgggagaatcatccctagaaacaatgcctttaaatagagggtcagaggaattttcgtatttctggatttcaaactgcaggtggctctcttgatctttcagttctgaatttaggttaaagactgctgttctgccttcttcctgtccttgttacatccagactatcagacttcctgttgaaacactgataattgtcttattattggattgtaagcaacatcgctttttctcacatgtagaagatagagttttttttgtttgtttgtttaacaaaatatattgcttggccttcctttaaaatggctctgatttgcctttgcatgtcttgtgtgaggagttgctaagtatcaatggcattgttgataatgcttgtaaaatagcatatcagtattctagcattattttaaaagaacaaaaaacaggtgattctaatcattttccttcctctcattttctgggtagcattgctgttttatctcataatttattttgtacacatctggtactacaggaattttaggagtcccaaaatgaatatgaaaacctgttgatacaactttaggtggaaacctaagccttatctgtccttttattcattctgatggttattttaaagaaattgctggataccattgaagtatagagatacaaatatttttataaattatgtgccgaagtaaattataaatcacatggcttatagtgtggattcttaaattatcaatcatatcacttcatatttttataagctgaatatctaattcttttgcaaagtaagttacgtgcaactgctaccttttaaaataatagataaatctaaaatatggtgggtgataaagtgctaaaaagatacttcttagcaatacttaattgtgttacaactgtaagcaccaacagccaaaagattgtttgcaataaagaccttatactaagacattcatcaagtaataaaatataacctcaaatgtctaattctaagtgatatgtgccttataaatatacttgtagtagtgctacaaaaaaggcacagataccaaactgaccttaaaagtggcacatgtggcgttactgcagctgggctattgtcttggagattcacagaggaggcctcccaggaattatttgtatgttccttttgtgtaaagtttttgtctggaaagtcgctgtgcaaacagtagctgttccatagcacctgcttctgttgagggagagtgagtcttttatttagagagcatcggtagccatttcattcattactgcacaatggacttacataaagagcagcattccaatgacgccaaaagaaaccagagcttccaacacgctgaggcgcttgtaaacattgagtctccctatgtttctttctaaacttttcttgcaattacatccaggtctttattttgaggaaaaaaataattgattcagagcaataataggaaaagttataaactgcaatttttaatttaaaaagctgtattatgtaaaatgctgtggcaatgtcatatataagcttggtcatttacataattattgctttaatcttcttaaggtattagaaaattaattgcattatagaaataaggatgccaaaatatttcatagaattttttttaatggtcatggaattgttttcagtgtgcctatcttcctaacatttaaatgattttattattttcgtggccaatcatcttcaatatgatgtcaatatccagtgcatctgctactttccagccctttcattgacccctggcagtgtggtacccatgtttgttactctactgaaactactctctctattgcctctagttcctaccttctaaccttttctctcagctattatcattcttcatctttatgtttgataagaccttcctgatacatcttctcttggttttgtttttgtttttcaagaaacctgtacccattagcagtcactcctcatcttccatcctcaaacccctgcccctgtcaatcactaacctattttctgtttctatgtatttgtctattctggacatttcatataaatggaattacataatctgtgttctttttgtctggttcctttcacttagcttatgcttccaaggttcatccgtgttgtagcatatatcaatacttcattcctttttatggctgagtagtattcggttgtatgatataccacagatggtttatccgttcatcagttgatggacatctgggttgtttccaccttttggctattgcaaatagtgctgctattagtgttcctgtacaagtacttgtttgaatgtgtcttttgaattctactgggcatgtatcggtatatatctaggagtggaattgctgggtcatatagtgattctgtgtttaacattctgaggaactgtcaaacagttttccaaagtagctgtaccatttcacattcccactagcaatgtaaaagggttccagtttctccatatcctttgcaacacttggtattgtctgcttttaatgttagccatcctaatgagtatgagaatattatggttttatttgcatttccccagtggctaatgatttcgagcagcatttcatttatttattgcctatttgtatatctactttgcagaaatagctattgagatcctttacttttttctttttcttttttttttttttttagtgagacaggatcttgctctgccacccaggctggagtgcagtggcacaaccttggctcactgcaacctccacctcccaggctcaagtgatcctcccatttcagcctcctgagtagctggaactacaggcacatgtcaccacacctggctaatttttgtattttttgtagagatagggttttaccatgttgcccaggctggtctccaattcctgggctcaagctatccacctgcctcagcttccccctttactcatttttaatggggtcatcattttatcattgaattgttgcagatatctcccattctctgggttgtgttttcattttcatgttagtgtcttttgaaacacaaaagttttaacttttattaagctaaattgatctgtttttttaattgtgcttttaatgtcatatttaaaaaactgttgcctaatctaaggtcacaaaaatttatacctctgttttcctctaataatttcattgttttacctaacttcattttttttccatgtggctatccagcatccctgcaccatttgttgagtctattctatttcataattgtcacccttatccaaaattcattgactgtaagagattatttctggatttttatttttattccatcaaactgtatgtctatctttatggcagtacctcaatgtcttgattactatagctttatagtaagttttgaaattggcaggtgtgtgtcctctacttttttcttcttttgatacatactgacctacttagtcttctgctttcttatgatgatcagcttttcttcccactagtttgtgactcaggttcctttttaacattcttcaatggtttccatcacaccaagcaccgaccaccattaccttctctgatggtttcatatgatcccattttcttcacttagaaaaatattcacagagtcacaaatcctgtctaattaattcatatttattagatgaggaataagaaatggaggaaaaagtcaaaaatcttaacacagtttttaaccacccctgggttgcccacttaacatcattcaaatctgcagcaaaaccatagaggagactaaggtagtagggatggagaagagaaatttttgagaaatcctcaaaaggtataattaacgagactattattgatagagaaataattgggtactggagagaacagtaaaacaagtccattttgctatattttggcaaaaattataatcacagctattttcttttttttctactaataattggatggttatgtttaagaacagtatgacaaaatatcattttagttgaaagtgctaaaggatgatacaaatatttttgatggttttgttatacttactagtaatctaatatgacagtattatgcgtacatgtaccatgccttctcgtgggatacaagctatatttggcagcagggggaaataacaaatcacaagaataaagagctcatatttttacattcatattttcagaatgactttagtgtttccccttgtgtttcccatgtgtgtttcaaatcaccttattcaattttgctatctctgactcagatatagtgtactatacatatataatctgtcatcagtttcatttttaagtggaaaattacattaacctctggattttcagtgaaatgtttttcatggcactatgaaaacacaatagtgtaaattgtaccatgttgacatagctaattattcaaaactgggtcatggcttaaattgtagtgagtagaaacatacgcttaaaataattgtaagccaataactatactttagagactttgtgcctttacttgtcatatttttgagactcgatttgatttcctgtttagtttaacaaattattttactcagggctttacaatatctgtccagctcattagttgttacttcttttaccctttttatacttgttctggcttttcaaggctcactgattaaccaccctttgcagcatttctcagccctggtgtgttagctgaagtcatactacttagggagattttaggtattttctgtaagtgatgtccatgggtgactttaggggagccatttatgtatggaggccactggctattggagcctgacaagaggtctccataactagttttcatcagaatgcaaaatgataaaattttgaggaataaccttaggcattcattggaacctatggggcgggagggggggggacatcctaaactgtgataataaaatacagaaagttggaaaaataatggaaaaatctataattctataaactttacagcctacctcaatgcacaaaaggtgtttattatagtataatgtattcccatcttttgttcaagcatcattccatcaagggaatgcccactgtatttaatcttgttaacagtatgttaattgcaagtgctagttgtttttctgctttcttttgtcaattcacatttattaaatgcatacttattttctaggcactgtgctgaatgctaggggtacataaataagactctgtgtcctcggggaatgcaaggatagtggggaagatagataggtaatcaattattatcataacatgtgtaaatgccagaaaagagaagagtaggatattgcaggaccacagaggggagaaggccaccgaactccgatgaagggaagtaagcaagaattcccagtagatgttgatgccagatctgaatttcaaagtcagaatgggaattagccaattgaaaaaggattgcaatagcaaaaaattctagacacaatgagagtacacattgaggcatgtgttaaggtttgagaaactgtggtgttttcaagaaactctaagttgtttggtgtaagtgataggtagtgtacttttagggaaagtggtaagaaatcagggcataaagggatgaagttacctactcactaatggcctagcttgcagtatttaggagtttagattttattctaaaactaacatggaatgagaatatgttaagcagagaagtaacactctcagattaaataattataaagatcactctgattatggtctgagagatgtttgggacctggttggggatggagaaggggccatttggtcttgaggcagagactagtctggagcttcttgcaatataaattgaggcaagacattgcacatgtcataaagtagtgagaataagagctttgtacatattctatatagagaaaaagtacaaaatttggttttagaacttgataagggctattattttacattactcaaattactaaattacggttctatttcctgaatttatccttgtcattttgattggaattttgagtgttggttaggcaatttagtgccagatctttgaactgatcagtttaatgccactagatagctattaataataatagccattatctgtaggcttttttctattctaatttccctaatttttaagctcttggggggccagtgtgttacctcattcttgtctctttttacatctattactgctatgctccgcttaaaaaagcactcaagtccacaaatcttagtgtaaaggaagtatttcaaagagattatctcaattacaaaagaacttgcataagtttcctggaatatttttaagagagtatattatgaaaacttaattttatttgcaccctttgcctaaaggatgtactgctttgtttcagagagtctgacttatgtgactaactactttggctcttttaagttttcagttttcctcgaataattcagtatctctattgggatcattaactgtttacttcacacaaccatttactaaagacctggtctactcaaaggactataattctaagtaagacagtatgatgcccttaaggaacatgtgtaaaccattgtatggtatccttcccaagggttctggattctgtattttgaaagtctcaaattcactgccagccatctacaaagaggttgcttctttttctggtagaaaaacaattcctaatatgctataaaaattttgttgagaatatttgatcttcagatatagttaggtttccatagatacatctagactagatatccattccgtgtcaagaaatgaaaatgtgagatttttatgagcaagattagcaaacaattaaaaccagtttccaactttaaatatttgaaatcctcacattcacagtgtactttttttcctaagtaagataatagcgtcagagatcagaaagatgccagatctaataaactaagtcagctgcattagaatgctagtaaatgtccttttgaaaggtcatctccattagtccttttgttgctctccttatagggtttttccccctctttctctctcttcttttgaaaatggtcatagcttactttagctaaatagagaattttatgaattatttaaagtctctgtatttaaacaaaacaaagcaatagagaatgtctaaatagtataacaacataagtaaacactttctttaaagatgtttgaaagaaaagagctggaaaaccaaagttactgtcacaaggattggtaaattccctcaggataagttactttgtggtacatatcagtaatttctttttaaagagttgctggatcagtgtaaattttcaaactctaaataaaactatatatgttccatctatgtcttgatgatgataaagttatgagtagatattaattacaagcatcctcaaaagaaaatatacactggtataaagggccaacatgattttaacttgctcttttgatgatgacttctaatacttcatgtctatgttgttccagtaattagcatgaaggaactgccctgccagctgggaatgtcttaaagccatcttcttattatcttttaagttattgataatgtaacagagattttgaatttaaaatatataaattctgaaatcatttttttttgtagagcagacattgttagtgtgtgcatttttttttttactgtgacactgttttatgaattaaacttaataaaggcaagtacttgtattactgctaaaaatgaaaaccaaaaggatccagatattgccagataggatttggtcagaattatttgtttatagaaattaggattttaaaaagtcaatgaaaaatataagtgttccaacaagcattgtagtccacttttattattatgtatgtagataattaacagtttcaatcatattgtgagtagaaacgtatgtatgatatagagtgatctttaaaataatctacatggtatatacagaacagattttttttaatgttgttagcctaaggttccaaaaaataggaaagtggaaatcaatgtggaattgtcaagtctgcaaaatatctttccttgggattgtacagaactcattctaaaaaaaaaaaaagtcaaaaacttcatcctgcagcaatgttctttcatgacttaggactagaagaaagagagaaatcagactaccatcatgtaacgatttaaaaattaatccatacttgagacccctgtaccactgagttttttttaacataacctcctcttttctcgtataaaaaaactagattcagaacattacagttgaggaggaatatattaccattgtaactactgaacactctctattacttaatttttttaaaagtgtgtatgtgtggattggatacagtaatctaggaaagtctctgtgtaacagtgagcatggtatttttctagacattgttggtctcagaggtccccattaaaaagaataagagttgctacttctcaaaccttgtcagatactgggcatattacctgcatgcacaatggagggtttgaggataccagtctacctttgtgataaccttgtttatacacttacaaaacatatcggctagtgtatgcattatttctacaacactaccacagctttgcttgtaagattttgtaagaaatacacaagaggaaggaatcataggccttggattctgaaatgtctaattcagtcacagtgatgcagtgctcaaatgaactatagcagatttaatgagcaatccaggacagagacacatgtactggacacactagggaaagagattacgtgtacaggggctaattagcatgaaatatgaatacattcatataagtagtcttgatctatgggacgccttcattattgggaatgatttttgcatgaagttaatgaagagaaattcaggagttatgctgtataaagaattttaaaatagtattttaactttttgattctgcaaagtctcaatttctggagcaaaaaagaaattgcatatcatgaaatagtatgagcaaatgaatgtggatctattttctacagtgtctaaaatataacaaggtggggaacagtagctatccttcatttaactgattaatcaacaaatagacttcaatctcttgaattagatatgtacaagatattgagtgtcagtttgatattttaaataagggaatgtggtcatagtgtattccagaatatatacctctagccagatagttgaaaggcttggattcagtttgttgggtattctaagcatctttaccaaagaaatcagtcttgaagcaggatttagagaaagaatggatttcgactggacatggtgcctcatgcctgtaatcccagcactttgggaggctgagatgggcggattgcttgagcccaggagtttgaggccagcctgggttacatggtgagaccctgtctctacaagaaataaaaaaattagctgagcatggtggcatgcgcctgttgtcccagctacttgagaggtagaggtgggaggatcccctgagaccctgtctccaaaaaaaaaaaaagatttcatttgttttaagtttggttaaggcttataggaaaaggagccagagaagtgagaagaataatatttgaaaatagaccaggattgtaatattaatttgaatatcagatactttattccatttaaacaacagttttattctaatttgaggtttgaaatttaacatatgaaaacttggaatttaaaagaatttttgataaatgttaaatattggaagtttgagaaattaagctgatttttgccactgcccttcaaaaaagttcaacattgtattgcttaaatatgtggctatatttatgtaaaatacacaattaatattaatattttattatttcgtatctgacttcaatacatttttatgtgcttcctgtttgtggatatcttagaaactgctacagaagtcaatattcttagaaaattcagtaattcagagatgtgaaattagaacaataacagcttaagtggtttataaacaaagattatttgcaagaaatagaatatttctgtgtaagttcattgggttatgtgccatctagcagaaaaataggctgtgtatggtgtttatgttcagtgttctcatggttgcccatggtactgaactcacacctttatatgtgcaaaatgtgtgtaagtgaagcaaggagttagtggagctggtaatcagaatagaataggaatgggaataaatttagaagtgaccatcattctctctgtcccagctttgaacaagtcaaaatgcacatgattttgtacatttcattatcagggcaccttttgagagagagagtcgattgacaaaagatgggtcgtaaatcagactaattctttgtgtgactgctctttgctttatgggaacatgtttgactttagggacataaacttcagggaggtgcaataggtagatgacaatcattaaaatagcagaagacacttgctgagtgttgagcatttaaattgtgctaaataatgtgctggatgagtttacctaagtctcctcatttaatgctagcagattccttgtaagatataggtactatttttttttaatctcagatttatagttgaagaaacaaaggtttaaggagataagtattttgcttgaagttacacaacttttaagtggtagatccagtattcaaatctgaatcattcatacaattgaatgtatacctcatttaatttagtaatatattattcttaaacattgagagtaacaaaagttccttttgaatccgtttttctatttagctaggcaataagatggcctcatttcatcttttgtgtactttactgtagtacagctgtgagaaaatcatactaggctttctgctggttagatctcagacatatatgtatatttatctcctgctgcctgtcgaagcactttttgctcttgcaaatgcctgtaatctggcctgtatgtcctctgtcactgtaggttccacaaaatagggtctctttccttcctgcaagcattgccttgggggatattttcatgtttccttttgtgttcattcatggcatgtatgttcattttataccatttaggaagcatgagagattttaaaaaggtctcttgaatttatatgacgcaattgcaatttagaagtaaccatcattctctctgtcccagctttgaacaagtcaaaatgcaccttaacgttttattcattttgctattctttcagtgatggtttccctatgtctgcggtttttcgttttttactgtgtgtgtatccttatatttttataagtactttattctggtatgtagtatatactataacctgctttttgaatctaatatttattcttggaacataaactaatattctgcaaatacatgattttattggctctataaaactcccttgtaagaatatactatgatttattatcattattttttaaatttcaatagctttagggtaaaattggttttggattacacggatgaattacatagtagtaaagcctgggctgttagtatatacatcacacagatagtgtatattgtacacaatagatactttttcagccctcatccttctcccaacctacccccttctgagtctccagtgtcgattatcccaatctgcatgcccctgtgtacccatagcttagctcctacttataagtgacaacatgcagtatttggttttcctttcctgaattacttcacttaggatagtggcctccggttccatccaaattgctacaagaaatgttatcttgttcttctttgtggctgagtcgtattccatatacacacacacacacaccacattttctttatctgctcatcagttgatgggcacttaggttggttacatatctttgcaattgtgaattgtgctgtgataatcatacaagtgcaggtatcttttcgatatgacttattttcctttgagtagatatccagtagtaggattgttggatcaaatcatagatcttttagttctttatgaaatctccatactgttttccatagtcattttactaatttacattcccatcagcagtgtaaaagtattccctttgtaccacatccatgccagcatctattgttttttgactttttttttttttttttcttgagacggagtctctctcagtcacccaggctggagtgcagtggcgtgatctcgtctcactgcaacgtctgtgttttttgactttttaataatggccattctgactgggataaggtggttatctcattgtcgctttaattttcattttcctaatgattagtgatgctgagcatttcttcatgtttgttggccatttgtgtatcttattttaaaaaatgcctgttcatgtgatttgcccacttttcaataggttcattcatttttttcttgctgatttatttactaagatttatttatttccctgttgttcaatatttagattgtttcaaattatttgatattattatgccacatagaatagtcttgtatataaatccttttgtaaatttcttattgaaattactggtggaaggatatgagttgttttgaactcttgttatgtattgcaaatttgtttctgaaaggctttcaaatttagattcctaccagccatatgtgagtagcaatcatttagaacactcacaaatactgagtgtcatgattttaaaaaatattatatttgttaaattgatgggtgaaaaactgtatcttattgtttttatttatatttatttgcttactcatgatgtttaaatagctttattacatattgaccattcgttttcgtctaatttttgttcatatagttttactcatttttgttttacaagtatagtatgtttcttatttctttaattatatttatatgtttatattaacccattatcaccatttttgcagtttgcaattttttcctgaagttttcatttgcattttaattttgttttaaagtattttaagataacctgtagtttttttgtggttgtggttgttgttaaaattagtgggaccgttgaaactagaatttcccttttagataaaaattttgcattagttacttcagggaaacagaagagtataataattgtgatagggactcaagagaaattatacaagtggtgctattcattatcattggcttccattcaaatggagctggatttgttattttcctatttctcttcctgagtctccatttgtgacagtctcttggcaggatttcagtctacttctaacttttatacttgtggttggagcccagccagcttctcctgctttctgggaggagctcactctcatcgtacatctattgacttgcatgtcttgtaatggtaaagcaatacgtggaaggtattcaagtttcctgagactaaagtgggtcatatctctgtcccaaaactgaatcatttgaaatctgaaagtgactttaaagatcatcgtttaaaaatctcaccatgtagatgagtcaaatccagagacactgcttttgcttgctttctcaggcacacagacttcactgaagagtagtaagcttgattgattctctgacagctacattatattgtagagaactttgttgttattgatctcatttacacatttaattcctactctgtatgtgggaatataatattttactgatttaataaaccaggcatgatttcttattgtgtgatttattgtgtggttcttttttgtcacaaactttgtaggttgagacttggcaagtaacctacccttgagggtttttttttttttttctcccagatgatggtatgtgtggtagtctctctaaggcattattatgaagacatttattaaatctcggtctatttgagtgccacctaacgtctagatctctcaacagttttgcctagccatcatttctcagcttgggatggtgtagagaaacatattattcccacctgagcttatagaactgtagctaacatcatcagatatcagggctttgagcaagcctgcttgtgggtggtttatcttttccagtgatttgagacttgtgttgcattgaatatactttgaatttcacgtgtatctctgctctattagtctgtatttgggttgttttgaaggatttttattttaatatgtagactgatacatttttgtatatgttgctggaggcgcttttgcactgctatgttttagaaatcaaaataataaataatgcatatggtgttcattgtttttctcctctgtcttttgatgactattaagtttcattggaagtgttagtaacatttctttatttttatttttactattttaaaaataatagtaataataataataaacgtttagctttttagccaggtgtagcatttcctaatttgaaaatgtgctattcattttttaaatagactattttgtagagcagttttaggcttacagaaaaaattatgcagaaatctcagagttcccatataattttcctctccttcagaatttctcacattattaatatcttgcattagggtagtacattttttactgttgatgaaacaatattaataaattattatccttaaagtccatagtttatatcatgattcagcctttgtgttatacagttttatgggttttaacaaatgtcttgtctactatatactgatatttgacttatcctttgatgacagtgtaatcattccttacatggttcattcattcatttcctcatttcatatattttttcctgtaactatttattgagtacttcttgtggtaggcattctgacagatgctaaaggaaattgccaacctacgcacacccgatgatgatgttgaggtcatttgtgagaaaaggctttaaaagggaataacctttgctgacagaatggtatgataatcagaatggtactgattactggcttaaaatttctacttgtgaagtgtttcaattaaaataggagtagcatgttccaattatgcttcagacatttatttgcagagaagtgcagtgtgggagctatgttaactggtggctgtactgggtatttctttatctcttccctattttttgtttgtgatgaatatttctttatatcttccctgttagaagctgtcagcggtattcaaaaaaagcagtatttttccttggaactaactattctgggacagtgtaagccaatgggaaattttgacttaatgaatttcccattgtaaactttcggcattaaatctgttgataggtgcaaaaaaattgtaatatttacatatctttgatggggaaaacagggttgatttctttttacctaaaccaagcattccaaataaataaataccagtagaaatgaagagtataaatagaaaacaataggaagacttaataagacttaattgagttaattcatctttctttctggttctgtcattccttttctctttagttgtaagattatacattgactagctagcagtgatgccttcaggctagacattagtatacgtttttggtaggttcttatataatctgccaactattactcttgcagaggttatttattattattttttgtaacagtttaattgagagtatattatttgaagctagactatcggagtttaaatcctggctgccatgccaccaggggcaggtgtcttaacctctctaaatctcagtttcatctgtcattataataatacttttttaacatggatgttagtatgattaaattgatgtacatgcaaaccagttccattaatcactgcttagaatttgttgtgatgattatattgtaagagaccaagttgaagttcttcttgatctataaatgtatttctaatgtttcttagatgaatttgttgaacattaaagagatttcctttcatggctaatggctgtgctttgaaaattttcatattaaatgtagaactataatcctctttctgtgtagattgtgaagctagtactttattttctttctctcaggcttctgatttatgttttcattgagtgaatatcagaccattgctaatgtcataaaataaaatccagaaaatagatgagtcactcattgaaaataaaatctgatcagaaatcctttgactgtgttacattttaagataatgaatgcttggtttttgagttttactatcataccaacttttcccatgtgtgcatgtgtgtatacatgtgtatgcatatcagaaaaactgaaatactatttctgctcaattctattttgtgaagtcaatccaacttttatagtcccataaatatcaaataaatgaaataattattgtcactaaagtggagaaactattgcttcttcttatcttgtttattttgtttgctacttaaattgacattgaggcaaattttaagtgagtttatgttgtgaaaccctgctaaaatttagaactcactgtagtttgttaaaatatgtaaaaatccattttaagtaagtatgaaatccattgaagatacttttattttttaagcaaccttggagtgtagattttaaagaatacttgtctggcaatatccatagcttaaaatatgtagacatgaataccgatagttgaaaattaacttatttaaccatttgaaaatgagatttattttgttttatccagtgaaaaatacaaaaccaagtagacattgttttttggttaaaaaggtcacaaatttatgactgtatatgttactgggattagaagtgttttccctattggtagtttatcaagtgagtgaatacctttctgtgaatgtgaacaagcttcaccaattttagcagttcaattttagagaagctgtgatgagttattttgcacaaaaggctttatctttcaaactgctttgctatctttgcttgacagagagaggatttgatgactttttcaaaactcccctttactgcttcacctgagtaatgttttagttgccgtgtaataaaaatggagctgagaattgaaaggccaaagcagagggagttttatagcttgggatcttttaagtttcatggatttattttgtatttatatcctgggggggatgtacattctgatattgctcagtttttgtctgttggggaagtcagttgtccaaaatagcactgtattttctaatataaaaagagtaatgatttgccttttgtgagggataattttaatggtacattgcagagatttagttggggagaaattataggcattattttaatatttataaagtattttgagggccatgcaagaaggctgcatgtaagtacactaccaataaagtaacaccactaatacaattgagatactaaaaaaagaaaaaatatatacttaccatctagtgagcagagactttctttccctaatttgcatttagaaagctctaaattaaaatgctaaaaggaagacaaacaatttcagcacatgctgctggttttgtaaatacaacttgctgacttgatataattttaaatgaatactcttgacattaagacatcatgctttctgatcatgtattggtaagccacagaacaacagaaataagcttgaaatgggcatagtttttaccatagtgtaactttaattgcatgcttttatatcttcaaattaatttttgacatcgctatacagaaatagacttgtacaaagaaaaatgaataacttgcttatctacaagagtgtcattttacttgtgaaccattgtaacaggttttttgtttgagcatacaacaaacaaaatatgtaatgttgttttatcttccaaaaatacattgctgtataataagaaattgtcattttgcaataaaagaaaaatccaccaaactggtatatatgtgatttattttttttttggtcaaaccctgtaagtgacaaatttgacatttaatgctatattgtaaactatcaggtatctttttttcttgcttgttaacatagctatttctcacgttttctcttcttcaacttctttcatgcctcacctctaaatccccaaagtacacaccacacaaacacttagagaaacataaacatgcacatgtttgatgacctacctcataattcattaacaaatctagaagcactccatcaagagccccttcatattcccttgcaaaatctatcaaattgtcctgtatctttattgatattatttcctgttaccatggacagaaagagtccctgtacctatggaagagcaatctgtccacttgtgccctggttcccattcctcagtgatttagctcctttctccatgccatatttattttctccttctcaactggggatcattttcagcagcatactaacatgctctagtgtctcttctcttgatagaaagaaccactctcgacctcatagctcactccaactattccctatctctctgcttctcagagagcaaagccccttgaaaaatttctctattattctattagtcactgtcttacattgtcatctcactctcagtcccttccgattgaactttcatgttcatcattccacagagtctactcttcttaagaactccagtgaccttccatgtttgtggctcaattattattttaacctctcagcagcattttatatatttgaccattccctctttcttaaaggaaactatgatattggttctcatgacttcatactctcctgggtttcctccctcactagcccactctttctcaatttgctttgttcactgctttaattggttttcacatatgttttggagatggaaccaataatacttgctgatgaattggatttgtgcgataaaagacaaaaaggaagcaagaaagactcctaattatttggcctaagcaactagttgatggtaccatttattgagaaaggaaaaacttgggtggtgtcagggtcaggggtcaagaatagagagttatgccttggccatcttacatttgagattttttttctagactgaaatcatgttggaaatgttgtttggtaagtagtaactagttagagttggagtctagaattccagggattagttatagctagaggtatcaatttgagatcattagcacatcgatggtattcacataatacatcgggttgaaattactttgtgaaagagtatacatggagaagagaaaaaattacaggatagaagccctgatgcattctatcatttacaggcctaagaaaggaggaagatccagcaaagcaaattgaggaaagtatgaccaaagaaagtagaacactgtgagtcatagaaccaaaataagaaaatgttctcagaaggagagtacgatcaaatgaatcaaatgctactaagagtttgaactagatgccatgttggtgtgagttgaagaatacagttggaggtgagagagtataagcagtttggctagacaattcttgaaaagcttggctctggaggagcatggagaaggtggtatgtgggaagggtatggtattagggtattttaggatttttttttttttttttttttttgagacagagtctctataggccaggctggatggagtgcagtggtgcaatcttggcttactgcaacctccacctcccgggttcaagcgattctcgtgcctcagcctcctaagtagctgggactactacaggtgcacacccccattcctggctaaattttgtattttttggaagagacagggttttgtcatgttagccaagcggtctcgaactcctgacctcagttgatctgcctgcctcggcctcccaaagtattgggattacaggcatgagccaccgtgcccagcctattttatgtggttttttttttttaatgggaaatatggaagcatctttgaatgctaatgagaataatagtgttggaaagaaaaagttgaagttgtaggagagagagaaaataaaaagtgaaagaaataaaagggaggagtcctagatctacaagtggaagaacttacctttgataggaggatccttttctcctttgtaatgggaaagatgaagatggtgtaaatgcaagtttatttgctggtggcatgattatgggtggggaggtgccatttgatagtttctattttctcattagttaggcagcagtgtcatcacctaacagtttagcaacagtgtagtatggattgatgtgaagtgaatcatttgaaaaaatgtgaagtaattatcggtatagtgttgctgtcattgctggataatagaaagtgttcccttgaaattgattattattactttagagtgatattactcttcccaattatgctattttctaagaatgccatacaaatgcaggcctgcaaaaacatatagaagcattaaggggaaagtgcattagataatgattactaatgtcaaggaatacatcttggaccatggaatttaaactagacagggaggcaagtgaggacaggagaggaatgatggatggtgggtcaaagagctggtggcttcattgacatttaataattggttcagcagggttacttgatcaactaaactggacctatagaaaaaaagatcatcagttatggtgattgaattgagatttgggaggttgtgttactttcggtggtcggggtgtgatgatcacaggattgaatggcagaggctgaattcaggaaaagatggagaagttaaactgagagactagaataggtctgatgcagatgatgaagtcactgaaaacaacagaagttagagtgaacaaaaagactgagtcagttgctacagtctttagtaaatgacaggggagtgactaggagatctgaagattaaatggaaaagatggagtagctgaattatgctacctaatacttatttctgtcaacaggatcatatgaaaatgaaatattggcaaaccaattactttatagaacgatgactgaatgaaaatcacttcatgcattgttagagatagcccaatgaaaatggattccgttgtgtttatctagttcagatagtacatttaatgagaacagtttaagtggaatgacatttatggtggttagccatgattataatgaatttttgaagcgtagtcagttaggcatatatagtaccctttatctataaattcatgttttaaaataaatatatatatatataattataatctgtgttaaacacttcagatatacaagttaaaacagcttaagggataaaataggctttttttttttttttttttttttttttgctgtgttcatagtaacactatataaaggatttacttgaaacatttcagtttgctcaagttagccaagtatatactttggcaggtgacaaggctcaataggagtccttgtgttttaagtcttggttctctgtgaccgtgtgacctcagttccataaaccaaaaaatcaaatggttgtattaggtacttttaagggatcctctgactttgttctatgattctaacaaaaagaaatttgaaatatttgtgtggaaattgtatcttagcttttatcattgacatcataatattatgtggtatatatctctgtaccccctttatataagattctaagctattggtgatggtgtgatttaatacttccggttttccttttattctgtaatataatttaaataggtattaaataggtattcaaatgatttcctttcaagcaagaccaggaaaacagcataatatagtacactgagaaacaccaagaaagaccagttatacattaccttgtatttgtaaatcatttcaaacctacagaaattgcaagattaagaatactacaaagaacacttgtatatatcctttaccctactcaactactgttaagctcctttttctccttctctctttccctcttccttaaccctcttccctctcttttcctgccttctttccttccaatctccatctccatctctatttcttcttcagcctcatttaatgtggaacatttccacagccattctttgtcttttatgacatcaacaatttgagaaatataaatctcctttttagaaacatagcattccttatgattagattcaggatatatgttcttagccagaattcagcataggtgatactatatgaggtatacacctggaggtactcactatctgtccacctctcattggagaagtcagttttcgattaaggtattatgtaatttctctagtgtctaattaactctttttttccttggaattaataagcagtctgtaggaagacactttaagaccatgcacatatcttgctcctcatcaaaatgttcccctaggttatctaacatttatcataatggttgtaaaatgatacgtggccaattacagtactccttccacaaatagcggttggcactcagcattctactgtaagcaagacctctcctttctcatctattatttttacttattgatagatttattattagtatgaacttataaattcccatttttcaatggtttatagttcgttactgcaatgcattacttggtgctaaatttttgccagatttagccagtgagagctccctcaagctgttcctgtgaaatgcctacattttttttttttagcactaccttactttttgacatacaaagacattttagtttcatcttgtagctactctcgcacaatcttcttttttagtgggaaattgtacctggatgctaggtgtgtgctcattgctactggaatgcaaggaaaggcaagttacttttaagttaacagacaacaaacattaaaaatgtaattagggcatgactttttagccatatcataggattgtacttttatatatgtctcatcggtttgatgcaggtgagaggtaattttgagcccatatatagtagcctaattataattaataattttaattttttaaagtaataatgtgtgaggtgaaggagtagcaaatacttactttccctaacataagaaaaataccattaattgatctaacggccatatattcatactctagttgagttgcctcagtgactcacttaataaaataagaaattaaaatgtcaaatagaattcgacaagagattttaaggagaaaacagagtctgtttctacctcagaaagttagttaaacagtagcttcaatcatctgctatggagtactacaggtgaagaaaacaattcttgatatttgtttatattttcaactttaaaaatcagattatggggtttcatagagtttactcaaggtgtggtagttctttgatgtttttaaaaatatatctttattgtagttgggacataatattgaagaaactaatttctacatgttcaatgaattgaataattcaaaattcaattcagaactcatacactcagtgttctcctttattttgatatcactcatgtttattttaaatccttttctcttcctaagcatctaattttttcccttcattcttgtattactttataagtgatcttattacaaataagcatacactgagtcattgcaacagaaaagtgcttcatatactgagttgctttctgttgcacttgatatattaattgtgcacttactatatatgcaagcactgtgcaggcagctctatttctttaaaagttacttaaattactggtgcttccaatgaagctggtggtagggtctgttccctatctccaaactattagaccagcttgtcagatgtattactcattaggttgctaaggcgtaaagtcagaatttcagatttataacatggtgacatttgatgtttttcttttgtttattatcagtgctgtatctgatggtggaaacaactatacttttaaatcttctgtctcaaaatgtattcttcctaaaatttcatatttttaaccattaaattttctctaaaatatatcttagaattgatggtatacctttcccccctttatcatgacagtgatgatcaaatccttgctttgtgaaatattttcttgacatatttgaactgggtagtttttttaaataagtgctgttttttgagtcatcttttccttttgttgccttttgctttatgaataatcatgtattctcacttggttcattaagtagtagtagcataatgatgagagtatattaaaagaatttattttagattgacccaatctatgtgagacatcaacaacacacaaataatagaaccacgtttttttgtttttttttttttttcctcttctggaaagaaactactcttactactaacattgaaactagagtcatccttggactttattcaaatgtgtcagttttggaaaccatacaaagatgttcgctttagcttaagggaacagaagaactttgttatgctctttgagtgttacattaaactagatcattgcctgaggagcctatttaatatgtccatctgatttatgattttttttgtagtcctttttcctttgatttgtcttatctttggaaaagttggcatttatttctcttttattttttacatgctctcaatgaatatctatacattcattactttcagaaatattgcttgctgaacttaaattatttggaatattgtgttttgagtttgcaatcacggagtgaaggtggtaacattgtttctaggtttacagaatgattttgttaaaagtatcactttctgtaaataccttagataccatatagaatttagcttttggtcttatataatagttagaacactataaatgtaagtaagtttttattctcattgttattattgattcaaagagactttaaatttctacagcaaatcacattttatccctttctggacatctactatcattaaggtgatatcaaagactgaataaaatatttaagtcattaagattttaattcttaattatgcaatctcccttgccagggctattaacttttataatacagggagggtagaaattcagcagagacattcatttattttcttttatgaacaaggctgtatagtttgcattttttccaggtggtttggggaatatttaaatagatcacacagctgctggcttggtgggtttggggggtgtgtttagcagatgcttccagaatctggaatttgaagtattcttaattttatctagagatgcagatatctattctctggtttaatttgtcaggggatgactacttctttgatgtcttagtgatatataactgtcttgctttgtttttttttctttttttttttaattggccactcacctcaagcaattttaacagctcagaggatatatttactatagcctttaataattagatggctattcctattaaatagctgaatgtatttttaaggataatgtggggttctttaattagcttgatagtttacctataagaaggaaaatgaaaactgcagccagctgcatttccacagctcatttctgtgtaagaagcacgtatctgggctaaagaagtatcactttcttcatttaatctgagatgagacaacatgtgaagaacttggagcaatctgattttttgaaaatcttttctctcattagctgttttgctcaaaaataaaagctgtcaaacagcaggaatttgagatgctcatgattgtgtttataggccttcaatatagtatttactgaatataagtgcttgttaaagccaatttatctgttaattcaaacaatttattgaacacctattatacaaaagatactttgctaagtatttttgaggactatagatgactaagctagacttggacccttacatgtaggagcttaatgttcaagaataagacgtgttcaactataccaaacatgaaagtcctaaaagtgaaatagagatgaagtgatactgatttacaaggaatgagagcagggaagacaaggagagacatgggcgtcatcatggaagcagaggtaattgagctgtgcctttacagctgagtagatttagacatttaatactatgtttgagggtgggggaaagatattttcagcagaataaattgtatattgaaaaccctggtgcttctaatgtcatattcccaggcaatagtaggtatataacatgtgggtagactacaaggttcgtgttggagatgggggaagcaggggtacctttaggggaaatggcagaaaatggtgttaaaaaggcaagattgagctggattatgaggtcccttaaatgctagtctaagaaattcagactttaattgttaagaaatttggaagcattgagggatcttagaagccagacaggagcagagctgtatttaaggaagtcaaatggaagagtataagatgagagggcctgagagtctgaataggcataatgcctttgggaatgaagatgagaagaataagagcacaaatgctgagttagaatctctaggagtagggaatttattattgttgtgcaatagggtatagggaagagttaaatatgattttatattaaacatgcttattatttcttgtacatttatctgtgggactattttagggcctagcatgagggttgatatccttcagaggagatttatgtttgcttttgctgggttgcaaaaccaacctaggctgatgttaatatttttggcttaaggttttcttttttttaaagactcttgaggagctatgaattcaggctgcatgaaggctggctttggactaggaaattatcagagaagatttttactttctccatccagcaccaaggtttgttatgggcaattttcttttcaggccccatgagagatgagcaagtttatttctaatttactgttaaactgaggtgtgatcctctggggtttgtaggaccattacctattactctttccactttgattaggccctaggcttggtttctattgccccatacttgaggccttgaaaactgatgctcaagttcatctgggttcagaatattcactcaaggtcaaagctgactccactgatatttatctctctaagtttatctttcacttagtttttggcctccaggtattccttactttcttgccaggttatctgtacgttttaaattatttttttaaatattcatcatgttcagttctcttcacaggtagttgatatcagggtacatattctatcatactttcaggaacagaaattaaggtgaccccttcttacatggacatgtgacatctcagaatgactttattcttgttatagtttcctaaacatgagatattggtactagaatacagaaattatggtacctggccttttctgatgtaacttagttttttattaatactcatttttagaatagggaaacacgctattataactacctattgaagaatcagagtgattcaggaggtgatttcatgggcaagaactatgttctgtcgatagttcaagtttccagtccctctttcacacaattcttcccttctccattcacaaaagaaataccttaaaagagaaaagtctaagaaaaaaatcaatacagtctacacagatcattatcttattaatggacctttagtaatgaatgtacatgtgctttgtgtggatatatgtgatttttgatttttcagttcaggactagagggcattgaatgaaagctgcctgcatgcagtcacttcaggctctaggatcacccacagtggctctgcttatcatatagagtgacttgacattgtaggattttgccataggaaaatctgtcttagttttatctgccaccagtaatgggttttaccagggaaacacatatgtcagctgttaagtttcatagtagtgatggaaattgaaaacataatcatagattagccatttttaagtgtaatatgcaccaatgaatgactgtgacatcttaaatgcattttgtttatagatatagaggttgaaggtcaataactggaaaggctggcctttaatttgttagattaggatacaatttagtttctaacatgtataatttaagaatttttacagtttggcaatatagttctttcactgaattcaataagctttattttcattgtctactatgtgtcaaattggtactactttctagtgatataacgatgatcaagatattgctgatggctttgagtgactcacacttaatggaggagccagatatctaaactaatgatagtgcagtatattaagtgctacatccaagatagggagaaaactctgtagaggcccagaggagggaataattaattctgcttggaagagttcaggaaggcatctcaaaggagatggcattttagcctagccaaatgtgttcaggttgagaaggaatggaatataaaaaacattcaacaaaggtattccgcaaaggtatacagccttgggatgtcctgattttgtctaatagtgagtaatctggtttgggtagagcattgggacaccagggtgctattaagttaatttggagccagattttaaaaggtactaaattccctacttattacttaagctttatcatctacatagggagaaaaaataaggataagtaataatatcttaacattttaaaaagataaccccagtaatgaatgtgtagaagaaattggagtaaaggggaggaaaaaaatgcaaaacaaaacaaaaatcggagtgactactgtaatttcatagctcttctatacaccctaatacattgttatagctgttcatttgtccatctgaaagcaaagactgtgctttaatcttttctttctttttaattttatttatttatttatttatttatttgtttattttagcgacagggtcttattccgtcacccaggccgccatacctggctagtttaatttttttttttttcacttttgtaaacatgaggtcttattctgttgtctgggctcaaaggatcctcccgcctcggcctcccaaagcgctgggattacaggtgtgagccaccacacctggcatttaatcatttttgcatttacattgcttgtatatgatcatgcgtgttataactgtagaataagtgaattaatgaatgaaagatctaagcaataattattgagggctctaaacagggcagtagaaatttaggcagaattttgcaggtagagggcaggcttagggagagaagattcaaaaatggcttgaacatttcttatttctatgctatatattttgttatgatgcctttcactggagtagggaacagacacaacacttctcaggtaactgagaatgagttcatgttggagcatatttatttggaggtcctgtggaagagataagagttggatttatgggtctgcaacccagagggaaaaacctgggctgaagatacagatgcaagaaacataagcacatagattaatgattgaagtcagggtagtggattgcacagggcaaaaaatataaagtaaaaaggctagagcatggggactttggggtcactaatatataaggagtaggtagaagtagagaatacaatatggaaaacagactagtcagaagcataggattgtttatcagagaagtctggtctttgaagtcattgagaagaaagtttcaagaaaaaaactattagtaatttaataaattcagtagcttcctatatcgatgtatatacatataggtaaatatgtaacatacttatattaatacagagttgaatgatagcaaggtcactcctatctgttgttatcaaatttcagatcttaaaccagtaggacaatttctaggaagaacacttcatgattcatttctcaactaagagaatagtgctcttatttttctagtgatcagcttgaagtagtttttttcattatgtgtgtttatgccttgcagtttcattgattacatactttaaaaggttttaatgtggccaagtattgaggatgtagctgtaaaagcctttatgtggtggtaaactccagcatttaataactgctagaaatgcaacatcttctctcttattgtatttgacagtttttttgttattattttgatactctttattttgccaagagttaactcattcctaaaggtattttatgccagggaaatttcattccactttgtatagtaggctaggttttatattaacctttgagtgtgcatttttactgtggattatacattactggaattacttaagcaaaattcatactgagattctttattttaaaactgataatgaccatacgtattaaagggctagctcagaaaactgccagcaaataatcatctttgcctttgggaaataatgaagtcattgcatcgtgcttgaattaccatagactatatcagcagatacactcattgattcatttctgttctttttgttaaaccaaatttttctttcatcgtttttagtaatgtaattttctatgtctggtatgcttacctgtaatttgacagaaccccatttctttgtatatctcactctattagactacatgtagtgcagtgtttgtagagggggccattaactaggaattgatatttacaaaggtgcctattaagtgccagtcactctgctttgttttaaacatagttcacttaatgaaatgataggcaaatatactaagggagggaatttgttgtagtggaatgaatatgcattgaaagcataggtttgatctaggtttgaatcccagatctaatagtcatttggtggacgaagtcacttcacgggtctgagccgaagcttttgtatggtaaaaatgggatcctatcttgaagagttattatgataattaaattgttgagagatacaatctaagatattcattaaatagaagatatataataacatcattgataattactattagaaaggaaattagacgtttgctttgctttgagtgctattactaaatgatgagtcgtatgtggcaaaaggagatgtggaacgtacaggcaatcgccttttaaataaaacctgaaacaaaaattatttgaaatgttagtttggcagttatgttggattatatacgtttcttaaggctagtgacttgtttcctggaattctttcacttcatagggtaacaccttgccccctactaggaacttaactatttctttaattttattacattgaagctgcttgaggaagcatgcttttttcactaaaaggacccagcaaatttcattctttcattggaatattttctcttaatatgactgcaaatgcagttagtaagttgaaaaagccacctgttgtcgtattggcaggccacctaactggtctgtctgtacttggtgtgcagggaagcttgaataactaccattaggcctgcacagtgtcagatttcacatactcatgacaccgtaggtaattgggtgacagccagtttatttcaatcagctaatgttatagataaatacttcatattttaggttagccctgatatcacagaatggaataatgttctaatcctcattagcagtttgttatgcagcaactttttgtatgccaataaaaatggcataggctgctgcttcggtggcatttccccttgaacatgccattttattcatttgttgactcagatagatggagttgtcatgtttctttgttggaaatgttgacagaaccttgtgggctgtgcttgtataaacgtttggttctctaaacaataattttcagtttagctctgttgctactgctacatgctatttttctctttctgtcacattgggaaattctattttgttgtcagtaaaaaaaaaaaaggtgtggtacttgcttactgtctatgtagactttattttgctagttgatttcattaaagagtgattccaggaagctttgggtcattgtatcaccttgtctcattccattatatgtattgatgcaacatggatcgttgaacagtataatctcttttgcacagttcctattgattttatccagtaaatcattgtctgctgggtttgttctgaaatcattttgtgcataaaaactattcgtgaatttgacaatcaggtgccttcttgtaatagataaacttacacaaaactggaatccagtcactttttgtctccttcacactatatagttatctttcctactaaactgatcaagtgagtgatctctattcagcaaatgtttctattccctttctcatttcttgtaatatggcttctcttatcattgctcttttgaaattgctctgtatgatctgaaatggcctattttcttctggtctttttttttttttttttaagtatttagactatgcttgaccttcctgctacttttgacactgttgattactttctcttattgaaacattttcctttctcacttctgggacaatgaactcccctgtttctcatacctttttattgttctttttgtcctcttaattggctgttctgtcttctctgggctcaacacttcaggcatcctcactacttaggctttagttacaccttgaagacagaagatcatcactttcacatttatattcctgtaccctcatttttccactctaaaatttcacatattttattctcataatatttcctgagcatcattttctacataccatgagaggagggattgatgtgggagataaagttgtaccgtgaatgttctcttccctacaagtttataacttagataagtcaataagatgcatacatgaaaattaattaagtagggcagcatgtggaaaataccttttcagtgctaaaggtagatgaagaatgtagtggtaattagagaagatttcatagagaaagtgacatttgacttcggtcttaatggatagataaaggtttgacagcaaaaatgtgaagggagatgaactgaaaatattttacagtcattcaggagtcctgtcatacttttgctatcttagctactcttgtcctagtagactataggcaaaaatcacttaaaattagaaactgtaatctctccatctatattaggcacacagaataacagtgtacacaatagctcatgtcatatccataagatgttaaaaatgtgtatattttggaggcgggacttcaaggatgatgctacctagaagtaactattttattttctgtactcacttatacctattacatcttatgtgcttcagttttctttaaatagtgcacctggtatcagatataatctctgcctttttgagtgtcttatcagattcagttccacgaaatctaagtggaaagctagatatatagttgacccttgagtaacatggagattggggtgccgaccgcccgccatgcagttgaaaactcgagaataacttttgactcccaaaaaactttactaatagtctactattgaccaaaagtcttacaggtaacataaacagtggattaacacgtttttgtactttatattgtattttacatgtgttacatactgtattcttacaataaagtaggacagagatgaaaacgttgtgaagaaaattttaagacagagaaaatatatttactgttcattaagtggaagtggatcaccataaaagtcttcattcttgtcatcttcatgttgagtaggctgagaaggaaggggaagaggagagattggtcttgctgtctagggtggcagaagaggaagaaaatttgtataagtggacccttggctgttcaaacctatgatgttcaagggtcagctgtattctgccctttttcattcttcttcatggattgtcacagccaactctggaatctatgttttttaactgatattttagtaaaattttccattaagaaacaggaatttattgtatcttataagccagtttgaatttttaatttgattttattacaacacttttgttccaaattttacgtatttacttcctgctctgtctctgtagttataaccagttcttaagttcagattcaaagcattctgcgctaaaagcagaggcacactttggtggcagccatgagggaagcaacaatgatcccccacagtgataggactgaagtggctggggtgaagtaaaggccagcctaatggcgagcacagcaggtttgaaatagtttgctaggaaaaagagtcagcaggttgctgtcctgatccagtcaaatacatatgctgtctgcgactattagcagttgcttcttacctggctattatcttcaataagtttctagtaaaaccttcaatttgtaggatttctgattttttttttttaacataaggcagatttcattctattctttatgagatgttttttattttgtatggtaatagctctatccgcagtctacagatttcagaaaactagtaagaatcttaggggccatatattgaggatccaccgtacatttgagttttgctttgccttcagatttagtgtttaatcttaaacattgcattcatcttatatatgcctttataaacagtataggaccctctattatctaactcttggctacaaaattaataagaggtgcacagtgggcaattacccattattttactataaatgactagtcttatgtttttgttctatattgtttgcagtaatgttatgaatgctctacagcactgaatatagtattaaacggtagttctcacagaagacggagtttgtcatagctgagctgttatccaacaattttttttttaagttcttaaaagcttacagtccaaactgtttctggcatttagttgaataaatacctcatggaaattcactgttaaactgaaactacctaagtataatatatttcatgatacacaaacgcacacgtgcgcatgcacacacacacacacgcaacagttgtgattgtcaatattaaaagtaaactcaatattaaactgagtttactttttggataggtttcataacaagttgactccatttactttgataaataggttacatgttaaaatcaggtttattttcatagatagtatcaacatgctacttgctaactgaaacggaccttgacgtaaagcagagtattagactcaggaatgtgcactttcagtagaatatggtttctgagatctgttgctctaaggcccacaagctttaaaatgactacatggtgtccaaaagcaatgaaactaagctatgatgtgcttgcttaacattttgtctagctcagttctggacttttattagattgaattttctctcttttgaagactccagtttttaattgaataaaaatttttttcacttcctattttgcatattccaagtctttgcctgccttgattgttttcagtgacctggcagaataggtgtgtgtgtatagcaagcaagaatacactcatttttgggctggacacagtggcttacgcctgtaatcccagcactttgggaggctgaggcaggtggatcacgaggccaggagttcgagaccagcttgaccaacatggtgaaaccccatctctactaaaaaaaaaaaatacaaaaattagctgggcatggtggagcacgcctgtaatcccagctactcaggaggctgacacaagagaattgcttgaacccaggaggcagaggttgcagtaggccgagatcgcaccactgcactccagcctgggcaacagattgagactccgtctcaaaaaaaaaaaaaaaaaaaaaacgctcatttttaactgcttttgatttccttttcaacagcagattattattattttttcttttcccgtcttctctacccctgtgacacctgtacctataaaaggggagagaggcagtggtatcttatattcattttagtatttattatttacataaatagttttaattaatgcattttatgcattcttattctaacttattctaagaacttatatatccctagcacagtgatagattttacaaatatgtgcaagatccttgccctcaatgatatatctagtttgtaattgatttaaaaattaacggagtgtaccttgaggatcctttgttctttcataaaatctcattatttgtcattcctatgagaccaatggttgaccaagtattgccttcagtgttagattccaagatttggaagatattataaagagggctttcatgggttactgttaacaatatttgcacttttctatttgggaagtatttattgagctattatagagtgttgtgttatgtactacagagcagattttctaaaccttgctaatatttggaattacctgaggagctcttaagaggtacaggtcctgaggccctacctgcagagatttcagcatgctaattcagtaggtatgagtgtgttagaattcagatcacaagtaaatgagagaataggagggaaggacagggagatggtgtcaggcattcttctgagatgcttggtagtataacaggataatagattgaggaggaagagggtagtgagtctgttcaggaaacaagagaacttaaagcttatttgaattttattctcgtatgtctttttacatttccaaaatggtctcaaatattacttttctgctttcaaatagaatgtcaccaacagactaaacttgacttaaaaaaagaaacaaggagccaggtgtggtggctcatgcctgtaatcccagcactttgggaggctgaggtgggtggattacttgaggtcaggagttcgagaccagcctggccaacatggtgaaacccagtctctaccaaaaatgaaaaaaaatagccaggcatggtggcaggcgcctgtaatcccagctactcgggaggctgaggcaggagaatggcttgaacctgggaggcaggggttgcagtgagctgagatcatgccactcctctccagcctgagcaatagagggaaactctgtctcaaaaaaaaaaaaaaaaaaagaaggaaatgaaatcttcaggtcctccctatcttactcttctcagaattattctaatgttttgatcacctgcaacagtatacactgatgtggtttctgaactaaagaaaattactgctgaaagataaaattgaaaccagttggaatccaaatggggaaaacagggacagtctaacttgatgtttcccattgagctcagccagcaacaaacaaattgagagactcagtaatatttttatgtgcatagaataagaactgtattatatgaaatacaaaagtctgatttatgtgtgtgtgtttgtttttacagaacttgctcttcattttattataaaccagtatgtcccaagtgaaacattaccgaacactgtagctgcttatgagctctcattcaaccccaataaggatgggatggtagaaactaattttttaattttattaaagttgagctgcgttttcagtcattttacatgaaaacgtatgtgagactatatggggaataaaataaaggacagttacagtttttgatgagataattgatccctgtaggaatgacacattcaaaaaccatgaggagtataaatgtgtttgattatgtgtatcctacttgaaaaacagaatgtcaacaattatagcaaggagcttctagatcctaatttgcaggggtagtgttgaacattttctcatatttgcaaaagtggaagcaagtataaattgacctcagttgcagaaggaaggggataaggaatcagacatttattgaacatcttgttatgtcaggggtttggaaactatggtctgcaggccaaatctagctgaccaactatttttgtaaacaagatgttattggaacacttccatccttatttgtttacttagtgtttctggctgccttcacaatacaatagcagagttgagttgttgcaacaaacatggtataacttgcaaagcctgaaatattcactatctagccttatagaaaaagttcgctgaccttctttatgttactggagcttttacatgtatgtgccatttctttctcacaacattcctatgaagcaggtgtcatcagcacatggtataaataatctaaatttcctatacttcaaacctgacgaatacatttttaatacccacattttcaaagtcctgaatccctacttacatgatatctaaaatttgtctcaactgcttttcaaagactctcctggttgattctgggagtctttgggaatggaggtgatcagaaactaatcagctaatgttctttggctttggattcttcctcttgcctatgccttctgtgagcatatagctccactctacacaaccattttttttcatctggcaactcctctgagcccttggattcctgacataatctccaaccctctcactccagttctttgtacataagttatatggctggactagataagtatggaacacataccccacccccctcaacaccattgttccatctctcgtctctagtctttatcttcccctgcaaccataaaaaattaataacacccagcacctcctgcagcaatcaccaaccatcaaattcagaattatatttcaggcaaataaggataccaagccatgtataatgagaagaaaccacagctttgagttaatattcaggaaggcacagcaaaacactttgattagggccacaaggaagaactctatgaggaatattaaagtgcggggttatgctcagcatctccacggaagttttttatctcaaattatttagtaataatatgtaggaggcaactgtgagtctcctagtctgaaaagtcctacattgtcaatttgagattatggctacaaatatttcagggtgttactttgttgagtcttactcagcaaggttaatgtacgtagcattaaactgaattgtgtgtaggatctgcaccaagctgagatggaccatatcaaatcagaaaagcctgtgtgtgatgaatgcccagactgtattctcaacaagaattgtcctattggcctagtgatactggtttttgtagcatcgcaattcctacagatatgcctttcttagtactttgtttgatgcacttagctcttggagttgattgctggactcactgattcgtgacaggaattctgacatttaaaataacaggaagttctctgaataaatgggatagccagaaaaatgtcagttcgtacttagaaagccagagacaaccagtgggtaaagtgactgacttgagcttgaataaggtaattcatataggttaaaggttaacaggaaaccaccttgacaacctcatttgtcaaatatagtcatgtaccacaaaacgatgttttggtcaacaatggaccgcttatatgatgatgattccataagattataatggagctgaaaaatcccaactgcctagtgacatgtagccattgtaacattctagtgcaatgcattactcacatgtttgtggtgatgttgttgcaaacatactgtgctgccagtaatatataagtatagcacgtacaattgtgtacagtacataatacttggtaataataaacaaccatgttactggtttatgtatttaccgtatttttcattgttattttagagtgtactcttgttaaaaaaaaaaaaagttaacagtaaaacagcctcaggcaggtctttcacatggtattccaaaagaagtcattgttatcataggaggtgacagctccatgtgtgttattgccccttgaagaccttccagtgggacaagatgtagaggtggacgacagtgatattgatgatcttgaccctgtacaggcctaggctaatgtgtgtgtttgtgtcttagtttttaacagaaaggtttaaaaagtaaaaattttaaaaaagttgaaacaggaaaacgcttacagaataaggatatagagaaaatatttttgtacagctttgcaatgtgtttgtattttaagtgtgattacaagagtcaaaagtttaaaaaaaacaaaaagtttataattactataagctaagtttaagttattattgaagaaagaacatttctgtgaatttggtgtagcctatgtgtacagcctatgtctatagtggtgtacagtaatgtcttaggccttcacattcattcaccacttactcactgactcacccagagtactgtccagttttgtaagctaccttcatgctaagtgctgtatgcagctaaaccattttttatcttttatatcataattttactgtaccatttctatgtttaaatatgtttagatatacaaataccattttgttacaattgcctacaatattcagtacagtaacatgctgtacaggtttgtagcctaggagcaataggctactaacctgtgaagtaggctataccatgtaggtttgtgtaagtgaaccgtataatgttcgcataatgacaaaatcatctaaagaagaacttctcagaatgtatccacatcattaaacaagatgtaagtgtactactttgaggtaaagaccatacttcagttttggtatttaagttaccacttcaaacaagggaaattcttccctaaaacctctaagacaactttatttgtccttcctaaaatatgcattacctgctgagttattgaggcccatttgaaaatacacaacattagctatgcacgctgttaaacataatgttctggtgacatttagcagtgttcagtaattggcttaatgaacaggtgtgcaagtatattagttatgcagatgttaatttgcagtaacatgtgcttcctgatttggggtgttcttgtataaactacaaccagtaagatttgttccttaattaggaaatcactacaaagtatgtctgtgttatccctaccattacaaccattagtcttgtttaatgtgctctgaacttcagaaacattcttagtaatgccattcctattgcttcaggtactatgcaggtgtcagaatgaaatctacctttctgtgggatgccttggttagtgtgcagctgtaggcaacatggagaggggaagcttcgcagctgtaatatgtagcatgtgcaaggagacagaaatggaatctcttcctgcctattgcatcagctttccctcctaaggtttggtgaacacatgtgttattcctcacaaaacagactcgataacaattgaacacaaaatagtggttccttacaaacagattcatctttaccagcatttttaattattcttttccatattgtttgtaattcctgtctacacttggcccttgggatttccaaggttaacagtttgtaaactataaaaatggataggaatgtttgtgagatttattcatatgatttttatttttatgtcaaaaaataggaaattacaaaggctaatttagcaaacgcccatctaccagccacccaaaatgaacacatgttaacatttagtcatatttactccaggtctttgcttttaaggaaataaaacattaaagttaaaatggaagtttccaaggttctacctattccagcattagattcctcctcttaggcaaccactgtcattaactggtgaatatctagtctatgtttttataattttgctacatatatactcatccatcaacaatacgcaagattagtctccgttttatttttaatttagatgaaaattatactgcatgtaccattttccatagctttaatttttccactcagcattgtatttggcatcaatccttgttgaaatatatagctgtaatacaatcactgtaaatgctgtgtgatattacattgtattaatatgccacaatttatccatttcataacccctgggcacatgggctgtttataacttttctactgttataaacactgttgaagtgaacatttttgtctccttgaccacttgacctacaagcagaaatgttgggctatgtttatgacaagcataccttcaaatatattagatgttgatgcatgcgttttttaagtcattgctgaatatttactgtcaaccattggcataatcaaattcttcttcgtatcttcatcaatacttggtattgtgagacttaaaaaatttttcaatttgatgactgttaatggtatttcttcagttattttcatttgcatttccctgatcactagtgaagttgagcatgttttcattactagctatatgaccttgggcatatgatcaagtttgtccttgatttcctcatttgtaaaatgacagtggttaatacctatcatataaagtggtataaaaattaatgccagatacagagcagatatgtaataaaaatttgatttttgtggtgcttgtgaagattgtattggtggttaccagtagtaaaactactactactgctgttatttttgttttttaatactctcatctgttgtgtattgcatatgtatttatctattgatctaatcttctttgccctttttttccatcaggttcatgtgatatttccagaaatgcatagataaaggtgattcagaatacagtagaaaataacaaaaaaaatcattaaacctgtcacatgcaaaaaccagagtagatttcccgtacctttcattgccattcttgcactcattttaatattatcaagtcattaattgaaattaaaatattgtatatttcaaccaatatgttaaaaaattatttccatgtagctggaatcacctctggaattgtatccacatggataaaatatgtatttaagtatatatggatcacaattcttatatttgtatgttatatgtaaaagaacaattggcatttacttgttaaatatacaaatatgtatgcgtgaagttacataaatatacaaatatgtatgcatgaagttacataaattttcagtgtgtttgttgacactactattattagctttatttaccctggctttgtatatagtgtacttttttgttagtttgttttcctgagacggagtttctctcttgttgtccaggctggaatgcagtggcgcaatcttggcacactgcaacctccgcctcccgggttcaagtgattctcctgcctcagcctcctgagtagctgggattacaggcgcccaccaccacgcccggctaattttgtattttttagtagagacaggatttcaccatattggccaggctggtctcgaactcctgacgtcaggtgatctgcccgcctcagcctcccaaagtgttgagattacacccagcctgtatgtagtgtacttaataggaagggacatccttttaattctcctcatatttcttataatatgatgcaacacataatgtgatgctgattcaaaggtatgatgttccctatatagaactatgcttgcactaagaaaatgagaatttactgagtggtatacatgtattcatctaagctatattttgtggatattttatggtacctaagctatatattttatggattctttataacatttataaagaaaattataaatgttaggtaccttttggggatacttccataattagtggtttacatatgaccatgcagtatgagtagatatttatgtgttgtgtaccattgtatgctcatgctaagctaattcatagtaggtgctcaagaaatatttggtagattaatgaatgtgattctggccatagaaatcagtctttctcactgaaattttaagataaagtagttatacaaattttactgtgattcatggttagttatcactatgtaaatcatgcaatgttgcctatttaaaatatcttaatacttgctacaaattataataacttgtcacatgttctgtgtatccactgggatatcagaaattaataggagattcctgaacattgcctatattaaattggggaaagaatataaccatgtttactttatttatgctgatgagcatttctcagttgtaaaggaatacatttatagtacaattgcttgtaaaaatccatgtattaaaggaaatataagaatactcagtgggcattttatcttagataatgagtatcttgatgttaacatatctttaataataatataaatgtcttcattattaggattatcttcctacagacagtattttataatgtttcattattattctattagcagtgccaatttacacactcaaattaattcaatatattggattcaaacccatttgcaatatgttttttcatttgtacggggaaggtctcgtttgactgtgggcctcattatgaacctgaggaccatagggcaattgatgataaaatcaattcatgaagtttttgtatcaaaacttaaaaaaactttttagtttcatccaagtaacttcaaataattatagaattgctatttatttaatgttttgtaaccattagaaacatacagaataaaagtatcctaggataagtgacattttgaggtcactatgaaagcaggcaatttttaacatatgatgtgttgaacactatagggatatttgatgtctcattgctgttctttgaattctctatttatctaagcctgtggtcatgatccctaaggaatgcttttaaaacaagaaggccaaaggcaataatagccactggtctgtaattatttatcatggcaaaaatatgattagttctgaaagcctgtctagttagagaactgttctaaacttgtttttctctagtgattctcagaaaagcagtgcccactcatggaactcttatcacttttcgaacccaggatttaagccaagttatataacacaaggaaaatatgttgagattcaagaaagaaaactatgaactatagatatttagggcatctaatcttaattttaaacaatttgttcacttgaaaaggggagaggctagaccatattttaattaaaaaatgcaaaaatataaagtcattaaatgagcattatctattcctgggttagtcaggatcctgttagtttgcagaaccatctttataggtccttcatggcacaacatgtttttcttatatgtacttggctaattagtctcccatagtgaattttaaggcatattgagatattaggaaaattttcttgactatttccttgactgggttcaaattagtgaatgattctagaagtaatttcaatatgattcagatatttcacattttatagacaaagggaatgactattggactgtcattttcttgtatacaattgtcttaagctggaactggcttgacaattagaataaattaaaatgttgattattgcatatgaaagactctatgctcttagaaagatcctttgaagaatatttgagatatgttttaatgtattttaaaacatatttggaaatatatacagataaatatcaacataaaatatattcttttaatatattttaagagaaatacattaaaagtcacttttcttccagtagtagcagtgactattatgttgaatccacatggcaaactgcttgccatgtctcataagatcataatttctaagtataattatccattctccttagactgcacataactttagattggccagtctggtaaaatttagcactgttaggagtttagttatccaggtaatttattttattaatatctggtatttctgtagcatgctcatttaatttttctgtattttgtaccattaaaacaaaggaagtcttaacggacttccagtattttgatgaattctgtagaatgttgcttccaagatggtaacatctatgaacatattgcctaagtaaaagtgtactgtggttttatgttgctttttctctaaaaaagaaaatcaataatgcatttgtggtctttttaacaaagattaggtgaattaaaataatatcattattgcctcaaaatgaagttatctttttaacattgataaagcagcagcatgattatggtcatatatgaaccagtgatgtaatttagcagcatgaatttgggggcaaggacctaacactctacttgactgaaaaagtactagctttacttttcttatattttctgatggccccattacttacaaccctgtttttatattggaaaaggtaaactgccaacacttgagtacaatggtagctgtaaaatttctataccggaggggtttggggatttaacttaatgctttattttcatagcagacagccacattgttttttgggccggcctacttggggagttggctgatggaggttatggaaggctaaagccactccttggcactgctactccttaccctttcagtcctttaaactgtttttaattatactgttaccttctaaagaaagcaaagtaaatcttctgttctaaggaagcaaatagtatttttcaaatagcgagggatacaaagctaaattactcaaaagaacacattgctgagtctgtttaattacatgtatgcaaatggtgctactgttgtacaaattgcaaatggttcataactattcttcaaaacagtctcagcaggaatttgtatatggcaacctgtttagcagttaaacttaccttaggtgctttaaagcaatttcactgaattgtttaaattttagcatattttgagagaaatgcatgtcttccttttccctcaattagttcagattagtgaggttgtactatatatttaattccagtactgctgtaggtacctggtaaaggagtaattaatgttgcgtattaggtaagaaggagcaattgatttttggttcatttggcttatcttttctgcttaagtgctgatatttaatttgtagtgaaaactctaaacaactctgtatttttatgtttatcctcttccttgagctaatgaaatcaacacatttattgatttcagaatgagctttattaatgtagttaatatgccttactaatgttattccgtgtacttggattagtacccttattgtttatgaatcaacattttttctttcagttcaaaagaacgcagaagcattagaagaaaagaagactgggcctacaaagaagaaagtgaaagaactgagaattttggatcccaaaacagctcagaatctgtgtatgtaatattttcttcgtaggattggtataggtaacggtgagaggggtgggagctgtttaatgtatttaatgaaagttgtaacctttttaaacaggcatatttagcatcttctagaaacaaaatcctgtgtaaacatgatttggttgcctttttgtcacttagccagtaaggagaaaattctaattcaacctctgtcaggccagatgaaacttgggaatagtaaagatttggaaagtaatgataataaaacactgttggaggacatagtgaaacataaggcagaattgacaaaaagtgatttttttttccttctctctagacctgggattgatagttttagagtattcactagttacattggaaaaatccttctactgctattcctttatgtctgaagtaattgcgatgtgagctacttaaattgttaaccttaactgcatttaaaaactggttagtgaatcttgaagcctttaacaaaccagtcagccattaagtataccttttctaaagcagatggacagttaaacccatcttcatttatgtaagcctttaagttttaacatactcttccctctgtcttgaaatcagaatttttggtctgtcactacagtagactgtgtttagattttgctgatacaaaaacactatgcatcagagatttccacacatcaagcatgtctaattgcacaaagtaataccatgggagcttattttgttaaggaatgtggtatagggaatcattacaataaacaaaacatcattctcatgtcagtagaaatgttgctttcagagaagcagtttatcagtagctgttgtgaatgtgtacattgcttatttgatagtacattttcaaagttgacgttcagtacttttctttaaaacacagtaggatctcaattgctggttgatttctgtcaacattattcttttagattgtggagatctcatttggtcttatgtataaggtaatcatttgtctatagagtgaggattttgttttcttttggtatggctgaaggcatatagaccttttcatgaaaaaaagaaaacaaaattcttagaagtgttcaagttctgcgtgccgggcgcggtggctcacgcctataatctcagcactttgggaggccgaggcaggtggatcacctgaggtcaggaattcaagaccagcctggacaacatggtgaaaccccgcctctactaaaaatacaaaattagccgggcgtgatggctcatgcctgtaatcccagctacttgggaggctgaggcacgagaatttcttgaacccgggaggcaaagtttgcagtgagccgagatcgcaccattgcactacagactgggcaacaagaacgaaactgtctcaaaaaaagaaaaaaaagaaaaaagaaatgttcaagttctggtgataagaacacatctgtgttctttaaaaaatatgtttaatggaacatgttgttgcaagtaccttctgaataattgttagctattctaggtttaatttgctgaattattccaatatgatatcatagatttccatttaagaaaaagttggcaggggaaattgtgagtcaatatataaagtaagtaatagtgtaccacaggaatataagcaggaatgcagagcacactgatgatttaggcactttaatttttttcttatgtgggagaattgcagagtagatggatatgattttttatttggttattttattgtctttcctgagaaatactgtgttgggtgcatctgacaatctccacactaagttcttcattgaataaaaaggtcaacttgaaataaaatctcttaagttttcatgggtcattttgtgttatcatcctaatctaaaaggcataagcatgtagtcatgaatgctattagtaggaattttattttgtgtgtaaatatgcactagctataaacattacagcccgagaaaatatgccattttgtctagatggatagagtgagtagtccatcaaatggaacaacttttgtttgttcataattctgtatattagtgacaaatttcatattttgagtctatgaaatgaaaatcagacgtttattaggactttaacatgttgatgctgttatacttttaataaaatcaaattttattttagccatctttctgggatcatatcgcatgccatatgaagacataagaaacgttattctggaggttaatgaagacatgctgagtgaggctttaattcaggtaacttggatattttccttttgaaattcattttcacagatttttttggactattctcttctcaatggagttgtaagaaaattctcttctataattagatttttaaaaagacattgaatagtttaataaaatcaggaatatctagctgtgttgatagtaaggggactcagtatagaaaatctaggttctaattctgtttctgccacttataagctatatatccgtttcagtataagcatatgcatatatagacatatcattgtccattattcactgtacatacaattacatgtacttcatcaccaaaatggctgcattaagtgtatattgttcttaccattttatgggtgaaaaacctgaggggtcaagaggttaaatagcttgctgaaaattagtgggtatttaacatacccattgttaagttgagtatctaacttttacccaactctgtttgggtacataacatgtattgctgattatggctagcactttctgtattttttatttcattgaatcctacagtaatcctatgagataagcactattattctcattttacaaataaggaaactgaggtttagagagattgcccaatttcacaaagcttgtaagtggtgtaagttgcaaagtaccagaactaggattcaaaacaatgtctgtcttgactctaaagctgttatattattctgctttccatgaacaaactgtttaatctttctaaacctctattttctcatttgaaattacagggtcattgtgaggttttaaccaaataaagtgctttgtatgataaaggactatacagagctgacacattatttgaattcttggtatgtctggccctgtctggtttaatttttgaaaggaataactgtaaagatttctgtggaagggtatagtcattgtagttttttctgtttttctttattttgttgttttttgtttttgagccatgagttggttttgagttttagaaaacatcaaatagggccaggcatggtgactcacgcctgtaatcccaacactgtgggaggctgaggcaggcagatcacgaggtcaggagatcgaggccatcctggccaacatggtgaaaccccgtctctactcaaaatacagaaaaattagctgagtgtggtggtgcgcatctgtaatcccagctactcaggaggctgaggcaggagaatcacttgaacctgggaggtggagaatgcactcagccgagcccatgccactgcactctagcctggagacagagcgagactctgtctcaaaaaaaaatgaaacaaaacaaaacaaaacaaaaacatcaaatagttaaatagcttatgctataactttaacaattttgccatattccctgcaaactctaaatctcagagaacctgcatatataatttgagcaagtgatgtctctgtggaagctcttctattttggattgtaggcttacattaaagtttacctcatatatatgtcttaaatctaggcgtgatttttaaaaataggactcaggtgtaataagatgacctatgtcatctcttccttgtttttagacctccattcccttttctaagcctttatctctttatctttttcatgtatctgtatattttacccatatcctgctttacccaccaattttgtgccttctgtttgctgaggacttttttaaagccaacttgctttccttctcagtaccagatactctgaagtttcttctcaatccttaccctgtttgatcaaaacccattttcttagttttgcttgtgggaagaaaacagtttaacatgtagtataatgtacataattggaattgtgctacttgggtacgggtgtagggcctaagtggcgagtaacttacctgagttattaaggttagtattgcttttatctagacaaatcaaatgtctgagtatcttctggtaaggaggatggatgctcctgggtagaaataattacatgattttctagtccccaagagagatgacttccctctgtcaggagaaaagactataatcactagcacctttttctacccccaattccagaacatttgtttcagtgatggaaaagtaacatcaatttgccattcatttgagctgtttaccatttatgtctaattaccatgtagcacatcgataatgcatggcattaaatgtgtatcatcagattaactttgttgtaagttctatttgattacagtgctaaactccatccatgcataattattgttttttgctcatgtagcatggttgtctcctcatagcaacaaaaacaacaaacaacaattaaggatacatcacttcccagaacttgaattaacagtagtagtattttctcttccagtatgggtcaataggctcttgctgggcagacaactgatagaatttagttagttggcaggataattgtcttacttaaaaaacaaaaaacaaaaaacagaaaaacttttatttaatcagcaagatccagctctaagttgaagcttattaataaatatcaattttcattttatttcaaaatatctaaatttaagctagaaaatgagttctctatgtgggaaaaattgaaatggcctaaaatacttgcagtagcacgtagaaacatttaaaagtacaccatatcctgaggttgttgaggagtttttaatacatgtaattatgagttactgtcaaataatgtgtactaaattttggtgacttttagaatcattattctagccttcaaaatttgtttcagtataattgaatttgatctattgagagaaaaatctaagaccaatcagtcagtgctttttaggatatcagtggtaaaacagaaatatgtatagacacacatatagagcattgacagagtaatgaaacgagcggtttgaaaaaagtgatgcatgtgtgaagggaaaaataaaagtatgttctatttgagatccttagtgcatgcaaatgattctaggtagggagtttatacttatattcttaaggaatatgtgaaaaaaagatgatcaacataaaagatagtgtattattactgcagaataatttgtaaagatatgataaagcataggttggtaacctggagttcaaagccctctttggggacccatggagagaattcagggggtcctgaacttgtatgcgaagaatattacatctttattttcattatcttctaattaatatttagcatattatttaagagtataggcaacagaccaaagtagtattaacagtacctctaagtttttcactaatagaaataataaatattttcatatcacattatagttgtggcagagatcttaaaatactgttacagtcattaatgcttcaaaattacagtacttattagagctgcgactagaaattatttttaatgctttaatcaagcacttctatcattatatcactattttggtaaatatgttgataactatttaaatgtaattggtattttatataatcctatttattttattttatcctgatatagaggttcacagaaggtgaactgtagggtagggtgggctgtggttaaggtagtcttcctggaagaagtgttctagactttgaaacactagtaggattcagttagagagggctaggataggagaatggtggccaaaggcttgaggtatataaaggatactgtctttatttttctggtatagataagccgtcatatagggtagcaatgagaaagagcgcataaaagattagtagcttggtggtggtcatattttaggggcacacagatagcaaattggtgactcacaggcattcacgctctctacctctcactttctctccctcacttctgttttatttggcctttctagtgcctaatcagtgaaattttaatgtcacacactctccggtttgccacaggtgccaccactccctattgcattttacttactctgactcattcctaacccctatatacaccagaagttttgatccctggtagacaacatgaatgctgagctattgagtttggtcatggtcaaattgtgtgcttaggaaaggtactcttagctgcagtacatcagatggcttgatgtaaagagacttgacatagggagatcattgcagtttcaagcataaggtgtaataaagccctgaatatttcagaagtaggagaaaagggaatttgggtaaataaggaatttttaaaaaaattattaattgaaaaatcctggtggtagagacagtggttgtagccctgacacaaacaggcaaatcgggtaggggagaaaatactttcagggcaagggagaaaaattttacaaaaaacattacattggaaaatgtattggaggtcagaatagaggctgagactgaaaataaggatttttggagtcatttacaaagaagtgattgttagaatatcaggaccaatggagttcttaagtttcctcatgaaaaaagtaacaaatggaaagttaaggactgcatatctggggactatacatgtcaaggggatgggagctattagagaaatcagagcaaaaggagtcagcatatcagagagatggccaggatgctatagtgtatcatcaaagccaacacaagaggcttttaaggagtgatgaataagagaatgagattgggagaagagatatttccttcgatatgtcagattataatgacttatttagtttaaatagttatttttctatagttttttcttgaaacaatctacactatataccagacacctgtattccttaagcaactgttctgtttattcatggtattttggtctctgtctcccttataagggacatctgcattcctactgggcatgcaactgtctggtgtcctatctattgttcttcttccacttgtattgttttttgtttgtttgtttgttttgtttttgacatttccttccttcctttcttccttctctccctccctccttctttcctctcttcctgctactttctcttacattcttttcattcccttcctccctcattcccttcttccttccctcccttcctcctctcctccctcccttcttttcttccttccttcctaagtaaattctttctttgatgaaagaccttaattttccttaataatacctaaggtgaaatacagctcctggatgcctccatacctggaaactacagaaatacctccatagatgtttctctacgatgcatacatgggactatgccagcttgcttctatcccccacaatccccctcccccgccccaccaataatttctacatatattggctgttttacttttctgaagcccatttgagtaaccagcactgtactcaatgtgtggtatttataggttgctacacgattatgttttctcaaatgtgatttttatctcaaaacagattatatgatctatataacttattattggataccgacagaataatcagaatgacacgaagatcatctagtccattcccctgattccaggcaatgctacacctaagtcatcaaagatagatgggtatctattgattctgcagggaaaaaagattcttcaacttccctcaattaaccagttctagagtataattattcttatagtcaggaagctcatgcatgtgtaatagtagagctcgtttttgtctcctcaatccatctttgtaatcattgatctatttacgtggctatcgaccatctgtattttatgcaggcttgtgagtctgcatgtgtgcgtgcactttacgagggttgatgactttagaagactacaagtatgtcaattaaggctataatggcattagtattgtagaatttgaaaacatttttctcttaaataacaacttgtattcaccatgttcattttcataattctttagggaaaatgaaacagtagcaatgacagtaacaatcataaaacatttctttcttatttctcatcatggtggaataattatggcatgcttttgcagtctgaaaattcttttatctataagctgctcttctttcacatctttggctcttaaataggtgattaaaaatttttttttgtttttttcttttattgacgtttcctttgacccttgtttgctactttcagtctattattataattacacatattccaagcaaatgttatcgctgcttatttttattctctctatgtctattattgattaatgccagtattttcatttgtcaccatcaccagctgtgttgttgttcacagagaaagaaaaggtagctttaaacaattaattttttcttgtactaattggattgtgcaaaatgtttttaaaatataaaaaattgagcctatggccgggcatggtggctcacgcctgtaatcccagcactttgggaggctgaagcgggtggatcacatgaggtcaaggagtttgagaccagcctgccaacatggtgaaaccccgtctctactaataatacaaaaattagccgggtgtggtggtgcacgcctgtaatcccagctactcaggaggctgaggcgggagaatcacttgaacccaggaggcagaggttgcagtgagccgagatcgtgccattacactccagcctgggcaacaagagggaaactccatctccaaaaaaagaaaaaaaaaattggccgggcgtggtggctcatgcctgtaatcccagcacttttggaggctgaggcgggcggatcacgaagtcaggagattgagaccatcctggctaacacggtgaaaccctgtctctactaaaaatacaaaaaatcagccgggcacctgtagtcccagctactcgggagggtgaggcaggagaatggcttaaacccgggaggcggagcttgcagtgagccgagatcgcgccactgcactccagcctgggtgacagagactgtctcaaaaaaaaaaaaaaaaaaattgagcctatttacatttttagcaaaacgtaagtctcactaacagttcagtaagatgcgatctcagaaatcatattttatgctgccttggacactttaaaccatggtagaacttcattagaattttgattctttcatactatatccattgggtctattgaaattagacgatggtcagggtagaacaggaatttcctcataagtgtaaaactaggggccaggtgcagtggctcatgcttgtaatcccagcacgttgggaggccgaggagggaatatcacttgaggtcaggagtttgaaaccagcctgaccaacgtaatgaaaccccgactctactaaaaaaaaaaaaaaaaatacaaaaattagtcaggtgtgggggcgcacgcctatagtaccagctactcgggaggctgaggcaggagaatcgcttgaacctgggaggtggaggttgcagtgagccaaaatcacaccactgcactccagcctgggcgacagagcgagactccatctcaaaaacaaacaaacaaacaaacaaacaaaaacaagtgtaaaacttggtaagtggcctctttttccttatataaacttccaaaatctgaactgggaaatgaaaagcaaggttataccataacccctcctctaagtactagctgtgaggctacttccagacaaaaagcattagacacttagcctaagagattcagggtacaggagtcaaggctataatgtccttgatggaattatcagagagatagagaacaatcatgatttcctcccccagctagctccctattcattttttgtagcatacaaatttgttttaaatccaaagcttattggctagtcatatatttaacaaattatacacttttgtaattgatcatatctataaaaccactttctcttatgtactaaagaggtaatcaaaacctttccttctatacataaggaataaatctttacattctttttgcaaggttctattataattctagatatcctcctatgtaaaatagaaatgtacctagttattaaatcttttaaagacttgtgatagttatagtataatctaacataatataaaatttaacatgctatggcacactttaacatagtataataacgggtataacgtaatggtattttaactaatctctttaaaatattttaggaaggcaggaaggaatacacaagggaaatttaagtcttttaatttcttaaactcagtggtagacacgtagattcattgtctttgtatccatcttcgtgtcttaaatattacacaatgaataaatttaaaagtatttagcaagtgctgaaagcgtatgcttaaatcaggtttcctctactttggcactactgatgttttgggcccatttttctctctctctcttcttttatttttgactactgtcctgtacattataggatgtttagcagtatctgtggctctacccactggataccagtagcagctccaccaccagttgtgacaacccaaattgcctctagactttgaaaaatctctggggtgcaaaattttccctggctgagaaccattgtcttaagaattacttttatttctgaagtatatgtagtaaagtttcagaatttaatacgttcccaatcatttgcttttattttccgtgtttattataaacttcgtgacaggttttggacatttaattagtataggtccaaacaaaatgataccatacatttacaaattctatatcccaggaatggaaagtactcatgttaagctctgattctgacagaatgcattcctgttacgttgcaaataccactagtcaagcattgcttaaagtacaggtcataattgttttccacctgtgaatacaggcaatcatatcagtgtgaataggcttttttttttcctttaccacatagtatttacatttatagtttaatagtgctgagcaattcactttacaccatttttaaaagcttatttgtttttgttttgttttttttaaatatgtcatttagataaatcaaataatatcatggtaacgacttcttctctgaagtgaagagagctgggtctgaatcccagctctgccactcaccagccatatgaatgggagaaagttacctaacctctctgagtccattttcttttatcttttaaatagctagtaagtttattgaacggatcaaattaaataacacatgaaaaagtcccctagcacattgctggttacatgataggcgcacaaagaatgtcttttccagtgagtaggaacagtacagttacaattggtattttgaaatattttccttcaaaacttacaattgaatagtcagccctcagttttctatgttaatggaaagaattatcagcagggtgataattctcctggggcttcttcctttctctgtactgtctgaatcccagaaatagagatatcaaatagggacaaaggaagtatccaggagtagtgtactatttttgaggggactattcagaaacctcactttaacccctttgatctttatttttcatgctttatgttgtattttagttcatttgcatgctgacaagagaaacgtagtcttcagagtagacaaatataattgaatgacaataaactagtaaggggcctctagataaagaaatcaaaggaatgtgaaagcaagagctgctttggggggactgcagtaggtgagaatgaggactccagaatgccatcaaaaccttttaatatttatacatattctatagatttttaaatattccacttaaataaatgaaacaaaagtttatccatcaattgtttccaacagctttaatgtgttgttggatttatattactgtaaattattcatgtctttggtgttgtaaaatttagctttcaatgcttgtattattattaaaaactgagatgaggctatcataatttgaggtccttaaggcaagtgatctgaaaatgttttaggaacctggtgtttttgtagttgcatattttttgtttagattttgttttattttagtatactgagtgatattagaatcatatattctatatttagaatcatttagaatatatgagaatatttgaaatcatagctatataaaattatcaatatctaatatgaatgaaattgtgtttgtttagtttgagtattgctagaaaacattttgtagaaaacgaagtacctaaaaagtaacaacatgaccttttctgaagttttggcagtagaagaatatagaaatcaaagtacctaaaagtagaaacatgaccttttccaaaggtttggcagtagaataatttttgtttgtttgtttgtttgtttttttgagatggagcctcgtttagttgcccaggctggagtgcagcagcacagtcttagctcactgcaacctctgccttctgggctcaagtgattctccttcctcagcctcctgagtagctgggactacagaccaccgcccggctaatttttgtatttttagtagagatggggtttcgccatgttagccaggctggtctcaaactcctgacctcaggtgatccgcctgcctcggcctcccaaagtgctaggattacaggcctgagccaccgcggccggccaagaatttgtcatattaaataattaatcaggaatggtgtgacccattcagaataactagttaggatttaatatcaactttgagtatttgttctaataaagaattgcaaaatatactaaatacttggggactaacaaagctagatggcagtgctaaaatgtggcttcaagagtgttttcagttgatcagaagtaggagaatgggattagtatatgacagcaggcaaaggggagagttgttagatgggagtaacctatagaggtatcactttacaggaaagaccgtaagcaggattccctcctaggaatgtctagaaagcatatgggtgaaagccaatatgatagggagaattctacctgatggaatgcttaaaatatctttttttttcttctcttcaaattgtggaacctttcatctatgaagtacttactaaggtgtgaccattcccttcagccttatacacattgtgctcaaattcatagtatgtacatgttggaacactattcaccctttaaaaagaaggaaatctttgaacctgcaggacattgtgctaagtgacataaggcagacatggaaagacatatactgtgtgatctcatttatacagtatatagaacctaaaaaagtcaaactcatagaagcacagagtagagtggtggttaccagggactagaggtgggagtggggattgggagatattgatcaaagaatatgaaatttcagataggaggaatagttcaggaaatttattttagaacatggtgatgatagctaataacagtgtattgcagctttgaaaattgctaaggtctattttaaatgttctcatcacaaaaaattaagttcgtgaaataatggatatgttaattagcttgatttagtcattccacagtgtatacatatatcaaaacatcattttgtacaccataaatatatcctttttgtcaattaaaaattatttgcctttgtatctctgtcagaatcagaggccaccaaaattaaaactaaagtaagctttataaattattcatttcccttatttcgcgggaggagaaaccaaggctcagagaggtttacatcacatagtcaatctgggatcacaacttggttcataagatgctcaatttattgatttttttaaagcccattgtttgacctgtttttccttgctgtggtatgcaggtgggcgagcgggttggggagtttactgctggacagcaataaaaagtagtaacagaaagtttactaattaaaaacacttagtgcaatctctgtcattggaagtcagagtagaaattaaattatcccttgaaacatcttcttccagtattagatgacattataaatgtcttcattgacattcattattgtttgtgttgtgaaatatataattaggtgccaaaaaatacttaattttacttaatgcagtataaggggcattggattccgtttctgcattaataagcagcattttagtaaaatgaaagggtagctcaattactaataagaccatcatttattttatcccatatgaaggattcagagtgacagaaccatttaatgaagtctttcagctttgtgagaaaaataagagtacatattttggccttcatttcataatttttcttcagtgtatatagctgaatagtgttgaaaaattagttgcttcttgggaaaagcaaagaaggtgtctgcttttcttccttgagtgctatgactaattgctacattgtctctttggagtttctactcttcggcggtttatacttaaaataccactctcagtgtagtggaaaaaaaattcttttgggtttcagtcctgtattctgtatatgaccttgggcaagtcacttttcttcttttagccatatagtttttgcctttagaaggggggaaatgtatacttataaaaattggttattatacaaattaaatatgagcatatgttaaaaacccttgcaaactataaaatactacacaaattgaacacacatagagattagtatcttagacatttatttagctgtaacctgtcactctttctggccatttatctaaagagaattaacacttaaacattcaactattacttgaaagagtatcccaaaaagaactcatagtcttcatccttcccccaaatgaaggcctatatctcctggaatttttttcatcccctctctcttctttgatcccagctcatcatgcattcttactgattgaagattttctcacctcccatgcccataggactagactactattgttttctagttggtctttgtctctagacttcctccagtctagcacatcacattacttgattcgactaggcattctttttcctccatcaattcattttcattcttaagaagtgattgcaatgattgccacctgttttcttctgtttttaaatgctgtaatggatctctagaaattggagagtttctcagagtcttgattttgaataatctgtgcattacgttacttacatttgctcttctccatgcctttgcacctgtccttccatcctttaggtgtcttttttatcttttaaaatatgacttaaaacctactttctcttggaaatactccctattctgtaaactagactgaacattctctccattcttcatctgctcatttctactgtgttattcttaatcttttgaagtgatttttgaaaaagatgtttgcatgtgatgcagacattctgagctgtatcataagcattctttgtattggtcattctttttacttgttttcgaatcagatgcatgatacagagttttctttatatgataatgttatatcatgtgatttggtgatattttcaattagatattttgagcctgttaggctagtcccctctacaaggctatattgaatgggtgagcactctatattaaactgactttcagatttacagatttccctttcttgaatatttagggctgctttatctctcaaagatttctgagaattataagaaccacccaatgtcctttattgaataaaaggtcttcatgaaagtaaacataaaaattccatacaatatcaaataaatatttacataaggttttgattaacgcttcgttctaaatatttctgtcatagatgactttgaaatttcttgtgcattgagagatgaaacctatcctcatctacacagtttcccgggtttcatctgcctattttgggggctttggttcacccaagagaatactgatggtcttcattagcctaagtgcatgcagtcagtgtgttcggtacactagatccaaacagaacagccacttggttctgtttatgtaggttccatgttgtatataattttaaaaatgaaagcgtgactacttccagatgaagagattttccgtcagtgatgagtagcatcgtaaatagggaagctttgtttttggctgccctaaatccatgaggaagatttgaagtattacaaagacaacagatgctaaaacagtatgcttctcatgtgaagttgtgcttcccctttggaccggaggtgtcacaggtctagagaagagttgagcttccctaaaggagagcttgggaatgttaggcatcctccttagatcctgaaagcatgggcttatctgatcttagggccaagtctcctcagaagagccaacaggttaaatgtcatcaagagggtggactttcagaggatgagtaactagttggtggcacagtaagcagtcatatagaagtgactgcttagagtgggactacatctgaataaagccaggataaactctgctcaaccaacataaagccagtcattggaaaacaaatgtattgggtcaccatatattgtcatatatgctacttaatcattttatttttatggaatgtggcatatgttctagatcatctttacatatgatctatctcattgcatttcatttgatggtagagtggtggtagagtttgcctgatgaatgtttataaataaacacgaacacatattgctagttgggaaaataatcaattattttattttattttttttttggagacagagtcttgctctgttgcccaggctggagtgcagtggtgccatctcggctcagtgcaagctctgcctcctgggttcacgccattctcctgcctcagcctcccgagtagctgggactacaggtgcccgccaccatgcccggctaatttttttgtatttttagtagagatggagtttcaccgtgttcggcaagatggtctcgaactcctgaccttgtgatctgcccgcttcagcctcccaaagtgctgggattacaggcgtgagccaccgggcccagcccgaaaataatcaattcttaagcattggagtgaagactgttatttgctttatatctgttagaaacagtgtcccaggccaaatacacttatataggttatatgtatagataatttgaatactgcttcaaggggaaaatatttcaaacaaaactagatttgtaattgttgtaggatttctttgatttctacttgactagctcccctcagttcatggtacaaatgaatgactaagagtaagaattgttcgtgatcctctgattgtctctgatcccttttttttttttttttttttttttttttttttttttgagaaagagctctggggcagtgggctagaaaggggtgctcccctaggaaacccccaggccaccgctgcccgccacgcccgggcctaatgcccaggtgccccagggctcaccgcctctccagtccctgtccccctgatctcattctttctacactcagttgatgattctctttgtgaaaatgtatgggatgtttggaaagggtccccaaaaagccaaagcaaacccaggagtgtgtctatacattacaaaagtgaagggtcagtatctagatgatggtgaccagctgaaaaatgtccctgaatggctcatcaaaagaaatccatattgaattggatcagattaaaggaaggctaagtcccaaattgtaaaattttaaggcaacaatgtaaactctcccagagtaatcaaagactatctgagaacagaaggttgaattaagattaagaaaagggtcatttgagatacgtctctaatatttaggctgtgtgtgtacagttcaaagcatagtattaataaaatgtaaccatgggtgtgcacgttaccattactgtgaagccattgtttacccttctccccagaagaaaccactattctgaatctgaggctcatcaaccccatgcctttcttttgccatatatggatgtgccccaaaatatatgttatttagttttttcctttgtttttgttttgagacaggatattcgctctgttgcccaggctggagtgcagtggcacaatcttggctcactgcagccttgacctcccaggctcaagcgattctcctatctcagcaaccccacaactccctgctttccacctcctgttccccacttagatttactcacatatttaacttttttgtatacctttcttcttatatgacaaaacttccttctaggatcattttacttctccccaaaacaagtctgtttattttatttattttaatttattataattatttttagagacagggtctcactcagttgcctagcctggagtgcagtggtccaatcctacgtcgctgcagcatcagtcttctgagatcttctcaccttggcttcccgagcagctgggaatacaagcttactaccatgaccagcaaatttttaaaagctattttagcgatgggggtcttgctgtgttgcccaggcttgtctcaatctcctggactcaagcagtcccctatctcagactccctaatagctggaaccgaaacaagtctttttgaaagacttttagtgagattctggtcatagcaaacactgcttttgtttctctaattattttttttcacccttgttctgaaaatatattttcactgggtatataattctagcttgtcaattattttttctcagcactatgaagagattatttcaccatattctgggttcagttgttaactgagctgtagtctaaattgacattccctgggaggtaatctttctattctacctaggagtactaccaaagaataatcactttaaatataaattatcagcatatatttttacaactaggtagtttaaattctaacccaaaacttgcatggtggagggcgggggtgttgccttgtgtttagaagtttccagcagagaagccccttatctccaatcccagagtcaaggcaaaaccagacacaattctttactgttttcttctctaggcgggctttgttttttctccaaaataaccccttttctggaggtattaccttttggggttctgtaaaagctctagaccagtagagtttggtagatgttcctacgatagtcttggacttcagtgtctggttatgtgtctggattagtgctttctttttattttttttcccattggggagtttggggggcaagtaatgagaactttttaaaaatgtcttgccaagttagcttttcatctgaagatatttttaaagaagtctattcagcattttaggtgttctgtaaattgacagttcctctgggtaactaatcagctatattgctggaagcagaagtctattctaaagtatctctatgactctgttattgggaagttgagagaaacattagatattgataatctgccaccatgttcaggttagtgtatttaaagttctgcagatgacaagcgttgtttctgcttaaagaaaaaagtgttagcttgccagatgtgtcaaaatgtccagggtattatggatgctccattttgactttgtatttctttagtctaatggataacttatactttgttttcgatacaggcacctttaactagtacttaaatgaaaacagagaactaaataatgatagccgatcatcatgtatggcagtttctattataaatattttgaactaattgaagtgatttatttggtgctgtaatgataggggtcttgaatatgaggatagaattcagctttggaagcatctgcatgtactattttataataatgaatcctagcattggtttgtggcagtttgtcatggccgtgataggatgatatctaatgaaagcagaatatagcgttaacagggtatcatatatctgtcaacctattttgtctgttaaaaatctattctaggccaggcacagtggcttacacctataatcccagtgccttgggaggtggaggcaggagaattgcttgagcccaggagttcgagaccagcctgggcaacatagtgacaccctgtcactataaagagttttttaaaaatcagccaggcctggtggcataagcctgtagtcccaactgctcgggaggctgagttgggaggattgtttgagcccaggagattgagactgctgtaggtagtgattgtgctactgcactccagcctgggcaacagagtgagactgtgaaaaaaagaaaaagaaagaacgaaagagagagagagagggagggagggagggggggaaaaagaaaaccagtaaaccagttaggaaagggtaggtatatgtaaaataggtgaaggatggatatcaatcagaggaaagcacgccaaacagaaagacaagttctcaatcctgcccaaggatttaatttgcagcttggctttcaagctataaactgtcttcggcctggagttggggaattggggtttcaccaggtacccacccgcgtctgcctaagcatttggctgcctcctgttgctatcattacatttagacatgggcatacatactttggatgctgctattcaatactcatagtcattaatttattctatatgtcctactttttaatgcttaatatcactttttatgtttaatatggtttataatttttattttagagtacaaaataggacataaacaaaataaaaggtaaatagcatcaaaggagtacttttcataattatcctttatactgtaaatcataaattatgtagaaagcaatacatgtattttgcaaataggatcatgacattagtgggagtagaattttttacatataatcactattttttctattatagtagtaaatatatctgtgatcttcactgatctacttagtacagggctagaaccccttgaatagtttaattgaatttaaaataggaaatgtttagctaccgtgtaatttccctagcccagatttttggctgtggaatggaaaggaagggttgaacctgaaagagattttttttaggaaaaattgtcagaagtgtgactgaaaggtaattgccagtttgaaagcttagaagatgaaaaggatgccagttctgttggcagaatgaagccattaggagacgctgataaggtgtagggatgggtcagagtgaggatgagttctcctttagatttgttcagtttgagttaatgatgggacatctgggtgggaatgtcagttagaaacatggagcttgaggatgcctaagagtagtcagggctggagacgttcatttggcattatcagcagtgaggtgatattgatcatgggaaagtcaatgcgccttctagggaactgagtataatctgaatgttaaatgtcagagtttcaaatcatttctttaggatatgtttctctgcctgggctagattaaagattagataggaaacctttaaatccccgattatttctaagacacacttgttacttcaaggtcaggaattttctcatcgattttcaatgcttgtgtgttattttattaactaatgtgtttttgaaaatagtgactgcatgttgagggattgaaatgctccacccccaaatactttagtggtaatcagcattttaacatacttcagtatgtatgtcgattcttggagtcaaatgcaagagttttggaaatgttaggaattttatatcaaaaggagaagattgtaccatcaccacctgacagaaaatgtattttggatcaaatggaaggcaaattactcagtcatatgttgattgtgttccattgtgtaaacaagaacatacacagcccttttggccctgtcatctttatgagggcagaatctccagaggttaatgtggtggtagtcacgtggtagacatccagtatatattggcagaatggatgaataaaacagaaaataagtatagaaccaagtactggcatgaaactgtcatttcatttgaagaaaagtaaaggaacacatgatttaagaacagtaaacacatacacagtgatttaagccatataccataaaaaagttctgaaaaacatgggtaaggaattgtgttttctgaccaagcaaaatggggaaaagatgtgttatgatgatagagatttagccaagggacttttagggaaatgtttctttttcttttttttttttttttttttttttttttttttttttgagatggagtctcgctctttcacccaggctggagtgcagtggcgctatcttggctcactgcaagctctgcctcccgggttcacgccattctcctgcctcagcctcccgattagctgggactacaggtgcccgccaccgtgcctggctaattttttgtatttttagtagagacggggtttcaccgtgttagccaggatggtctcgatctcctgacctcgtgatccacctgcctcggcctcccaaagtgctgggattacaggcgtgagccaccgcgcccggccaaggagaacgtttcttatctagatttttaaaaatacacaattgtcaacataagttaaagtaagacattacatatatatataatatatatataaatacattttttataaagaaatattagccccaatccgtttatgtggaaaatgatagtcttaatcaaaatgaacctaacgcagttcttctactagtaaagtgacttaatgagatagaagacaaaaaagaaaggttatgttttggcaagaaggaaagggcattatggttcaatacctttacttaactaacctttaagtgttcaattaacatttaaaggaaataaagttttggaagtattacagaataattgcagaaatgtaaaaagtagttaaaagcgtgtggtctattcgtagaaattccttcacttaacactgacaatcatcagaatgtaaatttgtgatgcgtaaaagatgaagaaaactctgctcaatcaatgacatagttgctgctttctcttttgctgttttctttgtgaacttcagttcattgacattttctaggataaaaccttcatacttatccagaattgatcttttaaacacaaatcctgaaatatttgaaaaaaaaatatgcacagtagtaagcagcagcaggtggggttgggggacggcggagaaattgaagggcttgtgccttgaaactttccaggatatttgcctatcaactcacagtttgtaagaatctgttgtacttaaaaatttatcacttctagcctttactactatgaacagtttttcacttatagcgagcatagagggtagtcttcgactattaactcacctttgcagtttatttagagaacagaagcaattgtagtatcaaggaagcattaaattcaaaagctattttaattttttttaagtacagagttttggggcaatatgaatctaacaattttattgcctagcctgatctgtgtcacttcacctgtatttttcttgctcttgctcatagctgctgttgcaggaccctgattcttatcaaaagtctcaacattagatgtttctagaggtctcaggaaatagcttacacattctctgaattaattttgccagcttccatgtggcaactgtgggttcttgttttgatcctctcccctggggacaactgtgtgtgggaagaggggaggagtttcccacggggcacagctggtggtgtattgaagccttctaggtgccaagggtgtggggtgttctctggcaaagtatgggaacatgtattttttccctgctttcctttttaaatgtacttgattagaggagtaccaaagcagtgctcttcacacagttctcctctccacagtactcagacatctgaccacgttggggatgaatagtctgggcctggaatcacatccaaaaaacaactacagtgcactcagaatcaccctaactctttccaaattgcaggttttctcactggactaatcttgtctgcttgctgcttgacttctctccctttacaaaatgtctttcctgggagcccccttagtccactacacaaacagacttcaggctgattccgaggactctgtatatcagtgtcaagctgtgccttgaacccctgccttttttccatattctctgttggtatgcttttgatgagtaggtgaagtggaggtaaatgagtaccattacatctctctctcctctgtattatcttccttcctcttttatttaggaatttatgggaatgaaaaaatactcctatccaaccttatactacatctttgtctacaacgtttagtatgtacatatataaaaaatcagatatgtttaggcattgactacaaggaccacttgcaacatgagatcctacaggtaggtgactcataagagcaatatgtactattgtagtagtctgcatctgccgcacatttgagagtgagttttattctaattcgcaagtacaacttactaaacagtggcagttacataagcttaaaactcataagatgatattcagagtcagaatacatccaaggccactaaatgtgttaaatatttcatacagctgaatagagaaaagatatgtcacctcccactgtggcgccttcattctgaaaataacaggttacctatagctaggagaaaaataaaataacaaaagtttcacattccaagctaaaattatattttaggcttgattcattccacaatacttattttcccagttacagcttaaaattgaggtggagatttttaaatatgcagaattgattttaaataattttgattatcttaatctttctaatttagtttcactgtggtgaaaattattcaagttaccaaactgagtctttgtttttcttaataacatacatacttcacacaaaaaaaaatcaatagaaacagtttttaaaaacaattgagtaatttccatgcatcaaaaatatttgaaaaaatggaaataataccttggtatttacttaccttcttattctataaaagaaaataatactaatggagcaaaatagtggattctcttgatttcatttcagtattcatatatgtggttatatccatatttatattttagtcaaagggtgcgatattttaaaacttgggtctcattaattagatgataggtgccattgcaggcccagagtttaatggaaaggcaaaattgagtgggaggagggaagagacaaatggggagaacaaaagggtacttatagtaggggtatagtacagttgttttccatgagacttatgttctgtgtaccctaccctagttatcttttcattgtggaaaaataggtaacataaaactaaccattttaccctttttacgtgtataataaagaagcattcattacatttatgttgttgtacaaccattaccactatttccagaactttgtcatcatcccaaacagaaactctaaacctattaagcaataactccccatacccttctacccccagcttccggtaacctcaattctactttttgtctctaaaaatttgcctgttgttgatacttcatatcagtggaatcatacaatatttgttcttttgtatctattttgttttactaagtgaaatatttacacatattgttatctatgttatgacatgtcaaaacttcattcctttatgactagtagctgggattacaggcatgtgccaccacgcccggctaatttttgtatttttagtagagatggggtttctccatgttggtcaggctggtctcgaactcctgacctcaggtgatccacctgcctcggcctcccaaagtgctgggattacaggcatgaaccactgcacccggccactggcctcttcttaagagggaactaatcatattcgtgagggctccactcttatgacctaattgcccctcaaaggcgctgcctttaaggataatcacgttgaggattagatttcagcataaggattttggagggacacaaacattcaattcataagaatcatcaaatttgagcatgcatcagacttcatcacttttgcttgattctccattaaaaataggattgtattgtgtacttaaatatagacattgtagataatgggagatgttgtacaagccaggtgtaatttataagattgaagattattccaggttttgaaaaattatgaatggtagagttgatactttcttttttagtattattgtacctaagcaaattctacatagtatttttctgtttttagtttagattgactaattattgtgactggaaataaagcttaaaaattattctaaacacggtgaaaccccgtctctactaaaaatacaaaaaattagcccggcatggtggcgggcgcctgttatcccagctactcgtgaggctgaggcaggagaatggcatgaacctgggaggcggagcttgcagtgagccgagatcgcgccactgcactccagccagggcgacagagcgagactcgtctccaaaaaaaaaagaaaattattctatatgtttaagtcccagaattttactcggttttggaatacgatttattcttatgtgatcttttattcaatatgtatatactatattgtacaaaaaccaaacaagtttatacgttttattcacaatttattgtagttcatttttaggtcaaattttggaggggcggggaagggcggatactctggtaccataacagaaccacagtcagaaatgtactgtcctagttaatcactttcataattgttaatgcatgtttaaaaattctaatactaaaacactaaacttttatacttttatttctttttagaaccttgtgaaacatcttcctgagcagaagatactcaacgaattagcagagcttaagaatgaatatgatgacctctgtgagcctgaacaatttggagttgtggtatgtatccaacatgagggaccacaaactcagctgggaggttaacacttgccagaaacagtgaaaagacaaacatttcagttgtcaattattttttcattactgtattgctacataatttaatataatattggctgtcagaaaaaaatacttttttacctattattatttgtcatggcattgaaaaataataaaatattcgcattcataaaatacttcaaaatatctcaggggatcttttgaataacagtgccaatttttaattctattaatatatgcaaacagtatacattattattatatgggctatttttctttccatttagatcttaatgttagaatttggcctccaaaaagtaggttaaaataaaaggataattactagataattagcaaagtactagagactctttttctagggtatatgtcgtgtcagaaaaagcaaaaggattttcagatttcatatagagtgtcattaattgatttaaagcttaaaatgtgctgttttagctgggaagaaaatcttatacatcatgtctttaaatcatcatgtagttaaattattattggaatgaattattttttcttattccacccttcatattaaggggtacaaaggatgaataagtataaattttgaattcaagattatagttatattttaagtattccccaaactgactattcaaatagttgacaaaaaacaaaaacaaaaaaatggcaggaaagagggcattatgatttatttaatttcttggagaaaaagctattttttacttaggtggtcagtgcaagtttgtttgctgtatgaataaatagttccattatggtcaccaactttaccctggctccctgaacattttccatttgcatactaaaattttaaaattaccattgaacctaatagtcaaacattttcagcgttatccaaaatattctataagcttttaaatagtataatatgttagaactgatccaatttgataccttgcagtttaaaaatcctgtttaaagtcaaactgtgctagatgggactgagcatgttccttttgaacatgtgcaataaatgctcacccatatttagagtttattaattttgagacatggcattgactgcacttatatagaaggattctgtcaaattcttgcaaagaaaatcaggaatgtatgtttgggatcagatagagcatataatggtatctgagaaaggtatttctcttatttttgaacaaggtgaattaatcaactaaattcgatagatatcatttgttaactaaaagcaatttagcacaacattgagtaatacagttatttagatcaaagtccacacttgaagcctaagctgcttggattcatattataattgaagcaagggtatataccctctgagaattcagctgtgtcatgatggttatgagttttacagtaggtatactacacaatttctctgaagccatttttttttttctgaatgcagtttatcttggaagatgtattagtttgccaagcaagtcctttcaagaggcatatccttggtaccacactgaggaaatgaagtttggggacgtaaaaagcaatataccttctgaactaaaagcaaaatagaaaatggaagagatttcttgtttatgcacataaccataaataattctgaggctgtgcatacatgaagtaacctagtccccgtatttactttcaccattcttagctacatgtctgggggtggggggcggaaagtcaaggacattacaaactagtttacactatgtaaattacctaagatagtatcaatcaggatttgcccaataaagtttagctgcattcacatcaaggaaatattttttaaacaatgatatactttagtttgttaaacgtgtactttgcagtgtttagaacaatatcatgtattaaatagacagtaaataaatgtttatggaattgaattacaggacaattattaagcctaagtccgagcctgaaattagaaagtagtatgatttaaatctgtaacaatagaaattttgctaaaacatatttctctaggtgtatgctgaaattcaattcacttctgtgtgtatacatccaaacactttttaacccttaaacatatatcaacagcctaatgtgaggacagttttggaaattgtttaatagaatcatctgcagtaatgagagaggctccaaactggaaaggctcattgcctctgctcacttctcttgttaacattattagtgtatttatcacatgatttctatatggaaaacctccggtgtctccctgaatttacagaatgaagctccttcgcattctcactgtatctctgactgtcttgctttcttcctttctgctccctttggtgaagtgagtcaattggtatctttttgacattttagcctttatttcaatcagactctcactgccgttttaacagctatttcactcgctccctattctgcgtcctttcatttttccatagtggccataccatacctttccttctctcctcaagtcttctgtctcctccccattcttttaacttaccacgaacatcctaacctgttacttgccagagaaaaaagaaagcagtttgacttcaaaacctccaatatttcttctacctacaaagttttctctagctatataccttttacttattctctgtcaagcctcagaaaaagaggagctccattatcattaacattattgttgttgctattagtatggatagaaacaaaataaatattgaggacttaatttgtcagattctatgagaagcatgtttacttccaccaacttatgtattcctcatgacaaaccctacgagtttggcactattaatggctccatattaaggatgaggatgccgggcgcgttggctcatgcctgtaatcccagcactttgggaagccgaggcgggaggatcacctgaggtcaggagttccagaccagcctggccaacatggtgaaactccatctctactaaaaatacaaaaattagctgggcatggtggcgcacgcctgtagtcccagctacacaggaggctgaggcaggagaatcgcttgaacctgggaggtggaggctgcagtgagctgacatcaggccactgcactccagcctgggccacagagcaagactccgcctcaaaaaaaaagaaggatgaggaaactgggcccaaggaagactagtttacttgtccaaggttacatagtaactagtagtcacagaattcaaatgttagcagtctgaatttgtagccagtgctttaaccactgtgctcctgggttgtgggtatgtgggtgtgtatgtgatgctctaccacatgctaatcttctcacttcagttttgggcattgttatgcactgcctactttaggtggtagtatctcttgcctgctttccttctgttagttattttattacttcctcaatttgtcagtttccactctgccctgctcttcagaaaaaaagaaaatcttcagtcatttgctgcctggaaaggagtggatagatgggtggatggatgaataaaaatccttcctgactgaggtttctgcttgctactgccttctctccatttcctagcatcagtttttttcaaagatcagtctcctttttctctctgcttccttaactctcattcactgttcaaccaatggtgatcagaattctgccttaaataatgcattgaaattgaaataagaaaggcccttaaatcctgttcacatccaaaatacacatcaaatatactcacttctctgtctccatcaccaccaccttagcccaagccagaatcatcgtttcaattaaccattacaatatacatttatcttgtttttcccgctaccacttttgcccttctccaaatccgtctcggcacaacccttagtaggatgtttctagagtgtatctgtattgcatcataatttttatctgcttaaaataccagtgctgttctatagcactaaagctacagcattaacttcttaccatgacctagaagatactatctggtctggcacctgcccacctctcctactttcatcacctgctatttggcctcttgctcattatgcctcagccacattttatttttgaacttaccatgttctttcctgcttaggaccattgcacatgctgctcctttactcctgcttgctgcctccctctcttgtttatacttcaagtcatagcttaatttttgctttcccagtggtaccttcatttgcctttcagtcagaaatagatcttcctactaaactctcccagattaccttttttcttttcctttctagaaatcatcctggattttaattaaatgtttatatatgaggttacttcttgactgtctataatcccaactatattgcaagttctataaatggatgaactatgttgattttattcacgtgtgcttaacaaatatttcttgaatgcatttgcatgaatggaaaatcaagtggactctttcagtcccatcttattctgtatctatatggcatttgataacataaaagaatttaagctcctttttgaaacctttcctctccttcttaaataataaatagtatttcctgattttttttttttaagagctgcctcttaaagctcttaaagaaagttctctctgtgtcccccagggtggagtgcagtggcgagatcatacctcactgcagcctcgaactcctaggctctagtgatcctcccacctcaacctcctgagtagcaagttccaccatgcccggctaatttttttaaaaatttttctgtacacatggagtcccactgttttgcccaggttggtgttgaactcctggcctctagcaatcctcctgcttcagcctcccaaaatactgggattataggtgtgtgccaccatacctggccttatttcctgattttaatactctaaccctgtgtagtgccctatagagtttccttgattatataacttcttagatgataaaaacaaaatctcatcagttaggggtgtaaatatgccagaaattagattactcttgcagtattcattaaaataatgataatgaataattaacaaattggctggtcatggtggctcacgtctgaatcccagcactttgggaggccaatgcaggcagatcgcttgagcccaggaattcgagacctgcctggccaacatggcaaaaccccgtctctacaaaaaatacaaaaattagccaagcatggtgctgtgcttgtccagctacttgggaggctgaggtgggagaatagcttgagctcgggaggcagaggttacagtgagccgagattgcaccactgcactccagcctgggcaacagaaccagaacctgtctcaggaacaaaaccaacaacaaaaaaacacaataaaattgacaaaactgggggaaattgtgaaagaaagaaacttatctaaggcagtgactgggacactaagctttctctaaccttttgggtttttttagcagccacatcattaggtttgcttataatcatgtgcaaccagttggaaaaaagagaaaaaaaaagaaatagaaaaacccagagacttttcctctgtctagagacagatcctggtaagggggacatgctcgctcccacatattgtatgatcaataatcttgtttagggggtagattggctgcatagcttcccactgacttgtcctccaacctacctcccacagaattgaatttggtacatcattgtaattatgtgctgtacctttactagggaaaaaagcacagatttttgaaagctctggcagttagaaccctcagcaggagcttttagactcttctgagtgtctttgcagctcagctgttctcaaacctcagagcaatggaagttcccacttgtcttgcacaggggatggagacccatactgtgtgtatctattaaactaacacatcttctgaggaaaagaaggcaataattaattctcttagtaatcgtactttgtttttctgacttcaaaattatccatatttttcaattaaaaacatcctaaagctataatctaacaaaaaatgttgaaattggcttgggcgtagaaatcttcataataggaagcacagatgatgtgatattgcggacagcacatttaaattttttttacacaaatatatgaagttgggaggagaggatttatgcatatagttggaagtacaactataaatttactgtgctttttaatttttttaaagcctcataagagcttatgagctataaagatagcttaaccaggtgaaaagaaaattcttaaaagctttttttttccttccacatatcatcaaaggcaattagtttggatagaaaattgtaagtcctctgttccattaatatcaaatcatttttcacttttgcatattcagtgtgaaaattgcatttttctttattttatatgcctgcatttggagtattaagtgttttgatttgtaatgccctgattgtttctattttcattacttttgtaaatattagtgctagttcttacttctagatatatattcattttatctgaggaaaaagctggtttaataattttgagatcaggtaaaagaaaactcaccatgactcattctcaaatacatgtatttatattcttatccctcttactaacttcttataatcatttttttgtgacagaatttcttatttccatcagcttttgcaataaaacaaggtaaaataaaaccacctgaaaattgaatattcaaattaggtcagtaggtgtcaattaattttgctattgattggttttcattaaattttttaaaaatcaaaagttaaccctttcatttttcccctccacatatcactaattcctaacaccaccatagaaatttttatggctgtgtccaggcatggtggctcatgcctgtaatcccaacactttgagaggctgaggcgggtggatcacgagatcaggagttcgagaccagccttaccaacatggtgaagccccgtctctactaaaaatacaaaaattagccaggcatggtggcgggtgcctgtaattccagttactcaggaggctgaggcaggagaatcgtttgaacgtgagaggcggagggtgcagtgagccaagattgtgccactgcactccaacctggatgacagagcaagactccatctcaaaaaaaaagaaatgttgatggctgttcttggcctcaaacatgttttcagaaaggtgttttaaaattcttgcctaactttttagtgtgattcttctgagtttatagtgccttttgggacacacaatgttattgtattctgttctagactaaagacaagtgaatggttgttgatgggtagtttccacatatttttatctttggggaaatattctctaccagtacatcattatttttcttttttctttttctttttcttttttttctgagatggagtcttgctctgtctcggcctcccaaagtgctgggattacaggcgtgagccactgcacccagcctacatcattatttttctgatgtagaatcagttttcaacactcaattttttcaaggcttcaattcacagattaagtatggcccttttctctcatgacatctaatgtacgaacatttggcattgactccatatagttggtacacttgtattgattattttttccaggcctggtactggatttgctacagaaagtattagaatgagtataagtaggagaggttctgccctggaggaggttgttgtctcaaagaagataacagtctttactttataaggtgtcataaatgcccctgccttatttccacaactccaggcagaaatctggtcagtattgactcaatctcatttctgtaggcagttctgccttctattaaacttaagtccattctcctttaatgtggtttcatgatcattctttttgttatagtcacagatacaaaaggattctgtatattcaatgggcaatggatcaaaagagtaactatttggaaaaaataccttgtagcaaatatatatttgttacaaatttttctgttaattctaatgaattcttaacattatattttgaagagacggggggatcagtttttctcccatatgttaggccttaatggaatatgtcttagaagtgaaaaggaaagatgatagaaataaccctaaaggccacacctgaccataggagtgccatgtggccatctccttttccgtcacatatgatttttacatttgtgctcttttcctttctcggtggattcgtaggttagttgggtagtagatcaatattcatgagctgcgtaggtactgaagtgtgtaaaattcaaattatataaacaaaactgtgtctaactctttggggaaataacccacttgtagttgctctcactaaagctgtcaatgcacttcttttatttttttttaatatagtgaagatcagctaaagaaatgagagccacttgatgtgatttgatagacaagtacatcgtaacacaaataaatcccctacataatacaataccctggtcagcatcccacagcacttcaaggaatgaattataaaacaaaggatgccagtcaactaaaatgctgcaagggaccacaactaaatacaaacacaaatttcagcagagtttttattttatttacttatatcacttaggtgcactcaagtgcctttatgagacatgagccttttaataattgtatctgtggctggggatgttgctcagtgcttcctactatttctaagcttagttatctaggacatttccttccatatccaaatcctctgatggagttgcaactgtttctatcagtgtacactggtctgatcgtaaaaattcacacttatggttgcaaaaattctgtggttatgatcaatatgtactggtttgtggcttttgttaagagatgcacatgtatagcttgcctcctacatcatctcttgattttgtaataatacaattttaataatgacatttctaatagtagatgtatattatgaattaaaaatagctaaataaagcatgatatttacagtggataatgagagctgttcttcactgagccctggaaatatatttcttaattttgaatgagagaaattttacgttgggtttgggggaaaagataaggaccccggtttcttcatactgacaatttctgaagatgaataaagaatgtaataacaacaagaactattgttttagggtgtttacatcatgtcagttactatgacaggagtgatacacatagtatcacatttaagttctaatgcatcgtgtatagatgatttaatgaatacattttcatgatgaggaagtaacttagaaactccaggtaacttgcagtaggtcatacaactagaaagtgaggcccagtgaggtcacttacatctgaaatcccagcactttggaaggcccaggtgggcagatcgcttgagccccaggagttcaagaccagcctgggcaacatggcacaaccccatctctgcaaaaaaatacaaaacttagccaggcatggtgacatgtgcctgtagtcctggctactcgggaggctgaggtgggaagatcgcctgagccccgggaagtcaaggttgcagtgagctgtgatcaccctacagcactccagcttgggcaacagagtgagaccctgtctctaaaaagtaaagtgacagaagtgtggctcaaacctatgtctgtgtaactacagtgtcgctgtttctcctactgcagcttacagtatgggtctggagaatgcagataattgtttccccctctttcctgggtttagagaaaaaaattctcctaaatcctattctttaagaaaaagctgtatggggctctgaatttgggctaagattgggccttggcggtattgttggggtgacctacctggaagctaatgaatgaccttacatgtacttcctctttccccacatcagcctgctgttatacctcttgaaactatatgtcctcttcttgacccagcattttactgaatattatgtttcctatttatatgaatgaagccattcattcattttacgatggtttattttcaaaatcacttttcatctttatcatctgccatgtatcaaaccttgttgtaggagatgaatcaatgaagaatttttgccagatcaaagggcaactttgaaccccttacagtatacaacttcttctgaaaagcaggctgactcatgatagattaatatctagtaatactggttcaacaaagttaattccctaacatttctggtttgacattataactgaagacattattttgtagaagtaaaatattactgtcagctattaattttgttgaatagacaattgtcctacttgggaaaagatctggaaaatagtcagctaaggagtgctttaaaaatcaatcagcacatattgatatactcaagactctgtgctaggtgctccacaagatgcagcttttgactcctttctccttttttttctctatgcagtctctgtatcaatgaccttacctcccatagcatctattcagataactcccaaatctgccaactccaatacttctaacccctagaactatagtttcaaatcctagcagatatcataataataacaaaaactcaacatgtcaataaagcaattttattatttccctatcatggaggtatcattttattattttttagaggatttgagagggatcaaggagaacatttagtctatgttagtaatccaagcttgaagtacataaaattatgagtttctatatggtgagcatggaaaataagggacgactctcagaaattctgcaggttaaaatattggtaaggattggtattattataaataacattgtgtttactgtgacttgaatatcacttcaagatttggggtcttgaatgggaaaataagagcatcattgttagaagtaagatgccctatttgccgggtgcagtggctcatgcctgtaatcccagcactttgggaggctgaggcgggtggatcacaaggtcaggagatcgagaccatcttggctaacacggtgaaaccccgtctctactaaaaatataaaaaattagccgggcatggtggcggctgcctgtagtcccagctactcgggaggctgaggcaggaaaatggcgtgaagccaggagacagaggttgcagtgagccaggattgtgccactgcactgtagcctgggcgacagaacgagactccgtctcaaaaaaaacaaacaaaaaaaaaaagatgccctatttgatgtctgagaagatggtcagctgaatttacttaaatgctaatacaaatttttcgtagcagccaagcaatacttttcctttatggaactagtgctttttactctaccttcccacagctgtagaggcagagcctaaaaaagaagaaagtaaacgtatggatcatttattttgactcccttcttttcatcaaaacaagaccgctttacaggaatttctcccactttacgatggggaaactaagaccagaaaattaggcagactgttttcacacagtcagctcacatgacagtttctaaattcagtctcatttgacttagttgctgctaagctacacctacctgcccctgctgccttagtccctgattggcttactggaatttaagtagcagcaggtcagggaaagcaaatccatctactctcattctctgaaacaagcaaacaaccaggtgacaaactgtaccaaattagcacatccttctaccttcattattgccggcagacttcaaactttggagccatctttgactttctcctgctataactggtcggttactaagtcccatttattcttccttaattctatcttttatatccattgttttctttatcttcctactgtcaacatgctacctcattacctgtttcttacaccattttgctaacttcctgatggtctccctgccattaatctctccttcaaccaatcatacttactgctcctaataagactcaagaggcagtgtggggtagcggttgagagtctggggtctgtagcccaaaggcctgcattcaaatcttcaggtttccaacataaaatttgattttgtgcaagttacttactatttgtttcacttttctcatctttggaatgaaaataacgataaccgtttcctaggattgttttgagaatcaaatcagttaatatataaagcaaatgttgaaaaatgtctggcacaaagtacttaataagtgttaattgctgttagcattgttaccatcattatcaaagcatactttggttatgtaatttcaattggagctgatatttttataaaaatatcaaatccatgttctctgagtttgtaggccaaacattgtaggttaatacaaaacatggaaaggataagaatatgattgcaggcacatgatattgggaccaaagaagactaaaagcccacatatgcctaagggttttgttccttgtccatctgggaccaagggcaccctggtgaacatggcccctataagctctgcaaagtatggccaggagagcaagtgcatggtcactagtagctgctcaaagtagctctatagcttttttagtcatcagggagactaaaaaactactccctaaacgtaaaatgatagaaaacctgcttcagtgctagtgatggccagttaccagtaaaaggaaaggaaaaataaagtggggagggatttggagacagaggtagaggcagaaatgaaggcagaaaaatatatagagaaactcagagtgattcccacacaaacatacacaaagagacctgcaaattcacggagacatagactttgatgcgattagcttccacttctgcggcctttacctggactctttagatacattgtttccaattctacccctaggtatgtatgtcatatatacctagcctataaaccttttctcacaccattctctctctctttacttttctcacaccattctctctctttactccctccttccttccttctttccctttctttcttttttttttttttttttttttttttttttgagacagggtctcactctgtcgcccaggctggagtgcagtggcacaatctcggctcactgcaacctccgcctaccaggctcaagcgattctcctgcctcagcctcctgggtagctgggattacaggcactgtgccaccaccaccatgctaatttttgtatttttagtagagacagggtttcgccacgttggccaggctggtctcaaactcctgacctcaagtgatcctcctgcctctgcctcccaaagtgctaggtttacaggcctcagccaccgcgcccggccactttttccttttagtgtcagttctatgtgtgcttaaatttacacatgcatgcacacacctatacatatattttttcatgtgtatttcctctactgtgaagccttcattaatcactgtaatcataagagtttaaagttttttcttcttccagtgaacacctccagaacttaatttctttttacctatctaaaatcatgtgctggctttttcaccagcaatagttttcaaggttctatgttgagtttcagactatattgtaagctttttgtgaataggtggcgtgttttatagttgccatgtgagtactgaagaaatagcagtacaatttgtataataataccctgaccagataaaaaaaagtgagtcataagtgatgagacctacaaaaatacagtaacaggtagatatttcatcatacttttgtatatctgcctgtgaaaagcatgaaagcatataggaggattagtagaaggcagaggttcatatttggagaggcagatgttcatggttaatgggcaaattcgaagaagaaaaataatgggctatgtcttgattctgtattagagtagatatggtctgcccaacagctcatctgctgcttttgaaaggtactttgtggtttaaaaacttttgtttatgtcgtcaaattctcttcatgttatctgcagatatgttggtgtctaatctgtacttggcatttgtatttaaggaagtaggctatatatacaaaaccaaatataattaggaatgttaataatttattttcactgtgtgcatgtgtctgtgtgcgttcatgtgtgtctacctctccccgacctccctcccagaattcattttgtgaaggaaaactagttgagtaacttggagctataggaaattaaaaactaaaacaattattatcatagtaactataccaagtggaatatttaatgtgcaccagtgctatgaaacaagtaattaaaaccaaagttgaactgtattgaagaaaaccaatgtagaattcttgcataatgtacttgaaagtaagttcatgtgattttactatcatctaattacttaacagcagcatctgtcaagtaggtgaaattctttagaaattctttagagtatatataaatagtatattttatgaatagaaatcataagtttaaaaattattaaatgctcaatcagagctagtcttctgatttcaaacagcatagtaataggtaatttcttaggaaatgttccagttatattttctgtcatcatgtacatcttttatctgcggcccaactattcactcaactcaatttcatgtttataaattttcctagttcacctcagggacagattttggcagtttgaatgctattgatggctaatgattatgcaattaacatatagcaactgttcagcttctataatattttattaatgccataaggatgatttatttttttaaaaacctgtatagccaactgctttttaaactttgataaactatttctttggaatgtttaaaacaaaaaagatttttaaaatcccagagcaaactgactttatgcagaaatgttacagtgttgtctatgaaattatccccactaaagagataaaataagaggcattaaatgtatattctcatagggtatttcttatcttacagatgagctctgtgaaaatgttacagcctcgtctcagtagtatcctgttcaagctcacatttgaagaacacataaacaacatcaaaccaagcatcatagcagtaactcttgcctgtgaagaactgaagaaaagtgaaagctttaacagacttttagagttagttcttcttgttggaaactacatgaactcaggctcaagaaatgcccagtctttgggatttaagatcaacttcctttgtaaggtaagatgacattttataatgctaatttacaacaataatcttcttgtctatgaaaggtgatactgcaaatagcaatcgtacataaaccacaaaattgtatgcttaaaaagggtgaattttctgggatgcgaattatatctcaattcaaacaaataattttttaaaattttagtaaaatctaaaagacttgaatattcttttggaatacagtacttaacatttgctgattacattttactgaagtttatagacaaaaaaatcccacttttataaactagatgcagtattggccaggcgcggtggctcacacctgtaatcccagcactttgagaggctgaggcgggtggataacctgaggtcaggagttcgagaacagcctggccagcatggtgaaaccccgtctctactaaaattacaaaaattagtggggcgcggtgacgggtacctgtaatcccagctactctggaggctgaggcaggagagtcgcttgaacacgggaggcgggggttggagtgagccgagatcatgccactgtactccagcctaagcaacagagcaagactctgtctcaaaaaataaaatataaaataaaatagatgcagtattatatttcctttacattattacttatatcgttctaaaaagtatctgacaagctaaatttaatgagataaatagccagaaatttatttttgaatatagtttgcttattctactctaagataataatactcttcaatgtcaagtagtgttgtacactggtatctggtgcattaactaagaggtaaaaaagaaaattgaataacaatcatcttgttttgattggatcatttaataatatttttgagacttatgaaaagcaaacaaagaaacagagaagcccaaaagtgcttgtatatgtccatttttaggctagagcaaaccaccttattcaaagaaaagatctgtctgttatagaagcctgaaaacactctgaggtgaaggcctgtaagaaagctagagacgaaaataaatctgaaaacaagcaatctgtctttgacaactcaccattctttcactcttttttttctctcacatctgaaaatattgcagaactttggttagttcttgaagtatattataatgagaatcccaaatctagcaatggatatgaatttcttttctatacatgcattaaattgatgttcattacatatacatggactagcactttgatatgtatcaaaaatgatttgatcttggtagttctaacccaaatagacataaagaataacacttatagataataataggatgtacaatagaattgtgaacatctgtttactcctgatatatttttgagggctgtaaggaaagagaacaaggaaaatacagaagattatctggaaatgctggattttgtgaagaaaacatttttacccccatcttcttgtgatatttggggacatgtaaaatcatttcataatgccagagggaataaggcagtgcttgtaataaactgtactaaatcatgccagatttataggatgaaataaagtatttaggacttcagcattgtattgcataccatatccccaatgttaatagagtcatctctaccatggtgctacttgcctagagtatatgctatatgcacactgagtgaatctaaaagtgttcttgcttgacaattataaagagattataagttaaaatatcatcagaaatttgtattagatacctattttgcatttaattcatataaaaatatttaaaaccattctaatttgaagaaatatgtaccttataagtgtcttaatttcacactattcaaattaattacatgaactgatttctttgaagcaagaatgaataagtcatttatacataggaacaaaaggttacgttaatctcaccgaaggattttacagttacatcttatattttggagagaggcttctttctgtcatctacctgtcaaataaaagttcttctacacaacgctgatctgacatctatcactagaggtatgctcaaaggattcagcacaaagatttttgccaacttcaaataaaataaaaaataatcttgcgggaaatactatcatgtagcaataggtgttccaaaagtgaaagaagtgaaggttttaaaatctgtcccccaactcaccccccacttttcagtaagatttttatcttctgggaaattttctaggaaaacagttgtcatttagaaagagaaatatcatacacatgcatgatattcccataatgtataggattcgaaggatgttcctggaatacaaaggattgtgagtaaatgtaaatgtctaaaatgacagaaattttctgaagcacgtagaaatagttagcttagttctgtattatgtttgaaatagaattaactagctactgatgtatgattagctagaattgctgtttaatttcagttgtattatgaaagattacttcattgatttttcttagtgattgccttcttaaagaaaatagcagggggaatttccctcatagaacactgattatggttttaaaatgataccatttactctcctaaatttttctaatgataatttcttttctcagtgattttaaaactaatccagtgcttttaacaagaagctatagagtatgttaaaatattcacctaggtaaaaaggaggcatgtggttaaacttatcagatgtatcttgtagtaaggtaatataaaaatttcagatggtcacagttggctgttatggtatttgggaagaaaaggaaaacagatggattaaccaaaatgtcaacactaaagggtatcattattgtaattactaccttcaccacaaaatgctttgttaatttgcagcagtgaattatcactttgtgagtcaccaaaccagtgtgctgaactgtaataaaaatcatttcaatgaagatgagctcccaatgttagcttagcctgttggttattaaaattctaaccaatagaaatgctacacttcaaggccatttgtttgttgttttttttttcagtacgaaatagcatatataatctgcataaggacaaaacattttaaaatacttagcattccctatatactaagctttgtgggtttatcaaataaggatctttgtttgtaagtatcagaacgtgactctgcctgattcaagcaaaaagtgaaacttgctggaaggatatgaagtaactaagccagaaactgaggaaagactaaagaacttgccctttaaaagaacagcaactgtgacagctttgagaattcaggtagcaggaatgaatgaaaagtctttttaggatgttgcctttgggatatatcagctccaaccattttccttctcctttccctatgtttgattcaaattcaaattatgaagagagcctaatgagcccggtgtggattataagaacaccccttgttcaagggagagcaaaaaaccctgattgacagtgctaccaaaactacctgccatggaagattggttatgccctaaagggtgctgttaccaaagatagggctaccaaaggttaggagcaggtaaagggatatcaggcagctctaaacaaatacaaaataaaacagatgatctattcatcagaggcctaccaacaatagagaagatacacagaaacctcaagaagcttgtggtacagttgagcagccaggaaatatacatacacaatattatgtaatgtcacaaggtacactgtcaatgagggcaaaaataaatggccactgagattagcagtagttcaggggaggaaggaatctttggtgattgggcagtgctggtaaattgaaaaagaagaatcttgaaggataggtaggattaagaatctataactttacaaaaggggagaacattgtggcttggaacctacgttttaacttacacttttgtcaattactagccaaattttcctgactaagtcacttaccttctctaaatctcaatttgagattgaatatttcttgaatatttctcccttcacttcttgtatctttttttggatttccttgcattgggcttcacctttctctggtgcctccctgattagcgtaataaccaacatcctgaattctttttcaggtaaatcagggattttttttcttggtttggatctcttgctggtgagctagtgtgatttttgggggggtgttaaggaaccttgtttggtcctattaccagagttggttttctggttccttctcatttgggtaggctctgtcagagggaaaatctagggctgaaggctgttgttcagattcttttgtcccatggggtattctcttgatgtagtactctcctccttttcctatggatgtggcttcctgagagccgagctgcaggagctgcagtgattgttgtctctcttctggggtctaggcacctggctctgggctggtactgggggttatctgcacaaaggcctgtgatgtgaaccatctatgggcctctcagctgtagataccagcacctgttctggtggaggtggcaggggggtgaaatggactctgtaagggttcttagctttggtggtttaatgttctatttttgtgctggttggcctcctgccgggaggtggtgatttccatagagcatcagctgtggtagtatggagaggaaccggcggtgggcagggccctagaactcccaagagtatgtcccctttgtcttcagctaccagcatgggtagggaagggccatcaggtggggcaggtctaggcatgtctgacctcagactctccttgggtgggtcttgttgcggctgctgagcgtgagattcccagctcaatggagttgtgtacctaccgtggattatggttgcctctgctgagtcatgcaggttgtcaggaaagtgggggaaagccggcagtcacaggcctcacccagctcccacgcaatccaaagggctggccccactcccaccatgcccccactaacagcaacgagtctgtttccaggcagtgggcaaacagggctgagaacttgccccaggctacccacctccgagctgtgaaagaaaagggctttagttcttcccctgcctgtagagtctacacagcggattcacgccctccactgagttctggccaggaggcttcttgaccacttcaagttgttacaaagatcagctggagactttcttctccttgtggcttttccccttgtgcctctggctgccctccggaaggatccctatggtgccaggcaggaatagcctgcttggggacccagcgaactcccagggcctttcctgctgcttcctctacccctgtattttgcttggctctctaaattgactcagctccaggtaaggttggaaacttctccctcaaactagaccttcggtttccccagtaggggtgtgtgttcggtggtggaggatctccctttcccacttcgcaatttgggcactcacagtatttgggtcctgcagcagcagtccccttccttcagagggtctgtgggtcctctcgggattcctggtttatccctgcagtcgttttggagctaaaattcacaacgcaagcctccgcacgcttctctgtccatccgagttggagctgcaatctagtcctgcttcccgtctgccatgatcctcccacaaattcataaactttcttaaaacattatgagagttttttgtgggtttttttttttttttttttttttagctcatcagctatcattagtgatagtatatactatatatagcccaagacaattctccttcttctaatgtggcccagggaagccaaaagattggacacccatgatctagaatatctataacatgtaaagcctcatctagaggccattacatggtattagtgacaaagtatcataccaactatacaaaggaaacatccatctccatccatttcccccatagaagttgttagaaggaaagtaaaataggttcagctttattgtgaaatagaaaattactgcagaaaatatgctttgtaaagaaaagtgactgctgtctatggtagtaaaatttggaaatctgtaatccacacacacaaaagaatctacaaaagaccttagaaaaaagtcatatgtaagtacacgcaaagttttgcagtgtctaatcatttctagctaaaataatgtggactatgtccatataaactcagaatgtcagcatatgaatacatccagtctaacctcttcagtccacaagtgagaaaactgatgcttgtagaagcaaaatactttagtcagtgtattgttcagcttggactgacataacagaaaccaaaggctgagtggcttaaagaggagaaatttattttttcacagttataggactgaaagcctaagatcaagatgccagcagggttggtttctggtgaggtctctctccttgggttaccatatggccaccttttcaccgtgtctttacttgacatttaatttactgttttcttcccctttgtccttcacaagactcagaactcgtcaaatttggatgtatattttattctgcattatatctccagtgtctattatatgtgaagctctcaatatattactacagattgaaagtcagacaatttgattaaatagaggatttgttattaatactcagcatgtgttaacttgttttttaagttagaacattttgttcctcacagatacaaagggcatatttttgccagcaaaactgttgaatatgtaactgtaagattttttatgctttatttgtaaagacgcaaaaatgtgttgtttgctgtaaatctaaatcagcaactcattattaaatatgggttattaaataaattaacatgagactattaatttaaaaccaaagatattttagaaaataatcactataggatgtactgaaagggaacctagcaacgatcaataaatcctggtcaacagtccatgcatttgtttgcctgtgtttttatagtttataaagtgttttccttgtgattcagggaggttaagtattattgaccccattttgcaaattagaaaactaaagcccagtgaggttatataatttgtccaagattcaaaaactagtaaaggtacaagttggggcttacatacaggttttctgtttacaaaattgtgtagcaccctgcctcttattgcattgtaacaatgtttggttatacttggctcatttcaaggaagcattatagaaccaactctggcacttacagtattctgaaaatggggaaaacctcatgtgaattttcttggctctctggcatgaaacttggaatccatcttttttattttaattcagcttggtgtaactgtaggcctatcaataggaagtttctcatcttgtaatagattttaatgtatccaagcagcagagcctatatatttgtaataaaatagcatctaataatttgaataattgtggagctatcccttggtgttgtatagactgtcagagtattttagttttgtgtaggcaaggttgactgctgttttcaatattttacaaatgaggatctgctctccagagagatgatctttacccaagatcacttagtgatgaaggcagagttaggatccagcttttcctgggactcaaacaaatgatttcagtggatcatgctattttcagaattttcattgactcttttgcttcactgaaatatactttttcctatcagacaatatttagcattaattgaatttgagggagatgtggttgataatttgctgagaagaaaatgactttgtgggttataatttgtcttgaaaaaaattatgtgaaagggaagattagactctcgatcatttatggagggggatgaaatgttaagccctatttccaaacttttatttttctccttgggggtcctttaaactttcctttctgtggagctatttgtgggaaagagttttcatttggtgatctctcctagtcactggttgctaatcagtgatgcaagattctatgctacaccaaatgcaaaggaacatattcatggtatttgcatttaaaaatgtcatcatataatatagtgacatgctgtaccatttgttcataattcattaccagtggatacaaacatttcaatttaagggtctgtctgtgcctcattatattacgttgaagcaagaatattcgctatagtttagacctctgaaataactaagcaccatggaatgacacaagaacaggatatcattcttaattttaaatagtttcctttgttcagcttatgtgatggttgacctttatttaagtccattgtgtttcattgtactgtgcttactgagctctcatcattgagaaccactgaatagtttcttgagcttaaagatgaatgttacactgttgtgatactatgtcagtggtgacattctggattcagtttttatagttgtgtcatgggtttttgtttcctacactttttcatgtaaatcaatacaccaaaatatgtaatttttcaaaggcaaccattaatactacttaagttagtaaatctagaagtatttaaatgtatagaacactaaattttttaaaggaaagaattctccataaggtcttttaattgctgtatgttattcattgtgtattctaatgcacatgccgttgatctgtgcatatggacttgtgcacgtaggcaaatggtaatagtagaagattgcttcagtcatctgatttctccactaaatcaagatacttggataccagctcagaaatccaatccaaagtcctcacctctaatgcccttcattgccatttaaaatctgaaccaaacacaggccacttcttttgagtttatcttctttaaaatgcagccctctaagagttggaaacagactatcatggctccttgattttgtaatcctatgaatacgctactgtgtgctttgaagattgtccttcaattagcaagtcagtgctttatcccacttctaagatgtcagctacctggtctccttgtgtgtctatatagtatagtggtgcacatacagattgactacttaagtagaaagaaaacttgatgaaggtaatatgtgtctctgtcttatgaggtgccatcttctaaaatgatagcctcaatttttccaaatggtcatacatcttctagatttatattaatgtggagatgcatgatatctttcttgttctctgtagcctacattaagaaattgaaatgagacaaaacactaactttgtggtaagctaattacagcagagggaaaaatatatgatcatgtcaggcataggaattaacaaagtttatagatgtattttaaaaattgctatagttctaaaagcttatgtgtctcaaaatatctttttgaaaacttgagctctgagtgaaagaaactaactcacacctttattctcctccttgcctcttaaaatatagaggtcccgtgagcttatttaaagatctttttctctaagttgaaatattcattaatttacattcattgctgcaaattagctagtactttaagtgtaacacttgtttgttttctcagaatttgattacatctgtttagacaaaatcatcacatttacaatactataggttgtgtgaaaacttgattatactccaaaattttcagtttgttaaattctctagagaacaatagtttgtaaatgtaatttgtctgatgcagacttgattagtattccttgtcaatactgactgctttggagactcatgggatttttttctattattcttatgtatgttaaaattttctgttgcctattacacacacacacacctccctttacctgtgattattaatatcgtgaagcctatgctgctatctctgattttaacttatatgttacagttatgtctgcctcctagatatctagataacttgctgtgaggtgtatatatgtatatacatgggacatacttgccttgagtactagtaatgcctcgttattatacacccctctgcaaacacatgacctttttgttatggaagagttttcaacttttgaaagttttgtattaggggaaggaccaaggaaaataaaataagagccagatgaagccaaaaagggtgtgtgtgcatatgggtgttgagtaagagagacagggagatagacagagacagagagattgagacacagaatgagagaaagataatgaaagagtgagaagggttggggtgattttcacaattggataatcagagagaaacaggattgagttaaatgttcctttgtatacatcaattgactcataaagagcattgaaaaatgcaaactggccgggcgcggtggctcacgcctgtaatcccagcactttgggaggccgaggcgggtggatcacgaggtcaggagttcaagaccagcctggccaagatggtgaaatcccgtctttactaaaaatacaaaaattagccgggcgtggtggcgggcacctgtaatcccagctacttggcaggctgaggcagagaattgcttgaacccgggaggcagaggttgcagtgagccaagatcatgccactgcactccagcctgggtgacagagagtgactccgtctcaaaaaaaaaaaaaaaaaaaaaaaaaaaagaatgcaaactaagaattaccaaattatattccttatcttctaccaataataagcattaaaaagtcaaccatatatatttgtgtatagaactgtaatgaagggtataatttgttttctgtagagaactcacctgtggcttagtttttgactcattaaatacagatacattttcaggaaataagaaaattaatgcatctgtattttctttcattttaaaaaaattatccttatagagtaatacaaaaaaagtaatcaaattaatgctgtgtcacagctatacttgttgaagtcgttgtgactaaacaataatagatacagttaatggttgaatagtataactggcagagatgaatactcctctagttaacaaaaatacattttttttgttcttgatgaataccccatatatcaggagcagcaataagcattttcagcgctagagcagacaaaaaatgatgatttatggaactagctgtaggtcttacttagttcgccatgaagactgttttcatagaggatttaaatgaacccagctggcttcgtattctgtgaattgctatagtcgttttctgagtataatcttatgactgattttgtaattctcacagtaggggaaagttgacaacatgaatggcatttagtgaatataattagtaagtctgaaaacaaaggcttttttattctataaaagctctgttcgaaggagattttgaccctgtatgagactgttccaaaaacatagctaccatgactaagtttgaccagtcatcttacaagctgattttcctgttaaatgaagccttcctagtgaaggcattgcacaaccttaacaaggagagctcatgtccatggaaggaagtttataaagtagcagttgatactaaaataaagctctgtgataattttagagaatctaaggattatttatatacatttaacgactttttagtgagtacttgtgcagcaagttggccacatttattgagcctttaccctctgtggaaccttgtgctagatgctttgtggggataaagagaagtaaaacatacatctccagtccttgaggagcttatgagctagatgccagatatagaacattgtaatgctaaagcaagagacagggagaagtgtgtgtggggacaggcaaatggattttatataatagcacacatgaaaaataaattatgttgctcataaacactggctaactaaccacaagacaagaaagcgcatactctgttagatgatatctatactgtaaagctgctccacttctttggaaaggaaggaaaaaacaattccagccccatttccaagatgtacttttcttctcttccccaaacaatgtcttcagttttgcttttcctgccttccgtcatggggacaagcacaaagccttgccattcattattttcttatcttttagtcttttttgaattttaaatctgaattatcagaatgctctcttcccttttatgctacaataaaagtatctttaaaactgcttctcaagttcctaacatctttctacatatagttaaatattagtattttaaattttttggataaaatcaatacctgttcaaaaacaatagtataatggtactacttataactattgtatgtctgtacccctcccaattcactaattagtcacaaaagtcaaataatttccttttgccagaggatatcatgagattgtctagataaataagaatgaagaaacttgttatttaatgttcagtatgagggatcactccaggatgcaagtaacctactatgaggaaatataagcttttcagaggctatttagggaaaggatctcaatatttcagatttaagcaactagctagatacacatattaaaacagaatcctctacttagaaacctgtgctgagggaagtggaaaagtattgtaagttatattcaaagacttggggacagatgaacatgcttgattccaaggatatttcatcaatcacagcctggcccattcagatcactttatgcttccaaatttcagctttcaaaaagtgtacgagaaaggctagggttactcgttgatttcttaaagcatcttcttaggactttgtttgttgtattgttattttgttagaagtaaaatgtattcatggccaagagagacttgaacctaacctataatttcttgtagtaactttactgaggtttttaactgacatactataaaatttactcattttaggccaggtgcggtggctcacgccaataatcccagaactttgggaggctaagtcaggcagatcacttgagctcaggagttcgagactggcctaggcaacatggcgaaaccccatctctaccaaaaatagaaaagattagctgagtggggtggtgcgtgcttgtggtcccagctacttgggaggctgaggtgggaggattgcttgagcttgggaggtggaggttgcagtgagccaagatcgcgccactacactccgcctcagagacagagtgagactgttacaagaaaggggtcctgatccagaccccaagagagggttcttggatctcgcacaagaaagaattcagggtgagtctgcagtgcaaagtgaaagaaagtttattaagaaagtaaaagaataaaaaatggctactccatagacagaacagccctgagggctgctggttgcccatttttatggttatttcccgatgatatgctgaacaaggggtggattattcatgcatcccctttttagaccgtataggataacttcctgacattgccatgacatttgtaaattgtcatggcgctggtgggagtgtagcagtgaggacaaccaaaagtcactctcatcgccattttggttttggtgggttttggccggctcctttactgcaacctgctttatcagcaaggtccttatgacctgtattttgtgctcacctcctatctcacctgtgatttcgaatgccttaaccatctgggaatgcaacccagtaggtttcagcctaattttacccagctcctatttaagatggagttgctctggttcacatgcctctgacaagaccccatcttaacaaaaaatttactcactttaggcatacagttagatgaactttgttgtttgtatacagctttggaacctccactgcaatcaaccagtgtggtttcctcatgcccctgtgcagtggatccccactcctagctcgagacaactgctgatttgttttaaatcaccatggtttcgccttcttctagaatttcatatgaatggaatcatacagtaatagagcctttgtgttactttgtgttgttagtgacttttttcacttagtgtaaagttgtggcatgtattggtagttcatttttattttgaggtagtattccattgtatggctgtgccacattttgttcatctgttcatcagctgatggacagttgggttgtttctaaattttctattatacttgttgctatcatcatttatgtataagacataaattcatttatcttgggtaaatacctaggagtgggaatcctgggtcatatggaaagtatagttttaattttaagagagactgtttttcaaagtgtctataccatcttttcttttcttttcttttcttttcttttcttttcttttcttttcttttcttttctttcttttcttttcttttctttcttttcttttctttcctctttcttgtcttgctctgtcacccaggctagagtgtagtggtgcaatctgagctcactgcatcctctgcctcctgggttcaagcaattatcctgcctcagcctcccgagtagctgagactacaggtgcacaccaccgtgcccagctaatttttgtatttttagtagagatgaggtttcaccatatagggcagggtggtctcgaactcctgaccgcgtgatccacccacctcggcctcccagagtgctgggattacaggcatgagccgctgtgcctggccatctaccatttttcattcatacttatgattaaattaaaccacaatgatggatttcatatttggaatatatgaatatatatgaaaagatatctcatattcatgagactggcaaaaaatgttaaattctgttaatataaagtagaggtaagaataaggggcaaagagaactaatggtgagagtataacttgctaaattcattttggaaaacaatttggtactatcaagaaatgttaaaccatgcacagaaatgccccttctagtgtatacactagataaactcttaggtaaggaccctggagacatatacaagaatgatcacataatcaaataacactatcaacagagtgaaaaaaaggcaacccacagaatgggagaatgtattcgtaaataatatatttgataagtgattgatatccgtaatatataaagaactcccacaactcaaccacaacaaaacaactcagttcaaaaatgggtaaacaaattgaataaatatttctccagagaagataaacagatggccaataaacacaggaaaagatacttaacaccactaatcattaggaaattgcaaatcaaaaccacaatgaaataccacttcaaacatactataatggctactatcaagaaaacagaaagcaacaagtgttggcaaggatgtggagaaatttgaacccttatgcattgctggtgggaatgtaaaatggtgcagccaatgtaggaaatagcatggcagttactacaaaaattaaatggaattaccatatgatccagcaattccacttctgggcatatacataaaagaatcggaagcagggactacagatgattgcataccaaattcatagcagcattattcatagtagccaaaacatggaaacaacccaaatgtccattgagtgatgaatggataaacaaagtgtggcatatatacaatggaatactgttcagcctttaaaaggaatgaaactctggtatatgttatattataatatgaatgaatctccgtgatgttatgctacatgaaataagccatatgaagaaggacaaatactatatattccacttatatgaggtacctagaatagtcaaatttgtagagacaaaaagtctttgtttaccaagggttgggggataaggcagatggggagttaatgtttaatgggtaacagtttcagtataggatgattaaaacgtcctggagatggatagtggtgatggttgcacaacagtgtgaatgcacttaacctcactgaactgtgtgcttaaacatggttaaaggcaagcatggtagcccacacctataatcccagggctttaggagactgaggcaggattgcttgaagccaggagtttgatagcagcccagataatatagcctgtaatctcagcactttgagaggccgaggtgggcgaatcacttgagcccaggattttgagaccagcctgagcaacatggcaaaaccccatctctacagaaaaatacaaaaattagcacggtatggtcgtgggtgcctgtagtcacagctactcgggaggctgaggtacaaggattacctgagcctgggaggttgaggctgcagtgagctgtgatcatgccactgcactccagcctaggttacagtaaaatcctctctcaaaaaaataaataaataaataaaaaagtgttcacagcagcattatctgtaattatatccaaaacagtgattccctcacaaaaaaaaatggaaaccagatattgaaaatgttcgatgagataatatgcctaaaatttataatatttatatggtcaactaatatacagcatggatgaatatagctagaaacatcaacatggttaaatacctcactcttaaacagctgctcttcagtgctgaattctaattacgcttttgtaatattctgtgtcttagaccttcaaagtttttcataaatagctaaaatcactaatgttaagtgccatttaatgccatttattaaaggttaaaacctttaaatgcgatttattatttatctacagtgtatagacagagcgaatgagtcctatggactcttttggtgctagtgacaatctgaagctatgtacataaaaaaaaatattccatctactctcaaacctcatacatataaaacaatttaagtaaaatgctcatgacaataaaagttaaaagttttagttacgtgcttaacccatgtctgagaagaaaccatctaacaccaacaaacattcatacttgtaaactatttctataccaatttaaataatttgatttttattaaaactattctcagaagaatttttatttggtaagccaactatagacaggatgattaaaagcatatgaaagtaccagaacagcttttctttgcatagatatatttcattaattcattctggcctttcctaaaaccagtgagtacaaatgatggttaatttgccactggtcctggcaatgcaggctaatgcacatgcaggtcattctccttggataagtggggctagaagggaaaatgctgagaaggggagcaggaaggacaggaaacagaatttgtcttgtctaagaaacttagcagcacaaatgccctgctggtccggaaggtggcaattgagatgaatccttattccatttaatgttgttacggtttcaagtttcagctctcctttcacagattgctaccataaattaggctaacaagtgtgaaacttttaatttgcttgactatacaattgatattatctgtttccttttggttggaaatatcattataataccaaactaaagggtgtaaaaaagggactatcaggcctacataaaggatgaagacctctttccaccgtaaattacatttggctgaattagtgtcagccctagtcatgtagtgcccagaaaagcatttttggtgacagatttagaaataaagctgggaaaacatgtattaaacctgtccggtcatagctacagaactaatgtctttatggtaattgcaatctttaaaaatacattatctttttcaatgttactgcagtgtgtggtggtattaaagaaagcaataatttgtaaacaacccttggcagagggcacagaacttaattttgtttaaataaaggagactaacattagaattcttgtgctgtatcaagactgacaagcagtagtagctgttttgatatgtgcactggagcattcatgattgcttaaatattaactgttccatgaatatacaaatataatagggaaaaaggaagccatgattaatgaaaattttcactaaaagaaataaagttgaattatatgactgtactggtggtttagatggttttattccattgactcaaccagatctcttcactgagtttcagtatttcttttcaaggacaattatatatgtgtattgtgtgatgttgctatgtgttaggaatgtttccttgacacagaaggattaggcaatttttttttttcctgagtacagcacctgttgataagtttgctgaagttcatgtggccattcatgtaaatccaaaaggaaaggggggagatccaaaagggcttccttcagatactctagagatttgaacttttatctcacatttaagttttaatatgctttaaagatagtcttccgttaatgtgtgcagaaacatttcctttagtgatatccacgctgctttactacttcatttcttatactctttatgcaaaaatcagtttttgtctcagagcagtttacactctacagcaattcatgcaagaaaaccaggtgctcctcccacacattcttgcatgtttccagaagagaactaactgttttgttttttcttttttcttttttttttctttgagacggagtttcgctcttgttgcccaggctggagtgcagtggcaggatcttggctcactgcaacctccacctcccgggttcaagtgattctcctgcctcggcctcccaagttgccaggattacaggcatgtgccaccacgcctagctaattttgtatttttagcggagatggggtttcaccaagttggtcaggctggtctcaaactcctgacctcaagtgatccacccaacttggcctcccaaactgctgagattataggcgtgagccactacgtccggccaagagaactgttttctgtgccactctgcaactgaggtcaggattgctttgggacagggagccaaggtccgctgctttgttcctatataatgtatggtaacatatgaacctagccccattctcactcttggtcttcaacccgaaatgagtatgatgacaaatgaaatgcagtatcagcatatgccagggccatggagcaggaatgaagcttccttccttgattgtcttctttacatacacccaccatagtctgatttcatacatgtaaactgtttggcatagaggtcaagcaaggcattaggttatttagatacaagaacttttatggcaagcactgaaacccgatgtctgcaacttacaatttcagaatctgattcaaactttctgagtaaatatctaagcaacaatgcagatttgcttgagcaggagttggaaggcatgaataatctgctaggttatctagtccatcactctgatgatacgtagtagacaagacatactatagcagcatttaagtattttttcaatacagttttaggtgaaggatgaaggacagtttagaacactgaagagcaatgtatctggaatcttcacagcatggagcatactgtttgtctcatctacttttggataggtagctgataggttatgataccaatcagtcttatttttatgtgaattaatcaagaacacttagagcaattctgtccttcagatgccacaaattgctagataatttctctcttattttaaattgacactaagcattgaaaacacgttgacacttcaactttttatatgtaaaagcagttgtgagaggacctaggcaagctgtagacaattgccaagcatcttctcccctggaaatttatttgaaagtagcctagtgtctccctagtggcatgcatcagaatcacctagaggtgatatcagaagttttcccctagtatattcaaactcaaattgctggaccaaaccctcagagtttctgatttagttgatttggggttgggcccccaaatttgcatttctaacaagttcccaggtgatactgatattgctggtccagggaccagggattgagaaccaataaagtagcaaatgctcatgaattcttgatttttcattcttatttcttccgttgcctgatcccttcaagcctaattatgctgaacttattcgggacaataattagaataatttttgtcactaacctcaccattttccagctgccagctctgctacctcctgtattatctggttattatccacagtcaatatttggaataaattattcgttcacattacctcttttttctgactacccattccttttaattttgaatcctttgcactgtattctaacagtgcttgaaggtcaccaaagattaacatcaagtcagccctaattatttttggcctgtctaaagaatttattcattcaacatttactgaataaaattgatatagtcctcatttttaagcagttcacaatctggtgggtgagactagttgtgtacacaaaattatatattgtggaataagtgctataactagagtatatagaaaccgctataggagaacaaagacagaatttagtagttttgctttgttttgttttgttttgttttgagacagagtcttgctctgtcacccaggctggagtgcagtggcgcaatctcggctcactgcaacctccacctcctgggttcaagcaattctcctgccccagcctcctgagtagctgggattacaggcatgtgccaccatgcccggctaatttttgttttgttttgtttttttgtagagatgggatatcaccatgttggccaggctggtctcaaactcctgacctcaggtgatccgccccaactccttgacctcccaaagtgctgggattagaggcgtgaaccaccacacttggcctagaatttattaattctattcagggaagttgagaaaggcttattactagtaactacgactctcctccctttccacacgcataccatcttcatcacccatgacagttcaatccagtaagtatatcttaaattccaagtgtgcataaattgccgtgctttgttctggcaccaacacctattgagtgtgggaactagatcaaacaacttatgagctctatcttatctataaaagtggcatattcgtaactaactcactgaattgattttaggatttaaaaaaaagcacttatgaaagtgcctgagttataggcacatgatagataggcaacaaatgttggttctcctaccccttaaaagaggaataggatattatcacctgatgaaggaagaacagtatgccgaggtcaggaggaacataagtaaatgggtagaaatcttcacccatttgtgcagtcaggaggaacataagtaaatgggtagaaatcttcacccatttgtgcagtcaacaaatacagatagagtgcctattgtatgctacccacttttctagatgctgagtatataaaagtgaacaaagaagacaagaaaactctgtacttgtgtccagcatagctgaagtgagtgtgggaacttgagagaggataatagctagagataagatcacaacagagtaggagccagagggatttttagtttatagtgatgggaagctaaggtaggctctcaacacttcttatctggatgatgatggtacccatgataacatgctatcttattcaattctgcaaacatgtctgtgaacataggtgcttatctaatgctcattttatagataacaaacctgagacatggagtattcatgtaacttgcccaaggtcatacaagtagtaaatggtagggtcaaggttcggacctggttctgtctgaatccaaaatctatgcttaataattattctgattagaaatttgaattttattacatgagttgtaaagaaccatttactttttttaaggaagggagtgacatgatcatatatatgtttaagaaccataattaggctaaatcatataggataaaatgaagcaaagagaatggaatggttatgaccatcttttcatagtgtattttcacatagctaacacttctgtttaaaatttgagctgccatccttttcctaatgccagttcactctagagttatttccctcattctggacatgatacaacattcttttaatcatcgggacttaaagcttttggagtctttgatttttccctttccctcatcttaatattcactgactaaatcctgtttttccttacaatctctcttgaatttgccctttttttgtcttttctacacataccctagttatcattttaagtatatcagtctttgacatttgccaccaaattattctcctatgtcgtttcttttctatatcattttgtattttctactaaattctaagcttaaggccttaaaagtaccatgcatcatttatctcttatccctggtgttcagcatagtcctcaactcacggtggattaaagaatgtacttctccattcatatttgctttgctcctaacctgcctcccctaaaaaaatgtacagtgctacatttcctgagtgacaaattataactttattctggcattcacttgcacctaactctagcaaatgtgtgttctggaaaagtttggcctttgtagtcaacctctgtgtgtgtggtggggtcatatataaacgcagttatacatatatatatatatatatatatatatatatatgtatagaattaaatttaggagtattgctctatagcccagaaaagttggagtttagagaagaatctgcattcggaaacatttattgactatctagtattttctaacatcctcctaggcaccatggattcaaaaatattaccaaagcaaagtctctagccatgtaagagctcatattgagtgtgagagactactatgttgaaatgtttacagtgaatgaagatggccaaaaaaagttattaattgcttctaagatagagaagtcttcagaaatgacatgggagttgagtagtctgaaatgtgagtaggtattttcttggcggataaaaaggaacaaaaaggaagggcgtccacacagagagagctgttggtgcaaaagcacagtggcatgaaactgcatggtatgtttaagcagttgtaatcaggcagacagcagcaggaggcaggttagaaaggtagacaagggtcagctcaagggagtgtcttgtatgcaaaatcaagaacttttcttttccagcagatgacaggagcctttgcaatggatcttttgaatggactctaattaccattgagaaattaaacatttgaagaataacatctatgcggttaggttaaattaactgcagttgtttatttggagaacaggacgggaatgagaagggaactttcactctgtgagaggttgttacgtacagcatagtgaccagttattttcagttcccactgaggacaaagcaagaagaaataggcttacatctcatcagaagggaaaattacctacagaaggggtccttcacagaaagattgaatgtgactgacgtaggtcattaaaatgttgtctgaggctctctggctgtgtgctggtttctgtgtactcaaacagcccaatttcaaagacatggcaagactgaaggttttgaagcttgaatgaggatatttggaataaagaaatttcttatgtgtcaattagttattgagaaattttgctatatacctaactaaattttggagatgtacttgaacatataaaatatatgtagtatctttcataatataacgtttgtgtgtactaggaaaaagaaatgatcaaaatcagctgtagaaacacgtgtcctattaaaggtattttgtattcatgtaccattttagaaagttattaaagattaggtagatagaattcaattaaattcagttattaatctttatgtgtaacatttattggtcagatgattaaattaaaattgctgtatatggtttattaactgatgattgcacctgatcagttaatacagtgactcactcttgtcttattttcattatcatccagtgataactgcgcttattaaaataatataaaacttattttagctttttcaaatatttcccatttctagaactgctgtttgtgttattgtttgaagatatataaaagaagattgtagagtgaccattttgttcatccttttgcatcttataaaaataagtcatatatgtctctccctacctgtcatggctggagagaggaaaaacacatacagggatgcaaaaaggcactttgcttctggctagagcaaaccttgaaatgcatacaatataaccaccactaagacttaggcaatctaggcaactattaattggatatttcatgttaatgtaaaattttaatatgatttcatattaaacagctatcaaatggaaatcaattctatttcttaataaactaactcaaacattttggaaatgacttgtacataatcagattagattactcttgttctaccccaagagatgtgtatatccaactagtacacttagaaaagcaaattattggataaatgtctttaaccagtagaactgatgttcttagttgccttctgtgctgacattgaacaacacgatagggcctgagagagatacaatggctaatgtgtgaatggcatagacttggtaagagagactgaaggcatgatataaagtaattaagcttcaataagtaaaaaatattttccattatattttaatattatatatatatatattttaaataattggtctaaggcctctcacacatagagaaaggtttaaaagaccacccatttgtcgtgatttcctgccagtttgaaccattaaaatggtctctgtgtgtttttttttttaaaaaaaaacaacaaatattgcaatacattaagcagcttgtctcccagaccaactaagatacttctcaacttgacaagacaaacatttggccatgtttgcccatgctttgaagggaatattatgattctaaaagaaatacatgcatagtctgtctaaaagtcttttatcatttcatcaaagatactaatacatttaactgatgttgtgctttatttatctttttaaaatgtaaccattaactcttctaaattttgtaacaaattaaattgttagtggaccagatactgaataaatatttattaataaatacaatttttgaaaattaagcacttataagtatgcatgccaaaaactgaaatgttttttaatacaaaacaatctaacacatgtgacaaagaaaaaaaatcacccataaaattgacatatgagcacagtgctatttttctgtttttatatttcctttccagtgttagccatgtgcgttttattgtaaactataatgtacttgtacaatttgatgtcctaaaaaactaggtgggtttttgttgttttgaattgtgttcttttttaaaaaaaaaaattgtttttgtctccatttatgttatgactccaaagagtccataaaatacataggaatttcctttcctttgggaagatgtacctgcaattttttctaagcacttaatgtttccagaattttaggatttaggtagttagtgaacttctaaggaaaaagaaaatgttaatttcctttttatttggaatatccggcatactcttaaaaacgatgcactttgtaaacacatcacacagtaatcccaggtaaagacctctctttaggaatgtgagcttcccattgattcctctacagctgctatccttacttaaggaaaattgcccttgaggtttgtgttgctttttgttctttcagcttgtccttgagttgtgtcatttctaccttaaagtacttaaaagtgtttagtggatcagcatgataatgtaaaattttaaatatttttcctatgtgggataaagtaatccccgaaattttgaaagaaatcattgtgacctcttgaactatcaacattatgcctcctgtggctgtttggttgtttggaaccttgagactaatatttcttctaagttgtttacatcacattgagatgcaaatggttgttaaaaacctgtagaacaaaacagatccagtgtgggcctgatttattaaatgctatgtttttctttcttagtcactcaaacaataaggattaatttactctgttacctaaatatcctgtacagccttttcataaacctgtttgtgaaaaatactcatttattctaaacagagtaatccttaaagctaaaaattccaaatcagtatgaacatcagtggacaaacccatcatctaaggattatagaattataacatccaatagaatgagaaaacttgatactttatgctgtatttatgctttgtttctaagtaaatccttgattttatttgcagcttagtctagtatgagaattatattgcagcactagattttctttttttgtgtgtcctatgctttaaagatttttaccattctaactgtggcatctcttttgttgtgtgtctgaaaaggaaatacaatatgtaagcaaataaaatttttcatattatcaggattgtatggtgagattttttttaataactcagtataagcacaaccttgagaattattttctgatggtccatgcaagtagaggaggataaaatgtgcttgctcctttacattaatttacatcaacaatggctagaaataaatataatctcacaaatgaatctaacttttaagaacatatttttgtaataaagcaaagaacagaatgatgataaaataagcacacagtaacttgggctattatcaatacttaaatggatgttcttctctcatgaaaagaatagttcattttgccacaataatttagacatttttgaaaatacagattaaggtttaatttggcacttttactggtcatcttacttgcttttaaaatatggagctccttttaaaatctagagcaccgctactagaccacattaagaacctaccccaaagttttaaaaacattttaaatgggttataataaattcattcatttcacttgtttaaaaaagtatttactaaaaaattactaaaaaatgtgttgttgttttctcccagatcagagatactaaatcagcggatcaaaaaacaacccttttgcattttattgccgacatttgtgaggaaaaatatcgagatatcctaaaatttcctgaagaactggaacacgtagaaagtgcaagcaaaggtaattgatttataactactttgagattatctcttgcctatatggtttaaatggaacaattaaagaatctgtaaacattattcataaaagtattttttgtttgtttactgataaaagaaaagcaggaaaatagtttccattagcttatatttgacagcatactacattttaataacctattttgtcttacatcattttttttaccactgctacgttattaaagctttcatttctctgatcagataatatgtttgtactttcatttgataaacatttaagtggatattgtttgcaaaggaaccatactatagggctcttggttatatgacaatgattgtgagagtttttgattgagtgtggttaaaatatagtaaatgagaaaaatgtgtgtatatatacatacacacaaatgtgttataaaataaggatgcatgtgagaaatgctgcaggaaaagataatgtcctatagttgagatgaggaggaaagtactcttgaatgggtgggtaagagaaggcttcatggaagaggtcaaaggtgaaatatgaggttagggttttacagacatggaaaagaggtttgctttccagagagaaaacaacatgagcaaggcaaagtggcagaatgttttaggacaagtgaagggaatggttgactctgaggctggagcagtaaggtaggtatctctgagacttcagtgtcaggctaaggagtctagtcttgatgtggtaagcagtacagcatcattgaagggatagaatagacaagccatggctcctgtgaggaacaggatgtttgaaacaaaaatgtctctgagattttaattcagggtaattagctttgtcagtaagtattatctacttttgcaagaggttgaaaagtgaaagaaaagaagattaaggaaacatttgctgaaggtgagattatgtgcgagaagaagtgcattttccctcttagataagagaagtacaccataaatcttatacttgaaattacgctgaagtaatttcattctgtaactctgaggacttttggtaaggacttcatatatgtttctcaagtttattacaaaccatataaacctgttagtttccttttaagttaaaaatagtgaatctataaaacccagaatattctttgaataacattgtgcagtggtcatctcagccagttgggtattgtcaatcaaatcctcaacatatttctttaattttaccgagtttgtatcgttttgtggtccaaggagcaaactaacacaaaaagacaaactatgattgtattgtattatttattttctttcgttgttttcaaaaaattgtgaaatatgatggaaaattacacaaattacaactataatggcaactttctggtaatagctcttctaaagaatttatctttggatttaaaaatacagctttctgactagaagcatatttactaacatgtggctaatgtgaaataataacattttaaacatttgtgttgtaatttgaaatgtatatatatatatagcacaaaaaagaccagttattaaattagctcattttgttgctattaatactttttgattgccttctaccagaatttttttctaagttttctttgttcaacatgtataatcaatttttacaacattttggaaagaagtatgtcaataatatatctatatatacacacacagtgccacacatgaaaatatatatatttatatgtaatatatttactatacataaataaatatgtaccacacacttatatcaatcaacaggtatttatataaacctcaatcaacagttatatatatgttatatataaccataggtatttacatgtgatccagcagttccactactaggtatttatccaaagaaaaagaaatcagcatatcaaagggatacctgtaccccatgtttattgcaacactgttcacaataggtaagatatgaaatcagcctagatgtctatcaatggattaatggataaagaaaatgtggtgtatatacacaatggaatactattcatctgtaaaaaagaaataaatcctctcatttgaagtaacatggatggaactggaggtaattaagtgaaataagccaggcacagatagacagatattgcatgtttttactcatatgcaggagctaagaaggttggtctcatagagatagagcgtagattgatgcttaccacaggctgggaaaggtgaagggtagggggatgaagagtggttggttaatgtgtacgaacatacagttaggtggaagaaataagttctggcctggtgcaatggctcacacctgtaatttcagctagttgggaggctgaggtgggaggaacacttgaggccaggagtttgagaccagcctgggcagcatagtgagaccacccccatcagaaaattttaaaaattagccagtttcatgctacttgcaggggctgaggcaagagcattcctcgagcccaggaggctacagtgagctatgatcacaccattgcactctagcctgggcgacagagcaagaccctgtctcttaaaaaaaattaaagaaagaaataatacgtcctaatgtttgatagcagaatagattgactgtgggtaggaatgatatattgcatatttcaaaatagctagaagagaagatttgaaatattcccaacacaaagaaatgataaatgttcaaggtggtagatacgctaaacaccccaatttagtcattacacattctatgcatgtagcaatatatcatatgtaccccataagtatacaaatattatgtatcaataaaaaacttaagaatatatagatatttatatatgtgtatatagcgtgtatatatatatatatattttatatagttatgtagtgagacattcaataatcttgtacactttagccactactgctactgacaaaagtagattgtagagcccagccttttgggttagacactataaatttctttctttctttctttctttctttcttttttgagacgaagtcttgctctttcgcccaggctggagtgcagtggcacaatcttagctcactgcaacatctgcctcccgcgctcaagcaattctcctacctcagcctcccaagtagctgggattacaggcgcacgccaccatgcccagctaatttttgtacttttttagtacagatggggtttcaccatgttggccaggctgttctcaaactcctgaccttgtgatccacccgccttggcctcccaaagtgctgggattacaggcgtgagccaccgcaccaggcctgacactataactttctaatcctagctctactacctattagttctataatttgagctaataatttaaacttctaagattttgtttactcatctgtaaaatgagaataataacagtgagattaaattagttaacataggcattgcatccagtaaaatggtatagtttatagtatatgcttgacacatagtaagtatgcggctgttgctgaactactaccagtagtagtagtagtagtagtagtagtagtagtagtagtagtggtagtagtagtagtattgatataccactaaggatattatagttctttcttttgtcttattagaagggaacaatcataaaatatcttatagttcctccagtctcagtaagtatgtattatattcaattctatttgtttgtttcctattcctgggcttttggtaaatccttttatatatttttttctttattttatttttcctttttaattttttgtatatcaccaacttcctttttccaatccatttcaagagcgaaatctctctgctctattttgatcattcctgattttgtgcattcttcctgccagtgtattcaaaagactgttgccaaaaatcctcttcttatatcactgtttgggccatatcaatccctactctcaaattattttgactagttatttttctttccctatgaaattcagactgagaattctcaactcaaaaagatcttacgcacattctgcctgcttgcatccctctttcatttcctcctagttctcatttcagtatacccagacatatagtctcctgagccatttttattcctttataataatcctgtctctgtgtacgatttcatgctgcatcctctggctggaaatttcacctgccctgtactctaagacaactgactgtcatttgccaaatctctgttcagaatctatttcctttttcttcttccttttttttttttttttttttttttttactaaagccttaggagaaaatactttttgtattagtctgcaggaagaaacaaagcattgtaaaaggtcaagccaattacctcttatttatatttaaatacttttccttggtatttgagtctaacttgtcttgtttacttaatgtacatttcagccctgtttgaatcacactttatcacattcaggactgtgtataacatagcaaaaaacaaaaataggtcaacactatataattcattttatttgatgatggactatctctttgtaaaatgatcccgttctcttcaaaaacaaaaacaaaagattgtctttttttttttaaactggagtgatatagataagaaaaaactaattcagttaatgaattatatagctaatattgaaagaacaacttgattactaccaatatcttttttcatatttttgtgttattagaacgcacatacctactttgatagagtaagatcttttctgtgtggtatagcaaataccaaatttattttagttcagtactaaaattccaggcatcaacattactggcaaaggggaaaaaaatcaccttgaagtgaaaggcaaacaaaaagaaagaagtatgtgggttccatggaaaaaatcatcataattacatttattccttgtaaagctaagctgctaaaattgtgtgcttcttggaaaatgcaaaactatggtataaacttggcatatttttctagacctctgtagctcaaagatagtggggaaaaacacatcatttttacattaaaacagatatgtattatggagtagaattcaaaatccacattaattttaaaaataaaacagatgacttcaaagaaatttcccacttgtagcagatccctacaggattattttcagtcttctcttccattaggggtactttggtgggaaaagtttatgaagcattgcctgaagaattagagagcagttttgttttgggttaagtttacgtatttatttatttagtttgttattcagttagttagtgactattgcagggaaaagggaggaaagtaggcaaggtgagggaagagagagtatatcacttccttttaaacattgtcataggccgtatgaagttcagaagcaaattgtataatgtaactttattaccagtaaagttaataaaataacattgctcttgtcattttattcttggttaaattataaatctgtgggtcatttcattcaagattggcataccaattagtctttagagaaagaaaatggttgttacagagactttgatgcctttaaaacattgaattttttttttcttttggtgaaccacaattatttttttccccaatgattaattttaaagtttatatatatgtatgtatatgtacatatgtaaacttatatctaatagatatatattgtataaaacattgctggtttactagacatatttgatgtctttttttccccctgtggctatcactttaattttcagctttaaggattttttactgtttgatttaaaaccactcctgttttataggttgactccaggttttaaaccaaatggttagtaaagtttaattaaagctattttattcaaaagggggaaattatattaatgtatttgaaggtattatttatcctgaggtttgcataaatccaaaatgggtttcacttcagttaaattggtgccatcctacaagataaaagctagttaagtttcttctgaacagtgctaacttttttatgaattaaataaattattataattttaacaatcaactataccttttgatatctgccatgtttccatgtcatgttagttaccgattagctgtttatccactctgactttttcacgggattaataacaatggaagttctgattaaaggcaatgttataggggaaaatctatggattcattccatagtagtatttcttttttatataaaagaaaaaagtaaaataatagcaaagttaaaaagtttggggggaagaagaaagatgaaacaattccagaaactccacagctggttgaagctttagagattatctagtccctgctaaaagggacccaagatgacatttcatccaaacttattttatagttgaagaaactgagatgcagaatgataaaggacttgcccacgatcacatagctgggcagtagagtccatgtacatttggagaccttgtttagagttattacatatatttcatccacatttttacctcctttgtggtcgaaaatatgcaacaaagactcatgctcacatactggaaaacatatagaaagtagatgctgaccaaataaaaaacttactggaagtataaatgctactttctctgtagttgtccataatctttctagctccattttgacagaattaaccattcctttctctgtgtcacagcagccctttagcgttattggtaatagagcacataccacatttgcactttttatttaattatttgcttctatctgtacctcctcttgagtttcttagtaacaaagactgtattctttttgtccttacaatctcggtgctatcatagcacctcagtcggaggggctcaatctatggccataccaacctgaatgcacctgatattggaagctaaacagggtcctgcctggtcagttcttggaagggaggtagaagtgcttaataaatgcttattaaattaattgcatatcattttagtacagcagtcatatttcaaaataagacattgtgggaagttgacaaatagagagtaacagtctgaaaattactgttcactgtaaatttgagaggagaaacaaggtaaattagaataaggaggacaccggtatttaacaatatttcccagtccacactttgcttcttcaagggaaatggtgaaattggaaacaatttgttaataatggagaggacctaaacttatggacgccaccaaaccacaaaggtttatggtgaacagtaaggaccaagtcataggacctaatgggagtgactgtctcaatgtgaaatgtaactaactgctgaaacatctatgtttaatacctgaaaaaaaaaattgcatattgtctgctattagtttcattgaaaaatctttgagttttttagtaatctattaaagaaaaatctgtggaacaaaatcctgtttttagagtgtttaacttttacttatagtgacttataggacctaagatgcaagaaagtattaaactaaggtttcctaacagatttaaactttgagttataatctaactttttagaagcacagaatgataatataccaatgtgacaaaatgttagtagaattgaccttacttaaatcttagcagcctgagtaaaactgagtatacatattactacattattttaataaaaatgttaacttgtttgttcagcttggtttggatttttttcatatataggatttcaggccgggcgcggtggctcacgcctgtaatcccagcactttgggaggccgagatgggcggatcacgaggtcaggagatcgagaccatcctggctaacacggtgaaaccccatctctactaaaaatacaaaaaagtagccaggcgtggtcgcgggcacctgtagtcccagctactcaggaggctgaggcaggagaatggcgtgaacccaggaggtagaggctgcagtgagccgagatcgcgccaccgcactccagcctgggccacaaagcaagactccatctcaaaaaaaaaaaaaaaaaaaaggacttcaagtaacttaaacaatttttgctgaacgaattgtactctatcaatagcaacaccataaatatgttataaaatttaggggaacgttgttaaatgttagggaatcaaatacatatttatctacataaattttccagtctgtaagacttctttcttcctcactctcaccaagtcagtcctaatttttctaaacaaatgactgtctttaaaataagagaaaaaataagaggtctaaaacagtcacagaatttttttttattattatttttatttttggtaagaacacttaacatgagatctaccctcttaaatttttaagtgtgtaatacattattattgactataattacagtgttgtacagcagatctctagagcttattcatcagttaaggaagataagctcaggaaaatgtatttttaatgtgaaatgtcaaaaggacttaggaaagaaagtcatgttttcttcttgctgttcagtaatctagtcattaccaaacaatgttatcaatgcataacatataaacatttcataattcattttcatttctagaggaaactagtgagtaaaaacaatatcttcaggtagcagtgaaaggaagcagagatcatggccgtttggatttgagtgaattctttcaacacaaatcaatgattttatagacatatataggtttttgtcagggttccttagcttttgcatctcaaaatctatttttgctagggaactgtataatagctcatctgtcttaccctccttgtctcagagcccaggcttctgtgccttttccaatctgaaaagcctcctccttgtctctgtccttttgagcctcatgtatctttttaaaggcccactttaaattccaccactctataaaaagcttctccaactattctacctttcaatggcttctcagtttcctccataatactttgaaccttttagctgatcctgtactctcttgcactacagtgtaaaggtttctgtatttatggctgcatactggcatgatgctttctcagttatgtatgatatcattagtctgctttttcaggacaaaatctgtgtcacagtgttacagacaaaatctataacacagtgtcggcataataaattcagctcagtgaatgcttattaaacattaacgtaatccttgttgctttctttattcaaccctacagtgaaattttctgggtgcttggagtaactaaaatatatttgcagatatttaatttcaacttcttacacattaaacaagtagaaaaccatgtcttcaaaaacatattctttaaaagtgattgcttagggcaaaagtagtctatgattttagaattcattataatagttattcttagggtgggttcatgattggaatggaatatgtaggggcttctggggtgttggtcatgttctgtttcttaatcttgatgctagttacatgggtgtgtttagtttctgcagattgattcaggtggccacttatatgcacttttcttaatgtatgttttacttcaaccaagcggtttttaaaagccagtcattcagatttttaatatgtgtaatatgaatagtgaggatggtactacattttaattcagaaggtcctcttgcttttacccatgcttagttatagtgatcacatgcattgtataagtgtaaataggcagctgctgtcagagttaatctgatgttattctaaataattattgttaggaagttgtatgtctcctaaagattttatccaaacaccttttttttttagtctaagagtggataggtgtactttattttaaaaaaagaaagaaaaagagccaccaaccacattatgtaccacgtgaagatcatggtaatctatatcatacttgtcaatattatgctgtcttatatgtcattgaatccttggcacttactgacctaaaatattcaccaataacctgtcgctgctgtcatttttattattttatctttgcttcaatgtcagtaaaaagaatatataggaatattagtcagctttagctcattgtggatttaagcttgttagttaaaaagtgaatattcgtatatcaaatgttctaatttgattgactcctgaagtaaaacacagggacatacttgatacaagaggttgaagtactgatactgagtagtattgtcaaggggggagatgtgagagtaagggaagaaggaagaaagacaaatgaagaaagaactagctttctgctgccacagcagaatcataagaaaagctggatcatgccctgaatggagactcccttgtactactatggaaataggtggaatccaggaatcaacttggttaccattattgtagttttcatcaccaccagtccctctgatatattcatcaataaggatgagcctgcttaagagatgtagggcttagggattggggaggttaccaaacagtatcagagctacctgagcaacaccccacattttccactttttacacgttttgagtgtagcttgaacacaaccaagtcatgggcagtaccattgctgttgtgatttcttgaaattaactggcatcttttgctggaatttggattctacaagttgatgagacaaatttagcaaatataacatttccttgtgccaaagttatatgactcaaactccttaacagtattttcatgtaaaacgatcagaggggaggtggcagttgtagccagttttgcattgccataataaaataccacagattaggtaatttctaaagaaaaaaatttatttcttacagttctggaggctgggaagtccaatatcaaggtgctagtacctagcaagtgccttcttgctctgtcatcccatggcggaagggtggaggggtagaagggtcaatgagcatggatgagagagaaacaagagagagtacaactcgcttttataacaaatctaatcctgtgataacaaatccactcctgtgataaccatattaatccatttttgagggcagagccctcatgacataatcacctcttaaaggccctatttctcaacacctccatggtagggattaattttccaactcatgaactttgggggacacattcaaacaacagcactggcattttaagtttaagattcattgaagtagtgaggagaaaaccctgacttctactggaaactagtagctctgtggcaaaagattctggtatagtcataatctgaaagatgtattcactggaaataatatgtccagggatgagaatcaggacacacacatttgagttccagctttgttaccagctacttttttggacatagtttggccatataacctctcagtgcctatttcctcatttgtacaaaaattttcttaatttgaaaaatagcaatggtaatatctaggctacttatccctcaaggtggttatgcaagtaaaattagatatgcaatatgaaaatgccatatgaaaaaggtgttacatataaaaaattattattcaagctagtatgaggatattaattccagttgattttgattagattttgtttattcagtccagtttaaaaaatgaaggtcagaccaggcgctgtggctcacacctgtaatcccagcactttgggaggccgaggcgggtggattccctgaggtcaggagttcaagacgagcctggccaacatggtgaaacctcgtctctactaaaaatacaaaaaaattagccgggcgaggtggcaggcgcctgtaatcccagctacttgggaggttgaggcaggagaatcacttgaacccgggaggtggaggttgcaatgagccgagattacaccactgcactccagcctgggcaacaagaacgaaactctgtctcaaaaaaacaaaacaaacaaacaaaaaaatgaaggttagaattcacaagttaaaatataaagctttctgaaatgatgtatgattttattaattttagtttttctacatattcttttactcttttccattttggacacttttaaaaataagactaaaaacataatcatgaaggctcatgttattttaaatgacatctctaagctttcatggaagaatcattgtcccccatttaaaggttgatcataaaatttccaatatcctattttgttaggatatctttttccttagcatgtataaacatggaagaaaagataaagcatatagtattaactgaatagcctaagtaattgatagtaaaagtttaggggcaaataaaaaaggtatgaatataaaagattattataataactaataaagatgataaataagtagaaagccaggtcttcaaaaaaattttcttttatgtgcattttaaaggagtagattctgcttgaatttgtagcagaaaacctgaagctaatgtttatgctcggcactgtttcttaattatgcatttgctgatacctaatagtgattatagtaaccactatcatttataaagggctaagtgccaggaattatattaagcatggttttatagaaaaggagactgaggctcagaaacgtgaagtaaagtgcacaagatcacacaatgaataagagcgaatattttttctacttccgtgtctcttgttctttccactataacatggacaataatatcaaaaacataattcaaaaggatataaaatatgaaaattttagttataaatttaatataaactgataaagcagtataaaccttggtaatgtccatattttaatgggaaggtcaattattataattagaaatatctaatcacatcatataaatactgctttgttctaaaacttcagtaaactcttaaatatataaaagtgctatctttagaatttagggttttactcaattgatttttccttctacgtgtccacagagaatagtaacatacattatgatgaggagaaagaataatcatctctgttgcacaccctttttgaggggtgtggtcctcaactaaccacatctttatttaacgctattcgtatgaggaactgcggctgctaaattgttcatttgtatcccttggtttaaatgtgtcagttttcttcagttatctattctctggaagtaagtgtatgctttaaattaatctgtgcacttattcatgtatcttttaccattagaaaacacactgaatagatattcttcggaggaaaatgaattgttgatatctcagcttactcagaaattcagtagaaatgattcttaactcttaaatgggaaaatggcacatggatagaacattttcgtaggaaaaacattccaaacgtatttagcctcaccagtaatggaagaagtgcacatgaaacaataaaatataagtttcagctatcaatttggtaaaggttaaaaaaatcaaactatatcgtattctcagcagtagtacaggtggtataggtgagatgcttatgtattaattatttgcttctctatataaattattgattatcacaaaatcccatacataactatttggagattaacatgtgaaataggccgggcttggtggctcacgcctgtaatccagcactttgggagggtgaggcgggtggatcacgaggtcaggagttcaagaccagcctgaccaacatggtaaaaccccgtctctacgaaaaatacaaaaattagccgggtgtggtggcacccacctgtaatcccagctactcaggaggctgaggcaggagaatcacttgaacccgggaggcagaggttgcagtgagccgagattgcaccactgcactccagtctgggtgacagagaaagactctgtctcaaaaaagaaaaaaaaaaaaaatgtggaatattatacagtgttccaggatttagaggacctggaagtatgcaaagatttatcaccttgaaatttatgtgtttttgaatgtatgttattatttttattatttaccttgtgaatctttgctacaataacttgtagtcagaagtctgagaatattggcatccttatgaaaaatgcactgaggaaaacagacaccatttttgcagctttgagactctgctatgtgcgtctcaccatacttcttggtaataaaagtctctttaaaacacactcaaaatacctacttgtaactagcagcttttttttaaagaaggaagactgatgtatatggctgtatttttattatatttgcatgcactgaaatataattattctgaagggaattaaaacaggcaagtgatttcaggaagtggatagagtttaaacatgggacagatcaaatgtataggaaacaagtggtttgtggtaatgattggtgttacatctttcaaggcctgataccattgacatgtggcggtgagcagcatatctctgacacttttgcacagttagcaatgatgttagacagcagttcttcctgaaataagtgagccaaatgccagtgcagctaattggtttacttgggaaatgctattcaccaatataaagcctagaaaagtgaaatttcagtatgcaccttataaactccatcggcatgtagataaccaactaattttgagttacagttggtccagtaccagaagtattgtatggtttatctgaagggactatacagaattcatcactgatatttaaatttttctctatgattgttttatgaaagcagcaaggcaggttatagaattctccgtattgacagatctttaataaataaactttaataaatgaatcaataattggcatagaattaacctccagaaagacacatattgcttagccttaaaagacatttttgaaaaaatgatttacggatacaattttaactctttcattgtactgtcaaaccttattttataattaaaatcctccatgatctggaatctcccttttattaacagtggctaaggagccatagcagtgagactagaaaggagagaaaagattctggaaaatgtgggacttaaatatgtgtgcattgtgacataagtagtggatgagggaaccaccgatggggagaaaaattgcaaaaacaagagtaatatttgtatgcagatatccacctatacaatatatgtgataatttgaaattacctatatctttttttttaaccacacatgattccctgagtagatttcatttctagtatcagcagtgtcatactatgaacgctcaaaagtaaaagttttagaataagctgtaatttcagatccaataatctcagttaaatttggaagaaagtgtcagaggtatttgaaccagagcaactccattttgaatgagggctaggaaaatgaggctgagacttgctgggctgcatggttaagggaacaaattaataatgtttactggccgggcgcggtggctcacgcctgtaatcccagcactttgggagaccgaggtgggcagatcacttgaggttgagacttcaagaccagcctgtccaacatggagaaaccccatctctactaaaaatacaaaattagctgggcatggtgacgcatgcctgtaatcccagctactcgggaggttgaggcaggagaactgcttgaacctagaaggcagaggttgcggtgagccaagatcgtgccattgcactccagcctgggcaacaagagcgaaactccatctcaaaataataataataataatataataataataataataatgattataataatatttactaaacagacccagacttgggagtgtccagatgtcctgatatctggagaacaaaggcattcctaattttgctttaaagataataatatcaattcttgcaaaatatagtaattaagaaagttaatcctgtatcacaaacccttgtagcaaagcacatctccccatatatataagcgttgtacctacggtagatgcattcctcctcttttgggaatgtcctactctgtctatggagtagctgttctttcaccactttactttcttgataaacttgctttaactttggactgcggactcaccttgaattctttcttgcgcaagatccaagaaccctcttttggggtctgcatcgggacccctttcctggaacagaagtacatagaaaggaaatgtttattctgtcagtccagatttcaaaacaaagtgtctagcagaatcaaaccattatcatatttgtattttgtgttctgtctatatttctgttctcaaaactaattatggcatttgatatagttagcgcagaaaagtatacgccgagccttactctgatgttaaatgcttgtggagttcaaatattttgtaaaatactatttacctttctacagatattaatcaaggtagaattacctctctctaaatacagtcttgtctgaagtaaaatcccagtcagtttattatatatcaaaagaagtaaacagcttttttgcttgcttctctaagaaccataatcagttagtcatcttcattctattgccttagtctggtcttccatgatcttaaaaaatgggaaatgactgtgattaatgaagctatttggacgatgatatttaagatgataattgcatttaaatgttatattgtttaaattatatgcaaatatctgagatcaaaggaaacataaagagctctattgtcccataagtagtttccaaattctgctagaaacagttaatatgtttgatcggttctattgtcttgtccagattcttgaattctgtttgtgcaaactggacttgaggggagtatctacagacagagcagcatttctatcactcctcggcagtgttctcttcaacagtgcttattgccagctatcgaaatgtgcagtgtgtgtatgactaagagtggatgagtactgtaacaccttaattacaaaataaatagtgactgtcactgttgctttttatagagctttctgactcaagtgcttggtttcctctgattttttaattatttgcatgaaagaaaaaagaaatcactcctttgacattcgatggagggaaaaggaagagctaattaaactgttgtggaacattattatcctctttagttttacactgacaattctaatgcagagtcactttaaatggctttgcaaatcggaatttgctgggccctttattatttctccaaattcactgaacaagtccattcacagggatattgaaaatgcaaagtaagtccagactgaaatatcatttatttcatgaaacattcattagcactttcagtagctgaagataaaggaaaaaatgtttcacagggagtcatgagagattaatatatacagatttttaaaaacaaaacacagaagtttgaaaaaccatcaggtattgctttgaaaggaatatagagttatatggattttgaatgtgttgaaaaatggcttaaatgtactgagctattcacagcccttggcttttactttttatgtgagttatatctgaacaaaaattttattatagtcagtgttgttcatgctgctatagttaaggttgtcagcatttccattacaaacccactatttcagttggggttcataactcagctttagaagtcaccctgggctaaaggttggcaaatgccttttcaacctgtggtggtaatgatgggtatgagtgtggttaaatatgtagtaaacatttaaattaacatatattacttcttatgttatgaaatattttaattgaataatatattatggttctctgattatagaaactgtctgaggaatgttagctttgtcagtataattgattcagggttaaagaaaactttttttcaatctaattagtccttgtagccaagaaactctgaacatatcttggagccattagccaaacacttcctgctaccaatgagcgatggcttgtaaaaggcactcagtaatatactaacattactgccaaacaactggttaattctgtccaaagattagtgtgtgccacgaggattgaaaagttaaactgacaagtttgagattttgcatacaaccatagccacatacgcaggtaggtaacagattttttaaaatgaaaatcggtttcttttgaattaatctcatttttctggttataaaattaattatttttcctagttatgaaaattaaaatattttagattacttagtaaaaacggaaaaattaaaacagagtaaagaataaaataaattacctataatttctcaaaccagtaataacgactggtaacatgttgatgaatgtccttctgatctttatattatacataaacacagatatgctacaggactgccagcttcatatgcccactgtgcagcagcagaccaatacactgactgcagggttgcagcagaggagtttaatcacaaggcgccaagcaaggaaatgggaggaattctcaagccttgaatttgtttccttgagggattctgggcaagggtgtttaaggggattcataaaagacgggggcggggcggggtgggggctggaaaatttggtgttgtgatcagtgggggcagggaggatgaaatcataaggatgtgtaactgcttttctccaagagtcagcttcttactgggtccaccagaccagcttgattccctagttttgttgatatgcagaacctcctaaagaagcatctcagacaaaaggcttatcttctcacaatgtctgagattttatctatagaaccggaagagaacagagaatcttgtgacaaaggctatgttatcctggggtggtaagtagaaaccagttacaaggaagtgggccaaagggcaagctggcttaatgattgctgctgcaaacctagttggattttattttattttatcttattattttattttatttttcttaaacaatttcattaaattatcttgggaacagtgtcagatatatatatattgctaaggcatactttctctggctgcccagtatcccactgtatgaaatgtttaacttatcacctactgtcgtggatttcgaaatctggttaatgatttatcttagttaatcttagttactttggaataaaaatctgatgaaacctttcagcagctagagtttgctcaggatcttggtcttaagtctggttttagccatttttaggtatgctagttactgtatcctccaaatgttaataatttataattttgattccaaaaatagattaaacacatagaatttattatatattgatcacagagagataccatataccaaacacttaaattccattggcatggttacatattgaagcttttagtgtaaatggagcagactttaaaaattaataaatttggaacatatggaatgatcatttcctttgaattcttcttattttaacttgaagagcaagggaaaaactttcttgcaaaccacatttttccctttaaggtttttgttttttgtttttttgttttttttttttttttcctccctagggaggatatagtggcgggatgcagccggggactctctgtaggaacagaatattatttaatacagaattccatgatccgaaagacctggatttcaatctcaactctgctttctagttatgtatgtgattttagggaaggtacatgacttatgtgagccttacttttctcttccttatgatgtagataatacttgggtcaatggtgttataaatattagatggattatatataaaaatttacttatttgttgattggcatatagctggttccaattaggtaaaaatgatgaaactatgttatactggacttcaaaagttttttgtgggttttttgtttttttttcttgagaagtctcactctgtcacccaggctggagtgcaatggcacgatattggctcactgcaaccttcacctcctgggctcaagcaatactcctacctcaccctcccaagtagctggacccacaggtacatgatgccacacctggctaatttttttgtatttttggtggagaagggggtttcgccacccagactgggaaaagttaaattgagtttagattcatgcgttaaggctgggaagccattgcctactcctgagcaggagagtgatttaatgaaagtgctattctaggaaaattattccagcactgatatcaaaatatctttaaaaggcaagcagtagctgggggtacattgcttttgtctttctctaaaattcatgattatcaataaaagaagactgtctcattacctctgttttagttaagaagctgccagggttttaccattatgttgcagtttttaatctttaggactcatgttattctttacttctgtaacattatagtctcttcatctgtaatttttataagagatatttggaaccttctcattctgtcctccgaagtttaacttttccttcttgtatgcatctcttagtatctctttattattgctttttatatgacttcttaatagctcttcttagtatttcttcttaatatctcttaatattaccttaatattatcaatttcttgagaattatcttccaatgcactaattctctttttttctccccactaattctctctttacctgtatctagcaatcttttcgaatcatctattaagaagcagtatagtgtggtggttaaaagcaaagacttcgaagccagacttcctagattcaagtcatttctctgccacttactagctgggtaatgctggtctagtttcttaacctctctgtgccacaatttcttcattgtcaaaatggatataagagtagcatctgcctcataggtttattttagtattaaatgagtgatgaatgagtttagaatagtacctgtcatatagtaaattttgaatttttctgtttttattgaggttttattattgtagtatctatatttttcctctcatcccctccccctctcttcttctcacagaatctccctctgttacccaggctggagtgcagtggtgcagtcactgctcattgcagccttgacctcccaggctcaagtgatcctccctgctttcgcctactgagtagctgagactacaggcgtgtgccaccacacccagctaatttttgttttttgtttgtttttggtagagacaggatttcgccatgttgcccaaactggtctcaaactcctgggctcaggtgatccacccgcctcagcctcccaaagtgatggtattacagacatgagccaccgtgttccttttattgatctattcattcttttttttccccgtctatttcttgctttatggtgcccctttctttcttcatttcttagatccttatgaacatatttaaaatattgttgttctgatatttattgtttctaaggtatgaatttcaccctttgttatttctgctgactttgtatcatagtggtttttaatgttcatctgattcgcaatttcttcactgagagctcacctttagcagaagttttctttggaagtttcagatgctctgggttgtagaggtaccatatgggatggtttcaatttttctgtctttcctaaattttaccagtttttacattaatttttatctttctattcttttcctttcttttctttttctttgagacagggtctcgctctgccacccaggctggagtacattggtgcaatcatggctcactgcagcctcgaacccccctggtctcaagagatcctctacccttcagcaactgcccccacccctacctcgccatagtgggggctacaagcacatggcaccacgcctggctgatttttgtatttttttcagagctggggttttgccatcttgcccaggctagtctcgaacttctgggatcaagcaaactgcccaccttgtcctcccaaagtgctaggattataggtgtgagccaccaggcctggcctaagttttcaatacatggtctccacacaggttggtaaggcattgaagtttcacctttatacccatagactgatgtggctaactttttccctgctatctttcaggaagtgactgaagcttttctagacttagttttccagatgagaccacccttccaggctcttagctttgtgcagggatctcagttccagctcctcatgtacaagaagcttgtgacataaattctcttccctatgcagatattaaaactctagtctctatgcttatatttagttccttattcctcttagcctgttgcctttagctccctaacagagctttgactttgaattgctactttctgtctggcccctaggaatttgccattcttaattttgagcttggcttttttctttaagttttatacagaacaatttgactagtagtagcttttcacattaacttattcaccattgtgtttggtagaatattgtcaggaataacaatgtaaatttaccagagatatttctttaatgagtaaattggctcaatgtatgcattaattgattcataagtctttgaggatctctgatatcaaacaaataagcaagagtcactaaaatcaagaatttattgagaacctactttaacccatttttaaggtcactactgtgtcagttccatttcaaagctagtctcaacctttaaaatacttatactctagttagaggcaaggaataaatacatgaagtacaatgaaaagagctaagtgacaatgcaaaacaaccaatccataaaactgtagatcagagtcatctgggctgaagtaccttgttctgacaggtcatacaactgtacttatccctataaatacctaaggcaaaaatacctatttcttacttcctgcaaagaaattatataaaattatctttcccccaatctttactgtctgtcggcaaaagtgaggcagacttatggttctgagtgagcactaccatttaaaagaaaaaaagaaaagaaaaaaagagtgtgaattgccttaggtaaactgaaattgtcaactctgagccaaaacaatgcatcaaatttagaaatgtatgtcttcttatacattgactttactattttcacatgtgtgacttttaacttttcagataatgtatacctattatcagctttctcagtaaattgtttacatcactgaccattaattcttagaagtccttattgctactttttttggtgttcagaaataaattaaaattctcttctttgttcttttacctagtagtgttttacaactttttgaaacatgaacgatgggttaggattttatacaatgaatgatatgaaagttggcttgaatatatacaccacaaggtttgccgtatggtcctctgtcaaatatctgttctcaagatgccccaaggcatcataaaaacaaaatggaaaactgcaacagaagaccaagaaagaaatattttcaggtaaatggtaaagcagggagatgacacatttcgtgcattgtatttcactctttcaacaactatggattgaatgctgaatttgtgccaggtattttataaactgggcacttgtcatacagtggtgatcaaagtggatgtgatcactaccccttgtcacagtctcataggagagacagacaattaattatatagctctagacttaatatgctaggaaagaaacagagtggatacaataatgggtaataatactatatggtgggtgcagggagagggctccttctgatagtgtgttcagagatagcttctctgaagagtggccatttaggtggggacctaaaggctgagtaagaggttgaagtattttctgttggcagggttagagtttcttgggagacataaaatagtttcaaaagaagcattaccaaaataagagtttttataccttcacctgtgaattatacgcttttgtttgtttgtaaacattttattttacaactctacatactctgatgcaattctgtattttggagttttgtttgtttgtttgtttgtttttgagacagagtctcgctctgtcacctaggctggagtgcagtggcgccatctcggctcactgcaacctctgtcccccgggctcaagggattctcctgcctcagcctcccaagtagctgggactacaggcacgtgccaccatgcccagcaatttttttttttttttgtattgttagtagagacgcattttcattatgttggccaggctggtctcaaactcctgacctcaagtgatcctcccgcctcggcctgagattacaggcatgagccaccatgctcagccctctgatgcaatttgagaataaacaagtatagcaagtataagcaaaaggcacaaggtattctgcatagttaaaagtgcagctgcttaaaaaccatcccgtcttctctactctctctctctctctgtcctcctcctcctctttttttctttctctcatattcgtcttacagaatattaaatctgtttccatattgcttggtcccttccttcatcttaagagagatgttaatactgtgcgttcattgagaataaccaaatggatgttagcattgttctttatttaatcttaagtaaaatattgtttttttcttaaaaaaaatacatttatcaaaatttatcttacccttatcaatctcaatacagttgtctttacattaacttctattagttggctattgtcctatgttttatatattcagtaattatataatatggaacaaaagtaagatatcattgctgaatgctgttttatggaaaaagaaaagcctttggcattaatgtaatatatactcctgttgattaatactttgaatgtctttctgtgagatatatacaataatgcccataaaatgatcaattttgataccattctgatgcattaaagatggtgaaataaatgttttaaaaagactgggagatgcgaatacctattttttgaaagcaggttagaatgtaatgcataaatgggcaaatgaaaataaaagcataaacacatagaactaccagggctgttgaatagtacctgactcaggtctcttccctccagaaagactataaaaaaacttctaggcaaaacagttgtgtttcatattttttaagtgctggttagtaaagactttaaaaaactcattacaaagtatttcatgattacagaagaacatgtaatagatagtatgtaaggtataaagaatagtgataatttaaaatcccacgaacttagcacccagctaaagaaatacaactttatcagtgctctttaatgccctgtctgttctgagatcctgtattcctccccctgctccaaacggaactactatcctgaactctgtgtctgttgtccctttgtttttctttatagttttactgtatattatgtatacataaataatctattgtctacttttcctcagttttgaatctttacataaacagaattgtaaaatatgccttattctgcaattagtttttatttttcactaaatcttgtgtttctgagattaactaatattggtgcatgtatctgaatccaattcctctgccacatagcgtttcattggatgactataccacaatttacttagccattctcctgtcaatgtacttgtggtcgccccctccaccaagtcttttgttaatataaacaaagctgacgagaacaatgttttattttgcttcctgatgcaaatatgcaagagtttcctctagggcgctattctgaaacttttttttttatcttagaacctctttactcacctaagaattgaggataccaggaacttttgtttacatctgttaaatgtatcagtatttattcaattagaaatcaaaacagatcatgttaaagcatcagaatatataagcacacattccattaaccatcaaagcagcggtgggcacttgaaacatgagtggcattggaaagttttgagatagagactctggaaactactgtacactctttcaagaatgagagtacaaaaggcagatttcttagtactattatgaatgtagttttgacctcatggacctgctgaagggacctcagagacctgtagctttcatagaccacacattgagaactattgttccaatacaaatctaaggttagaatcattaggtcattatgtctcttcaattactagataacatcaaatatttttctaaagcagttgtactgtaccaatttataatatcaatagcagaatatataagtacttcctttggtacacattctagccaacatttggtcctgtcaaacttttccatttttgacaatctagtggtttaagatggtgtctcactgtggtttcatgttacatttctgtgatcactaatgagcctcaaaatttgtattggccattaaaaagactgttaggtctttttctgatctttcttttgggttgtttatcctctttaaagaaaattctttcaattagttattgaaatattacagatacaaaccccttgtcacttatatgtcctgcagatatttagaaacagttgtggctagtagtagtattacttttaaaaatgtgccttttaatgaacaaatgaacagaattttaaaattagacagtctttttttttttttttgatggaatctcactctgtcactcatgttggagtgtagtggcatgatcttggctcactgcaacctctgcttcctggtttcaagcgattctcctacctcagcctcccgctgtagctgggattacaggcgggtgccaccactcccagctaatttttttgtatttttagtagtgacggggttttaccatgttggccaggctggtctcgaactcctgacctcaaatgatccgcccgcctcaacctcccaaagcgctggattacaggtgtaagccaccacgcccagcctatatagtcatttttatcagtcatttcctttagcacttagactttttgtattttaagtaaccctttctaccttcagttcatgaagatatttttctgtattttcttttattcattaaaacaacactttttgattacctactactatcagacacagttctaggtagtgtggatatggcagtgaaaaaaatacatttaaaaaaaaaccctagactcttagagcttacattctcgaagtggggaggaaaacaataaacacatatgcaagtatctcttagtctcttcagactactgttacagaatactatagactgggtggcttaaacaacagaaatttatttctcagagatctggaagttgggaagctgcagatcagggtgccagcatggtctggttttggagaaggccctcttcctgttttatgcatggccgcttcttactgtgtcttcacatgtcagagagagcagacaggaagcaagtgctttcatgtctttttataaaaggcttgcatcaggtggttggcaataatgaaaaatgtccagattcttaacgtgaagttaaaaattcacaaattgattagaatccacccttatgatctaattatttcccaaaggccctatccccaaataccatcacactagggactagggtttcaacattggaattttgacaggacattcagtccatagcagcatgattttgtatgaaggatagtgataaatattatgtagaataataacgtcagtgagagtgccaagtggtcagaggtggggttctgtaggacagaacagcaaagcacaaacttcccaaggcaattaatgtacttggagagtttgaggaaaaggatgaagtccagataactagaatggagttagcaagaggaagcgtattaggagatctggttgataacagaaacccagatcacctagggcctcctaggccattttaaaggcttgagcttttactttgagatggtaaggcgatggaaagttttgagaaaagaaatggcaggtttttaaaagatcactctgtctcctggtttgagatagtctatatgcaagcaagggacaaaactaggggaacatgtaggaggttgtttcagtaattgaggcagaaatgatggtggcttgcatcaggtggtggcagtagtgaaaaaatgaccaaattcttgatatattttgaagcttttatttgcaattggccagtcacagtggctcccacctgtaatcccagcactttgagagccaaggtaggcaaattgcttgagctcaggagtttgagactaggctgagcaacatggtgagacctcctctttacaaataattttttaagaaacgaacagggagtggtggcacatgcctgtggtcccagccacttgggaggttgaagtgggaggatcacctgagcctgggaggtcgaggcagcaatgagccgtgatcgtgccactgcatttcagcctgagtgacagaatgagactctgtctcaaaaaaaataagacaaaagtacccaaaacaaacaaacaaagatttgcaaattgattaaatatggtttgtgagaaaaacagagtcaaaaatgagtaattcctttttttgttgttttttgttattttttgacatgagtaactagaaagacaaagttgtcatttagagagatgaggaagattgtaggtggaacaagtttaggtacaagagtaagaagttatttttgaacatggtaattttcttatgtccatgttcaccacatagggacaccaagaaagcagttagatatatgagtctggacttatggggagaagtccaacctggacatgtaaatctgtgaggcattagtgcacatagtctttgaagccattagactggatgagattaccaaaggattgattatagatagaaaagggaaggggcctggtgtgtgatccatgacatactataatgtttagagttctagaagatgaaaaggaaccaacagaggggactaagcaatgaccggagaaataaaatggtatttaaatcatatcctgcaagccatctgataaaagtcttttgtaaagagagtgatgaaatttcttaaataaaatgaagtcaagtgaaatgaagacagataattaaacatgaggtctgacaacatgagcctgacaagtcctgtttggatatagtgttggggcaaagaacaagattggaggagattgaagagagaagggaggaattggtaataagaagtattttcttctaaagctcttaaattttcaacatgttctttaaatacattgctttttacctgttacaaaagtaatagtgttcattgtagataatttaggaaaaacttaagaaaatattttatatggtccaaaaaactaactataaccactgtagatattttggtttatagcattggagtccatttttttctgtgcatttttataaattcattttctaaacaaaaaatacattatagacatatttacatgattttcttttttaaaaaattatttatttatttatttatttttttgagatggagtctcgctctgttatttaagctggagtgcagtggtgcgatcttagctcactgcaacctctgcctccccggttcaagcaattctcctgcctcagccccacgagtagctggaattacaggcacgcaccaccacacccggctaattgtattttcagcagagcccgggtttcaccatattggccaagctggtcttgaactgctgacctcaggcaatccacccgcctcggcctcccaaagtgctgggattacaggcgtaagccaccgtacctggcctatttacatgattttctcacgtaagaatgtaccatgtttgtctttccttagtatttttaatggtagtgtagcgttatattatgtattacggtttatatgtagccaatatcctattattaggcacttttcaacattttcttttagaaacattgcagtgagcatttcaatatgtaattatagtctttcattagcatattcttaaagattttgacaattagcccactgggatatgtccagaagagaaatactctgataatggtcggtctgcaaaccttatcatacatacagagggcttaggaatagttgtccacgttgcaaaaattgtaagggttcagtggaagaggaaagctgcccagcagcagaaggtagtccttatagggaagggcagttctctgacagaagaggccttgtccatagaaaagatatgggtagaattgcagcagttgtttgtatgtgcagcagttttttaaataagaaactttccgggctgggcgcggtggctcacacctgtaatcccagcactttgggaggccgcgacgggcggatcacaaggtcaggagatcgagaccatcctggctaacacagtgaaaccccgtctctactaaaaatacaaaaaatcagccaggcgttggggcgggcgcctgtagtcccagctactcgggaggctgaggcaggagaatggcgtgaacccgggaggcggagcttgcagtgagccgagatcgcgccactgcactccagcccgggcaacagagcaagactccgtctcaaaaaaaaaaaaagagtaactttccatattttattgaattgtaggtcatgtaacgaaggttttccatatatctcataggcacaaatataaacattgtatgcattctaaaatcaaataaacacaatctcatttatatatgtctatgcatgtctgtgttgtagttgaggaactttagtttatatgttatactaatagtttactgaatataagtttgaaatatttttctagaattaaggagtatttttaaatcaacttagaattctattttctgcaataggaatatgacaaacattttctcttttttgaccataaactacttgaaccctgtagttttccatttagcttactattttaaggaatgtgataaatcaattgcgaacctttttgttttctttttcttgaggcttctgttgtgatttccagcaaaaaggtcgatgtagacggcattttacctgatgttgatgttgcttgggatcagaattgacaatcaggagtagtctctcagtttagatttacaaaaggccagataacttggatatcactactgcttatagaaacatctctatctctcttcttccttttcaaatattatactcactagatcattaataagtaagataaaatgttctttacactttcacatagcctctgaatttttcccatttaaaatgcactgcttgaaaaatcaaggggaaaacaaaggtttaaattttctttacattttagataatgaaaagagggctcaaatgaagagtttaacagaggcacctgatgggactctttttattgcatataaatagaactattcgtgctgctatttaacaatcaaaatctaaatacttcagactgaagatcaagtcccctactttcaaactatctcccaaaacttcccattaaggactgtatactctaggtgaactgaattaccttccgttcactatgcccagaatacagttttctagaaactctctgtctctgtgatattcacgtcatgtaggtttcctatgtccacgactttgaaattctaaatctaatccataatttaaggttcagttaagttgccaccctcttcaaataggcttcctggaataccacaactaaaagtaaaatctctgccattgaactttattttcatataccaagattctactacagtgctaaaacataattatgactatgggctagtcacaggggcttatgcctataatcccagccctttgggaggccaaggtgggcggatcatttgagttcaagagtttgagaccagcctgggcaacacgacaaaaccccatcttgacaaaaaattagccagctgtggtggcgtgggccggtagtcccagctacttgggaactcagaaggttgagatgggaggattgcttgagcccaggaggcagaggttacagtgagctgaaatggtaccactgccctgtagcctagatgacacagagagacccagtctcaaaataataataataatatttatgattatgtttaattttgatttgttctgttgcactcttatgatgcatgacatatataacaaacaattcctaaatatgagtgttcctcatgaaaatcactagcatatgtggatgcatacttatatgtatttttggccttttgattgagtattcacaaatcataagtgttccgcttaggagtacttttaaaaagtgaaaaaagggctggacctggtggctcagacctgtaatctcagtactctgggaggccaaggtaggcaaattacttcagcccaggagtttgagagcagcctaggcaacatggcgaaatgccatatctacagaaaaaatacaaaaattagctgagtgtggtggcatgctcctacagtcccagctactcaggaggctgaggtgtgaggatcacttgaccctgggagaagctgaggctgcagtgagtcatgattgctactgcactccagcctgagtgacagaatgagaccctatctcaaaaaaaaaaaacagtgaaaaaaggagttaaatagaatagtatctaatggtatctaaagtagcagttaagcagtagagtaacagttgcatttattaaggatttagtatataataatttttattatataaaattattatataataaaaatatataataattatattatataattataatatataaaattgttatataataaaatatataataattgcatatgcgcatgataatttttatatgcactcatctcctctgtacttcacataaatcctgataggtaaggtactattattattcttactttacaaatgaagaagctggaacttggggaaattatgtaacttgcctaagttctcatatatagtcaaagacccccaagccttttaaccactttactatgctgaaaaaagtcagaagacgtagcaagaatgtaaagttttgaaattaagtcttaggacacagaaattatgttagaaattatacttgggtttcaggattacattctcgtgtgttggcaaggaggacgctactagctgagtaagaaatgatgtgtgtgctttatgactttattatgtgaaagggtactaaccatagtagagggttacattaatgtatctttagttgttgtagatattaatgggagaaaaggatttataagagctttcataaaacaatttgattcctttatgcctctaaagctgttttcccaggaaacattaaaattgtaaataatgatttatcctactgtggggttcttcggaaacttaactcttggggttagatttctactggtgtgtgtgtgtttaaaagagctattaataaaactgcatatacattattccattgtggtgttttaattatttttgattgatcctgctttctaagctccaaattagaacaacccctttaaacatttattaggaagaaatatctgaaccagtctgacctgacatttgtagacatcatcttagggctgttctccccttagaggatagtaacttaggactatatcagttacgtctggtaacgatatgccatgtctgtgatactagcatgcatttctataaggaaggaagagatggagggagagaggaatttgttttgaatactctgaaaatgtctagccagtggattataattaccataatcacagtttttggccatttggatgaaagaatgttgttcatgcccatactgctagctaagacagtcatgtgcatactgcattatgaacctatttccaatagattaggaaaatagttacaacaggtttgaggcttctgttttgcaaaaaccttttatagcgttatggtctcagaaggaaccattgaagaaaataatcattaacattttctcgaacactaaatcctccgttctgctcctccaatatctcataggctgtcatctgatatcagcacttatgtaatgtcacgataggtggtgccatagttctatactgccttacattataggaaaatataaagtgttatttgaccaattgaataaaaagaagaaaaaatgtaaaaagttttctgaaccctggttttaagaaatttatgaacaactaaaaatttctcaaaggactgcatttttccattctctgttagtaaaatatctcagctgccttttgattctgctagctgcgagaatggcagaatggggcctgaatggcaaactatattatttgtaacattaatgccagcctgtttggagattaattactatctttgtattaaagtactggttgtgttggaattgctgcctttttaaacttccccccaacccttggtcatttctactgatgatttgcagtaaaatagctgacaactgcctatgattagtttagccagatgctacttgctctggtaaattcattttaagcatttgacaagactgcaaagattagtgccagctgagcttaaaatatttttacagacgaatgatacgtgaaaagtcagttacttttcaggtatatgatgactatgtaaattaactgacaacatatcttctttggtgtttatttgtgaatcatttatctactttatagaacaattggtagagttatccttcacaggtatattcagaagatgtcaccaaatggagtgctttcaagtttttgtatgttattatgttgtcctatgaattgcctgtgctccaagacttatagaattgcagggtaaagttgggaatctctggattagagaatgaaaataaaagtgagaagtcttttctttagctacttctaccattcaacatcaagaaagaggctcttactctcaaaacattgttcttaggaatggccatcaaataaatgccttagttacagataacattgaacaatgatgagtagtttattggtttttcacctttcttcattctttgccctcttttattattatatctttactctttctcttatgccctttttaaaaagcatgtattatactatagaaatgtttcctattagtgattaatgtgataaatttgattagttgaataaaagcaaactttgattctagattttatctatttcttggtatccggcactgtcaaatacagttgtccctcagtatccatgaaggattggtgtttttttgtttgttttgttttgttttgttttgttttgttttgttttttgagacggagtcttgctttgtcgcccaggctggagtgcagtggcgagatctcggctccctgcaagctccgcctcctgggttcacgccattgtcctgcctcagcctcccgagtagctgggactacaggcacctgccaccatgcccggctaattttttgtatttttagtagagtcagggtttcaccgtgttggccaggatggtcttgatctcctgacctcgtgatccgcctgcctcggcctcccaaagtgctgggattacaggcgtgagccaccgcgcctggccgaagtattggttttaagacctctgcagattccgaaattcgtggatgctcaagttctttatttaaaatggtatagtatttgcatataacctatgcacatcctcccatatactttaaatcatctctaaaccacttataatacctaatacaatgtcaatactatgtaaagagttgttgtactttattgtttagggaataatgacaagaaaaatagcctgtacatgttcagtacagacacaaccatccaatttttttcccaatatttttgattcgtggttggttgaatttatagatgtagaacccatggatatggagggtggagggcctactgtatagttatctctataggttttgggtagtttcctgtccttcacccagctgagtgtgaccttgtctattagaatcatatatactgttctggaataagcttgagatgttatcttttctaatctcattttaccaatgaggaaactgaggtcctacaatttcaataattagtcaaatagcacatggcaaaaaaagtggtttatataggattggaccctagttttcttcaccttccagtgttctgtccactttttggacttcgtacatttgaatttctttatactttgctgatttcactcaccaaacttactgacttacctgacttctgaattatactcagaacaaaacacctgtatgaaagtcttcagtggcaccccattttcttttccagttttccttcccttctttcatctctccctcccataaggtcttcctttttccttcattactgcattttttaattcatgtagaatctacaattttcacttgtagttttatttcaaaatttgttaattttttctacgtctcttttttgttatagctctgaaaagcctacttaaaaaaaaaaaaaaaaacaaaaaccctgctaattggcttttcttcctggtctattgaataaagcactagatagggaataagaaaaccttgatgcattttcttaccttgaccagtgacatgcacactctgtgctctagttttctattaatatcaataaagcggtatttatctgtactgcagagttatcaacctgatttaattaaaaaatctagatatgggccaggcacggtggtttgcccctgtaatcccagcactttgggagaccaaggagagcggatcacttgatcccaggagttcaagatgagcctgggcaacatgacaaaacagtgtttctacaaaaatacaaaaaaagttagccagttgtggtggtgtgtgcctttaatctctataatcccagctgctggggatggggggccttggggggaatgctgatgcaggaggatctcttgagccctggaggtcaaggctgcagtgagctgtgatcacaccactgcgctccagcctggctgatagaacaagaccctgtctccaaaaaaatctagatacatttggggctttctcagagaatggtgcacagaaaatagaaaacggtattagcgttttaagatatggaaaaaaagataattgttttgatattgatggttattattactaatttttaaagactagtatactcctagcttttcaagacaatgatgaagcaatcctgtacctgtgacaggcctatatttctctttttttttttttttttttttttttttgagacagagtctcgctctgttgcccaggctggagtgcagtggcacaatctcagctcactgcaagctccacctcccgagttcaagcaattctcctgcctcagcctccagagtagctaggattacaggcgcccaccatcacgcctggctaatttttgtatttttagtagagacgaggtttcaccatgttggacgggttggacaggtctatatttctttccgtgcttattttacaactggtatggtctgaatgttctccaaaattcatgtgttgaaatgtaatcgtcaatgtgatagtattaagaggtgaggcctttaggaggcgattaggtcctgagggcagagccgttaaggatgggattaggactcataaaatggtttgagggagtgggttcattttcttccactcttctgccatgtgaggacacagatttcattccttccctagcatacaacaataagccaccatttcttggaagcagagtagccctcactagatgtacaatctgctggtgccttgatctttgacatcccagcctccaaaagtgtgagaaatgattttctgttgtttacaaattacgcagtctgtggtatactgtattagcagcacaaaaatactaagacaaccatcctatgctttagattaaccagtatttaccatataacttgtaaatcggtgttagtggtggtaatgggattactaatgtgcatgtgttaacatgttcattggttcaatgcgaggctgtgatcctgtactctgagtgtgccttttttttttttttttttaattactttaagttccgggatatatgtgcagaacatgcaggtttgttacataggtatacatgtgccatggtggtttgctgcacctattaacccatcatctaggttccctcccctcacctccccaacaagcccgtgtgtgatgttcccctccctgtgtccatgagttctcattgttcagctcccacttatgagtgagaacatgtggtgtttggttttctgttcctgtgttagtttgctgaggatggtggcttccagcttcatccatgtccctgcaaaggacatgacctcatttctttttacggctgcatagtattccatgatgtatatgtaccacattttctttatccattctctcatcgatgggcatttggtttggttccttgtctttgctattgtaaatagtgctgcagtaaacatatgtgtgcatgtgtctttatggtagaatgatttatattcctttggatatatgcctagtgtattagtacattttcatgctgctgatgaagacatacccaagactgggaagaaaaagaggtttatttgaacttagagttccacatggctggggaggcctcagaatcatcacaggcactttctgcatggcagcagcaagagaaaatgagaaagatacaaaagtggaaaacccctgataaaaccaacagatcttgtgagacttattcactaccatgagaacagtatgggggaaaccacccccatgattcaaattatctcccaccaggtccctcccataatacatgggaattatgggactagaattcaagatgagatttaggtggggacacagagccaaaccatatcacccagtattgggattgctgggtcaaatggtatttctggttctagatccttgaggaatcagcacactgtctttcacaacggttgaactaatttacattcccaccaacagtgtaaaagcattcctatttctccatagccttgccaacatctgttgttttgatttgcatttctctaattatcagtggtgttgagctttttttcacatgtttgttggccgcataaatgtcttctattaagaactgtctgttcatatcctttgcccagtttttgatggggttgtttgtttttttcttgtaaattccttgaagtttcttgtagattctggatatcagacctttgtcacatgggtagattgcaaaaattttctcccgttctgtaggttacatgtttactctgatgctagtttcttttgctgtgcagaagctctttagtttaattagatcccctttgttcattttggcttttgttgccattgcttttggtggttttgtcatgaaatctttgcccatgcctatgtcctgaatggtattgcctaggttttcttctagggtttttatggttttgggtttcacacttaagtctttaatccatcttgagttaatttttgtataaggtgtaaggaaggggtccaattttagttttctgcatatggctagccaggtttcccagcaccatttattaaatagggaatcatttccccattgcttgtttttgtcaggtttgtcgaagatcatatcgttgtaaatgtgtgttgttatttttgaggtctgtgttctgttccattggtgtatatgtctgctttggtaccagtaccatgctgttttggttactgtagccttatagtatagtttgaagtcaggtaccatgatgcttccagctttgttctttttgcttaggattgtcttagctatatgggctcttttttggttccatatgaaatttaaagtagttttttctaattctatgaagaatgtcaatggcagttttgttgttgttgttgttgttgttgttgtttttgatgggttcttgctctgttgctcagactggagtgcagtggtgtgatctcggctcaccacgtcctctgcctcctgggttcaagtgattctcttgtttcagcctcccgagtggggattacaggcatgtgccaccatgcctgggtaatttttgtatttttagtagagatggatttttgacatgttggccaggctagttagtctcgaactcctgacctcaagtgatctgctggcctcggcctcccaacatactgtgattacaggcatgaaccactgtgctaaatatgtatctaaggtggcatgagtatatgtgttgttgttgttgttgttgttttgtttctttgagacggagttttgctcttgttgcccaggctggagtgcaatggtacaatcttggctcaccgcaacctccgtctcccaggttcaagccattctcctgcctcagcctccggagtagctgggattacaggcatgcgccaccaccccagctaattttgtatttttagtagagatggggttttgccatgttggtcaggctggtcttgaactcccgacctcaggtgatccacccgcctcggcctcccaaagtgctgggattacaggcgtgagccaccacgcccggcctagagtgtgtgtttttaacaaaggccttccttgccacatcctcattccagtcctagtttagttaatgtgacaatagtagtcttttgcaagataaagattataagtaggtaaccattttagcatttgatgcactttacagattgcaagcaataatatgctataaatttagtttttataataagatcatggtgtgttaatagatcatattctgtaggatagttatagaaagtttttaagtactcttttaaggccaagattcatcaaccatttgcttatcctctcactatttgctgtaatttgtcagtatccttcacaataaaaatagattatgacataccttgggggttcagtgaaggttaggacaagttagggatccaggtaaagcttcagagaggtgatgtaatccccttgatgagattccagtagattaagatcttagtatggcttgtgggggctaggcatgataggaggaagagaagaggttggaattctaggtagaaaaaaacaattaaactgagatataaggtaaagaaagtacagagtaaagtacagagtaaatttgaggagcaataagtagtccatcttggctgaagcataggatatgtgtatagtactgagagaaatcctgtggtggaagaagtttgagactatatcataatggcctcgaatgccatgttaaggattttcaattttatttagaaggctgaggggagaggattgaagaattttgagtagcagaggaattttatcaagaggttgttttgtgatgattgataggaatcatcatcatcatgatatgaataaaatggatagagtaaaaattgaaggtggaccccacttattattaggttactgcagtagtccatgaaagaagaacctaaaccagagtagatgcaactgacattaggaagaaagactcaacagtaatttatatttttatgtggccaggatatgatcaaagacaattctgagcctgaataacttgctgaatagggatgcattttttgccttttttaaaaagaggagagcagtagattcagagaaaggttcctggcttggggagaaattatttttgaacttctctggtttgaagtatacattgagtatatagctagagttgcttaatagggagatgaacatatggtactagaattagaagaagggtgggtatcagtaattacctatttttgcaactgtatctacaaagataataattaaaatgatgagattaaaagagatcactagggcagagagtataagaaaggaagaaagataaggaaagaactttggtgaatacctcatttaaatatagaaataagagttatcagagaagctgggtggggtatttatgccgaagcagtgtttagaaaacttatggaagagaaaatttcaggaaagaaagggttaatcagcaatctaagtttttaaaaacttttgcgaatttgtttttattggggtataagacatgggttggaaaatgtcagtttggggtatgcacttgtctccaggaaatatctatcctcatcttcccgggatgatttttggaactttttctctttaatggagctgctcttgctgccagcacaagttcactgctggctggctcctccttggaagataattttctcctttgttttggagacacttaacaagtggattaaggatttaaaagtaggttatttgatttgttggcctaggttatattgctgatgctgcaagaataattttaataaagtggaaaggacaaagttcatattgtaaggggttaagtagttcctaggtgataattaaatgtagtcaaatttgtatagattgcagtcttttcaaaagtttaacattgcttatttttgtcttcataatattaaaccaggtctatctaaaattttaatatcacatgcaagaagcattatcattttgtagcagatttttaaagctgttatttcagattttgaactgatcagcatgagacagattttctttagaaccatttttgttctggacaaaattcaagctggatattactgattactctgaaatgcaaatagtgctattttgttttacagctatcatttaaaaagccatgtactcattaagataaatatgtgcagcatgaacaacaaaaaaatgagaaagaaaatggacattatttgtattttgtaggctctctgatatggaactgaatgcactaatcttcaaatactaatgagcagcaaaaagcaatttgccagtgcacaattaacttctgactggcttctgttgatatgtagtgctataaccccacaccaggtgaacttcccattttttgagattttatttgaccagtatttataattgtggccaaataatgagatgattattatgaaataatgttatgttggagtaaatcatacttacatggagctcttattatagtttctctatttaattgtctgccaccagggccttgagcttttattttcctctttccccttctgctcttcttgccttttcccatcattgaagaaacaagggcctccctctcaattctcaatttggaaacctgctagtggcatgtcttagttacaaacactgtgttttatatcatgtggttatgttcgtcacttatctcttctttctgttaacttttattctattactgtgtcatgtcatttatatgtatgtacgtgtagatacatatacatgcatatatatttacattcagatatatatgcatcccccatgcatgcatacatatcatacagtagtggagaggaggttgtaaagcataaagtttacctgttttgctcatggtttattgaggcagattttgtcccttagctcagatgagaaaatccctactccacagtcataagctgaaattctcaatccagccagatattttgcaaatgtgcctctggtgcctggggagattgagttaaagcatatatggctcagtgagaccaatcattgtgattggcaaatgaactcaaaacactatcttagtaatgttaaggcagttgggaattttatttccacaacatgcaaactaatactctgaatgagtagcagattggaatatggtaggaaactttgaaattgtgattctcaaataatttagcctaatgcttgtttcatagaattatgaaatcttgtttattgtaaggaaccttagaggatcatctaatttaatcactttttctaatgcagcggcacgttgtataatacccctgagaggtaaatgtccaatgacatggaattccttactttgtctgggctcctgctgcattgaaaatatattctttgtacttggctggatgcggtggctcacgcatgtaatcccagcactttgggaggccgaggcaggtggatcatttgaggtcagaaatttgagaccagcctgaccaacatggtgaaaccctgtctctactaaaaatatttaaaaaaacaaaaaaaaagaaaaaatgacccaggattataggcacccgtcaccaatcccagctactcatgaggctgaggcacgagaatcgcctgaacccaagagacagagattgcagtgagccaaaattgcaccactgcactctgggagacagagtgagaccctgtctcaaaaaaaaaaaaatatatatatatatatatgtgtatatatatatatgtatatatatatgtgtgtatatatatatgtatatatatatgtatatatatatgtgtatatatatatatatgtatatatatatgtatatatatatgtgtatatatatatgtgtgtgtatatatatatatatacacatatatatatatatatatatatatatatatatatatatatatatatctcacttcttcatactgaattgagatctgtcctcctgtcagctctcactcagttccaccatgggggcaatacagaatctgagatttatctcttcctcatgacagttatttaaatatttgaagcactttccattttgtttacttttctaaagtacttttctatggtacctatgcatactttgttaaccatttcttgattgctgactcctccagaatgttggttattctctcttacttattataatttgtcaatgccccttctaaaatgtcatatgttatttaacctaatgcttcaaataaagttttacctttgcatgatacaattgaacaatgccttatacattgtaggttcaaaggtcaaatctttgaagtataggttcccatcctaaattattgatgacagttttttagcttttatagtaattgcatcttgctgtgaatgcatgttgactctgtggtcaacgaaaaacctcattcctttttttcttttatttttataaacacaaactgcagtcaagttagattatcccaaatcccggacctatataaatgatttaaaaaaaactaattgtaagattttcatttatccctgataaatttaatttttgtttggtttcagttcagcactgctacccattacaaaattttgaatcctgactctatcatctagcatattcgcagtccctttgggttttgtgtcatttgtaaatttaacaagtataccttcaaacagcttcttttaagtcactgatttttttgaaaaaggaacaagaaatgcctgcaactaactaccataaacctcctactggttgacaccaatctaattattaatagccttttaatttaatttttaaaccaaattaaaatctacccacctgtactaatatccagttcttatgcgtgttcctttcccacaatggtatccacagagaatttacccaaaataaaaatatgttatgcatttactttccagttgattttctctaagaaacagttgccagtagtttggcatcagttattttacataatccatgctacttcttgatttttagcatgatgatttataaatttatgaagactttgggcatacccaagcatgaggcagagttgggagtgcttcattttctttaacacaattgagaaaagttgatatttttatcaagacatttgttaaggaagaaacagggaaggtataagaaatctaaataaactggcttgcatactacaggattctaatctccctctagctaatgcagcctacagggcctagcccattccacatagagacctatggaaagtgaggggctttgccttgactcctcatttccactattttggtctgcttccatgttttgagtgtcatttgatacacatcatccaagataatcagtctggattttatgactgttgaatatagtacaagaaaagttatgtccttttgcctgtttacgtaaggaccactctcttaattcctgtttctagaatgaaagaaatgccttttctcaagttgattgttaccaggaatgacttcatattgtttgcgagattccactctatccatatgcttgtggccttttcccatacagagtcaatagtatagtaacttaatacaacctactatcatggaattcatttagtaggaattatcagtttgtaataacagggaatatgggcacaaattgccacttattctggagaaagtgatgagaatgtattagaggaaggagtagggatttagggattgaagactaattaagtagcctttttttttttttttttttttttgcaactgtctctctctgttgcccaggctggagtgcagtggtgctcactgcaacctctgtctcccgggttcaagtgattctccaacctcaacctccctagtagctgagacaacaggagtacaccaccatgcccagctaatttttgtatttttagtagagacaaggtttcaccatgtttgtcagactggtcttgaactcctggcctcaagtgatctgcctgcctcggcctcccaaagtgctgggattacaggcgtgagccaccatgcctggcctaagtacctatattatcttccatatgaaatgtgatgagtaccttaactagtttgtagcaatgtgattgaattatagacagttcgctggtaaaaataggcaaatgataaaatataagagactggggaatataataatcaatataagtaaggagtttttggaaatcaaaaattaagagaactaaagtgtttgtgttacacttgggatcatataaacagaatgctaatgaatgaattgtaggtttttaagggttattttccaaacttagcaaggtaattaacatatcatgctaatacaaatattaatagaaatatagatatactttgagcagcctgcagcctacacctactttcctagagctattgaggttggagagcaaggtgaaaatgatgggtttagatttagttctggattactctgggtgaagattttaagcatgtagttagaagttttacctggagagatatttggaagttgccaaaaagataataggtaaattcaaagaaaagtctttggagtagaagacgaagattgcagataaaatcttagagaataatgcctacctttaggatggaggttgaaaagaacttgccaagaaagagttacaaaagaaaaggaggataaccaaaatctgtgctttatctcaggagccaagagaagaaagcatttttagaatactagggagtaaaacaacaccatcagtgtccacagagaaattgagaagaataagctgctatcaggcctttaagtttggtggtgacatagttatggagatatttcatagaagaggttgaggagactgggaaaggtagattggaagggctcacttaatagaagcagtagtggaggaagcagaagcaatggaccgtccaatacgaatagtcatgaaggtaaggaaagagctttactgtttcttcttcccatttaactgatagctcagtagataaaaaaggagaacaagataaacttatttgttgaaaaattactagaagtttgttatattgtttaaattgatttcaacttcagactgtttaataataagtacatagtttaaccaccataggaatgaatttgagttctttgctctgtataactttaataacagacagatgttagtctttcagcaaagaaacaaaggttgttccctaaattactttagatttacaatgcaatagagcattttaattacattcatatgtgcagacttttaaaaaataatttttaaatggtttattatggtaatagaagcacatttatgccacatcatgcaacacggaaagcatattctctctgttgagtggtgtaaaatgtttgtggcttttgcatctcacatttcttgctttagaagtgctactgtcatttacattctctagtaatccaattgtgaattttatggatatatatgagcatgtgaggacagggtgccagtggaaagctaagaaaaggagaaaggtaaataacagccagagaagttggcaagattactttttcttcaccgtgccaagacagctattttagctgaaaatgaggaggatgggaggtgcacaggaatttagttagatatagaaagagaaaagctgggcaaataattcaggtatgtaagcaagttcaagagatgaatgaagacattattctgatgtctgaagagcggaggttaaaggaaaggttgactaaccaaaaagccttatgtgaacccagggtaatcaataactgcgcttgattagaggtcttgtagcagtggtatatagaagaacagaagaaagatgtggcccccaaggtcgtatttaccagagagaacagtctgagaaacaagccacaaaagaattggtctatgaagcttttctcagaatcagtcgtccccccccctccctccctcccaccctccctcttcccttgctaagtaatggctggacactacagaagtactgtatattcctgggtttatcttaggatatggatagtgaattacaaatgatattttaacccatctattgccattgatatgtaaaaccattttctttattaaaaattgccaatccctatgtccaatattataaaattaatgtctctactaaatgaagaaaaaggttaaaaaataagaagcaatttttaaaaaatccctctttttgcctagccaaaaagaaaaagaaaacaaaaagtgagtaggatttattgtgagaaaatgtaacctttaaagctggcatgctgtttgagttacctgcctctgaagggcaaggccctagagagatgcttaactaggcaggtatgatgattgcagtgcccttagggcaagagcaaaggcagagattgtcaacacataggcaataaaggctgcctactcaaactctgggcactcttacttggcttgttaagttgtatcctacgtgcatgagtgttttggctcaggagaaaaactctagtgctattagaaaatgtctctttcacatagacagtatcaaaacggctttattagtcttaaataatgaaaaagtagcagaaacagatttagaatttaatctcttggtttctaggtttctcgtcacttgcttcaccactgatgatctgctctgtttttcaaccaaattctttgtgaattcatggcattggtagccccattctttgtgtttgtacaatgcactagtctccagagtgtgcattccttgaatgatagaggtttttagttatagtggcatgggccatcactagggtagatgaacagatttgtgattctaggatattacgccagtccagattgggaaaagttttcaaaggtttaaaggtttttctgcgggctgcctttgtttcagcagagtggagagaatttaaaaacatgtacccttaataggaccaatagagtttaaactatatattgtgtaacttttagaaacttttcaaagtacatatcttagcaacttcagaaggatgacataagggtcagcctcactggggatgctgtcccatgttgctccttagttagcaagacattgtaaatcggccaggcatggtggctcacgcctgtaatcccggcactttgggaggctgaggtgggtggatcacgagttcaggagttcaagaccagcctggccaacatggtgaaaccccatctctactgaaaatacaaaaattagccaggtatggtgtcaggcgcctgtaatccctgctgaggcagagaatttcttgaacccgggaggcggaggttgcagtgagctgagatcatgccactgtactctagcctgggtgacagagtgagactccatttcaaaaaaaaaaaaaaaaaaaaattcataggtactggactctagaaggtgaatcactgccagtccttcccccagttcattatctgaagtcacaaggcaaagttctttctcctaatcccataaagtcctcgtcctttccccacctaattctgtgtgcagtagccccctctttcaaatgctaagtggacctgactctcatacagagaaataaaaacgggctgggcgcagtggttcacgcctgtaatcccagcactttgagaggcccaggcaggcggatcacctgaggtcaggagttcaagaccattctgaccaacctggtgaaaccctgtcgttactaaaaatacaaaattagctgggcttggtggctcatgactgtaatcccagctacttgggaggctgaggcaggagaatcgcttgaacctgggaggcagaggttgccgtgagccaagatcatgccattgcactccagcctgggcaacaagagggaaactctctcaaaaaaaaaaagaaaaaaaaaagaaaaatgtattgcttcttggccttttggctaagatcaagtgtagaaataaaaaattacacatttgttggatttgttccttcagagttcttccttttaaaatctctagtgggatagatactgagaaagcattttgtatcttccctgggaagcaggcttaaggagagtagtctcactcttctctcagctctaggaaagtaggtgtaggctgcaggctgctcaaagtatatctatatttctattaatatttgtattagcatgatatgttaattaccttgctaagtttggaaaataacccttaaaaacctacaatgcattcattagcattctgtttatatgatccaaagtataacacaaacaagatactttttatactttagttcgcttaatttttgatttccataatatcgtcagtttatacttaaatcttagggagacaaggtagaagaaagaaaagtgactggatagcagcatgagctttgctgccctccaaataagtgctgaaaagatgagtatgagtctactctaatcatctcaaaaggaagcagtgaaaaactgaacattagcatgttcatgaacctaatagtaaaatggccacactgaaacaagaatttatcccagacaagactctttgccttaccacaatgaaaaataagtacttttgctgagtgcagtggctcacacctgtaatcccagcactttgggaggccaaggtgggcagatcacgaggtcaggagtttgagactagcctggccaacatagtgaaaccccttctctactaaaaatacaaaaattacctgggcatggtggctcgcacctgtaggtgctcgcagctacttgggaggctgaggcaggagaatcacttgaacccgtgaggcagaggttttggtgagccaagattgtgccactgcactccagcctgggcaagagagtgagactccgtctcaaaaaaaaaaaaaaaaaaaaagaaaagaaaagaaaagtactttttcaaaagtagaagttctctttatctctacccctaatgcccagtaatacccttaacactaatacctgctttttaaatccgtgcatatacctattttgtaaagcaagagagtatctaaataggagttgagccatagaatgtaagagctagatgcgcccttagattccatttgctaaaacactgttctgtgaaccagtgttaacctgtgaagttttcatcagcctgtaaatgataatttaaaacacacagaaatttaagctcaatgtattcagtataaagaactactcctttattctgagattatttcttttacatattttttcatgataaaatatcctacttttatgagatgacggtgatgatagatggtaggaattttcctcttaaaataatagcctaatttggcagtataaaaagtgcctcccgattttttgcagtttctgaaaccctaacacctgagaacaactggtctagtttgatctccttatttcatatttgagaaaagtaaggcctaggagaagttaagagagttacttaagactcactactaagaaatcatggaattaaaactagaacctacacattcatattcctagtccacagctctgaataaagcaacaaattccctctctttttcctaaataatacattatttctttctttttctttttcttttcttttttttttttttttttgagacagggtctctctctgtcgcccaggctggagtgcagtggtgccatcttggcccactgcagcctcgacctcctgggctcaagcgattctcccacctcagcctccttagtagctgggaccacaggtgctcgccaccatgcctggctaattttttgcattttttgtagagattgggtttcaccatgttggccaggctggcctcaaactcctgagctcaagcaatcctcccgcctcagtctcccagtatattgggattacaggcataagccaccgtgcccagcccacatttctattcttaaattaacttgaactttgtcaattttatttttcttcttttaccagatttatacttcctatattttgatgtgccagtacttcattgggttaccttcattatgcagttaatttagtttctcaagcacattttaattattgatttctcttattttattaaagtgaattaaaggtacatttgtcttgccaaaaatttaaggccttttattgtccttgtactaagactaagttatctcccagttggtatcatttaataaagacattgattgcattctacttggttgcattctactggtgctggaaaagcgatttcattttctggtgaagtttatgctgacaagttgaatggaaaatatacttgtataatacttttaattacatgttatatgcatttatttattttgctctttagcaggattttagcatcctcacaaaatattatatgactcaaggaactacctactcactttgctttctctgctggaagtaggcaatcaagccaattggaaaatttaaatccgtggattatgggttctaatttctggcctataaataagttagttttgtcataatattatatatttgtataatactttatataataaacacttctttatttctttttggtattcagtgtatcttttacatacattgtcaggctttgttttttctgaaaacactgtgaggacatatttgctcactctcattttgtggatgacagactgaagctcagatgccttaagtaatgtgcccaaaacagcagaactagctaataagtcgcagagtcagatttagaacctcaggtcatatgactacaagtcttgcatttgctccatatctctgctctacggtaatgtttctctttgcatattagtattaaaaatggcttctcccttccctaccagataatggtatgattcttagtaaaacatcccatttccattttaatatcctagaaatttttttttttttttttgacggagtcttgctctgttgcccaggctggagtgcagtggcgtgatcttggctcactgcacgctccgcctcccgggttcaagccattctcctgcctcagcctcccgagtagctgggactacaggcacccgccaccaagcccggctaatttctttttgtatttttagtagagacggggtttcactgtgttagccaggatggtctcgatctcccgacctcgtgatccgcccaccttggcctcccaaagtgctgggattacaggcgtgaaccactgcacccggcccctagaaatattttcaaattgttgaatttgttttagtgatttcacctgtccagataacctaccttaaacatcatgatgagaggggaggggagaaaataaatagtattgttatagagtttaagctagaattaagtataaaatcataaacaattaaatgtgattaaatgaaccattttatagcttaacagtatacaggcacatattatttatgtcagcaagagaaagagcccacattattaggaaagcctattttttagatcattcaaaattgtttcctaaactgtataactaccttcctcaaggatggatttacttaatcaacagttctgtaataattggttaaaccatttggttggggagtatggtcccaaccttaccatattctaaaataaattttgtaatgattaaaaaagcaaaagctaataaaatgaatcaataaaggacaacaaaacctaggtggctattgtttagtcttaggatagggctgggcttactgagcatgaaagtttaggagaaaacctcatgtaaattttgatagatatgtgtcacttgatcaattccgtaatttaaaaaaagttataaacaaaattaaaaagtaaatgatatcttctaggagatagctgaaatatatataacatcaaaatatattgtataatcatacatttggggcatcataatgaatttttaattaaatattaaagtgtaacttcagcattgtcccttgaagtataattggaaattgccattgactagtctcactggtaaaatgagaaatgattaaaagtggatagattaggccaggcgcagtggctcatgcctgtaatcccagcactttgggaggctgaagcgggtagatcacttgaggtcaggagttcaagaccagcctggccaacatggtgaaaccccgtctctactaaaaatacaaaaattagctgggcatggtagtgcacacctgtaatctcagctactcaggaggctgagacaggagaatcgcttgaacctggggggtggaggttgcagtgagctgagatctcgccactgcactccagcctgggcgatagagcaagactccgtctcaaaaaaaaaaaaaaaaaaagtggatagattgctaataaatggaaagtaatacaaaaagtctaagcccgcactggcctaccatgttacaaatttttaatgttgaaatattctgttcgacatattaaaaaaataaaagggaagcaaataacattatgttgttaaaaaaaaaaaaagaagagtaagcatccatggggcagtagtaaacgtgattgttcatagagcagaaaagcttatcagtagctgggtagttaacttagaagcaaataaataaaaatgtgtgtgtaaagagaacacaagttaattatttgacatgatgccattgtttttcaaaataaaagcattctttgcaagatttaattgcaataaatgactaaaatcataactgtattttcaaatatgagaaaaatatgaaagaatatgacaatgatatcttcagaagctactaattattggaaacacatggggacaattacacaggctagcaaagctcggtagcttatcactggatccagaactcagaatcagagttgtagtgatacacatacacacacacatacatacacacacacacacacacacacacatgcacatacgtgtgtatagttttgttgtattgcagtatatagagaaagaacaataaaaagggatttttggtattatatcttacctttgctcattcagttccatgttactgccttcttatctgctctgaagccaagcaggatataacagaagattgtaggcattaggacatcatcagatgctaacagaaatttgttgatagaaaatatggttctagtggtataaaatccacaaaactaataacgggatttgtcatcaaatgttagtaaacacagaaatggtagagataccaggaaagaaataacatgaaatgcttcaattatgagctagtactggaagtttgttaaagaaaaaaagggaaaatgttcactctgacctttaccaacaatttctttctagattgaaatataggaaatgagccaggtatcactgtatagttattttaaacgcaatttctatattgagagtgtatatttgcagctggtacatatctgattttcgtttggaaaatgtaaatgaaaaagggtttttatttcttttttttcggttttttttttttttgagatggagttttgcttttgttgcccaggctggagtgcagtggtgtgattttggctcactgcaacctccgcctgccgggttcaagcgattttcctgcctcagcctcccaaatagctgagattacagacatgtgccaccacgcctgactaattttgtatttttagtggaaatggggtttcaccatgttggtcagactggtcttgaattcctgacctcaagtgatccacccgcctcagcctcccaaaatgctgggattacaggtgttaggaagttttgaggaaatacataaaaaacaataatgtgtaactggtaaaagaaaattaaatgaaaggtaaatacaagtgaaggccagttcttgttctgccattgcctggctgctgtactcactatactcatatactatctctattccctctcatgtgccaaaagaaaaatggtaacttaattcataaatttatagtgaggactaattgtgttccccatgagatgtgttctgagtcacatggaaggttatctgtacattcatgtacataagtatatacacatatagacacaaatcataaacagaacttcctaatactaaagaaattatgtgcttacattttctatatatgcctcattttaagaatagtgcaaattcgaatatcttaggaccataagaaggagaaacactgtgtgattcttcatctcatataaggtagagtgtaagttattcttataaacttccttcagacatctaacaatcgatcacatatgtaagaaatttagttagcctattttactggaagataattctatagtagttcctgagctatatctgcattttaaagtatatttactgtgccttgcttactatagatgacatttgtttcagttctcttgtttaccaggggcatggtagggtgatatttatatatttgatttgcagaattagtagcttcagcttaacaaatggctgctcttcagccttttcccaaggttaagtttgaagtgttcaggtcattttatgattttccttgaccacaaccacgttggctgtcaagggctaagattttactaatttgaccaggttgttctttaaaaaccagttattttaattcttttctctatttccccagccttgtgtatttccagttgagtaaaaataaatagaaaatgctattcagtattctaaagcaagccagttatgtttgcatcacttagacagctttataggactcagaaagagagactgtcagattcatgagagtcagctgaaaactatttgtttctttcaaaagacaaggggaatgaatgattctggtgcatgtctcatgaatgttgagaagctcatcttatggttaaaaagaaaaactcattagacgactctagagagatatataagaaacctaaggattctgttttatttacctaaaacgttcctggtcaaatcagtgaggtatactaacaacaacaacaaaatacacacacacacacacacacacacacacacacacacacatatgtgtatatacatatatatatacacgcatatgtgtgtatatatatattaatataaggaccatcagattttaatataccctttaagctaaacttgtccattgttacacgtggtcacagaagtttttctatgaaaacttacgaagtggatgaaactaggacttatttaatttgaatatgcatattatacatatataggcacaaatgtattttaatttgtacttaatgtatttgcaattataataaataaaagttcattcctatgtaaaatattatgaatttacagaattaccaacaatgccttaagtatattatttcttctgatcttttattccattaaaattataacatctttaagctaatgatccatgccagctactgcattttttatcagttagcacagtgctgactatagacaagtaagtacctgatgggtttaatcacatatattgaacttcaactacatagtttaagtagtgtggtcttctgttatcgtaaagtcacagtgattttccagcacattcatttgatattttcatccctgtcagctcacaaatcccctcatactttgacagcattatactttgttaagaaaggaaagcaggagatatcctttatatttcaaatatattaggttgacatgtgagccatggccaaacttgattaaaggtgaggggaagtgaatgtagaaagaagaattcacaagcagagaagtaagtgctttgggagggtggggtcagggcaggcagtggatgggaggaaaagcacctagccataagctaaggcatgtttcagaggaaggcagtgctgagtttttctcttaccctattttttataatctccccttataatagttagccaccctcaatctaagtaatcttcccataaggtggtttttttgaggattatattaacatatgtatatgtgtgtgtgtgtgtgtacgtgtgtgtatctgaacataaaaactgataatacatttcttataaaataacttgctttatcatgttgtatagcttaaattgcttttattccatatatgtgtatggaatatgtgtatacatgcatatgtacatgtacacatgtatatgtatatgtgtgtatctgtatctttttattaatatttgccaatggcataattctacactccagtctctcaagcaagcatttatgtaaagcttgatccagggatatttctttctttacatcatgttccttgcttctttgttgaagcaatttctatttttccttcttttctgatctcccgcaatgttctagttcttgtgaaatattagttttctcagcactgaagttgaaaactttccatataccaactgctgttttcagttctgatttcaaccagggcttggtggaggagtagggtagggaaacttcctgaaaccttgttgatattaatagcaacttaatcctttggcttctactcagatttcgatggactgtacattcatgctcttatctttgaatcatctgacactttttcagccatgaagaaatcagaatatttggtctgttgtatttcctttctaagtactttttaaaggttacctacttttaaaagagctagaccaagtatagtaaaagtatacaccttttcattttggggatggaggagccaagatggccaaatagaaacagctccagtctgcagctcccaacgagacaaatgcagaagggaggtacctagttgatctcattgggactgattagacagtgggtgcaacccaaagagagtgagcacaagcaggatggggcgtcgcttctcccaggaaggccaaggagccagggacctccctcccccagccaagggaagcagtgaggggctgtgctacccgccccagatactacgcttttcccacgaatttttgcaatctgcagatcaggagattccctcgtatgcctgcactaccagggccctgggtctcaagcacaaaactgggcagctgtttgggcaggcacccagctagctgcgggagttgtttttgtaccccggcggtgcctggaacaccagcgaaacaggagaaccatctactcccctggaaatgtggctgaagccagggagccaagtggtctcgctcagcaggtcccattcccacggagctcagcaagctaagaaccatctggagtcgagctgggatgatcaagcttggtgatagggagggtcatccgccattactgaggttttagtaggtggttttcccctgacagtgctgagactgacaggtttggactgggcggaattcatcacagcgtggcaaagcggctgtggccagaatgcttctctagattcctactcaggggcggggcctctctgaaggaaatgccacagccccagtcaggggcttacagataaaactctcatcttcctgggacagagcacctgtggggaggggcagctgcaggcgcagcttcagtggacttaatctttcctgcctgccggcttcgaaggcagcagctgatcctgataagggggattcttccagcacagcgcaccagctctggtaaggctcagtctgcctcctcaggtgggtccatgacccccatgcctcctgactgggagagacctcccaacagggcttgacaaatatctcatacaggagagctccagctggcatcaggccggtgcccctctgggatgaaaattccagaggaaggagcagataacagtctttgctgttctgcagcctccactggtgatacccaggtgaacagggtctggagtggatctccagcaaactccagcagaactgcagaagagaggcctgttagaagaaaaactaacagaaagcaacaacagcatcaacaagaaagaccccccccccaaaaaaaaccccatccaaaggtcatcagcctcaaagatcaaaggtagataaatccatgaagatgaggaaaaaccagcgcaaaaactctgaaaattccaaacaccagaatgcctcttctcctccaaatgaacgcaacacctctccagccagggcacaaaactggacggaggatgagactgacgaattgacagaagtagactgcagaaggtgggcaataacaaacttctctgagctaaaggatcatgttctaacccaatgcaaggaagctaagaaccttgataaaaggttagaggaactgctaactagaataaccagtttagagatggacataaatgacctgatggagctgaaaaacacagcacaaaatctttatgaagcatacacaaggatcaatagctgaatcgatcaagcagaagaaaggatatcagagattgaagaccaccttgctgaaattaggtgtgcagacaagattggagaacatagaatgaaaaggaatgaacaaaccctccaagaaatgtggcattatgtgaaaagaccaactatgattgtttggtatacctgaaagtgatggggagaatggaaccaagttggaaaacacacttcaggatattatccaggagaacgtccccaacctagcaagacaggccaacattcaaattcaggaaatacagagaacaccactaagatactccatgagaaggtcaaccccaagacaaataatcatcagattctccaaggttgaaatgaaagaaaaactgttaagggcagccagagagaaaggttaggtcacctacaaagggaagcccatcagactaacagcagatctctctacaggaaccctacaagccagaaaagagtgggagccaatattcaacattcttaaagaattttcatcccagaatttcatatccagccaaactaagcttcataagcgaagtggaaataaaatcctttccagacaagcaaatgctgaggcattttgtcaccatcaggcctgcttttcaagagctcctgaaggaagcactaaatatagaaagggaaaactggtaccagccactacaaaaacgtaccaaaatataaagaccaatgacactatgaagaaactgcatcaactaatgtgcaaaataaccagctagcatcatgatgacaggatcaaattcacacaaaacagtattaaccttaaatgtaaatgggctaaatgccgcaattaaaagacacagacgggcaaattggataaagagtgaagacacatcagtgtgctgtattcaggagacccatctcacatgcaaagacacacataggctcaaaataaagggatggaggagtatttaccaagtaaatggaaagcaaaaaaataaaaaataaaaaataaatagcagggattgcaatcctagtctctgataaaacagacttttaaaccaacaaaggttaaaaaaggtaaaggagggtactacctaatggtatagagatcaatgcaacaagaagagctaactgtcctaaatacatatgcactcaatacaggagcaaccggactcatcaaacaagttctcagagacctataaagaaacttagactcacacacaatgatagtgggagactttaacaccccactgtcaatgtttgacagattaacaagacagaaaattaacaaggatattcaggactcaaactcagctctggatcaagtggacctaatagacatctacagaactcttgacaccaaatcaacagaatatacattcttctcagcacttattctaaaatggaccacataattggaagtaaaacactcctcagcaaatgcaaaacaatggaaatcataacaagtctctcagaccacagtgcaatcaaattagaactcaggattaagaaactcactcaaagtcacacgactacgtggaaatcgtacaacctcctcctgaatgacccctgggtatataacaaaatgaaggcagaaatcaagaagttctttgaaaccaatgagaacaaggagacagtgtaccagaatctctgggacacagctaaagcagtgttaatagggaactttatagcactaagtgcccacatcagaaagatgggaagatcccaaatcaaaaccctaacatcacaattaaaagaactagagaagcaagagcaaacaaattgaaaagctagcagaagacaagaaataactaagatgagagcagaaatgaaggagatagagacacgaaaaacccttcaaaaaaatcaatgaatccaggagctgattttttgaaaagattaacaaaatagatggactgctagccagactaataaagaagaaaagagagaagaatcaaatagacacaataaaaaaagataaaggcgatatcaccactggtcccacagaaatacaaactaccatcagagaatactgtaaacacctctacacaaataaactagaaaatctagaagaaatagataagttcctggacacatacaccctcccaagactaaaccaggaagaagtcgaatccctgaatagaccaataccaagttctgaaattgaggcagtaattaatagcataccaaccaaaaaagccccaaaccagatggattcacagctgaattctaccagaggtacaaagaggagccggtaccattccttctgaaactattccagacaactgaaaaagagggactcctccctaactcatattatgaggccagcacgatcctgataccaaaatgtggcagagacacaacaaaaaaaaggaaacttcaggccaatatccctaatgaacatcaatgcagaaatcctcaataacatattggtaaactgaatccagcagcacatgaaaaagcttatctaccacgatcaagttggcttcatccctgggatgcaaggctggttcaatatatgcaaatcaataaacataatccatcacaaaaatagaaccaatgacaaaagccacatgatcatctcaatagatgcagaaaaggccttcaataaaattcaacgtcatttcatgttaaaaactctcaataaactaggcattgattgaacatatcacaaaatagtaagagctaattatgacaaacccatagccaatatcatactgaatgggcaatagctggaagcattctttttgaaaacctgcacaagacaaggatggcctctctcaccactcctattcgacatagtattggaagttctggccagggcaatcaggcaggagaaagaaataaagggtattcacataggaagagaggaagtcaaattgtctttgtttgcagatgacatgattctatttagaaaaccccatcgtctcagccccaaaactccttaagctgataaacaacttcagcaaagtctcaggatacaaaatcaatgtgcaaaaatcacaagcatttctatacagcaataatagacacacagagagccaaatcatgaatgaactcatattcacaattgctacaaagataataaaatacccaggaatacaacttacaaggaatgtgaaagacgtcttcaaggagaactacaaaccactgctcaaggaaatgagagaagacacaaacaaatgggaaaacagcccatgctcatggataggaagaatcaatattgtcaaaatggccatactgcccaaagtaatgtatggattcagtgctattcccatcaagctaccattgactttcttcacagagttggaaaaaaactactttaaatttcatatggaaccaaaaaagatcctgtatagccaagacaatcctgagcaaaaagaacaaagctggaggcatcacactacctgactttaaactatactacaaggctgtagtaaccaaaacagcatggtacttgtaccaaaacagacatatagaccaatggagcagaacagagacctcacagtgtaaccccacacatctaaaaccatctgatcttcaacaaaactgacaaaaaaaaagcaatggggaaatgattccctatttaataaatgatgcttggaaaactggctagccatatgcagaaaacagaaactggaccccttccttacaccttatacaaaaattaactcaagatgtattaaagacttaaatgtaaatcccaaaaccataaaaactgtagaagaaaacctaagcaataccattcaggacataggcatgggcaaagacttcctgactaaactgccaaaagcgatggcaacaaaagccaaaattgacaaatgggatctaattaaacaaagagcttctgcacagcaaaagaaactagcatcagagtgaataggcaacctacagaatggaagaatatttttgcattctacccatctgacaaaggtctaatatccagaatctacaaggaacttaagcatatttacaagaaaaaaaaaatcaaaaagtaggcaaaggatatgaacagacctttctcaaaagaaatgtggccaacagatacatgaaataaagctcatcataactggtcattagagaaatgcaaaaccacaatgagataccatctcatgccagtcagaatgatgattatttaaaagtcagcaaacaatagatgctggtgaggctgtggagaaataggaattattttacactattggtgggagtgtaaattagttcaaccattgtggaagacagtgtggcgattcctcaaggatccagaaccagaaataccatttgacccagcaatctcattactgggtatacacccaaaggattataaatcattctattataaagacacatgcacaggtatgtttattgcagcactatttacaatagcaaagacctggaaccaacccaaatgcccatcaatgatagaatggataaagaaaatgtgacacatttccaccacagaatactatacagccataaaaaagaatgagatcatgtcctttgcagggacatgaatgaagctgtaagccatcattctcagcaaactaacacaggaacagaaaaccaaacaccacatgttctcactcataagtgagagttgaacaatgagaacacatggatacagggaggggaccaacacacactaggacctgtcatggggtcggagtcaaggggagggagagcattaggacaaatacctaatgcatgcagggcataaaacctagatgatgggttgatgagtgcagcaaaccaccatggcacatgtatacctatgtgacaaacctgcacattctgcacatgtatcctggaacttaaagtaaaaacaaaaataaaaaaaattaaaaatgaaagtatacacctttttatcagcattctttaactctgtctcttccaagctacttctaaaaatgacatgttgtaaaaagaccaatttatttaaatattggaatgattgtgaatatagttatcatgaggtcctaaaatgctgtttcattttgattgtggaggttagtagggaaaatggatacttatgtcataggatcttttacgttgaaagacttggatcatacatgaaaacatatatagaggcatacataatgcatataatcagatgatcaatttataatatccttatatcttagccatatctattgtaatgctgaatgataattaaacattcatttagcatttgacacatcttacgctctgctgaggttatgctaaaagaaattttttttaaattgatgaagatagtatgtttgacagaaaaaaatcaatatgagtgtacctatcaaggggcaggcaatgcttttaaaatgctgtgggtcaggaacactcaggcgtatatacttgtgacatattaaaagcatcctttccagtaataatatcgtttggcagaattattttaatggcctgtgatcctgattctataattctattaccaattaccttgactctgctttcaaaagatgctttaagttttagattctggtattctgatctcagtatctcgtagtgacctcctgttatctactcacttgctactgccagtgtcatggaccatgaattgaacctactgttatcttatggaattttggcactctttctaatcaatcctttgtcatgctaacagtatctttattgttgtttttggctaaattaatagctaaactaggtatttgcatgttttgtctaatcgcttatgaagaaagtactttaccaatattgtgaaaaatgttaccagtcgtatagctttaatgccatgtaacaatgtttacagcgttcaattgaagcactttaatattttaaacccaagttagattgaaagtactcattcagcaagcattttagggattttatggacatcttttaagatcgtctgtgggacgtttgtaacaacagtaatcgcaagaatggcgatgatgatgatgatgatggcagctcacatttattaagctcatagtatatgtcagactctattctaaggactttatatgaattaattcatttaatctttaccagaaccttatgaggtaagaaccatccaattttagagatgtaaatactgaggtactaagcagttaagtgacacgcccaaagttagaaaactaggaagtgtcagagccaaaattggacccccactttttttcatgcctctgattgagatagtaagattttgtcttaccttctgcccagtatttgattaataaaccttatggagcttcacaaaagtaatattttcattaagtgttgcttgtcagtcatgatccatatatgcagaggactaaagagtgtgcaatgatgattgatttttgtactgaaattctttcttttattttgtcaaatgaagaaatttgtcacaagagtgaaccggggccaggtgcagcagctcgcgcctataatcccagcactttggaatgccatggtgggtggatcacgaggtcaggagttcgagaccagcctggccaacatggtgaaaccctgtctctactaaaaatagaaaaatttcccaggcatggtggagcacatctcaggaggctgaggcaagagagtcacttgaacctgggaggcagaggttgcagtgagctgagatcatgccattgcactccagcttcagtgacatagtgagactctgtctcccccctgcaagaaagaaaagtgaatcagcatggaaatgaaaacgttctagtgtcttttcttgtaattattttttatatccatccatccatctggaattcactgtgtgtccaatactgtaataagtgataagaatataatagtaaacaagacatggtccctttttcaaaaaacataattgaactcaggaagagaatagaaacccatttatccttgttgattatatattcacctacctgaaggcagattaactctgaaggagtcaaccagttctgcaatttagattgtaagaataaattttgcttcaaaatagaatttaatttgcttaatttgtttcagtctgttttcagattaacttggatctaattaatgcattagctactattagataaggagtgcttttctgtgttcgctacttttgccaaaagggaatgactgacaaaatcctatataaatttaaggtagaaaatagtctattttctgtggcaatatatatttagaaaggaatgtatagactttctgggtgttttgagataataaaatattctaacaaatgttcttacaaaaaatatcttttgagtaggatgctcattctgttggcccagaattaagtggactattatgtaagcctttgcattatttcaatttttatcacttattttttaaacaacattaaggcaacaaaaggatgtttctgatatccctctcccagtaatgtaaggcagcggtgaggggtttttttttggtcattattttaaggttcttttccccagtctttatcaataggtaatgtttataggtcttcatttgcatttattacccttaactttttaaagtatgatactctttctatgttgctacccttactacataatcatttctaattattatgtaatcctgactcaaattgatgtaccaaaatcatcaatcagtcttctatagagcacagagacctcaaacctttcattattaaacataacttaacattttctgtcttcatgtatctttttatctcctccctttgattatttccttttagatgtaccaagatctgtaaacatttttctactcttcaattttctagaaaaattgttttccaggaagattgtatcaatgtatacaatcatcaggaataaataagcatatgagtttcatcacagcctcaaaaacagtagttttatgtattttatgttactttgacttccaaagagggatagcaagaactgctcataaaaacaagcaaatgcccaaattcaataaaatataaaagtaaaaatgagacattttaaaaaattgtgccaatacatataaagtggtaagctttttgttataacttaaattcctatgactctgaatgaaaaatattttccttttttaattaactttgtcacttcatttgtgaatcgacttcatatgtccttcgtctattgattaagatcaaattttaaccctttatgtagcttgaattctttatataacaaatatttgttgcaaatgttttcctattctgtttattttaattacagttaattataattatcaagaattataactatgacttgatatgtttgtatgttgaaatagtaaggtacttattctcacttaatttttaagtgaactaattgttttggaatcatatatattaattgagtctatcggaactgatactctatactaactgcattttattgttaggaccatttataatcctcttcttaatgattttaacggaaatcacttcttttttttatatttataagcatttagtatattaatctgaatgatgaatacaaattctttattattctgtataccttttgcacatctgaaacatagtattataaaataaaaccttagctttcaaagtcattgtctctgttaagggcttgacaatccaaatttggaggtcaacaaataagcattgacttttcactcttctttgtaattatactataataatctcaatttatgtcaaggaagtgtggatgactctaacttttggaaaaacaaattaccaggtagtataaagtgtgcaaaagaaaaacagattaatgtttcaagatattatttgacctcttttacacatcccttactactgttgacacacttgactttgatatatttcttaaatctttctttcagaagtaatcaagttatttaagaggaaacctttcgatgatagtgtttgttatctctgtgttcatctatttatcaggaaatcacttcttaattagtatagcttttagtatatcttttggacatgtcacctttattttcatttctgttataggaaaatgtcttgagttaagtacatacccgaagctagaaatgtctccatttaaaaaatgtattctctattttgttttatccagcattgtattttccctggctttgttcattctgctgtttcacaaacactgtgtgtttttatgtggttataacaatgatgagacattgacttatggaattaacatagacacatggaaaatattttatggtactgacataaaaagaaaccagttctgggccatgattgagaccgggagctactgaggttcaacagtttctattccacagagtgccattttgtcccaaatgattgatgacattctcttgccctattctccacagattataagaacactgttgcaatctagagcttctgtagatacccgcttcattaagcatgatcccaaaatgtcatttaatttatttcttagattgaatgtctcattaaactttgatgaggccaggagctactttgggctggacttgttatgaagcactcttatcttaaaattttgttctgtccctgttggcaaaggaaatggacatgacagtgaaatcaatgcacagtgcactttatctttgacaaactgaaatattgttttgctaaaataggcccatggggtagggagattaaaatcacacataaagtagatcagcataaagagtaaatatacaaacttatacagtctttggtgtaattttattttgtttaaactgactttgccccatttggacaaacataacacatctacttgattaaacaaggtactgatctccctcagcctcatttgaaaagaaacattttcttctttttagttataagaagtgaatatatataagatgaagtcagggcatgagtaatgttctatcagtttttagtaagaggtatgtctcaatagttgtgttactcaccttgtggaataggttgtgtcaaaacaagaaaaaaaaaactaatagtatttgtattttccctttggtgtccattgtagaatcaggagcatagtcatagattggtataggcgggaggtggagaaaagcaggtgattccttcagtagaccaaagtgaaaacaacattccttgcaaaaaaggaatttagacattggccagccctaggtcatgctgggcattggagtataattttttgatgcttccttaggtttggaatcaccatcttgcaactgatttttctctcatggctcctgcatcctgccatgttgccacactgcacacttagaacatgagttccacccctgtgtatgcttcccttgattccacaccagaatttgccagctcttctttgatctttcctgagtctttatacagcatattaaagagctgctctgcagtctaactctgaaaatcagtagtgtcatctagcatattttatactgttgcctaagatgtcttgggttcgaaggttctcactttgttaactgccagtttgctacctaatcaaatttgcaactttgaagattgcccttgtgtacagggttaatgtcagatttttagtattaaaaagaaacgactaagaaaatcacaaaacagatacctataataaaacaattgtcctaaaggattatcagcctacctccatgtctgataacagggcaagaaaagaaaatctgagaccatttcaatatgtattttgctaatatcttgagattccacctttccatggaatgataaattttagttctaaaatcatttagaattattaatgttatttgagacaatatggtatgctcttctttattgtgccttctattgaaaataaaatatcccttcagcatctaaaatgtcacttgaattaacactgtgcaatagcaataggagtagataaaactgtcagaaaatgactgggcaatgagacaattattgcagtttattttatcaatctttatttcagagcatgtaaaagtaagtaatgattttgagtctccattttgtgggttatttgagaaaaagatatgttagaacctttcggtttgtgtttttggtataatcataagctgcatgatttgcaatgcctgattttggttctaccttgtttaaatagcttagtttatattatattaattttaatgtagcctcaaccaagatcctattcttacctttctcactaaaaaactgtatagtattaaataatgtgaatcttagggttttttgttttttttttttttttttcaaattgtggttgctaaaagatacaagcagtgttgggtgagtcaggtcatccatgggatttagtcatagaaggacctgatttttatttcttcctctgcaagtaaccagttatgtgatattagacatgtttataacttcttgagacattagtctcctcccataaaataactgtaattgtcaaaattgttctatttagggtgttgctaaaattaaatgaggcaatctgcataaaaaccgtgctttttgcatactcaggagtatgtgatttatcacatttatgtagcttttaaaatttgtatgtaagaagtcattggttaaatagttgaagttttggatatttttatcattatacaatcattattatggtttaattttgtatatatgctttaaaggaatggatgatatgtgtagaaaatgcagtttcagtttgtggaacttagaattgtttttaaaatgtggaattcacatgaagatttgataatagatcaatgttctgttctctgtagaaattacatcattatagggaaaggaattgcacttgtttttgttgtttgagtatatgaactttaacaaggcaacctgagactaatttctaagatatgagatgaaaatgtgttaaaataatagacatatttcagactctgacttcagttgaaaacatagatcccatttttatttctccaaaccagaggaggaaagactgcttctttcctatttttttccctttctatgctattcatcatagcctcttaaaaatgcttctgttttcacttgttcccagattaagaaatgtgttttcattgaaatgttaaaatatgcagtgtgtcacattttgggttaatatcatcaagacaaacaactaagccagttctttatttcctgtcaaattgctgttagttaccaaagccaactaaatactattatatgtcatgttttagaattgtgctttgctttatcagatactaagatgcagcatactggtttgcatctcttagcaatgtttccaaaaccgtaactgtattaaatattagtaaagggctgaatgtacttaagcaatatacaaatgtactcttgatttactgtagagaataattttgttaaaatggttgtattttcatttttatagattcaatagataaacagttattaagcatctatatatcagacactttgagagtacagataattttgtgtagtacctgccattcagtatcctacacatagtaagggaaacagaaatctgaagaagtaaattaccatatagcatattcactcatattaatattaacctcagtgctatggagtacagtggacatagcaaccacctctgcctgttcaagtccaggaaatctttactgagcagctggttttaatcttgatctttgaggatgagtaggaaattgcccagtaaaaaagaaagtgtaagggcggggaattgcatgtgcagaaaattggagtaatgaaaggaccctaacatccatatactagggagtagctagttataggggcataaaatcaaatcgctgctacttgataacttgaagaccaatcttctgttctgacattccatagatcaaacttatataattgtctaatttgaaattgtacaattgtataatttgaaaacgacatgttttcagtgaaaagtaagaacaaaaactatttgttttatctgtgtgtgcatgtgtgtatagtgttaaaagttgtaatgtcaacaggtcatggtggcacgcacctctactcccacctactcaggaggctaaggcaggaagactgcctgcgcccaggagtttgaggccacagtgagctacaattgtgacactgtactctagcctggacaagagatctcatctctaaaaattaaagaaaaaaaaaaaagttgtaatgtcttcatatttaaaattttcttagaaatttcctttaaaaaaaaaatgggtcctggctgggcacggtggctcatgccctgtaatcccagcacttttggaggccgaagtgggtggatcacctgaggtcgggagttcaagaccaacctgaccaacatggagaaaccctgtctctactaaaaatacaaaattaggcgggcagggttgcgcatgcctgtaatcccagctactcaggaggctgaggcaggagaattgcttaaacccaggaagcggaggttggggtaagctgagatcgcaccattgtgctccagcctgggcaacaagagcaaaactccgtctcaaattaaaaaaaaaaaaaaaaaaaaaaaaatcctaaattttaaaatgacgattataaacttgagtattgattttctgttttccttgagttagacagagtttttttctgacaataataggtacagtttagataagaaatgcttaacttagtcaaattttagtaatttcagtaatgaaaatgatggagttggtttagtctcctataatcttgcttaagaaaaaaatcccctggtattcagtttatatatagcatgcaatctagatgaataggtttaggttttgtttggtttttaataacaacatgcataaaggaaatataatgatctcatcaaatctgtctccttctgagagacagtagcctactggtctgcctctcaggatccttctaatatagttttcttggatattaggtggttttgtttcattgaatctcagcagtttattgctttagaggctttttactgagttgggtcaacattccacattgaggagatttttctttctaatgcaagaattcaactgttattaacagtggtatgaatcattcatgtacactaagaaggaaataggttccagttgtttcaaaaactgttaatttctagttctaaccatcggtagctttgtgaagtgaatcatatcactgtctgtggaaaagagaaatgggaattaagttatttgctcaccatcagccatgtcattattgaagatgaaagctaaggagataaatcctccactcagttttctgtcatttatccaataggtcttcatatgcccctttagccatgagactgcaaggtggtgtgggaacctccgtactttatattaaagtctgttagagaaataatgggagtttggctacttgtttgtgccattaagacactgctaccctctgctgcctaagttaattacattccagtagtgggaaaaaaatgcatttgcctatatagacaccaatggaaataaacatatcgttcatacacttacagagaatgtacgtgtactgttgagagtgaggaaaaattgtagtttatagctgacatactttaaaatgctttgtttctaaagatgcaagtgcgaaattgatccaatatgttcagcagtcaaatattgagatcaaaattgctctatttcctttattcgtgtgtccgttaacaaccctttctgataatgtcagagacttattcaccggcctcaactgccgaaagaattttaaactaacagccgatgtatcagtctaaggactggtagatttacttgagaaatgttatgtatggtgtttcttagctataaaaaactatgtatcctgttatgtaaatacagatactattgaggcctttgaggcctcaattaatgaatcttctgtgggaaacatcttttaaaatgatggtgactgttgaagatatttcttatacaaaggagtgtcatatggattatacgtaaaattgttaactcatactacacattttcttcgtttttattcttcattatttttgagacagtgtctctgtctgttgcccaggctggagtacagtggtgtgatcacagctcactgtagcctcaacctcctggactcaagggatcctcccacctcaacctcctgagtagctaggaccagagatgtgcaccaccatgcctggctaatttttttttttttttgtagaaactgggtctccctatgttgcccaggctggtctcgagttcctgggctcaagtgatcttcccgccttggcctcccaaagtgttgagattacaggcatgagccacagcactgggccatattttctttaagaaagcagtatatttttgttaagagaagaagggggtatataggaaagaagaatcagcatgtaacatttgtatgatcctgacagaagaattacgtgatataggtaaaatatacccatccattaagccccttctcaaatgctggcccttcattggcaatactcctagtgggggcaacagtattttcttttgaaatgtcaaacacttttattgtaattctgctgtggcacttatcgattttccgccttgaactatttgtttgcttgccttgtctcaactactgtattagagtctaatttcaggaaggaggaatgtggagagatgtaggacagaaacttctgccatacctaacatagtatttctgtcacatagtaaacacttagtactatgtatggaattgaatttaataatattaattggtttagcatgaaaaaaattatgctatagtgtgagttaaagaagctaagaaggacagaaataaaatagaaggagaaatatatttgatgctggtcttccaagttgcaataaaaagagctgaaattatgcccatcaccattaccttccctgtgccactcttgtgtttatcagtacagagggtcaaggccacatttaaaactatgggactgttgcgtctcacttcaaattcatctggtttccttgggccgaatgggaaagattggtagtttaactcactgtcatacaaactccaacccctacttaattccgttggtcccctgctttggaagctcacctgctgcagtaagaaaggaaaaactgtgcctctgttccccagttttttgtagatacttaacctgccaccctcatgatcacattctaaagctgttctgctggcagtcctcatgttctgctctgaatctgccagcttcatcactcccattacactctcccatgtttcagaaagccactattctgtccatgccctgagggaaggagagtttttttcccatcattttattcttgtccccaaataatcaaatatttcctcacaatttcacataggtattcattcatacattttagaaatttaaaggccgggcgtgttggctcacgcctgtaatcccagaactttgggaggcagaggcaggcggatcacgaggtcaagagttcaagaccagcctgaccaatatagtgaaaccccgtctctaccaaaaatacaaaaattagctaggcatggtggcaagcgcctgtagtcccagctactcgggaggctgaggcagaagaatcgcttgaacccaggaagcagaggttgcagtgagccgagatcgtgccactgcattccagcctgggcaacagagcgatatgccatctcagaaagaaaaagaaagaaagtaacaacgcaaacttattttttgaaaaagaaatttagaatttcttaaaatttaaagccaagacatgctctaggaatacaaagaagagaactcctaatttctcctgtgaaaatttaggacatgcttttctttttttttttttgagacaagagtctcgctctgtcacccaggctggagtgcaatggagcaatctcgtctcactgcaacctccgcctcccaggttcaagctattctcctgcctcagcctcccaggtggctgggattacaggtgcctgccaccacacacagctaatatttgtatttttagtagagacagggtttcaccatgttgaccagactggtcccaaactcctgacctcaggtgatctgcctgcctcggcctcccaaagtgctgggattataggcatgagccaccgcgcccagccaggacatgcttttcatgtgagatgacatttgagctggttttggaaagtaacactataaaatgcacatgtaatgaacacatatgtaacaagttattggaatgatcttagttgttactgagaaatctcaattatatgcattttattcaactgatttttattaattttagcatcttgatctagtaggaaaaatcaaatactgcctgctaatacaagaaaaaaaaaatcaaaccaaatacagttgtccttttgtatccttggaggaactggttctataactgctggagataccaaaatttgcagatgctcaagtcctgatataaaatggcctaatatttgcatacaatctaagcatatcctcctgtatactttcgacatctgtaggttacttatgatacctaatgcaatgtaaatgccatgtaaatagttgttatattgagttttaaaaatgtgtattattttttattgttttgttatttttattgattttcaaaaatatttttgatctgcagttgtttgaatccatggatatggaacccatggatacagaggcctgaatgtagatattctaacagtaaattttcttatctgtgagatactataactcatacttaaaacaataagttatctgggcccttacaaatacagacctctggtagagagtctttagagaaattattaaaccttcatataatttgttgagtgtaccatgaatatgttttgtgtgtatgaaattagcagagtagcataggctacgttgtggatgaaaaatgttttatgtgcttagcacattcctctgaaagcaagtcatggagaaagaaatataattatttcaatagaaaaaatttaaaactctgctatattttaatattttagtgatttatatgatataagcatacatgcacttacgattttgcttttttatttcttttcacaagattgagaaaatggagcaacacttcactatttttcttatagggataatatgggcaaattaaatgtaaattgttgactctgaagtgaggggattatttttgttgctgtttcagggaaaacataaataaaagaaagtgaatagatgttatttcctactttagaaagtttgaaaagtaaagataaaaaaggaaaattgtacctatatccattaagttttataagtgctataatgttgccatttttttcagaaaatcatattttaaagccacatcttaattcttaggaattctcaggtaaaattataataaaattcattgaataaatatgattaaatacactagcttcacatgttcctttcttcaggactatcaataataaaatagatggaagtacagcgctgaagagaaactaccctggcaaaagtatatgcttacccatagttgtagctttattgttttcccaagatagacttttcatatttctgcaccttcatttttcatcttactcaccaattgcatatcttttatagatgtcagaatgattagatttagcgtctgcaaaatactcatcgttgagaattatagaccacttagaagattggcaaggacaagttaaaactgaaaataggcatctcaacaggcatgcaaaatcatagcagtgattcagtaaattctcagagatatttcccttttgtgataggaatggggggatagtttatattttgagattctttgcagaataaacactgggagcagaaaattacacctatatttattgccaagctgcatttgttatataatgcattttcctcctccctagatgtaccccaccttctgtcaaaatgttatttctttggctattctttgttgcatgtagttcagttcaggcctgactcctaggattctgcaggtttttttgtttgttttttttaacttcccacccagggaagtgaaagttctgttttaaaaattcctgaatgtgtataaatttcattctgacaagcccactttttcagtatgattttatcagtgcttacaagttttagaaaaaaaaaaaaaagaaaaagaaatctcagatgacctttaatgtcataactgaacttgggttttgaggagagcaaagagagcaacaatttgaagatgtaggtttactagtaaacacttctgttccaccatctgctcccccaccaccccatcgcagattacagtggaatgagataccagggtggggccagaggggccgtggtaaaatggggatgaggtgagagcagggaaggtgatgtgggagcagatggcagctggtgaaagaggcactccatggcactgttggcatggttacagagaagtagatgtcctaacatgctgtgccaattttggaatgtttcaaactctactttgtaacttgtggcctcaaactaaactcattggctgtgtagagcttctcctgtgacaagcagttcctataaaagcattagtttagttatattgtctaacggctgcttaaaatatattcgtgtgtgtttgtgcgtgtgttgtaattaatctatggaaatgtaaaaataaagtatttactgtccttggtctccaggtgaataataattactacatattaacaaccctgataataatatatatgtaataatgaaacagttttgctgtaccatctatttgtgtaacaggagcaaatattgttaaaaacagttcattggattttgttgttgttgttgttgctttacatcagtttataaaagtcatatgagcatttgcctgtctcatctttagatgaatttttgttttccattaaacaaaaaaaaaaccgaaatggcctaatttaagttgaactaggtcattgactaaagtcttatttttgtctaaaaatgcatccattgcaaatgttactgccatttctagtgtctacagtgtccttagaggatatgcatagtgagttgatttgaaaagtttttggccatatggcatggttgaagcaaaaacgtattgtgttaggtcaaaccatgtgtaattgctgatgccacacaatttttttaaatataaaatataaaatagcatttttttgtggttcaacctgatatatacatttttaaattccttattctgaatttgggtaaaaataaataataacttataaaacacgtgtatgtatatttggtcttgcagctaaataagattatatataattttccaaatcttcggagagtccagcttaattaaaaatactatttgcacaaatgttgcggtttgtctctgtagaagctctgagagcattcatttaatttattaacccaagtttctcttgctaatacatttactcagaagtaactctgctgtacataaaaatagttgattcaatagagaagtagctaaacaattttttgttgttgttgttaagtaaagggattaattcatgttagtcactggaatgtcttgcttaaaatttcctccaaaattttttgttcaagttttcattacacttttcccgcaatttaacaaaaatgattttgctccttctttttttttttcctgaaactgtttttagaatggaattaactgattctataaagtacacaaatgattggtattaaatgtctgtctctttagtccacaagtgtttagttttttgaacagagatgaaaattgaattgggctttgtaccaaagatttatatttagataaagttattccaatggtattcaaagtgttaattgtatttctacagcaaacttcatcgtattacaccaaagcaaataccatatttgagatgcatctctaccacatttagtcttgttccttcattttgtttatttcattatttgaagtataaagggagggtctagatgatgatgatgatgatgatgatgatgatgatgatgatgatgatgattgagatggagtttcgctcttgttgcccaggctggagtgcagtggcatgatctcagctcgctgcaacctccgcctcccaggttcaagcaattctcctgcctcagcctcccgagtagctgggtttacaggcatgtgccatcatgccaggctaattttgtatttttagtagagacggggtttcaccatggtggccaggctggcctcaaattcctgacctcaggtgatccaccctccttggcctcccaaagtgctgggattacaggcatgagccaccatgcctggcccaagtctagattattgaatagaaaaacatgatcctgaatgacaaaatgtgtctgaccaaagtagatttacccatgcacagaaatcgaagtcaatttttagtgataagaccccatattaaatatgaatcatgtcttggatttctcctaaattcgctttaacatataatgtgacataattgttaaaggaaggtctgaaagtcatataatccgtctttattcattttcatgcttaaactaacacacaatgctagtataatgtgaccctttaattctgagataattttctggagattatagtttggtttgtggtttttgttttgtgttttatttgttttggggatgggatctcacactgttaccaaggctggcatgcagtgggattatcaccactcactgcagcctcaacatgattggatcaagggatcctcctatctcagtctcctcagtagctgggaccatagacctgtgccaccatgcccttaagctaacattttatttatttatttgtagagatggagtctccctatcttgtctaggctggtctcaaactccttggctcaagcaatcctcccaacccagcctcccaaattgttggtattacaggcttgagccactgagcccagcttgttttgtcttaaagtacaaaaggatctcttgtccttaagtgttccttagatctgagtccaaagcaaattttccttttttcataatgtttattttaaatgaagaaatttgactgttatatatatggctcaaatttttactctaatttctagattgtttacctaagtatcctatcactatttgcagattcacttctaactctccctaaatttcaggccactagtagtgtttttcatgttttttcaaataggaatgattcaaatcgacttatatcagcttatggttttttgactgtttttaaccccccaccagtttttgggtagaaaatggtagatcattctataccatttaaattcaaacatttttaatttatcttagtttctgatatgttttcatttactcgattacatatttctgcaaatataattgaatataagtcaaaatatcatttttcataccttttatacttcctgtctctattttttgccttatattttctaattttctatatttctaatttctagggcaattgatatttaataaacattctctattgtgtagtaaagcttgtatttctaccgatttaaattagtaatatcctattagtttaaacaactttaaaccatatctcaacttttcatagttagttgttttggggtcaactatgaatgaatagaagaatctttgtattagcaattcaagaagcagcaattatgtatttctgagttttttgtttttgtttgagtctagttcaaagtagagaaagttattgtttactgtttttttagtttaaaattaaatgaaaaagatggatatgtcttgaatatcaagtggagtagcatgtactcagaaaaagcaaccatttcctgaccaaattagacccttattaacgatagcacatgatgctgtttaatttgtttggggtatgctcttaccccaattgttaattgtcagtttctgaaaataatcagttttcaacatttcacggtttttcaattaggctatggcaacaaatgccattgttgctaattgccagagtttagtcagtaaaattatgatatggtctttctttaactattatcaggtcacttagtatctgcttcatctttttacgctttaataaactaagcagaagattgagatcattagatatccaactgtaatttagcactgtcaagattaaggaggggattatggtcattaggagcaaaatggtttcatttatggactgagaacaatgaggcccatcaataaaccactttctgcctctaatgatcttacttctctctaattgtgtgctaatctaacaacaaactcattttcttctttcattcttgagggaaagattgctaaacagaaatgctttgcatatatgttgcttttacttccttaagttttggtgtgtgttcatgaatgcagtaaattatttctaggtgaacagatatgtctcttaagggaaatatgctatgttctcttctagtttatcaacatatttttgacagaggaatagattttctgtgattagatgtgctttattattagtaccatcttaatccttatttgagtcattcattgtagaaagagatctgtcttataaaattaccaactcaaaatatctaagtgtgctaagaatcgaaaatgatctcagtaaagtgggtcataagggatatatctcttattgggctgtctgccattctatcacctttatgatagaagttctctaaacccacctctttgtagccacattccttgagaaatcaatgcttgcacttcactgaatttaacatgttgactgaggcccaaggcactctgactgtttgcagctagtagaggatccttgagtacaccctggtacttctgctctcaacatttgagattttggcttatcatgaatcaattgtgcttattctccaaacctcccttatgtggcagttgtactttttggtgcagttatttactctaattaaatattatgtgaaccaagaaatggtgcttaaaaaaaaaaccttgccatttatgcaaaaatgatgttgactgcttgaaaaatacttgctaaagtcattttaaatttactctctaattaggtgtgcgtaaacaaacttaaatgataggaactcattccaaaagccttctctaattagatttcttcatgaatgtttaaattctagaaacttaattctagaaatcaatctagaaactggtttagagggtacccttcgtgtatgggttatatgcaaggaaggctctgcagatacccaactggagcctaactcacataggatacctcagctctacatcaaaaagggtagcaagtgaatattatttatactttttcatttaagattttaacatgtatatcatgtcttctggatacctactttaactgacctctttgattaattgaccttgcgtgattttctaattatatttattagtcatgcttagtgtattaaaaactttactgctgctcactcatatccactagaaatgttaacttcatgttctgagtccatcatttctctcctttctacaacatagaaatggacctattgggtgtttatatattgaaattttttttctcaacatgacctcaactcccataagctattgtcattttacccaattaatgtatttttaagaaaaaaacctaaataattgaaagcatctgtcttgtttctgttgtaaatattatgttatcaatagtacacagactatctgcaaaagagaatctgatgatgacctgcacataattttgttggcaatcttaattttaacatcagagataaatatggagggcttctggtggtgcctaagcatagtaggtcctatgagaaaaaatattacacagctgctctagaggaacttacatgcttattgaatagataggattaacagataagatgtacttagcaggataagagactcagatccttatggtgcagggcagactatagattttttaggcactaagagaaagaagagctaaaacgtgtcattatagtaccacctcccaaatgttacccatatctaatgagtgaatgaaagaatggcccaggaagacttggaagtctgtagttgttattaatggaatgttccttccactgtaaactggagtgtaagattgtaaaaaataaatacggcattaggaattacataatatgacttgaaacatgccaggacttgtttctgaagattgaggaatgagtatacgttttttgttttttgttttttgttttattttgttttgttttgttttgttttgtttgagatggagtctcaccttgttgcccaggctgggtgcaatggcgcgatctcggctcactgcaacctccacctcccaggttcaagtgactctcctgcctcagcctcccgagtagctgggattacaggtgtctgccaccaggcccggccaattttttgtatttctagtagagacaggatttcatcatgttggccaggctggtcttgaactcctgacctcaggtgatccacccgcctcggcctcccacagtgctgggattacaagcatgagccacctcacccagccgagtatatgttttaaagtatgtaatgtaaatactcaggcagtcagtggagtcacaggaaaattccctcaaggactttaatcagcagaaatgtttgtgtatttgtgtgtgtgtatatatatgtatatatgtgtgtatatgtgtatattccagtagttacagttaatgtatatgtcataacaatacagaaaatgttaatattaaaatttatgtcacctttattcattcacctaatataatcagaattgacaaaacatgttagctattcatggcactgaatggagtattctgagcacagtaggaaactcacaaaattggccaggtgcggttgctcatgcctgtaatcccagcagtttgggaggccgaggcaggtggattgcctgaggtcaggagtttaagaccagcctggccaacatggtgaaaccctgtctctactaaaagtatttttaaaaatgagccgggcatggtggcaggtgctggtaatcccagctactcgggaggctgaggcaggagaattgcttgagccgggaggcagaggttacagtgagccgagatcacgccactgcactccagcctgggtgacaaagcaagacttcgtctaaaaaaaaaactcacaaaatcaataaagcaatgtgggtcaacaggatatgtgaatattataaggatatttccctattctattcatttattatttagtacttcacatagtttattcttagctgattagtgattaaaccattagatagtaatatgtttgttcatttcacccaatatatatttactcctactttgtgcaacacaatatactaggcccattgagaagtacaaaatgtaccccttaccttcaaggacgtgacagaaatataacttttttgataaaatgattgcaaaagatttaatcagggtgacactaagagaatgcttttgaagacttatctcaaacaggtcttagtttattccaagtcttacaaagtcaaagttgcataagtcttacaaagtcaaagttgcataagtcttataaagtcagagttgcaaagtgaatagtgaagcaaatcaagaagatttttttagatcatataagaaaaggtaataatcaaaaagtaaaatccagttgctgaatttaggttagttaatataaggcatgattatgtaaaactgactgtaaaattgagatccagtttttaaaaatccaagttatttgtaggcaaatgttaaacaattaaaaaaattttttttcaatatttttgagacaggatcttgctctgtcacccaggttggagtgcagtggcactatatgagctcactgcagcctccacctcccaggttcaagtgatcatctcacctcagcctcccaagtagctgggaccacacgcatgtgccattatgctatgctaatttttaaatttttcatagagccgagctctcactatattggccaggctggtctcgagtttgtgggctcaagcgatccccccgcctcagcctcccaaagtgttgggattacaggcatgagccactgtttctggcccttaaactatatatataattaaatcctgcccctgattttatattagaaaattcagcaggtgcacgcagcaaatcttagggggaaaatggtagttttcctaatacttaaactttagctgcaaatacatgaggccctggatcctaaaatcattggggtcatatgctagattctgtgtgtatggtagaaaatttgaaaatactatttttgtggggagagaattcatatagaaaatgaagtctgttgacgtatggtaagtaagacaggcgaaaaaagtgttttgcaacttcgcttgttgctctgatactactcattagtgtatgctcacttttttctttctaagatcataccctttattaggcagcaatattcttctaatggagaaaagaaaatgagcagtttacaattatgtaaataagacatagttttttctatttctgaaaagtaatagaacttttttcccctaaatgaataaaatctcaaataaaattagaatccctgtacctcactactcattaaagggtgacactagtaacaatttgtaaagaggaaactgtagaaatgcaataaaagaagattatcttagcaaaattgagatttctctctgtatgtcatgctaaaaatgtagctgagagctggtctttgcaagatcaatgtgggatctatgcatgaaatgtgatttgcatatttaaagaaacagtttaaatcatagcttataacccatgccacagagagaaagaagtaatgtaatgctgttgtacccttgtccatctatgtatagctgagtccatgtgtgtgccaaaagggcacaggtgcacttttaattccccagagacaataaggctggtatgtggggtttataaaagcttttccttttcatgttcaccatggcgattgtgactattttttatatttgggatagcactgccatttcccactaatttgtattagttaaatgtgttcaattctaaaaacctcttgattcatgttcaggatgttagtcatattcattagtttctaattgcattctgtaacctatggtagctctggggacttcaaatgtaattgaaggttttaattttaactcattgaatcaagtagtgatatggtgacatcagtgtcttaagaattttttttttctggaagcattatgtgatatggattgaatgcatgtagaacagttgcagtgttccaacctttaggtgagatgcacttcctaaaagtggcaattgcaatgcacagacaaaggtggatgccaaaggcattttgaaaatgattgatgagacttggtgactggctggttatggttaatacaaaagataaagagtaaaagctaactctgtggttttaagcagtgacagctggaagagtagtaatgccactggggaaaacaggataatcagaaacagatctggtttctgggagaaggtggtctgctcaggtttggatatgatgcttatgaagacatgggacactcaattacatgtttaattttatgtgagactagaagaccattcctcaaataaaagattggggtttgggtatagagatttgggcttatatataataacaatataagatttcagcttatatataataagatataatatattgttattatatataataacaatattacatcttattatatataacatattatatattatatataataagatgtaatattgttattatatatgataacaatatataagatttcagcttatatataatagcaaaagccttgatgtaagagcaatgcattaagacagggtttatagagaaaaaaacgcgtttatagagatcttggggaatgcttccatctgaatggtgggaaggagaatagaatgcagcaaatgaaacaaaggaagagctgtcatcttgctctataaaagtatttagcatgaaagagatctctatttggagttaaagcagtattatggtattggcctcaaacaatttttccatgtgtcaagtagtaatttcttttcaaatattgataagaaatcttcacagatattacaataaatgtattcagaattcttatatactgtgggtctgaaatcaaccataattatttttatgagttgacaaaattataataaatgcaaatatcctttgctgtagattagaggcatttttggaaagtttcctatgaaaaatattttccatttactggggttttctttctaaatattccctttatatgtagaaacttaaaaggaaagagccagagatctcttttggctccatcctcctgccaagcacaattttcttattgcagcatttataataccatcaactaaagatttttatattaaaaacattttacaaagagtcacagacccatttgtatgttttgttttgtttttaaacggagtttggctcttgttgcctaggctggagtgcaatggtgcagtctcagctaactgcaacctctgcttcccgggttctagagattctcagcctcccaagtagctgggatgacaggcgcgtgcctccactcctggataattttttgtatttagtagagaaagggtttcaccatgttgatcaggctggtctcaaactcctgacctcaggcgatccacccgccttggcctcccaacgtgctgggattacaggtgtgagccaccaagcctggccagtttgtatctttataatgaccccaccagatcagagaggcaggtgatattattcctgttctacaggtatgaaaactgagactcaaagtggtttaggtgtcttgcccaaaggcatatgtaaaggaagcgggaattgggtcttctgactccaagaccagctttctttttgctgttactgtgctgtctcacatttgttatacattccctgaagactcctgtgagggaaactttagaatttcatcaaagcaaatcctaaaggtacatgataaatttgttgtctgttttattgagtaaaaatctgtctagtcagcagtccatacgttaggtcagaggtctaaagtaattgtttactgggcttttttggatacattctgaggcatattaattctttcaggctttttttttttttttttgagtaaattactcttgaaagggttcttattggtaccctctagaggttcagaagagttaattggcttacaaaacatatgtggatcgaacttggggaatagttcagtcatctcttaacatctggatgtactgttttattattttaccattatgtatttgtatctgaaaactgcagccatttaaaaataaatatggtaagtaaacagtatgtatataattaagaataattcactgtagctcttcaagtttacagcactgttaaaaataacctggtgtatccatgtaacttatgaattcaatgaaatttaaataactgaaaaacaatttttacagtaacatgccattcacattttgaaaatattaccaattattttaatattatctactttgaaaatatgggaaacaaaattgttcatgatgtttgtgtgcacatcattcaaagaaccaaaacaaaatttttatcaatctgcattccctcagagagataaaatattgctctgtgaaaatctgattttcaccatatgctaatcataccctcttccacagacctcttctcttacttcctcctgaacataaccttccatcaaaacaagaaacaacacaaaaacatcctccaagaaaaaaagaaattacaaaatacaaaagcaattcacaaagccagaaataaatgtttatttagttaaaaaaaataaaaagatgaatgttgatgacttcaccattgaaaatgatgcctcaatatacaacttggcttcaaagatccttagccttgatttggtcatcacgagttattctctccatttcagcttcccccatagcatgtaaacatcagactttgtcatcacatatgacagtgtagctaccaccaagatctcaagctctgaatgtgtccttgtacccacaaccatcctcacatagcccttgcctctggcgcctgtttttctgttgccctcattatgaccttacccttacccttcctcatcttatttatttattgttaagacagagtctcgctctgtcacccaggctggagtgtagtggcgtgatctcagctcactgcagcctccttctcccgggttcaagcgattctcctgtctcagcctcgcaagtagctgggattacaggcgtgtgccgtcacacctggctaatttttgtatttttagtagcgacgggatttcaccatgttggccaggctggtctcgaactcaggtgatctgcctgccttggcttcccaaagtactgagattacaggtgtgagccatcgcacccggcccctctttcttttctcccaaactatttgctcccctcaagctgcatttgccatataacctacacactgtctagcactgtagaatcctcatacttgcttcaagctcccctcctttagccttctgccgtccacaccctgatattcctgttgctctgatccaatcccaactcccgcatacatgacagaagtcacacagtctacctgatgggatccgttgttccatcatttctaaccttagcctcctaatggagttggggtagcttttcatttaactctaattctgtctttttccccacaacagcaattccaaactaggtttgttctcctcaaatccctgagtctagctaccatattcccagataaacatctcttctcattcttgactgaagatgaaaaaatattcttttcatttactgccacatatctcaaagaagacattacatctcctcctgtttacaaattattttcttcctactaactcttcagtgtgttatcatctgactgatactcccatcaatttatacgtctttgtatttggttgtcttaacctccctacaataaagctccatgggggcaaagacagtggtttgttcccctcacttccttgtttgctattgcagtgctatgccattagcagaactatgtgttaactttcagggcctaaaagaacttcagataccaggttcaccttgtacttcccatacttggaaatactgctgaactaaatcttgccttattctcagcaggcagtagagcatgttggttaagaacacacatgagacttcataacttcaaatattgtctctgccacttactagttacatgactttgaagaaattatttaatctctctttgtctcaggtttttcatatgtaaaactggcataataacaagatacgttttataggatgaaatgagtatgtgcatgtgtgtgtgtttgtgtgtctgtttatacaacactgggatttgtaacttggcaacttcctggaatgtactggagtatcattttaaagcccatggtaatgacaaagagatcagttatttaggatgcgttttggtcaattctaaaaggaagctataagatgggataatggagaatttcatttggactcctccgtgttattttcagaagtgataatttggccattgagattgaatttcatgttgctttatagtggctgatttttccttttatactgactgggatacaggacctggctttgagtttctgcatgtgtctgttgcttttatattttatttatttaatttggggatttacaaaataaattttgccagcctgctttgatcatagctgtctgtggcattgtgctaactcaattaaaaagtttttttttctgtcctgttaaattaacattctattgatacattcaacagaataaacttatataatcaattccacattatagaattcacaatatacattttaccctcagaaggatgcaaagaattgttgtaaggagactcagttgcattatggttatagaggcatcaagaaatccagaggcacagtggctcacgcctgtaatcccagcacttagggaggctgaggccggtagatcacatgagatcgggagttcgagaccagcctgaccaacatggagaaaccccgtctctactaaaaatacaaaaaaaaaaaattagccagacatggtggtgcatgcctgtaatcccagctactcgggaggctgaggcaggagaatcgtttgaacctgggaggcggaggttgtgttgagccgagatctcgccattgcactccagcctaggcaacaagagcgaaactccatctcaaaaaaaaaaaaaaaaagaaaaaaagaaatccagaggcctggtggtgtatacctaggcaatccacttttgttttctctctgtttccatatcctcatgagagatctggactaggaaattgctgatatccctccccaagggggcatttttgttaatctagaacatggatcaacaaactttttctgcagagagcaagatattaaatattttagggcttacggaccacacacagtccctgtcacaaggactcaggactgcctttatagtccaaaagcagccataggcaatatgtaaacgatggacctggctgtttttcaataaaactttatttatggacactgaaatttaaatttcatatacttttcatgtgtcacaaaatgctatccttcttttgatttttttttcagccacttaaaaatgtaaaaagcattcttagttcacaggccatacgaaaacaggcagccagctagatatggcctgcagacagtagttcaccaatcccttatctagtctagccaagcaatgtatacatatgtctatttgaggaacttctatattgaagacattatctcatagtacttgtattagtgaacattttcactttcctttcccttgtttcataaatgatcactaggcatttgaatatttcagagcctttagccagattgcatgtgtatttgtgcttgtatatatttttgccagaacacttgaaagtctctgggccttttattcatctttgctttgccaaatattttcccacctgtatagatgaattaaaattttcaacagcctttctttgaacatgacttttgagaccagttgctatttaaattacacaaaagtatatttagcccttctttgtgttttattccctttttgccagggtggaaggacttttcaggaacatatttgaatagatggagaattctgaaaaacataacccagatatttatttgggtctcagagaagaagacgttttgaaaacaacctttgtggctgggcacagtggctcatgcctgtaatcccaacactttgggaggccacggtgggtggatcatgaggtcaggagatggagaccatcctggccaacatggtgaaaccccatctctactcaaaatacaaaaattagccaggcgtggtggcacatgcctgtaatcccagctactcaggaggctgaggcaggagaatggcttgaacctgggaggcagaggttgtggtgagccaagatcgcaccaatgcactccagcctgtgggatagggcgagactacgtcaaaaaaaaaaaaaaaaaaaaaagaaagaaattttatcaatttatcctgcttgaagtctttcagcgctttctcactacacttaaggtgaaacccaaattccttacggtgtcctacaagaccctacctacctctcaaacttcatctcaaatttttttttaaaatccattattttgttagtagacaaaactacataaagtataataaatttatgacatgataatgcccagataactaatcaagacttgctttatttagggactgctttcagtagtgaggaacttaaaaacatagtacaattatattatctaattgctttagtttgtattgccaatttcttatttcagggcatatagtaatcctattaatatccacagttaatgaataaggaaaatacaaccataggcttactatatcctttgaagcatcttttgtctgacctataaccctattacccaggagaaatattgctaatccaggcaacactaatgtggaatggactctaatggcttcaggactatgacctcagcactgatctcaacaacctgcattcagtttgggtgaaaattcgtggctttgtatatgttacatacctgtggacttcatgcattaaacttgttcctcaaaaactctgtgaagtgcaagaatctgcatatagtcctattaatttccctgaagagttcaggaataaagttaatgaaaaatttacccatgatcacaaaaattacactcaacaaggctaacattattttaatacagcattatagctttatggaaacactatttatgtgtacttaattcttgccaaatagtaatgtggaagacagtatctattcaaatggttcatcaatctgtatgatcttttcacaacttattgaagataccatttaccagaagtaagggtatatattagtaaagttttctttttcctttttttttcattttcatttttttttttttttttgagatggagtctcgctctatcgcccaggctggagtgcagtggcacaatctcggctccctgcaagctccacctcccgggttcacgccattctcctgcctcagcctcccgagtagctgggactacaggtgcccgcaaccacgcccggctaattttttgtatttttagtagagatggggtttcaccatgttagccaggatggtctcgatctcctgacctcgtgatccacccgcctcggcctcccaaagtgctgggattacaggcgtgaaccaccgcgcccggcgtgtaaagttttcattaagtgattgctcagataaaagcatttgtgaatgcttattcaagaagcaggtagtcgtcttgttgtgaaacagtgttcatttatcgcatctagtttgtcaaaacattgtttgacagtattgaatataaattgttttctacctgtttgttcttcgtgacctttttgcagtactatttactcaattattgtagttcacaactaaacacacctataaacatatactcaaaattccaaattttacagactagtaatttcagatttcttaaactaggattttcttctttctagttttagtcaacacgtctacattcttcatagcccttgcttttccatgattttactaatttattttaagcctttctattgttatattaagtagcctcctttgacaacctacacttttatcattagtgttctagttccaaggttaaagaagaatgcattacatagattggacaagtgaagacattagtatgggattgtcataaaggatttatcagcatttgaagctcctgacaagcttttttttttttaatttagaagaatgccattccagccatttaaataaaatctccaggagaagactattcaggttagaccaatatcaagtcgaaaagacttgacctattaaaattattccagtttgagttttaggtgggtggggcatcttttattacaaaacaaccaaatgagtttttaaaaagatttttctttttcttttttctatttttttttttgagacaagagtctctctcgctctgtcgcccaggctggactgcagtggcgccatcttggctcactgcaagctccacctcccgggttcgcgccattctcttgcctcagcctccccagtagctggtaccacaggcgcctgccaccgcgcctggctaattttttgtatttttagtagagacggagtttcaccttgttagccaggatggtctccatctcctgacctcgtgatccacccgcctcggcctcccaaagtgctgggattacaggcgtgagccaccgcgcccggcccgcaaaaaaagatttttcttgacgagaacaaaccattccaccaagactttatccagcattgctttattacttcctagtcctggccttgagctaagactgtcaagaaaggtaggagatttcagtttgttttttagcctttgatttaaaaaatcacgcatagtatttgctgcaggcagaataacacttgcagaagagacagcaggggaagggactgggattcttcaaggggcagcttgactgtctgtccactactgttggtttggtgctcaggcttcagaattttcttattgcaaattattacttagacagtttcaaactttcccttcctccttgttttctttttgttagaagtctctctttattttttcaaacatgcagtcagactgaggttttcaggctgagaacttgtgcaaatgtatgaactcagacattgaagtgtacttagcgaagttttaagagttaaatcatagaatgcagctttcatgttttcttactggatttcctctgctatcagcatcagttcagaccacattatgaatccagttgagaaaaactgcactttcttcccaagggcacatgttagaggagtaaatgatggtacttaagaacacatatttagaatgcacatttttaagttttatggaataagaattctagttgtgttttctgtgaaggtgactttttaacaggttttttttttttttccccctaagaatgagtcattttctcacatttttcttcattatagggattttttatttgggtaccatttaccgtttattttctttaaaggccaaagaagctcacagtgatgagcttttgctattgttactgtataaacacatttgcttcatttccaggtacagcgttcatgtaaaatgaaactaccttataaatgcacttgagaaagaatgcaacagtgtctattgttcaggatgcttgtaatgttccttttcttttttacatatgctttccggatgagtcactttaatggtatgccgttccgctgatagtaattcttcaactaaatatattcagttaaggaaaattacagggtacttatataatcatgtttgggcctattcacatatagacttgcaagagtaaattcttacttggtctttcttagagcaaagatgtaagaagtgctccgttaatttgtcaatggttacaatgaatagaaacatttaattcagaaaaaaatccacaaattcctggaaatgcttttatatttacatagaattacacattcttaatatggtctagacagtgtcactggaatactgtgattttttttcttgcatgcatatctgttctcttatatactgtgtaattgaagagtccttccgttcaaactcttgcttaaaatatgtatcttatactttaccttaggattatgtattagagaaagtctgtcatttaaaatgttttgaatgaggatcaggccactatcatatatttgcttgaagccagggaaaaagtatatgtatatttttcaactgaagcaagtagataaataagatatgtgaggaaagtttctcctacatataactcaagagagtacactaagcttaaaaggttatttatggagtacaaggaagaaagctataataaagaacccgatagctataatttaattttttagtgttataattcagattcagtaattcagtagcagatttaaaaaatgaaatgagagaaaaaaaattaaagtgctaccagactgactaatcagtcattgaaaatgcctgtagtgggaatttactcagatagaaaatgtttgcactgtcattaaagaccccctagtttatattagtgaactaatataatgacaggcacaaaaatataccctgaggctgaggctgtgcaaaggcaagcatttctaacccactctggtacttaaatattcttggcactacaggtaccatcatcaccctgcaacctctagtaaaaatctctctctctctctctctctctctttctctctctctctttctcacacacacacacgcacacgcacatgcaccccctacctgagaaatattagaagtagtgtaggcaaagacctagttaaatatttaaataatcataatattaattgattgccaactcttaagattgaggcaaatgtgttcaaggcaattaatgaggcaggtaaacacatattaattcttttctaatactttttttttgtctgttaccttttagacaagtctagaaagccaaagtgatgaacttttaaatgccaaggaaatacagactattgcatgggttttaatttccagaaatattatttaaatttggaacttgctaataagtctgataaattggctgttagttagtgtaattgtcactagttcccaaacctaaaattccatgtaccctgtaaaatctaaacacagaaaacacaatctaaatttagttctctttattaaaaaaagaccagctgggcgctgtggctcgcgcctgtaatcccagcactttgggaggccgaggagggtggatcacgaggtcaggagatcgagaccatcctggctaacacagtgaaaccccgtctctactaaaaatacaaaaagttagccgggcgtggtggcgggcgcctgtagtcccagctactcaggaggctgaggcaggagaatggcgtgaacctgggaagcagagcttgtagtgagccgagattgtaccactgcattccagcctgggcaacagagcaagactgcatctcaaaaaaaaaaaaaaagaccaatattacgttaaattaggccatagtagggatagcaggttggaaatgtctgcatttttttcccgtagattacatctaaatagttgtttaattcgtggtagcatgtatacagtgggaatgtgtatgttggaaggtagggtgtaggaaagaggatagtgaaatataaaatgaatatttatgtactaggtataataataagtactttatcaaatcatttaacctaaatgactaccctttaaggaagatattatcatcatcattttgcaaatcaggaaatgaaggcctagagaagctaagtcattggcttaagataacctaactagtaatatgtatggctgagattagaacctaggtctgtctgattcctaaaaccattcctaccccatccaattctgccacagcagcatatataagtaacatgaccttgtgccaatgaatgataaagagtacaggttttatttcatgatgctggccttccaggctccagaaatactgctttacatttacaatttcctgagatgacatcacttatacccctccttaagagtagtgcataccttatagaatttttgtattagataagttaatacataaaactacttagaataatgtctagcacatagtaagtactcagtaaatgttggttattacttaagaacttaagtaatgactaattctttttttttttttcccgagacggagtctcgctctgtcgccatgctggagtgcagtggtgcgatcttagctcactgccacctccgcctcttgggttcaagcaattctcctgcctcagcctcccgagtagctgggactacaggtgcctgccaccgcgccctgctaatttttttgtatttttagtagagatggggtttcaccatgttggccaggatggtctcgatctcctgacctcgtgatccgaccgcctcagcctcccaaagtgctgggattacaggcatgagccaccacgcctggccagtaatggctaattcttacaccacagaaggactagttgaaggaactgggtatgtataggctgggtagattaagaagattcaactgatacatttcttgtaaaataggtagtagacttgatcagtgctactatgaggcaaaattaggagtaatagataagagtttaagtaggctgatttttttttttttttttttttttgagacggagtctcactcttttgccaggctagagtgcagtggcgcgatctaggctcactgcaacctttgcctcccggattccagcgattctcctgcctcagcctcctgagtagctgggattacaggcgcccaccaccacgcctggctaatttttgtatttttagtagagacggggtttcaccaagttggccaggatggtctcgatctcttgaccttgtgatccgcccgcctcggcctcccaaagtgctgagataacaggcgtgagccgccacacctggctaagtaggctgatttttcttatgagtaaataaaaaaattctagtgatatcaactgtcaacaattgaataaggcacttaggatgtagggagtactctgttttagatctaatatatgcaacaccccagatttactgggcactcctttgccatctcccacctccaaacccaggctactcatttcccagccatagtgggaagttaacattgctagaaacaatttcaccaatgaaggaacaggagatgctaaggagtaagcaggtaaatgaattgctcattgtctcctctaagcagctcttttttttttttcttgagacagagtttcactctgtcgcccaggctggagtgcagtggcacgatctcggctcactgcaacctctgtctcccaagttcaagtgattttcctgtctcagtctcccgagtatctgggattacaggcgggcaccaccatgcccagctaatttttttgtatttttagtggagacggggtttcaccatgttggccatgctggtctcaaactcctgacctcaaacgatccacccgcctcagcctcccaaagtgctgggattacaggcatgagccatggcacctggcctctaacctacttttctaagttacatttgttttatctggagaccaggactgactagataatttttgggtccgggtgcagaatgaaatgtggcaccccactgcaaatttttattttattttatttatttatttatttttttgaggtggagtcttgttctgttgcccaggctggagtgcagtggtgggatctcagctcactacaagctccgcctcccaggttcatgccattctcctgcctcagcctcccgagtagctgggactacaggcgcccgcccccacgcctggctaattttttgtatttttagtagagatggggtttcactgtgttagccaggatggtctcgatctcctgacctcgtgatctgcccacctcagcctcccaaagtgctgggattacaggcttgagccaccgcacctggccaaaaagttattaagaatttcaaaatgacaacaaagtattaaacaaaatgcagggccctttgcagcatgggatcttgtacaactgcacaggttgcatatccatgaagtcagccctgacggagacaacctgagacactaaacaaccagcatttttttttttttttttgtaaagctatgacaagttctggaacttaccctcttgtatttgctgtctttccctcatgcctgcttctctgggattatatcccgctcaccccaacaaggccttaagaagtaagctctaacttaggctatgttttgcagggactcagactgtgatactctgtaacctgagtttttcaaatttaagaggctggtccaaatctcctttaatgtcacttttacctcaaaggtaacataattcccccatgcaaagataaacactttacataatggcattgtttaatgcagccataaatttctgtataagctagaattctcagattattacatctccaatattttattctcttttgttcaggcataatataaataatccattagaggggaagaatggaggagcctaagaaagaaaggtgccctttacttttttttactttatccgctttcctcacattcccatttgtctaagcatctcccgaaccacgtctatatattgttaggcagatttcaagtccctgctctctttctctacttatataataattggtatggtaacttcaaatcattatgattatatctaacctctccctgtactttcagttgtggaagtagacataaatttaaatgtgaaccaaaacttcttgaaatgtacatattcatcaataaatatttattgagtgataaatactgagcacagtgataagtactgagggaaaagcaaaaaatcaaatatagatcttaccattaggcagcttggagttttataaaggaaactgttgtttatgtatatgagataaaagacaattattattcaaagcagaaggtgataggtcgaagatcacttaaacaaacaaaaagtacatatgaaatggtagagaatttggagtagagctctggagagatttatagaggactaaagattatacatgtgaaattcgggaggacagatgttcagaaaaatattgatttattcagaatgcaactttagagtaaaagtaatttccctgggttaaaaatattctcacttattacttgacatatgtagactgctgtgtgcatagcaatttgattaggctagttttgtattgaatgattggaagatgaagtcattatcatcatcatcccctttttactagtgccattactattgtgacctaaacctggccttttagcacattttatttattacagaaagttagggaggaaaaataacttttccttttccccattttaggttcattggccacggtctctataccaaaaggcagattagcaaaagaaaataatgcagatttatttaggttttacataacttgagaggggagcattcataaggaaatgaagatccaaagaaacagttaaacctgaggttttctatagtatgtttgatgaaaaatggagaggtgtggaaaaatatgatagggagaaggaaaagtatgtgctaagtataataaactgggagaaatttaacaagacctatttgttcagatttctatgtccctttattttcagagataaggatgttggtttcctcagggtgcatatagcaaagttagctctcaggccggacatggtggctcatgcctgtaatcccaacactttgggaggccgaggcgggtggatcacaaggtcaggagatcgagaccatcctgaccaacatggtgaaaccccgtctctactaaaaatataaaaattagctgggcgtggtggcacatgcctgtagtcccagctacttgggatgctgaggcaggagaatcacttgaaccagggaatcggaggttgcagtgagccgagatatcatgccactacactccagcctggcgacagagtgagactccgtctaaaaaaaaaaaaaagccacatgagtttttgtttgtttgtttgcttttgttttttgtttttttctttaagagaaaggatcaatctgtgttgccctgtctggagaagagtggcatgatcatgactcactgtggcctcgagctcccaggctcaagcgatcctcctaactcagcctcttgagtagctgggactaggcacataaccaccgcacccagcttgcttatttatttatttatttatttatttaaggcagggtctcactctgtcacctaggcaggaatacagtgatgccatcataactcattgcagcctcaactttctgtgctcaagcaatcctcccatctcattttcttttttttaaattttttgtagagacgaggtctagctatgttgcttaggctgctctcgaactcctgggcccacgtgatcctcctgcctcagcctcctaaagagctgggattacaggtgtgagccaccacacccagcagagcttatttttgtattttttgtagagatggggttttgccatattgtccaggctggccttgagctcctgagtccaagcaatccatccactttggcctccacaagtgctcggattacaggcatgagcccccatgtggggcctacatgagggtcttaagacctgtgcccaggaaagatcagatagtccttcctgcaggtgtcatttctaaaagttcttcagcttaaaatactcaatatgccaaggcaccatatttttgggtaatgtgccctgaacttcaccatgtccgtgtaacctaaataacataagtgactggtcaatgttttgtcttcacttttttttttttttttgagacggaatttcattcttgttgcccaggctagagtgcagtggcgggatcttggctcactgcaacctccacctcctgggtttgagtgattctcctgccttagcctcccgagtagctgggattacaggcacccaccaccaggcctggctaatttttgtattttttttttttttttggtagagacagggtttcaccatgttggccaggctggcctcaaactcataacctcaggtaatccgcccacctcagcctcccaaagtgctgggattacaggtgtgagccaccgcgctcggcctgtcttcactttttcaatcaaccaagtggggaaggagaaaccttttgaataattggaatacagcagagaaacctaagtgaaaaaattcaattttaaaatcagagagaattatttcttccatagcaaactcatcctttaaataaagcaagcaatgattggtgaaccattagcaaatttttggcaaaactttcttctgcaataaagaataatttccaagcttgtcagatctaaacaaatggaactaaattggacagagctatttaaactgacagattaatagaaaaaaaatagtctttagtgttagtgtttgatttttagtctcttgaacttccatgtatatttaaggtgatttctcctcattgagttataaagatgtgcccatcaacatgatgaatttgtatctgaacagtttggctgaaatttgccaaggggttgattttggcagtctcttaaatttttcattgtaatgctgatatgtctctgcataagactaactttgcttaaaaataagaaagaatcatagtatttttctatttgtgtttcatggtcctttaatgaaaataacagtatttcagaggcctggatttaaaaaccaatgtcacaggctgtccatcaaattataacacttacctcatctttgcaactagaatcttgccaaatgctgttgatattgatagaagtgttttcatacataattggcagttatgcagcaatagagtatctataaaatagttgaaagttaaaaaaaaattacctggtaaaaagaaggtctcctgacagatctgaaaaatgtgcatgtatttaggagcagtttgaatacaatacataaaattattagttgtcaatgagagcaaaaggaaggtgcagagaatgttaggggtaattacagcaactaatgatagtgtttgagggcaggctgaatctttgtgggtatgtacgttcatttgtgtttgctggggtttgctctaaattatctttctgtatcaacagttatttttcacatctctttgaaaaatactagagatgggaacttttaccatagatattggtttataaaaatcaggatattccaacaaaagaaaaatatttgatccttttacataatttaaccttaaatcatttatagagctactaacgtgcattaataacatctctttgaaccttagtttttctttaatcttcaaattagattttaaagaatgaaatgttaggaattccgtcaataaatttaaattgaaatggattcatttgaactaatggctgagtaaaatggtgacattcccatattaaacatgataatttggtatactgtattacacattttcatttatttcatggagagtagaatttttataagcagtaattcagaaaaatgtgagttgacttcatggaactatttcccacatttaaaaaaaaagactttaactgataatgtctccttttagatgttttgtggaacacttggtaaaatattctaaatcctttgcacactgttctttagtttcagctcaaattctcaagagcaaccttgcatcaatggaacaacaaattgttcatctggaacgtgacatcaagaaattcccccaagcagaaaatcaacacgataagtttgtggaaaagatgaccatatcctttatttatttaagcattttgtctagtttttagtctctatgtctgtctgtttactaactgtgtggttagttctagatttactagtcttttcacaccatctggatgaatttgtgtatatgctgtttttctattagtagcataaattttgtttcatgatgttttcaaccagtaggcaagggaacaattagattttttttgaaggctatttctcaaagaagaattccatttgaaagcccacaggatatgcaaggtaagtcttaagaggtttgatgaaacctaaacaaaacaaaacagaatgttcttatataaccaaatgtttaaagtaaattatcaacagaaggtttttttttgtctgagattttgtgtgtgtgtgcatacattttctgagggcatgtgtgcattttcaaggacaataagaggataactaatatcactagacagaaaggactgtgaaggataaatggatacatggttggatggatagacgaattgattagtagattatatatttaaataaattgtagtagatatctgtataacattaagcatttcttgctaaataaacattttttgaaacttctagtttatagcagtatattcatataaatcataaaaatatataaaaggaaaacttgagaaatagcatttagcttgaattgtttaatgttaaatctggtgtctaaagataaactacattagacctgatttttttataattttctattttagttttcaaaagttaaagccatatcctcctcctctgggtttaaataagtatcttgaactgcagattgattcaccattttatatctttagagggaataaatactgtaaattctttatctgataataagtaaattccttcaacaactatttggcagtcaccttgtttcaaggttaaatctattgcctttttcttctgtgatatgctttattttttgcccaacttggaagttacagtgctgaactcgaattacttaagaatggcaatttagatttatgttaaaaaaaattttaactctcagtgttttggttcattaatgaatactgtgttttgtatggtactttagtgattctgagtaccttcatgaatacaaatattggcaaaataagtttgtgattgattggaggcagggaatccacaaaaataaccttgggttgcattactggccacgttaggatacctaatgtgaaggtttcactttattgctgattacattttttttttttttcaaatatgttatattgtcctgtgcctggaaacaccacctcctttttcaccttttgattttggttcttgcctcatatatttgaatttaattccttatcccctttttcttttgaacattttcttctactgttggcttatagccacacaacagcttgcaacattgagtctttgttgctcatttagaaaaagaaaagtaatttcaaaccctcatgaacttggcctggactccttattttatttctctctttatgcaggtaattaagcactttaaaatgaaaatccagagccttctgtatctgtatgttacagatgaatggttattcttcatttaagtggcactaaagtgtgactatttgtccacaaggggattgaaaactgtattaaaatgtatggggctgttactttgcatatcatattttttaaagaaacaaaataaaatacacagcaatttatttcagagaaaaaattagaatattgagttgggttggttaaaaactatgaattaatggattataaagataaaactgtggctcaagttattcttcctttgaaagacttcttggtcacccattgagagtttctatcttctagaaagagacgaacgaaatgcgtaatcattatatgtatgtatatgagttctggtgcctacctaatatatatattttttacccttctggcaatgctaaaagagaaagatattttattgtgggatacttgatcctgttttaaaaatagaaccatgagccaggggtggtgactcacgcctgtaatcccagcactttgggaggctgaggcgggcggatcacctgaggtcaggagttcgagaccagcctcaacatggagaaaccccgtctctactaaaaatacaaaattagccaggcatagtggtgcatgcctgtaatctcagctactcgggaggctgaggcaggagaattgcttgaacctgggaggcagaggttgcggtgagccgagatcgcgccattgcactccagcctgggcaacaagagcgaaactccgtctcaaaaaaaaacaaaaaacaacaaaaaataggaccatgattccatttctagtataggatcctttgtactagatgatctttccaatatttccatccagtgccaataaattgttttgcttcaagtcactggccctttaaattgaataattagggtcacaagtattggagtagtttccatggaaagtaactttagctacttaaacagtaatctgtctgtgaggactgagttcacaagctgaaaagcattcgtatgcctctggacttcagaacagcaacaatgctgtagttagcagcaatggcatgatggcttcagggcaactgaatatgcaggttggatcttcaagtcaggctatgtcctggagcaccctatatttacccttactctttcccaattttgattgaacacttaaagtatgctagacattgccaggcatgaaaattgaacagtacacaagatgatagaaaacttgacctcaggctgctgacagtctgacatttgtatgttctctgtcttgctgttcccatggcagagattatgtatggtttgttaattactatatgcctaccacctagcacagtgtaggcactcagtaaatatgtgttgaatcacacggtattatagctagagacagtgaagatcatctagtccaagcccctgcctttacttagcacttcaaaacgatactgtcagtgttaggctgtgcttatatttataaaaattttcttcatatatctctcacaaatgtatcattgaatcacctttatagagcatgctgtaatgtataatcagttttaagagagaggatccacagcttttaaagtaaacatcagaaaaaacatagacaaaaaacaaaaacaaaaacaaaaaaacctctcctttgaatggagtttccaaggctatttctagcctgctggggccaatggctttagaaggaaactcatcacctctttcttcctttctctacccaaaataggttgcttgttctgactcagaaaaaattagatggtataggagagaaaaatcagtcgttcttgacccattcgaaggttcatggctgacaccctataataccatattaacaagagcaaagcatacaaatttatttaatgtgagttttatgtgacacaggaaactccataaatgaagactcaaagaaacagggaaaaaccatgtattttatgggcagttgtgcagaagtatgactggtggataaaaggatatgatctaatggtaataagctgggggcaacccatgaaggctggttcagattattttctgtatctctgtatgacagtcttcccccaggtatggggaaaagacacctgtcatgtgaaggtctcttttttttttttttggagacggagcctcactctgtaacccaggttggagtgcagtggcgcgatcccggctcactgcaacctgggttcaaacgattatcctgcctccgcctcccgagtagctgggaatacaggcacacgccaccacgcccagctaattttgtatttttagtaaagaaggggtttcaccatgttagccaggctggtctcgaactcctgacctcaggtgaccagcccacctcagcctcccaaagtgctgggattacaggcacgagccacagcgcccggcctatgtgaaagtctttggtgaggaaggacagagctcagaaagtgatcttcctaggttttatggcttctttcaagggagaggaattctagtttctttgacttgcttcaggagacaaaggaaggtacgaaggagggagggataagttcagagacaccttcttgcttctgtggtcctcctggtgtccttcagctcaaagtattcagcatgccaaggtagcgtacttccagatattgtgttctgaaccccaacactttacttttttaaaaaagtcaaagcatcatttttacttaccaatccttgcttcttctgtcagaaaagaaacccattcttaaaagaggacttcttagacttttaaatatgtgttgtggtccattcttaacatcttaaactatctaaaaaagcacatcaaccacgatgtcgaccttactgcttatatccagttgacaaattccttaccacatttacttgcagagattttgtcaatggcagggttttctgttgcccaaaatcagcttagctttttgattgactgctggttaaatcatttccccaaccggaggacagagagtgactgagcagcaggggcaccattaacacattgacaagaagagctgacagaatgttaatgacattaacaccctgtcaactaactatcaacacttgggatttcctcatagtatgagggaagtcatttgaagtggttacaaatcaagttactgagaaggcacattatcctttccagataattcaaaacagatttggggtcttcactgcactgccattatgttaattgtattccacctttatttattaagataataatttttaagtagatgaaaaaactcacagaaccaccagtgacattgatcacctttgagaacatgccagtaacaggtttcagggagatgataatccacactttgtaaagcaaatgtcatataaaattgacaaaatagaaatgaaagcaaaaacaaccctcaagagcaaagctgttgtgttttgttttgttttgtttttaatgaacatagtaattcaggtcattttctggtgcctaaagaaaaattgagaacttcagattaggctggaggggggaagttcatcacctctgactctctccttaccctcactgtctgctcctctcaaatgcagaaaattagaaagttcaatgcaaacatttatgagactgttcagggagaggagggtacaggatttaaaagggggcattgtcagtaatacagataatgcatacattgagaagcaaattgttttagaaaaccacaaggggggccgggtgcaatggctcacacttgtaatctcagcactttgggaggccaaggcaggtggatcacctgaggtcaggagttcaagaccagcctggccaacatggtaaaaccccgtctctactaaaaatacaaaattagccgggcatggtggcacaagcctataatcccagctactcaggaggctgaggcaggagaatcacttgaacctggcaggcggaggttgcaatgagcagagattgcatcattgcactccagcctgggcggcaaaaagagtaggactccgtaaaaaaaaataaaataaaataaaataaaaaaagaggaaaagagtgctttttaaaaaagtaagattcttagcattttttgaaatatactctcttgacaatggtactggtcaatggaatttttagtttaattgaatttaaatagaaagtattatcatttatgataataataaagtagtaggccgggcacagtggctcatgcctgtaattccagcactttgggaggccgaggcgggtggatgactaggtgaggagttcgagaccagcctggccaacatggcgagaccccgtctctactaaaactacaaaaaaaaattagccaggcatggtggtgcacgcctgtaatcccagctactcaggaggctgaggcagaagaatcgcttgaacccgggcagcagaggttgcagtgagccgagattgtgccactgcactccaacctgggcaacagagtgagactctgtctcaaaatgaataaataaataataataaaaaaaacagtaataatagtaataaactgttatgaaagaaaatcaaagccagaaagaagttaaagtggtaaaggccaattttattcagcaactattgcaataggagagagaccttactatacaacgaggctgcattctgatacaacaaaggcaagtggggatttatagccaagaagcagggtggaagtcaggcaatggaacattactagaaggagatatcaaagataaggggattccccctaaaccaacttgataggattcttgctgaaggcaggcaaggctaataagatatgaagagtggaggatgaggaatttgaccatatatgaagggtggaggatttttgctaaacagacccagtaggattcttgctaaaactggactgtcagggccaaggactgagcctaagaatgaggcctagtcaaaaagaggactcaaggctgggcgcggtggctcacgcctgtaatcccagcactttgggaggccaaggtgggtagatcacctgaggtcagaagttcgagaccagcctagccaacatgttgaaaccccatctctactaaaaatacgaaaattagctgggtgtgatggcaggcgcctgtaatcccagctacttgagaggctgaactaggagaatcacatgaacccaggaggcgaaggttgcagtgagctgagatcacaccattgcactccagcctgggcaacaagagcaaaactctgtctcaaaaaaaaaaaaaaaaaaaaaaggactcagaggaacctgactaaaatttggttcaagagagagtctttgtcactgtttagttaatgtcatatgccagccattatgctaggaatatctatatctatatatctgtctatatattttcctaagtgaccgccaaagcaatactatgaagtaggtactattactaactttattttattttatttattttattttattttattttatttattttattttatttttgagacagagtctcgctctgttggccaggctggagtgcagtggtacagtcccgagttcaagccattctcctgcctcagctgcccaagtagctgggactacaggtgctggccaccacacctgactaatttttgtatttgtatttttagtagagacggggtttcaccatattggccaggctggtctcgaactcctgaccttgtgacccacccgcctcagcctcccaaagtgctgggattacaggcatgagccactgcacccagccttaactttattttaaatgtgataaaattgaggctatagaggttcaaccatgtacaggagatcacataggtaatatgtgtggttcatgagggtcagaattccaattttggtctttccgacattaaaccttgtgcttctaaccatggtattgtgctgcctccgaggttagacctgtttgaaaatctgagataagttctacatttgttccctgtgaaactgtttttttgcttccttttcaatctctctcaaatgggaaaaaaaatgttctttttgaaaggattgtaaactgatttaaaaattagctgctcacttataccatctcctccagaaagccttccctaatcatagcaatcaaaattaatttccctattccctgtatttttataacattttaatactttgattattgtacttgctggtttgcctgtactctgttcatgtacatgtacatatctattttgcatactggtttatgtactcttttcagatacagattctgattcatattttgagtacttcacaacaagcctgtaacaatgctttatagaaagtcaagtgcttaataaatgtttatttaaataggttagagtttattatataattaatataaaacttaacattatggccagtaaacagaacattagcttgtttttctggcatagcctcagtttaacagaagaaaggagtctaacatgtttcaaatgttattcttttatcatgtcttgatttaaaatgcagctattgaaaattatgtcttaacagattttaagatagaaatcacattctaagaccctgtctgaatggagcatatttttaagggtccgttagcacaaaaattttctctttgaagagttttgcttgcttgaaattcaccctgaaattacgtacactatgagctacatttttcaaactttgttcagggaattgatagacatttggtgcatgatgctaatggtgagaagagaatatattgctcagttaaaggatacataaaccctttcaggccacaagagactcatctgggaaatcatctttttcagaacataaaacggaacttaatttgtctgaaagagttaatgtaccctcaacctgacaaattctaatcgctctcaccagaagctaagttttaaaagatgtaaaaacctttctgtgggatttattcatattgagtagaaataacacaaaaaagaagcttgaaagaataaattacccaatatgaatgtggttttttgtgtgtgtatgcacataaggaacatgtagcatgtgcacatgtctattcgtagatgtaaagccattttggtatttataagactataaattggatatcataccaatgaatctgtgaatttgttttctttgctttgatttaaaatttggtaaaagttttcaattatgaaacacgtggtatcttaagcatacatagtttacaggtaataatagtgatgttagtataattcctcaagtaatatactctggtgcaaaatctcaatcatgtactgttttcataatgcagaaaaatatatcagtatgtttttgtataataaaagtgtgtttacttatttctagttaggatgtgtttgacatatagcttatgaaaagtatggcaagtaaacttggcttttcattcagtaatccctgctcttttcttctgtttttgtttgtttgtttgtttgtttgtttgagatggagattctttctgtcacccaggctggagtgcagtggcgccatctcggctcactgcaacctccgcctccaaggttcaagtgattcttctgcctcagcctcccgagtagctgggactacaggtgcataccaacatgcctggctaatttttgtatttttagtagagacggagtttcaccatattagccaggctggccttgaactcctgaccttttgatccgcctgcctcagcctcccaaagtgttgggattacaggtgtgagccaccacacccagcctttcttctggttttaaattgctttacaagatgaagactgaaaaaaaaaaaaaatacaagaaagtataggaaatcattgtttaataatcatgtaatcatgctgtcttttatgttgcaaatgtaagataggataataatgtagtacattgtctgaattaattaatgaagtgaggaatggaaaaaaatatatgacattactgaaaattatctaattgaattttaataataggattgtatgtatacctagtaagacatatatttatagaactataatcaatttgagaggatcatatctcagctacttatttaaggctaagggattcactaatggtaagaatggaaaaatcaatgaaaaatttaaaaaggccgtgtggacaagctttgcaaagatcatcagtgaggagaataggacctagtcacaaactgatgatgtctgaggagacaaagggcatgagtaactgagttgacaatggttctgagaggtaacggtaacaaaccctctttatcgtatcgaaagcaaatatctagtaagtggcttttcatatctgctaagacattatcaaatttgtgcacagcaactctgttcaattactgatctctagatgcctttatcataggcctgactcagaacctatatataaaagtaccttcaaactttagtgttctttcagatgccaagtattttacttaatccatgtgaatgaaaagatatttggactgggtatccattgagttaagctctagccttggtatttgtgaacttaggaaagactgtttacccagtcataaaattgaaaaaatcatacttggcttgcctacttcatataaattgttattaaaattaggtataatagagtgacttttaacatgccttgcaaaatggaaaatgctttgtaaaatagaataaccatttaaaattgtcatttatgtatcattctcccctaaaccgcacaaataggaaataattctatcccccaaggaaaatgttctttgtttaaaaaaaaaaaaaaaaaaaaaaaggcctcttttttccaatttcattttatctaactttaaaaacatttttaagttctagctaactttgctttttgtatgtagaccagtaaagggcacatttttcaaaatgtagtgaatgcttgtagagtaagcaggatgctaacacctcattattcaaggaatatccagatgttcagtgttaaactttgattccttacttttttcactttggtaggaaagaggaagatggagcaatagagtttgaaaattcttgcatactttatgaatgatgacattctatatgctatgacacctataaaataaagattaagggggccaggtgcagtggctcatacctgtaatcccagcactttgggaggccaaggtgggtggatcacctgaggtcaggtgttcgagaccagcctggacaacatggtgaaaccccgtctctactaaaaatacaaaaattagccaggcgcgtggcacgcgcctgtagtcccagctactcgggaggctgaggcaggagaaccgcctgaacccaggaggtggaggttgcagtgagccgagatcatgccactgcactctagcctgggagacagagcgagactccgcctcaaaaaaaataataagagccagtcacggtggctcacgcctgtaatcccagcactttgggagactgaggcgggtggatcacggggtcaggagatctagaccatcctggctaacacagtgaaaccccgtctatactaaaaatacaaaaaaaattagccggtcgtggtggcgggcgcctgtagtcccagctactcgggaggctgaggcaggagaatggcgtgaacccgggaggcggagcttgctgtgagccgagatcacgccactgcactccagcctgggcgacagagcgagactccgtctcaaaaaaaaaaaaaaaaaaaaacaacaacaacaacaacagaaacaaaacaaaacaaagaaagaaatgatcttccttccactgctccaaacttctaagacaatgtatgtgaacgctcaacacagacagaaaacctctactgatatctgcctgaggcaggcaaatcacctgaggtcaggagttcgagaccagcctggtgaacatggtgaaaacccgtctctactaaaaatacaaaaattacccaggcatggtggcacgtgccaccatgagtagtcccatgagtagtcccagctatgagtagtcccaccatgagtagtcccttgagtagtctcatgagtagtcccagctactcaagaggctgaggcaggagaatcacttgaacccaggaggcggaggttgcagtgagccaagatcctgccactgcagtccagcctgtgtgacagcatgggactccgtctcaaaaaaaaagatcaaaaatgttctgagaaaacatcaagtagacctctttggctggaagtagtgagagctgttactaagaaagagggtaaaaatcaaattctaaataattaataatattggtctaaggagtttgaacagtatttggtgggttataaattgctgaaaggcaagaaactcttgttccgtcttctccctgcttccagccaccacatggtatttgcctgagagtgatacttgctacctgccaactactgatccaagtaagtactaaagtcagaattgtttccagtattagaaaggtatgtgtgtgcacccagactcatgtgtctgatggggcaaatggttatttctttgtcttcaataatgcatttaactgttctgtggttgaatttgtaatacagttataataacttgcatttatatagtgttttaaagcttgaaaagatcttttatcttctcatgtctaaccctaaatgttctgtagcaaaaattatcatattaagttttgttttgttttgtttgagacggagtctcactctgtcgtccaggctggagtgcagtggagtggtctcggctcactacaacctctgcctccttggttcaagcagttctccctgcctcagcctcccagatagctggattacaggcgcccgtcaccactccgagctaatttttgtatttttagtagagatgggctttcaccatgtaggccaggctggtctggaactcctgacttcaggtgatccacccgccttggcctcccaaaatgctgggattacaggcctgagccaccacacccagccacatattaagtcttgcacctacttgatgttgttgaggattcatccatttcacaaatatttattggttgattactcactgtgtgccaggcactgtgtcagatagttggaacacagtggtgaacaaaaaagatacaatgcttactgtcaaggagattttactttgctaaaagagatagacattcagcaactacataagcaactatggcaggtgataaggaagagatttataatgccatgccagtcaacaacctagttacaaggactgccctccagagagaataatacttgagctgagatctgaaagatgagtaagaattaattcagggaaaaggtgaagaggaatctttacctcagcctgtttatctacaggtgtttcaaatgtttgacagtttggtaccttggcgatgatttggttagtttcttgtttatggtcttactggatttacaatcctagtggagttttaaagttggagttagaaatctctcaaattgagccaaatcctgaggacattttatgtttaaaaaaccctcttaacttttctcccccaaaagttgcttttttactattggctagggattgagtatggatatttttgaaaagctatgtcagattccgtggaaaacctaaagctctgtgaaccttgtgggagctggaatttttcagctaagaggttcgaatagatttaggtatttatccaaaccgaacttttaaaccaccagagatttgcccattactagtttacatagagcttaactacagtggtttcctctttcaacatttactttttttatttaaacagcttaatcgagagctataaaaacactggatcagtcttttcaaataaaaatgaaatgcaactgccatgcgttagtcttttagaagaagcccttctgcctgtaggcagtttaggtgttaaaatgatggctttttcaataccaaaagatctagtttttgtttgcaaggtcatatctttgaattattagtttataaaaacctggcatatcttcgaattataagtttataaaaacctggcagttcttttgattttagttacaagtgcacacgtgtgtgtgtgcacgtgtgtgtgcatgtgtgtgaaacaccaagagtcatgagatttacattattggcttgttaattaagggaagaattccataattgttttaaatcaatcacactgcacaggggacattttgcctatttgtttttctgcacatattttatatgtcattgtttatgtttgcttaaaatgccaagatgtgcttaagttagtaatgctaatattgatccaaaactctcaatttatgactgattcttcatttttttcttttgtaagtcattgctttgctttaactcttaatgttatcgggaataaggtattttaatactcatttcctttagaggaaataaaaatatcaactttctttttttattttttatttactttatttttatttttagagatgaggtctggctatgttgaccaggctgctctcaaacttctggcctcaagcagtcctcccatcttggcctctcaaagtgctggaattacaggtgtgagccaccacgcctggcctcaacttttcagtaaattaacctggaacacagaaagtcagagaaatgaaataataattccaagttatgcaaataagtacatttatgtacaaagggattgtattaggtgatcttgagcatcactttcagctctaaaaagttcttatattgccaaagctaggtagtacgttcatccttgttctgctcaaacattaaatgcttaaatgttgaattaatttcttctctgattcatcacaccagtattgatattataatattgtgacatcattcctactggtcacaaattcatctattcattcaacaaatatttatcaaaaaaaagtttatcagatacctacaatgtgccaaaccctgtttttttcagtggagattcagtgatgagaaactaaaaaaaaaaaaaaaaaaaaagaaaggcctttgagcatatattcacatatattctagtgttgtagagcatcaaaataaatatgtagtataatatcatacaatgataagtgataaggaaaataaaggtgagtaaaataattcattaaagaatgatagagacacttgtttttaaagttggccagggcaggacccctccaagggagtaacatttaggcagctgtttgaatcaagtgaggagacgatttgcgtgagtaactgagggaagagctttccatgaaggaggaacaactagtgcagaggctgtaaggaatgagcatgagtacaaacacacgtaaggtataacaggaagagcaagaccagtggctggattgcagcaagtgagggagaacgtagaaggagcaaggatagttctgatgtgaaatcatggaagacattgtataagggaaagtcattagagaattgaaaagagataatgacacaggggtgaggatgactggatgaggaagaagggaggttgtcggggtgatgaatcaagagtttggtttgagaggtgggaagtttgagacgcctattaggcatccaagtggagatgtagatatgtgagcctagagtataaggggaaggtacacattaaagacagaaatctaggagccatcgccatggaaattgtgtttaaagccattagactggttaaggtgacctaaaacacatgaacagacggagaagagagaggtccaaggactcaggtctggagtactccaacgtttaaaagtttggaagatgagaagaattttaacgaaggtgtaggggaacttaaaaggtacagcctatgtggtaggaggaagccagaaaattctgttggcctgagagccaaatgacaaaaatgtttgaagaaggatcttttgactaggctctgtgcattgattaaaaaggtattatatgtaaggcattgaacacagacagcagagaggagctagtgacttcagaaccctctaagtattttattgagaaaatgtagactcatatcatgcatctattcttttactttgttatttgttaggatagcacatgcattagatttttttcctctatcatagctgactatttccagatcaatcaaaatgtccctattaagttgtcagttacatcacagataattgccataagccattcatttcatgtttttagtatcctgtgcaataaaacgctgtgaaacactttgaacagttattcagtgaaatctcaattatctggaattctagtaagcatatatctgtttatagataaccaggattttccaaatttgagcattaaccatttgaatgctagaatatttttttaaggaaaagccttctaaagtgcattattatattgagcaccagccatgtgctaggcgttttattaggcactataactatacattcttatagcttatggacctttgtaaataggatgttccaactgttatttatttatttatttatttatttatttatttatttatttatttttgagacagagtcttgctctgtcagccaggctggagtgcagtggcacaatctcagctcactgcaacctccgcctcctgggctaaagcgattttcctgcctcagcctcctgtgtagctgggattacaagcatgtgccaccacgcccggctaatttttgtatttttagtagagacggggtttcaccatgttggccaggctggtctcgaactcctgacctcaggtaatccgcccacctaggcctcccaaagtgctaggattaccggcgtgagccactgcgcccagctccaactgttagttttttatttatttatttatttatttatttatttatttatttgagatggggactcactctgttaccccagctggagtgcaatggtatgatcacagcttactgcagcctcgacctcctgggctcaggtgatcatcccaccccaccctcctgaatagctgggactacaggcacattgctaccacgcccagctaaattttgtattttttgtaaagatggggtttcgccatgttgcccaggctggccaactgtaattcaactacatcttaatgatcttagattatcatcaattcctctcagctgctgtagagatatttatctgataatgcagtatcatatgcctagaaggctttttttctctatccttctgaaactttatttcattttttgctttaagaaggtcacataggtgctctataggcacagatgattgtttggccccttgtgtgtgaataaatgcacatatgcctctttctcatcgttttcagtcattctgtgtacatatatgtctcacagaaatactcatgcatagacacacagacacacacacacacacacatgctatacatttcagggcactatattgaagcaaatatgactattcattttcttgctcacacatacacacacatgtacacatgtctctgatgccactgaggcacctggccaagtggttaattaacctttgcacaaatatattttagaaaagttatgtggcatcaagggctacattactgttggtcctcacaacttcttaccctcaaggaattcagggatggtcaatcttctccttagaaatgactttattcggctgggcgcagtggctcacgcctgtaatgccagaactttgggaggctgagatgggtggatcacgaggtcaagagttcaataccagcctggccaagatggtgaaacctcatctctactaaaaatacaaaaattagccgggcatggtggcgggcacctgtaatcccagctacttgcgaggctgaggcagaaaattgcttgaacccgggaggcggaggttgcagtgagccaagatcacaccactgcattccagcctgggtgacagaggaagactgtctcaaaaaaaaacaacaacaaaaaaaagactttattctctgttgtcagtgtatgttaacccttttattgcatttaatttctacaggtgttagtctactattatttttgttccagtatctcatcaagtcaaataagcacagagtaagaatttcaaagctagagagggctgacaataatagaaaacagaaacatactcaatatatactcctctctcactatgaagctggggcattgcatgaccagaggagtggtactttagtaagattgctctgccaatctagtcattgcatgcagaatgaataaaaaaagggagagactgaaaacaggaaaatcagttaagagagtcaaatatttcctatgtgccgctcagtgttctgggccttcagtctcagagagtaatgaaacggatgaggtgcctgctctcatggagctaaaatttacttgggcatggaatggggtttgggattcagtgctatgttgtgctaagtgctatggaaggaaataaaaccaggttatgtgatggtgactggggagccactttaggttaggagggcctttttgtcgtggtgacgtttgagctgaggcctgaaatatagaaagattccagacatgtaaagatctagttaaaagcattttaggcagggagaatagcttgttcaaaattgtatggaaatggacataaacttagcatattcaagaaacaaaaagaaggccaatatggctggttgtgtggttaacaaaggggagattagtataagatgaaaactgagaaaaaggtagggacaaatcatgtaggtccttgttggccaggataaggagtttggagataactatactaatccaagtgttcagtaaatattattatcactattgagttgagttttaactagacagttctctaaatgagttagtcagtgtttaggaataacccatgctcacagcatcattaaatgtttactgttaattctcactgctctttctcggtttcttgcaaggcattgttgcaaaactaatttatcacatacgttcctagttggggttcttaaaagaacatttctttttctagtatgacagtacagaacatgtgtgtgtatatatgtatatgtctgtgtgtatacttgcatatactatgtctgaaaaatacttttattctgattgaccctttgtacatttctcaaataatatagtttaactacccttgagccagaaactgtgtcagatgctagagatctaatggcgaataagtcatagtacttgtcctaaagattacagtataaataatgtattcttttgatcacaagaaagcttcgtccacaactttgaaggaacaagtactggctattctcctttattattttatgcaaattattatgtttcataaggactcattgccagcatttattttgtttatggactttgaaagtaggagtttcattaactctcagtttggacagtattatctttacatgcagttagtgcagtgactgtcatcatccttattagaataccaccaggacatctggcaagatgtctaatataaagcagctatgttatctatttccaatcaaatgattctttggtgcttcgatgtcctgtaacttctccacttatgtaattctctgccataatctaatttgtaaagtggggtgggagtaaaagaaaatttagaaagaaacacagagcacaaaccctttatcctggtaaagcatctcatgtttcaatttgcagttgttttggtaaagtataaaacaagaaatatgattataaatatagtttttattttttactgtgggtaggatgttttttgactaacacatgcttttaattgcctaatctattttggctttacctttagagaaaaattactgcactttgctgcatctgtcaaaaatgacacgataattctttgagtcaaaacagggtacatgaaatgtgatttttgtttattttctgaagaatagcagaactcattttttgacacatcctttactgtggttaagactccatggcatagaacagactgcttattttgaggttgcaaagtacagctaacctacaagaataagctctctaatatcttctatcaaaccaagaaatgatctgtttcacatgcacatagaaaagaattgattttcttacacaggatgctgccacttggactgtacatagagttgatttgtaatataaattaactcaccaattatcgattgttccatctgactttgaacacattaagaatctgcaaaaagtttctgagttatcaataataagaaagctgtgtatgaaatgtaatggggtgcgtcagctggatccgagttagatattgctgtaaatgttgcttagctttgccatctgtcacatactctttttgcataatattttaatccattaaaatgtgtctttttcttttaaaaaacattagcttacttaggttacaatgaaaaccctttaagaaacagtcagtgaccactgacctttccatgtcttaagttactttgtaactgtttttgcctttgtgccccctcattaagatgaataatgacaatccttagaaacaggaaatgccaagctcccagttgcaatgctaacaagtaggaagtcccattaacttttcaacttctcagacaagaaataaatttggacatgagacattatttctgaaactacttgtcctcaggagcagtgattgaatgaactaaggacttgctttcactaagtggaatggaaaactcatgtcacagcatgtcagtttctgcttaatgaatgagatattccctggggaataaattaggcgcctcacgtacataactcttttagggtacccagacctcattgatttccttttgtagaatagtacccacgtgacttataagactcactgtacaactaaactgactgactttgaccctcatgaatagttttgtcacctgggagggtttggttagaaatggtctccaccccttaataagaaagtcagctctttgctccctgttggctcactgctctcaggccactaaatgaaaggcacttgggtgtcatttagagccatttaccaaatgaactatcttggcctgagaaagttaagcactgttgggcctggcaatttaccataatcaaagagctagagcagaaaatatgcaagatctgatttctggccaatttgtgtttttcccgtgttgctcttggcagatctctgttttgagtagcccactcttctacttctctccatgttattaatttgtaaagtgaaacaaattactgacccttgaattgtgctattacacatgcttgagtaattttatttcatttgcagagaatttcatttcatttatgtattatttatactctacctacttccgaaacaatgtgtactggcttattttaattgtaattcaaatcatctgagtatttttccaagtcctgtcctgaagaagacttgtgtcatcacacatcatttcacatttactgtgctatggtgatatattggttatgatgcaatttctctggccacctaaaaacgactgtattaacaaaacatcatgcctgcagtctaatgtaacttcttttgttgtggtgtggtctattgggaaagaacatgcaacttacagttatgtgcttagttctaccatttatgtgacctagggaaagtcatttgccacatcttgctcaagtttactcagttttaaatgtagttgttaatgcttactccccaaacctttcaaggttatggaaatcaatgcagtaaatactgcatataaaatgtctgtgaattcccatatttctccagttaacaccaggaagaataattgtcagctgaactgaaatgatcaagcagcgttcttgtattcaggcactgttcttttttttttcttttctttcttttttttttttttttttgagacagagtctcactctgttgtccaggctggagtgcagtggtgcaatctcggctcactgcaacctccgcctcccaggttccagcgattctcctgccccagcctcctgagtagctgggattacgggcactcaccaccacgcccggctaatttttgtatttttagtagagatggggtttcaccatgttggtcaagctggcctcgatctcctgaccttgtgatccacccgcatccgcctcccagagtgctgggattacaggcgtgagccaccgtgcccggcctcaggcactgttcagacaaatgagggatggagatgtgacaagagagagttcctattttgaggagccacagtgttgtggtgaaaaaggcccagcacacaaacaattataaaattcccaatgggataagtggcacaagtgaggtatgcaaaagtgtcatagctgacaggaagaggaagcaatgaactctggccaggaaaatgggaactaagtgaaaaattagggtaaaacaagataacgtgtgggaaattccttcagaaacactctgtggatactaagacacaatcttatcaatgtcatttatttaacaagcatttatgtattatttacaatttgccagacaatgttctaaatgtcttacaataggaaatcatttaatcctgttcattcaggtctgtttgctgcgaaaaggaattctagaagcactaaggaaatcctagatacagagattcctttgtcttctagtaaggaggaagcatactgggtcagttaacatccacatgtctgtgaggcaaatggttagaaaagtatataccaaaaataaatgaatgaatgaacaaactaaggaataaagacacaatgaaggagatactatttttattttttttttttttttttgagacagagtttcagtcttattgcccaggatgtagtgcaatggcactaccttgactcactgcaacctctgcctcccgagttcaagcgattctcctgcctcagcctcccgagtagctggaattacaggcatgtgccaccatgcctggctaattttgcgttttgttttgttttgttttttgaaatggagttcctctcttgttgcccaggctggagtgcagtggcgtgatctcggctcaccacaacctccgcttcccaggttcaagcaattctcctgcctcagcctcctgagtagctggcattataggcacccgccaccatgccccactaatttgtatttttaatagagacggggtttttccatgttggtcaggctggtcttgaactcccagtctcaggtgatctgcccgtctcggcctcccaaagtgctgagattacaggtgtgagccactgtgcctggcctaattttgcatttttagtagaaatagggtttctccatgttggtcaggctggtctcgaactcctgacctcaggtgatccgcccgcctcggcctcccaaagtgctgggattacaggcgtgagccaccatgctcggccttgaaggagatactattaacctcattttacatgataggaaaactgtggtacagagggactaagttgcccaaggtcacacagctactaagtggcagacctgagtttgaaccaaatgagtcaggctctagaggtggcagccttaacaaggatgctatactgcttctcccatcacccatcaacacagaagtggacatctttattgctggaatccagcactggaatcccttggtggtccttttgatctctgtttcagtacctatagaaacgacaaggacttaaccagctcttgaaacagctgactacatttttggacagttgtaattactagagagttctgaatttgagccaagatctacttttcctggaacttccacccattgatcctatgtctgctttctgacactacatagactaaaccttcttccacataactgtaaaagtattggaaaacatctcccatgcctcctgcttgaattccacattcccatgtaaaaagaaagtgacatttgagagcaattagatttcattattccattgagcatttatttatggggtgcctattgtgtgcaaattgttatacagtgtgctagcaatcgcagagaaaatgaatagcaccagattcgcatgtacaaagtatgtactctgcactaagctattccactgctacccaaaatgtgcaattatcatttaagatacaaactaatgaatagaattattgcctgcacttatttaaatcagggtttaaataagcagtgtcttgctgggtgcacctgtatacatgccttaattaccccacaggattacaaacctgtgggcagaaactgctaatacagccttgtatttcctaccacacctagcacaggttctttggcagagtaaatgagcaataaatatttttgaatgagtgagagaaatgctgtattcattaatgctgtccttcagataattgctctaaatgatgttcacatgtgatcataacaataacaaatacaattttactttgctgtttgaatttcttcaagttttgtgtgccacattaaatagcactagagaagcaaattttcccagaagaaatgtcgtagtaaaatgtttgaaagacagcaaggtaattcaacagccagaaatacagagctttatagtactgatcagtcttcaactctttttgaaaagattcactgttatcaactgagaacctctccaccaccatgtgagcccagtaaaggcattttctaggttaccatcctggggtgctcctttggtaccaattgttctaatattattattatagtggaaaatgcaacaacatcattgaacctgtaccctgacctttcagttggccttggtgtagagcatcacacagtcaaagaatcaagttcagatcagattttaatcccactacattactgtttgctctgctttttgaggagattgcaatgactatatatatatgcacacacacacacacacacacacacacacacacatgcgtacagacatacatatatacacatatatgtatacacactgtattttatatatctatggaaaatatgtatttccattctgtagtctatgaaaacttgtatgaatggggcaaggtacaatacacaataaaataataatgcccatgttaaaaacttttttttttctttaagatggagtttcgctcttgttgcccaggctggagtgcaatggcatgatcttggctcactgcaacctccacctcccgggttcaagcgattctcctgcctcagcctcccaagtagctgggactacaggcatgcaccaccacgcctggctaatttttgtatttttagtagagacggggtttcactatcttggccaggttggtctcgaactcctgacctcatgatccacccgcctcggcctcccaaagtgctgggattacaggtgtgagcccccacgcccagcctgttaaaaactttttgagtgcctatttgtgaacaagaaacctttctgctgtctcatctggcataaccttaacatcacgcatttatttgtgctacctaacataattagccatgatagaaaactttaatgtaaaagaaaagaaaagaaaactttaatgtagcatcaaatcttgaaaaatcattttaagattcagttgattattttattagccaggacctctgtgaaatgactctaggatgagaactaaaatataatggaatgggagaggttcattcattatgttagagatttggatagtgctaggcctttaattaattaacatttcattaataatctgtaaggagtaccagtaaacagcactttaattaagttcatgggtaatacattaataggtatagaaaataccaatgaagacaggaaaataattcaaatagaccagataatttataagatataggaaaataacaggaattccactggccgcatgcagttccctactcaagcaaataaaaggcagtattcactgcatacattggggtatagaaaataaacaagtacaataagtaaatatccttgttggctgagcgcagtggctcatgtgtgtaatcccagcactttgggaggccgaggcaggcagatcacctaaggttgggagttcgagaccagcctgaccaacatggagaaacccagtctgtactaaaaatacaaaattagctgggcatggtggcacatgtctgtaatcccagctactcgggaggctgaggaaggagaatcgctcaaacccgggaggtggaggttgtggtgagccaagatcgtgccattgcactccagcctgggcaacaagagcgaaactccatctcaaaaaataataataataaataataaataaatatccttgtcaacaatataatggctacaagaagcaaaaacttttgtttctggtggggcctctgaatatatttctacatatagaaatgtaagaatacaagaaatacatacaagaaatatgaataaatttttatatattttggctttatgcatcttagaaacaaaatgattgtatcatctgaatgacagggctagtaaagaacctacatttactgaatgcaaactactggccagttcctgtatttaggcatgataaatacattgtgttttctttaatcttgtctctttttataagttcagatacatgaaaattaacaaggtttcatatccattaagtggtagagcttggttttaaccccgatctttctatggtacttccaataatgatatggacgattgcatgattttatgtgtgagcacatgtgtgtaaaacaggtttggatacatttaccgtcaactaaatggtatactaatcagtgatactcagatatttttcagtaagtttcagtttaggggggatttgtacatgtaaaatggctccaggagtctgtttgactaattaggccacctggggtctcatataatagttattttaggtttccactgagtcagtacccagttatacatgttgtttgacattggtcattttaatgaatacttgagccttaggaaactttatccattatggcaataattttatatatttactcttggccttgacatcattcccaggcagaagtagaagtggtcatcatcattttccttctaatgacttaaaccaagtcatttgctgttgaaactttaacagcaaataaaactagcggtgtgtgtgtgtgtgtgtgtgtgtgtgtgtgtgtgtgtgtgtgtgtgtatagagagagagacagactggaatccgttttgtttttcctatctctaaagtgcatgaattaaaaagatactaaacatacatctttgagtttatcagttcatcaggaacacatttttgaaaaccagaaggactctggataagtacaacttgttttggttataagaaacataactagccaggcacggtggctcatgcctgtaatcccagcaatttgggaggctgaggcaggcagatcacgaggtcaggagttcaagaccagcctgggcagcatggtgaaaccctgtctctactaaaaatacaaaaattagcctggcatggtggcacgtgcctgtaatcccagctactcaggaggctgaggcaggagaattgcttgaacctgggaggcggaggttgcagtgagccgagatcaccccactgcactccagcctcggcaacagagcgagactccatctcaaaaaaaaaaaagaaaagaaacataactaaaagtcatatatcttgttggcagtgaatcagtagaatcatgtcaacatataaaggactattttttactgtcatttttcagcacaagttttttttttgttttttttttgtttttttgtttgtttttattgatcattcttgggtgtttctcgtatagggggatttggcagggtcataggacaatagtggagggaaggtcagcagataaacaagtgaacaaaagtctctggttttcctaggcaaaggaccctgtggcctaccgcagtgtttgtgtccctgggtacttgagattagggagtggtgatgactcttaacgagcatgctgccttcaagcatctgtttaacaaagcccatcttgcaccgcccttaatccaattaaccctgagtggacacagcacatgtttcagagagcaccgggttgggggtaaggtcatagatcaacagcatcccaaggcagaagaatctttcttagtacagaacaaaatggagtctcccatgtccacttctttctacacagacacagcaacaatctgatttctctatcttttccccacatttcccccttttctactcgacaaaactgccatcgtcatcatggcccgttctcaatgagctgctgggtacacctcccagacggggtggcggccgggcagaggggctcctcacttcccagaaggggcggccgggcagaggtgccccccccacctcccagacggggcggctggccgggcaggggctgcccccccaacctccctcccgggaggggcggctggcccggcgggggctgtccccccgcccacctccctcctgggtggggcagctggccgggcgggggctgccccccccacctccctcctgggtggggcggctggccaggcgggggctgcccccccttcacctcccagacggggcggctgccgggcggagacgctcctcacttcccagatggggcggctgccgggcggaggggctcctcacttctcagacggggcggctgccgggcggaggggctcctcacttctcagacggggcggctgccgggcagaggggctcctcacttctcagacggggcggccgggcggaggggctcctcacctcccaaacggggttgcggccggacagaggcgctcctcacatcccagacggggcggcggggcagaggcactccccacatctcagacgatgggcggccgggcagagacgctcctcacttcctagacgggatggcggccgggaagaggcgctcctcacttcccagactgggcagccgggcagaggggctcctcacatctcagatgatgggcggccaggcagagacgctccttgcttcccagactgggtggcggccgggcagaggctgcaatctccgcactttgggaggccaaggcaggcggctgggaggtggaggttgtagctagccgagatcacgccactgcactcagcctgggcaacattgagcactgagtgaacgagactccgtctgcaatcccggcacctcgggaggccgaggctggcagatcactcgcggttaagagctggagaccagcccggccaacacagcgaaaccccgtctccaccaaaaaaatacgaaaaccagtcaggcgtggcggcgcgtgcctgcagtcgcaggcactcggcaggctgaggcaggagaatcaggcagggaggttgcagtgagccgagatggcagcagtacagtccagcttcggctcggcatctgagggagaccgtggggagagggacagggacagggacagggagagggagagggagaacaagtttttaaaataacttttttttaatttttattttatttgagttcattcctaaaactatatgtggtagtaaatttgtaaacaaagtcaggacttattttgctaagtcaccgcagtgagttccttacataaataaggaagacacctgtttattagtcacaaagttccaaccacatcttgttttgcacttctaagagatggaatacccccaatgagtttcctttgctaagcacagagaaggaaacaatgctgatttctagactttatagctaagcaacatttatgctttcagaaatgacctcagaatcctcctcaacacagcattctaggcagcatttatcaattgctttgagttgtaatgcaagccgaaacatacttatctcctccagagtttaccacttaaatggctcatcatgaatgagaattgcctttagtcatgactcagtgtgacattaagtagtttggacataaattatttggaatatgatagatagcctttatatgagaattgtacctgatatatataaattttgctagctgcattccatagaataagagaataaggtgactagatcttcaaggtactgaagttagaaaaactgattgaaatgaaactgtaagaaatgcctaagtggtacaatctatgatcatctagaactgtttctgctagtcaatgttagatactttatcatgtgattaactgaaaatgttctttaaaaaatgccacaactaaagaggcatgtggggctgggagcggtggctcacacctgtaatcccagcactttgggaggccaaggtaggtggatcacctgaggtcaggagtttgagaccagtctggccaacatggggataaccccgtctcttctaaaaattcaaaaagtagccaggcatggtggcgtggacctctaatcccagctacttgggaggctgaggcaggagaattacttgaacccaggaggcggaggtggtagtgagcagagattgcgccactacactccagcctgggcgacagagtgaaacactgtcgcaaaaaaagaaaaaattaaaaataaaaaaaaagacactgcaacggggtgcctttcaaatattagctgaaatgctagaggaatatatcagaggagagaaagctcacccctagaagaaaatgttaggtatggcttcatagagaaggttgcattaatttcaggccttgaaagatgggtaagatggtaggcagaaactggaacagggtccacattccagctgtacagactgtatagagtttcttgagccaggataatgaatctcaaggtatgttccctgaagacctagctgagttaagagtacctggtaagtccagctaaatcctctcccaacaccccttcctactggatttgggagctatccttatgcctcccattcttaccctgttcctcaatctgaatgttgattgtcagggaacttcagtataatccacgctattacttagcccaagtgggaatagtttgtagaaatgactatagccggttgaacatttccattccaaaaatatggattaagggccatgtttctttattgttagcattctcgctctgttgccaggctggagtgcaggggcgcgatctcggctcactgtaacctctgagtccctggttcaagcgattttcctgcctaagcctccggagtagctgggattacaggcacgcgccaccacgcctagttaatttttgtatttttagtagagacagggtttcaccatgttggctagggtggtctcaatctcttgacctcgtgatccgcgtgcctcggcctcccaaagtgctgggactacaggcgtgagccaccacgcccaatcaagaagagctttttaactagagattttaaaacaaatagactttaatttttagagaagttttacatttacagaaaacatgagcacatagtacagagttcttatatcccttctctacctttcagtttccctattattaatatcttgcattagtatggtacttctgttgcagttgatgaacaaatattgatatgttaacaaaagactatagtttatatttgggttcactctatatgttatacatatatgggttttgacaaatgtatgtcatgtatccaccattatagcattatacagaatagtttactgccctaaaaatcccctatgctctaccttttaatccctccttccctccccctaacccctggcaaccactgacctttttgatgtctccataattttgccttcttcaaaatgtcatacaagttggaattctgtaaaagaagattgccttcttttacttagcaatatgcatttaaggctcttccatgtcattttgaggcttgatggttcattgcttgttattgcttaataatattccgttatctggatgcctagaaacagccatgtatttttgaaaatagctccaagacatgtttctatttggctttgcctctggcacaggttgcagcatatcagtgtagtacaatacactgttataagaatcacagacactgagataaggaagggtctgcaccactggttcttccaacagcatgtgtgtagaaggatgcgagacaggcaggctttcaggcacctgaaggacatgtctgtggtttgcagcttactgcgtgcctttaacaaagcagttcacctctctagactttggtttcttcatcttgcaaacaaagggatgtgctagatgagttctgaagtttctctgaattctgaaatttgatcatctgctctcatctccttgtttaaaagttgagaaaagaaagcctggggaaattaactgatctgaataagaggaaatagcaaattattagcattacttggactagaaatctagtctctagatttggtctagcattttttctatcatttcaacctttatgtcctgatttttcatgtaagaacttatttttcttaagaactcctgattaaactaaattgattttttaaaaaaagaaacatagattgaaagtcactgaaatttttttttgagacttttttttttttttttgagtcttgctctgtcacccacgctggagtgcagtggcgcaatctcggctcactgcaacctccacctcccgagagtggggcgattcttctgcctcagcctcctgagtagctgggattacaggtgcccaccaccatacctggctaatttttgtatttttggtagagacgggatttcaccatgttggccaggctggtcttgaactcttgacttcaagtgatccaccagccttgacctcccaaaacatgaatctttttttttttaatttgagctttgactgcatagaaaatgtccatccagtctctgtttctaaaacatgaaattctttaacgttcttaaggcaaacaatttttgtaaaacttttcaccactgatggggttgctcccccttaccacaccagatttaagaggatagtgaatatttatgtctataatagcatgtgaagaatgtggctggtgaaaataagtggaagaatatacatctcgggctgtttcttcagtttccgggcaggctgcaacacttttaacactgctagtgagaagaaaggtgagagagttagctttcctcttggcttggttgcagttaaagtggattcccgaatctcccattttctacattataaatattgagagggacataaatatagatatatggatatgtttgtttgtttttctccctcctgtacttaacaagtgtaaaatcctggaattttctttttccttacttatcacaagttttcttagtctcaatcctttgtagtatttaaccttttagataggagaggtaaataagcccacaccagataagagttacatcacagtagctataattaaggaccggcatggagacatttttaataatagacttgcagccgggcgcggtggctcacgcctgtaatcctagcactttgggaggccgaggtgggtggatcacgaggtcaggagatagagagcatcctggctaacacggtgaaacctcgtctctactaaaaatacaaaaaaaaaattagcccaccgtggtggcgggtgcctgtggtcccaactactcgggaagctgaggcagaagaacgaacccgggaagtggagcttgcagtgagccgagatcgtgccactgcactccagcctgggagacagcgagtctccgtctcaaaataataataataataatgaaataatagacttgctaaatctgaggttaaagtgaacatttttaataatcagtcaaggttaaaatatttgtttaatatggtagtcaatgaaaaaatgttctaaatgaaaacctggtactaaaattattatgtcttcaggttgcctagagaagctggtgaggcactagatattacactgtttctcctctttggaatcatatagttttgatttaattaacagagaaagtctgcatatacaataggggatagagtgtggattttacttctttaatggtttgacaagcagattgcaacaaacaaggtatttggaagcctgctagggtcccagaggccttataaatatgcagtgcacttctctgcatttccccgggtccctgaggtagagatttgatgaataaaattaaaaccaccagatctttttgtatagcttttagctatcactaatttaaactgagtaatgactattttacaggtataccttcagcagtttaaaaagcaaaggaagtgaaatgtgaatgtgttttgactttgtattaatttcctcttaaactgaaagattttctactttttgcatcatgatacgttttctttaaacctaatttcaagagtaaaactctttacgcccctgtaggattgttttatatttaatagtgctattgagactggcatgggacaaaacatgcagacaaagaaagtatttcttgaaaagtgatgtgtatttatatataaacacaacgttggaatagcatactccatttggaacaaggtctttagaattagattttaatagattaaaactcttcttatttactgtatttgtagctcttaatgattgaatagatctctgtggttccttttcaaggatttcttgaaacatactgaaattcatgggtagatcatttaaggctcctgcgccctttaatatattacctagaaatggtagaatattttagaacacatacaaagaaggaggccgggcgcagtggctcacacctgtaatcccagcactttgggaggccgaggtgggtggatcacgaggtcaggagatcgagaccatcctggctaacatggtgaaatcccgtctctactaaaaatacaaaaaattagccgggcgtggcaacggccgcctgtagtcccagctactcgggaggctgaggcaggagaatcgcttgaacccaggaggcggaggttgcagtgagccaagaccgcaccactgcactccagcctgggcaacaaagtgagactccgtctcaaaaaaaaaaaaaacacatacgcaaaaggttaaggtaaaacacaattcattgtatatacatttgcaacaaagttcattaaagtctggggaaaaattgtataatgtaaagctccttagcttgatgtataatgaaaaaatgtagatattacgttaataataaatagcgtgaataatattggcactgggtatacacttactgaaaaggctgggcttttctaatgttaatcctgaggaagaggagagtctcttgcttaaaagtcaacactggtatgttgctttcaagaaaaaaagaaaaaaaaagcattgatgagggtatgaaatttatttactaagtattcagttgtgaagtttgaggagtggaaaaactaatttgtcaaattataccctcagagttcaacagtaaactagatgaagtctcccaggcttataactagcagaaggcacctatgttttgtctttgtgtgcctatggcttcacagcggcaactgaatctcacccagaagtgctaagttgtaattcccagtagccacttttagtgctttttgttttgcgttgttttgttttgtttgagacggagtttcgcactgtcgcttgggctggagtgcagtggcgcgaaattggctcactgcaacctcggctcactgcaacctccgccacccaggttcaagcgattctcctgcctcagcctcccgagtagctgggattacaggcacctgccaccacgcccagctaattttttgtatttttcatagagatggggttttaccatgttggccaggctggtctcgaacccctgacctcatgattcgcctgccttggcctcccaaagtgctgggattacaggcatgagccaccatgcctggcctttagtgcattttttaaagaatgtatccaaataacagacaattgaattaagaaaagcacattgtcatctttaatcctttccatttatttgcctcttgatagatgacctttatatttttgctttttgacaatttctacctgaggcatgatgtaactaaaatttctaacatgatagtggtagttctctggattaatttatgctcatggttttgctttgtttctcccttaccaaaatgctcttttcagtattacacaagaaaaagatcatgatttgcatcatgatgtacatagcaaatttcatgtatgatcgtgtttcctgttccatcacatttctggcattttttttaacccactgggacattaggatgtcataacataattggatgttagacataggttgagaaatcaagggtagtggtagatggaggctgacagacaccttccagatccactttagaggtactgagtattcctaaaccagttatgtaatttgcatgtggtcatatagctagttggtggccaaatcagggatacaacatgtatgtgagtatcattctatcatctatctatctacttattgacagataagaatatacttgctttgtgtaaatgattaccctttgattttgtggttgtcacaaacacatgaaactattcatggatggacctacctgtctgatgatggtggtagtgatgatgatgatgatgttatcctaggatataaccactattctttaacccttgaaactgaggtgcataaggtacaataattcgcccaagctcacatagataacaagtttgcagggctagaaatcttactgagtttcatctgaaatgcagactttcagagagagagagagaggatgcttagtgtgccatatcttacgtctaacaatggctaatgaatctttaaagagaggactactccctagacatgagcgtgttaggactctgttcccatttctacacatttatgcttatatgagggccattgattggccaattttagcatttctttgtactcgtgggatgatatttaaaatatttaacaactgccaggcacggtggctcacgcctgtaatcccagcactttgggaggccaaggcgggcggaacacctgaggtcgggagtttgagaccagcctgaccaacatggagaaaccctgtctctactaaaaatacaaaattagccagatgtggtggcccatgcctgtaattccagctactcggaaggctgaggcaggagaatcacttgaacctgggaggtggaggttgcagtgagtcgagatcgcaccattgcactccagcctgggctacaagagtgaaactccatctcaaaaaaaataataaaataaaataaaatatttaacaactaatatgtcatgagcattgaccaatcaaaatagatgcaatcgtaggctgaactggagtctaagaggcccttgctttgccaggtaccttttagctaacaggtcacgagtatgtctggggagttctgggatgaggggctagtgcagctaggacagaagttatttaccaacttgtatgaaaatatttttttagtattttaataaccaatgcagctatcctaatgtaatctgactaaatattagcacagcatcttgcccagcaagccaagacaacagtggttgttgtgatgttcataaggacatctcttcttggtgtttatgcatgcaatacatgagagttacaagattcctgggctaggcacagtggcccatgcctgtaatcccagcactttgggaggctgaggtgggtggatcacctgaggtcggaagttcgagaccagcctgaccaacatggagaaaccctgtctttactaaaattacaaaattagccgagcatagtggtgcatgcctgtaatcccagctactcgggaggctaaggtaagagaatcgcttgaacccgggaggcggaggttgtggtgagccgagatcgcgccattgtacttcagcgtgggcaacaagactaaagctccgtctcaaaaaaaaaaaaaaaacaaagagttacaagattcccgataagtgaatgaacatgttattgagtcatggtgcaaaggcaaactatatgcatcaggcacatttttttctctcgccagcctcccaggaagttctcaaattgtgaatatttggagttagagagagagagagaatgcttagtgtgccatatcttacttgtgtatctatctcttttctaagctatgaatacctagaaggcaagggctataacctcatttctatcccagtcccctagcacagtatgtggcacagagcactcaatagttattgaacaaataaaagcattcaaccccactgatgaaaagccattctatttgtaatctagagacataaattaaagatatcagtttcctaatcttgcagaagtcattaacctagctgcaagattacttctttataaaacaatgaaaaacagtacagtgtcaccattacaccaagtgtgaggccaactggaaaatgtttataacaatcagatttgcaatgaaagaaacctggaagcaaacccagttatttgaatgaattattccccttccacctttcttgtattttatgcataatgacatgaacctttcaaattcagctttctagaatgcctgtaagattcagttatggggccgggcgcggtggctcatgcctgtaatcccagcactttgggaggctgaggcgggtggatcatgaggtcaggagttcaagaccagcctgaccaacatggtgaaaccccgtctctactaaaaatacaaaaaaaaaaaaaaaaaaaaaaaagattcagttatggtcaggctggcagtctgtataattgtttcaaatgctatgttgcatctttttgcaatagtacatcaatatgtcaggatggatactacaaacttggttattgctataatcctgaacttttaacctatatgtaggatgagcataacccgtagactaggatcaatacacaattgtgtctcctgttactttttttttttgaaacggagtctcactctgttgcccaggctggagtgcagtggcagtgatcttggctcactgcaacctccgcttcctgggttcaagtggttctcccacctcggcctcccgagtagctgggactacaggtgtgtgccaccatgcccagctaatttttgtatttttagtagagacgaggttttaccatgttggccaggctggtctcaaactcctgaccttaagtgatctgcctgccttggcctcccaaagtgctgggattacaggcgtgagccactgtgcccagcctcctgttacttctttaatatttattttgtggggattaccttgtcctacacctagatgaaaatctaggccgtttccatgacttttctgcttgcttttaggtctctaaagtttctgtgagttgctaatacaatctcagcccagaaactttttttttttttttttgagatggagtctggttctgtcgcccaggctggagtgcagtggtgcgatctcggctcactgcaacttctgcctcccgggttcaagcaattctcccgcctcagcctcccaagtaggattacaggtgggattacaggcacacaccaccatgcccagttaatttttgtatttttttagtagatacggggttttaccatgttggccacgctggtctcaaacttctgaccttgtgatctgcccgcctcagcctcccaaagtgctgggattacaggcatgagccaccgcgcctggcccagaaactattaatagaatgctaccctctagcatgctagcaatagtagcaatctaaactctcgggttttaagttaaaagtaaactgttttctgcttccaagctgggctgttgcaatgctagagggggcaaggtacttttctgctttgagaccctcctctgcaattcccttaatgtgggtaatatatttccttcagcttgccacttgcatgttgtcccagtcttctcagagctccatgccacacatattttaacaaggattctctggcggagtacgcctgaactcccagatgttcctcttggataggactgaaatacgggcacctctcactcccacgtggctcacttctagtccatggaaaacactcatgcaggtctttgccctgaaaaactctgagactacagagatcgaatcctgtctgtataccactggcatggggcaccttggcctcttcaggaatgacccagatacccctcttctgggtcccgcaacttcaaggaacacattccttttctgaatagcctgatcaatgtcccttcacttcgctcaacttgaagaatgtagcatctctgtccacatacttggcagtggggtaaggagcaagatggagcaggtgttatcatggcaacaacttcttccaaagaatgtctttcaaaatcctcttttcctccactacatttaccctttcatatttgtgaaatggatgagcaagcttccaacaaagggaatatgagaattataaaaatgattttaagaattttttggagcctggacaacatggtgaaaccccgtctctactaaaaggacaaaaattagctgggtgtggccatgcgtgcctgtaatcccggctatttattctctggcataaaaatcacttgaacctggaggcagaggttgcagtgagccaagatcatgccaccgaactccagcctgggcaacagagtgaaactccgtcgggaaaaaaaaaaaaatttgttttggggaaaattctgcatatggaaatctgtcttatacacacttttctatgtactgtttagctgatacacgtttttctatctactgtttatctgatattgccaatcactgaaaaatgcgaagagtcaaattttaatatctagttacacacaggtatgcttttgttttgttttatacctggaatgctttatatatcagtaggctatataaaattgtcaaaggcatttatgtactttgtagtgattttaggtatgggtgttgggtgctttcatttgtcaccacaaacaaacatattaccacagagtttagatgacacagtattagagtatggaatcaagctcttgtcttttgaagttgatgttgtgacctgtgtaaaaagaagttttaaaagtcaattatttaaaaaaaaaaaaaaaaagtaaagaaaagaaagaaaccagcctggccaacttggtgaaccctgtctctactgaaaataccaaaattggccgggcctagtatgcacctttaatcccagctactcgggaggctgaggcaggagaatcacttgaacccaggaggcagaggttgcagtgagccaagatcgcaccactgcaccccagcctgggtaacagagtgagactctgtctcaaaaaaaaaaaaaaaaaaaaaaaaaaaattaatgccttcacaaagacaaatatcttgtttatggtgaggaagacttaaaagcaaatctggattttctgtttgactgaaagagtctagatacaggattttagaacgatggtgattttggagtattatctgtgcagcaaaggaggaaaaacaaaacacatacaaatgaaaagtgcttctagatgatgctgagggcttggctgaggttggtgagtataaattagtattgttgctactttataattctgtgatttccttcagtatcctgcagtcaccctagtataacagcagagatagtacttgaagtatttggtccagagttagagctttacttggcagacgtggaagcagtaaggttaaaggaaattgacagggctagtaattatataatttaaatgatgaactgtggggccatgctaaattgtgaaggaagggaggccaggaatcaactaatagatggcttaaatgaaaagatttctgcaggccggtcgcagtggctcacacctgtaatcctagcactttgggaggccaaggtgggtggatcacgaggtcaggagttcgagaacagcctggccaacatggtgaaccccatctctactaaaagtacaaaaattagctgggtgtggtggcacatgcctatagtctcagctacttgggaggctgaggcaggagaatcgcttgaacctgggaggcacaggttgcagtgagctgagatcacaccattgcactccagcctgggtgacagcgcgagactctgtctcaaaaaaaaaaaaaaaaacaccgattcactctaagagcactttctcataaccttggaaagccagccaattagaactggttaagctcctcatttgtcctccttgattacctagctccctcatgaacttaacgtgtcatatatttcaggtgccccattttaaattttattgtgagcaacattccttctcttgtaacaactttattttcttagttaactaatgttttaatattgatgaattcttcccgtgtattttctaaactcaccaatttgtttttgtccagggtgttgctgcttctatggttattttgaaggtgctttttgctcaaatgagttatggactctatcaaccaaatacgggatttttgagacagaaatctgacattcagcaagggtacagaaatcttgctctctaaattgatgttaaaacataacatgtccataattaatgtattataacatttgtctataatcttcccaggtgttgaaatggtagtttcatactgcttgcctttcaacatatatggacattgtttaatccattcagaaattcagaaatattcaagataaatcacaaatacaaaacatgctgtaatgccactaatcttttctattagatttgctttaaatggtgtcatgtttatgtcttcatttacattgtccatttaataggcttccccagcagtcctgctctggtaattagctggcttatttatacctcaacaccttgagctgctacatctcatttaacttactgctctttaaagttcttgtatctcagtggttctcaaccctcaatacacattagaatcatctggggaacttttaaaaaatactgatgcctggacaccatcccagatcaattaaatcagaatctgaaagttgtagctctgagaaccatgggttcctaacctttgaccaatgccactgcaaacactgtgcttaaggtgaggttgaagcagtaaaaacaacaatccaatttttttttttttttggtttgttttttgacccagggtcttgctctgtcgcccaggctgtagtgcagtggtgtaatttctgctcactgtaacctctgcctcctgggttcaagcgattctcctgcctcagcctcccgagtagctgggactacacgcgtgtgccagcacacctggctaacttttggcatttttagtagagacagctttttgccatgttggccaggccagcctcaagtgagctgtctgccttggcctcccaaagtgctgggattacaggcatgagccaccgcatccagccagcaatccactgcttgacctcatcccttccactcttattttccttcccttggcagtaatttaaatatatatatatatatatatataattagatatcatcacattcatgggttatcaaaacttagtatttctccaccaaccctaaaatgccattggaaaatgcaatagaattctggaagtaagattgtatttgaaaattataaaagagatccatttgctttgctttcattttattgtaatgcaaagagaaacagagcaaggagactatcagcaaagacaaaggagattgaaagagcataagacatttaggaagctaaaggttgtttagcataattgagccttagaatagtttccaagggaacagggcgggcaaagctggagaggtaagcatgatccacattctgagggactttggatctcatttcaaggggtttcatcatgactggttacataacttgtgtggccacaaaaagtatgtagccagtacaatatgaaaatgtggggcccttgttaaaaatcattgagaatttcaagatgtcagcataagagtattaaaccatgcacagggctcttctaaacattggcctgtgtgtgactgcacaggacttatgcccaggaagttggccctgggtttaattatatcctgagggtgatgtgggacctaaaagatttaggcagtgacttgaggtcattgtaaagattgttctgaccttggttggaaaatggattgttggacccagagaacaaggttctacaatggctttaagaaagctagtgtatctgtcttggccgggctggtcacgcctgtaatcccaacacactgggaggccgaggcaggtgtatcacttgaggttgggagcttgagaccagcctggccaacgtggtgaaaccctgtctctactaaaatacaaaaaaagaaaaaaattagccaggagtggtggcaggtgcctgtaatcccagctactgtagaggctgagacaggagaattgcttgaacccttgaacccggcaggcagaggttgcagtgagccaagaccatgccactgactccagcctgggtaacagagccaggctctgtcaaaaaaaaaacaaaaaagctgggtgctgtggctcatgcctgtaatcccagccctttgggaggccgaggcgggcagatcacctgaggtcaggagtttgagaccagcctggccaacatggtgaaaccccgtctctactaaaaaatacaaaaaaattatccaggcatgttggcacgtgcccataatcccagctacttggtggctgaggcaggagaattgcttgaacctgggaggtagaggagacagaggttgtggtgagccgagatcgcaccactgcattccagcctgggcaacaagagcaaaaactctgtctcaaaaaaataaaaataaattttaaaaagctagtgtgtctatctccatattttttctgtgaattttaactattgtgatggtaatattagtgataggaccaggaatagcttctactaatacaacaagtaaacaaagtaaacacttttttttttttgagacagagtctcactctgttgccaggctggagtgcagtggcgcgttctgggctcactgcaacctccgcctcctggtttcaagcgattctcccacctcagcctcccaagtagctgagattacaggcacccgccacatctcccggctaatttttgtttttgtattttagtagagatggggtttcaccatgttggtcaggctggtctcgaacgcatgacctcaggtgattcccccacctcagcctcccaaagtgctggaattacaggcatgagccaccgggcccagcaagtaaacactttcatatacaatactgtcatttgatccttcaactatctggttgtcaggcaaggcatatgttattatccttagtttacagataaggaaacagttaagtcacttgccaaaaattacatgactagtgattgatgtatacaggatttgaatcagcccttctgacatttacactactgatatttctgctctattaatactgctagttttattagctacttatagaagcaattttttttttttttttttgagacagagtcttgctctgtcacccaggctggagtgcagtggatcctcctgcctcagcctcctgaataggtgggaccacaggtgcatgacaccacaccaggctaattttttaatctttatttttgtagaaacagggtcttgccatgttgcccaggctggtctagaactcctgggctcaagcagtcctcctgtgtcaccctcctaatatagaagcaatttttaaaacatccatttgtacagtatttagtagattttattaaattgtaactgaagttattgtctactgtgttttcaaagcctctcattacagagatccacatgatgaaatttgtactaccagaaagatctttatgtagaaagatgtctgttttcttttaatcagatgttaaaaattatgttacatgcatcactcttttagcctagctgccagagaacctatgtgccaatttaatacccaatttttttttttttttttgagacggagtctcactctgtcaccaggctggagtgcagtggggcgatcttggctcactgcaacctccgcctcctgggttcaagcgattcccctgcctcagcctcccgagtagctgggactacagggatgtgccaccatgcccggctaatttttaatatccaatttttaaaactagctcatacagctcctcaactcactcaagagcatgtctactattgttatcgttgataatgctattttcacattatatttaactttcttatattaaatgttataagttgcttcaaatatatttggaagcggtcaggatataaattcttaataaactaaataatagccatttggaaatttatgcaaaagaaaaaagcagtgtttaaatggctgagcaatagtataacagacttacccactcaagcttattaaagccagaattaactgacaagtcagataagcattccctaattaaatgaaagaggagaatgaataataacatgaaagtgaaaaaggatgtgtgagcctacaaaagacttaggccaacaaatctactcttagagattttctaatgtcactataaattctagtacctctgtgtcctactcaatatctctcgtgtttttatcgtcttccatgcttaggtcttgtttttattttaggcctgtctttgttgatatttctttcttttttttttttttttttttttttttgagacggagtctagctctgtcgccagtctggagtgcagtggcacaatatcttggctcactgcaacctccgcctcccaggttcaggccattctcctgcctcagcctcccgagtagctgggattacaggcatgcaccaccaggcccagctaatttttgtatttttagtggagacggggtttcaccatgttggccaggatggtctctgtctcctgacctcgtaatctgcccaccttggcctcccaaagtgttgggattacaggcgtgagccactgcccccggtctttgttgacatttctttattattattttgtgtatgtcatgactagggatttagatatttgaaggccttgtcttttataatagatataacaagtaaatttaggaactttatattttataaatagttgattatttttatagactcactatgtttagattgttttaggtgtttatttctttttgtaatttaagcacttagacttagttacactccagggaaaaacaacattcttttaatagtcttggtttcacattttcttgattctcttgtctatctttgtttgttcctaatttgtacataaatagtgattaaagttcagagtggctactgcaaaagataatgtttgaatttcaaaacttaccttatttcttttatgatattaatatgttcgaagtatcaagtaaaattttagcatttgagaccatgtggaatataagcttctatgtataggggagatcttataaaaacagcttgaaggaaggtgttcagcagaatttattggctggattgaatatctagtccaccattcacccctatatttgaatggattccttgccttcttatcctgggtaggttcgtagtttatcttgtcacatgccagccgttgttgtccaccctggacttcgcctcttaagtaatagacagcccctgactttcacccataaattatctgatggtgactggtttgcctccttggttttctttcactgcccagtgccagcctatctaagcaagatctctataaagataacatccttatttattaggactggaaagtaatttagaaacattccagttcgttggtcttaatttatggatgagaaaactgagacccagaaagaggaagtgacttacatctgtattgaataacattttgtaacatattggaatccaaacatgcagattatttctatagcactttgtctagtttttttaagaaattatatttctctttgagttattcaagttatatttgtgcatattagttacaggaggcagattagtctttcttactttatttcacacagatgattataggaatgtagagcatccacaagaaaaaaatcaatagcacttaatataacaatttagatatatcatactctattgaactttgaagctatttgttatacactatcatcatcatatttttttctcttaaacatatgtaggtcataaaattgaattgtaaaattgcgagtaatttttataatttagcaaatattcaactaatatttacggagttccaggtatgtgacattacatttgtgttttctttacgccatcactacttgatcttgcttttgtgtacgaaacacttcatctgcttttataattttcctctattttaccttctttcttcatttcccttggctgtcttcactagtcccaaaactttaatcaacgctttaacatgcaggactattagctttatgtctcccttttttgctcactctttgacacaccagccctaatcttctaaccattaactccatgtttctacctagatatagatccttaacccccgaactcagtatatttactaataaactcattcatcttcctctggaatctatttcttttaatgttaccatcactttccttagttatacaggtttatcactggtggttttcttgataccactctctcttgcctcccacatccattcaataattatcatttttaccatttgtttagcatttaccatgagcttttggaattcaaatattatcttttgcagtagccactttgaacttttgtcactattcacgtatgaattaggaacaaacaaaggtagacaagagaatcatgaaaatgtgaaaccaatactattaaaacaatgttgcttttccctggagtgtaattaagtctaagtgcttaaattacgacaatgaaataaacacctaaaacaatctaaacatagtgattctataaaaataatcaaatatgtgccaggcctttaacatttcatcctcagaactatcctatgagttaggagttactatggtctccattttacagttggatcaactgaggcacagagaaattagggaccttcctaaattcagaagactagtaaacagaagagttaagattcaaatctacacaatctgactctatagttaaggctcttaatcactgcattcagttgcttgctaaattaatacatgctgtattttcttcttttttttttttttgagatggagtttcacttttgtcgcctatgctggagtgcaatggcctaatctcagctcactgcaacctccgcctctcaggttcaagctattctcctgcctcagcctcctgagtagctgggattacaggcgtgcaccaccatgcccagctaatttttgtatttttagtagagacagggcttcaccacgttggccaggctggtctcgaactcctaacttcaggtcatctgcccacttcaacctcccagagtgctgggattacagggttgagccaccatacgcagccatattttcttcttttacaatgtatttgttcccatctagtcactttctattattaccttggcacaagctctcattacttcttgccagaactattgcagtagtagtctagccagttcccccgtctctacctccctccagtccatttcatatactttcctgagataaatctttcccaagcatggctaggtgtatttagctgtccttagcctagagaaaaatggagtggctccaaactaattaggcccttgaataatataggaattttccctactacccttcatttatcttgtgatctaagcaaacttaattacttcctgaaacaccattctctttatgtattaatttatctatgcctgaagttgtcagctttatgttcttatttatgtatattattttataattatccatattatacattatcctgtgtacatgtatctctgggacatatagctattgtatatgtgtattgcttgttttccctctgagatctttaaattctctcacatgtaagcatatgttgttgatgtattctgaaaatgttttttatgtgtcattggcgtgattgtgattttacaccataatttcccaatgtttatgtaaacattataggaactctgtatttgaatatgaaactctttatgccattagggcatttgccccatctataccttttctggttcctattttaaccagggacatgaatttgtagcctggccagctatagttataggtattggctacagaacttttttttttttttttttgagacggagttttgctcttgttgcccaggctggagtgcagtggcatgatcgcggctcaccgcaacctctgcctttcgggttcaagcgattctcctgcctcaggctcccaagtagctgggattacaggcatgcgccaccacgcccggctaattttgtatttttagtagagatagggtttctccatgttggtcaggctggtctcgaactcccgacctcaggtgatctgcccacctcagcctcccaaagtgctgggattacaggtgtgagccaccaggcctggcctttttttttttttttttttttttttttttttttttaaacaaaactaactggctcttacaagaatcagactcatgaccttggcctcattagcactatgagctaaccaagtctgacatatagaaattacacaagcgacaactcataagagaaaccagaactgtaagatggccttttggaaataattttcttaaagagcatatccaaatggagaccttcatttagcagcttataacaaattcttgatcgcagagttgcttcattttaagagtgaaaaacaatataacaatagcagtagaaattgaaagcagggaagttttcctgacatattgttttctttcttgtataatgtagatttatttagaacaggggctctaaccacctgtcagtaatatgtttctgtcaattttcctgtagatttttattcatggaaatagcactggtggcaaacatgagctagtgagtgaaagtatcctacacaattccccaaacgcctctgccagtttattttagtgttaatttttagtgcactttttttttttttttttttcagtgtggttggagcaaaacagagattaagagaaaattgctatggttctactggtttggataaatgggacaggtgccaacaattaccactggtgtgacttttccccccaatataagcattactattatgactattttgtttcctccttttacaaaatgccaggtggaatttatagagttcttattgtgaaaactaagacctattcctgattcttttctgaatttcatgactttgggaatatcctttagtttatatactacagttaccccctccataatatggggataccatggtgttaagattgatgtaagaattaatgtgtttaccagtcagtcttctagccaaacaaaaataagacacatttgcacagctttagttgtcagagaggtctggagcaattgttacatcctatatatacttctgcttgtgattttgagggcttagggtatgttgcttcaatcatatttataactaatgctgtatttttttactatttctgattgctaccttaactaaattaattttttcctcataccctgatactaggcatttggaatttagtaagtagctgaaatttgaataaatagcaaaaacggtataagtttttcaggttttttttttttttttttgagctggctagaacagacacatggattgaacatgatatctgacattgttgataatataatgagtaatatcaaggaacggtgaaggaagtgttgtagtttctaattttttcaatatggaagtgaatctactctatgataagtgcaacacagcttatctaatgctacttaaattgaaaaaaaaatgagagttccatgataagatttaaaaagtcatgtttgcaaaactcatttgaatagtcagaagtatagaaagtcgtcattaggcagctcttcatatatttgttactaaatcatctatgcagttacagattttatatatgtgtttttttcacatttaccattaagggactcttagtcctttttttttttttttttttattgaaacggagtctcactgtgttacccaggctggggtgtagtggcgcgatcttggctcactgcaagctccgcctcccgggttcacgcctttctcctaccccagcctcccaagtagctgggactacaggtgtccaccaccacgcccagctaatttttttttgtattttttagtagagacggggtttcaccgtgtcagcctgaatcgtctcgatctactgacctcgtgatccgcccgcctccgcctcccaaagtgctgggattacaggcgtgagccaccgtgcccagcctcttagtccttttcttacctgtgtgagtttatcagtgctacacaaaccaggaagaatgttaatttgctggctgcctcccttgagctgtttaccacgtttttgaggcagaatagaaaaggaaaggaacttaattgagtgtaataaactttaaaaaatctttccaggccaattgagcagtcatttcattacttttaagacaagcagggaatgatctataaagagggaaaataagaggaactagctgtgaggactaaatgaaacaaagacataaagagtacagcatagtataaagcacatggtatcctctaaatagtaataataatggttattggtaaggccttgaactaaattatgcttgaactaaatatacccaaaaacataacaattcagatttaaaaatgatgaattgcccagtgacgtttaccatcaacccctatggataagatgtttcattttagagagtgcttggtagaaaatgctagatggaaaagtcagaggattctttgttacagactacatagcttgaaatttatcttgtaataatgcattaatggaaaaataggaagacctcaatcatagattcaacttttagcactgggtgcaatgtccctcatttttgagatactgcgagattcagatgatttgcccaaggtcataccatttgttagtgaccaaagaagatcttgaacctcagacatctgatataaagttattccagtgttctttttattttaacaacctgacatcaggatggatattataaaaatagcgccaaatgtcagtctaaagcaaaatatttttgtatttcaataaaaaaatgaaaattatacattggatgaaatgtatatgactaaagtaaacaggcttttgaaatttaaatcaaggctctttcatagaatctgcataataaatgccatttatagttaatttattctatatgtcatatatttaaaatgcattcaaaatcaaatatcaagactaaattgtactccagttgaaaatccatgacaattttctctttgtctaaatcctagctgatatttgtttattgcacccctttcttttagaataatagaagcttgagaactatgcttggtaatataacaagaaagcatgattatagatataaatgatgtaacaagaattctattcccagttgtgcgttgtaagactgacaaacattggattaatgttgaataggtcatttgcaattctatgctgtttgtagagaaatcatattttgctattcttaggaacttacatatgagtttgttttggaggttttctgaaacatgaaagacataaaaaagacagacttttcctgtagcaattcatggaatacgttgtacattgttcttcctaaactacgtaactctctatgtgaataagacatcatatcctacaagccttacaaactttgactgtccctggacctcttgtgagaataaattaaagatgtcatgtctcatatattttgttatcagtgaggaaaaagaaataacattttctttttcatattttggtagagagtgcatatgattgatagtgaaatacatgcctatagtaactatttgtagttatatatagatggaacaattcagtgacgctttccaactttatcaggacctaagacttttacctttccaagtccaaagtgactaactgtaactctactagtaatttttttaaaaagcttatttaaaaaaaaaaaaaaaaacaagaagaatgtctccggccgggcgcggtggctcacgcctgtaatcccagcactttgggaggccgaggcgggcggatcacaaggtcaggagattgagaccatcctggctaacacggtgaaaccccgtctctactaaaaatacaaaaaattagccgggcatggtggcgggcgcctgtagtcccagctacttgggaggctgaggcaggagaatggcgtgaacccgggaggcggaggttgctgtgagccgagatcacgccactgcactccagcctgggccacagagcaagactccgtcttaaaaaaaaaaaaaaaaaaaaaaaaaaaaaaaaaagaagaagaagaatgtctccatagttattcataacaattgtgaaaatttaagtaattggccgggcgcagtggctcacgcctgtaatcccagcactttgggaggccgaggtgggcggattacaaagtcaggagatcgacatcgcgccactgcactccagcgtaggccacagagcgagactccgtctcaaaaaaaaaaaaaaaaaaaaagaaaatttaagtaattggatgagttgttttcgtataaattggatgtatacgtttgatgtcctcattgtgttcagcaagctaagatgtatatgtacagttaaacatgagtcatgccctctatgatgagtttaaacatttaaaccaaatatttgttacatatgatacattaagtacaaatgttttttatctatggtaccttaatttatataacatatcttaggttataaactgtttgtttataacaacaaataaagcgaagtattcaaaatggcttgtagcaaggtgctgagacatgtgaaggagtgccagattgttcttgataatttacttcccacctctgactcacttttacatggtcagctttcagagaataagcacaaagatgttagcaaaattaagggcactttaaagtttttgttgagatgtttttaagtcttaaacaaaatttcaaatccagagatttgtgggaccaaaatgatgaattaaaagagaaggattcagtgtattttctgaaaaattattcattacctatagctgatacgaccagtgccagccatgaattacctagtccccatgcattgacagctgatttacattcttgcgccagctccttatctcatagtagatcaggcgtttgagtagcatagcattagcttatctgtttttttaagatcaatagaactcaacaaaggacgatagaactgtataccccagtcaataagttagacacttattaaaccttttataaaagtattggatatggccgagcacagtggctcacgcctgtaatcccagcactttgggaggccgaggcgggcagatcacaaggtcaagagatcgagaacatcctggtcaacatggtgaaaccccatctctactaaaaatacaaaaattagctaggcatggtggtgcgtgcctgtagtcccagctattcaggaggttgaagcaggagaatcacttgaacccgggaggcagaggttgcagtgagctgagatcgcaccactgcactccagcctgacgatagagcaagactccatctcaaaaaaaaaaaaaaaaaaaaaagtattggacactcagccaggcatggtggctcacacctgtaatcccagcactttgggaggccgaggtgggcggatcacctgagggcaggagctcaagaccaacctggccaatatggtgaaaccctgtctctacttaaaaatacaaaaaattagccgggtgtggtggtgcatgcctgtaatcctagctacccaggaggctgaggcaggagaattgcttgaacttgggaggcagaggttgcagtgagatgagactgtgccattgcactccagcctgggcagcaagagcaaaactctatctccaaaaaataaaaattaaaaaataaaataaaataaaatagtattggacactcatcctctgaggaggcagtgtaactgggtgagaaaaaactctcttatatatcctttaggtacagctctgatttctgatgataagcttgctataaaacaatctattaaaaatgattctggctgggcatggtggctcatgtcccaaagtcatcccagcactttgggagactgaggcaggcagatcatctgaggtcaggagttcaagaccagcctggccaacatggtgaaacccgtctctaccaaaaatacaaaaattagccgggcgcggtgtcgtgcgcctatagtcacagctacttgggtggctgaggcatgagaatcgcttgaacccaggaggcggaggttgcagtgagccgagatcgcgccactgcactccagcctaggggatagagtgagactctgtctccaaaacaaaagatatctcctataccttgcataagcaaatgatgtgaggaaaacttgcttaattaagatcccaattttgttttggtgcttttgacactcttcatgcttgactaaactttttcattatggatttgcatttcttttactttttcttttcttttacttttcatttcttttacttatatgaataaaaggtctattcccttattggtttgaatttgggttacttggtgtctttggtcagtaaagagaaataatttgttttagcatccaatggattatggtctgcttcccaattgtttttgtttttcaattccatcctgatactggaacaacagatcatcttgtttttgctacaaacaggtgacacccaactatagtttgtgtatattgtaagacatacagagagtgttacaaattcccagtgttttcctctgtttcttagtcctgtactattcaggaattgtttcacacgagccttgataaactagctttctcaagaaagaaggttatgatatgttgttgttttgagatgttgaaattatgttaaattatgcataggaggtattatttatttattgagtttagtgctcccaaactgtattctacagaatattgttctacaggatgttacaataatgttaaaaaagggaaagaaaaagtatggaggtagtcaaggggatcatctgtggcaaataagttgtgaatgtgctgggttaaacaaagacaaacagatctattttctgcagaacttctcatgacttttaatatgctatttttattgtaaatctataaggggctatactataaaacatttctctaacttatttagccatggggtgtgtgtgtgtgtgtaatactttttaacatctcaagtatggcacacagtttgggaaaaggtggtctagctatttgttcttgtatgcaaaaggcatgggtaaaatggacacaggacaaaattgttaaaatgttgtttgtaacatgcctacagaccttgttggcaaagcttcctgattataggaaatccccattgaaatattcagggggagaaaaaaatcaaataggattattttttaaatgcattggctataacaccctgtatgttgaatgtgggaaatagactaattttagctaatatataaataaacagtatggattatatcaaacccaggacttcagaacattatgaagctgtgcataagtgcaagcctgagtattgttaattagtaaggatgtggttttcagatcatgtcatccagttataacaacataccataaacactgtccaagcattgtcagtttgtaaacgtatcatttgctgtgagttacttaaaacattcaaaaggtgtttaacaacagtaatagttgatctgagaagaaatcacagtggtcgatcttgaataattataacagcagtattaaaaccatgggactgcagtgaagctgtgatcatgaaagaacctcatgttacaacataaaactctctgtgaaccattactgagaacagaacaacactgaaaaaggcccggatagatatattgctagaaacagttgccctagttatttagtttcaaaatgaagtagcagagaatcccatatgggaaaagtacttgtacatatctctgtgatggtgttcatctcacgatgtttgattccattttgatgggtttgttgatagcatgattcctgctgtcactatgatttgtgtttattatagctgtttcctttttaataaaggatgctgttgcatataaacactgacatgaagctatcttttcagaaattgcattctgtatgctgatatagtcattgcaatgttgtaaagtgagtattttgctaccaacagagttggattatatattttaatatatcgattagtgtattttgttgtttcaatataagaaaggacctatagttatatttattttgcatttgttcttaggtagtatacacactttcaaggagagatagcacagtaggcaatacaatgtggctgaagcacaccttgatagaagaacaaataaaggactgggcagaggtgaaaatgattatgtaggaagtaggagaaagtcagattcaccatagtcgaagagtcatggcaggagaccattgaaagtcaagaggcaccatctgtcctaagctgagctgaggcagtgtctaactgccatagccaagagtaggagctaagaaatctcagaccgagaaaatagccaaagattgaggggctaggttgggcgcggtggctcatgcctgtaatcccatcactctgggaggccgaggcaggtggatcacctgaggtcaggaattaaagaccagcctggtcaacatggtgaaactctgtctccactaaatacacaaaaattagctgggcgtggtggcgggcgcctgtaatcccagctacttaggaagctgagataggagaatcacttgaacccaggaggcagagattgcagtgagaaaagattgcaccattgcactccagcctgggcaagaagagagaaactccgtctcaaaaaacaaacaaacaaacaaaaaacaacaataacaacaaaattggctaggcgcggtggctcatgcctgtaatcccagcactttgggaggccgaggcaggcagattacctgaggtcaggagttcgagaccaacctggacaacatggtgaaacctcatctctacttaaaaaaagacaaaaattagctggacgtggtggtgcgtgcctgtaatcccagctacttgggaggctgaggcagggagaatcacttgaacctgtgaagtggaggttgcagtgagccaggatcatgccattgcactccagcctgggcgacagagcgagactccttctccaaaaaaaaaaaaaaaaagaaagaaagaaagaatgggaaatgggaggcaagaaggtagggaactgtcactagggcagttcagctggttgtgctgaatagtgtttttctcacctagagctgcttttaacaacctcatacctaatggcattttaaattttatgtctggccccagaaaaaggtttgcctgtaaaataaattgaacatgattgaatagaaagtataaagaaaaaaaaaaaaccttccgtacatctggtttaattaatttacagtcctctagcaaagtgtcattaaaggcatttctgatcagatccagattggcagcaaatccaaacccatcatttcctctctccttttttgcctccccgcatctctccttcttaggttagaaaaggatctgtttgaattagccaaggatatactacgttgtagatggtgagggcagaagtacattaagcagaattcagcataactctctttggcccccagagtagcttcagggggcagggccattggtggtggtgaggttgtggggagggtttgtggtatgtagggataaccttcctggcccctttctgtaagctgtcaccagatctggaatgttcaaatcttgctgtatcactgctctttttcatacagacctatcattaccattcaggaagaatttctgcaatctatatacgttctcatttaatgggatatttacaaattctgagccttccttatctctgaaccaaattcagcattaccaatactgccaggtatcctggaacaacatctcgttttccatttccttgcaatccgtttatcattttccttcttctccacatgccaatacactctctaatttctttgtatctgggtggttatgatactgccctgtttttggagggccacagtaacaaattcatttcctcgtgagtatttgttcttacttatccaaattagccttatggaagcacttgtaacagataaacatttgctttggaactttgtgctcttaccttaaaggaactagctttaagctttgaatctgaagtaggaatagagataagaaaaaaagactttccacactaaagagacagttaacaaaggctgagaagtgggaaactctgaaaggtaaggggcaccgaattgttacatttaattggattattggatagataatgaattgtgaatggggcagtttaagataagacagaaatgtctattgagaccagacccctctgggtcttgagtacctaaggaagaagctcttattatatgtataaataaggtttttgagtagaaccccactgaaaggctgcttgctgacttgaataaaaagccactgttgaatcaccaggatgatcttgccagttacaaaacccttgccttgtgaaactaaaagtttattcctataaagtagaaatagtcatagctgactctgtatgggaaaaaatgaaatgagcatttatgcaaaagcttgaagcatgcacctgcctttcaggtttaatccttgtgtctcatttggcaaaccagttgtaccctttgtctgaaacactcctgcacttcatctgaatggaaaccctttcatttctgttatgagattgaataaccaggtgattggaggaagactacagttaagtgtgatttatagacaatagattttgccagaggagattttgaagctatgtaaaaattctttttattttttcatgatatttactaaggttttatcgatttcagattcagtctcaatataaaatagtaataacattagtggtacaaatttcattagcacatacttagatgtaagaaatcataggctgggtgcggtggctcactcctataatcccagcactttgggaggttgaggcgggtggatcacctgaggtcaggggttcaagaccagcctgaccaacatggagaaaccccatctctactaaaaatacaaaattagccgggcgtggtggcgcatgcctgtaatctcagctactcgggaggctgaggcaggagaatcacttgaacctgggaggcagaggttgcagtgagacaagattgcgccattgcactccagcctgggcaacaagaacaagactctgtctcaaaaaaaaaaaaaaaaaagaaaaagaaaaagatatcattactatagattagattggcatgactcaaccttctttagaggttagttgtttctactgagtatgtttgccatttggagatctggcatttggggagtatttgtgcttcaggtggtttgaaaggcagatcttataagtttataacattgtcatctattttcaataggtttttgatattgaaaggaatcatttccaaacagtatcactactgtctaaacactgagtagttacacatacatattagcaatgactaaaaaaatactgtttgcagcaaggttggaaagaaatagaatgatctaggcataaaccacatatcttcctaattaaatgaaacagtatttcattgctgcttaacctactcttgtcttacagattgaccttgactcaattccaggtcagaagtcttcccacactgtgcttattaaggtctctggcatttgaaatggcagagctgctctaatcttcaaatcccatcgctttactttgcttgctatactcccttttccctcacttctgtacagcctacaagtcttatgtgttaaaaagcctctgctaaggccaggcgcggtggctcacgtctgtaatcccagcatttttaggaggctgaggctggcagatcacctgaggtcaggagttccagaccagcctgaccaacatggtgaaaccccatcttttttttttttttttttttttttgagacggagtctcgcactgtcgtccaggctggagtgcactggcatgatctcggctcactgcaagctcggcctcccgggttcacaccattctcctgcctcagcctcccaagtagctgtgactacaggcacctgccaccacgcccggcaaatttttttgtatttttagtagagacggggtttcaccatgttagccaggatggatgaaaccccatctttactaaaaattcaaaattagctgggcgtggtggtgcatgcctgtaaccccagctacttgggaggctgaggcaggagatggctcgaacctgggaggcagaggttgtagtgagctgagatcgtgccattgcactccagcctggggaacaagagtgaaactccgtctcaaaaaaacaaaacaaaacaaaaagcctctgctagcagatttttgatcaacattttcttttatcagtggcttgctcaattttatttatttattttttttttgagacggagtctcgctgtgtcatccaggctgaagtgcagtggcgtgatcttggcttactgcaacatctgcctcctgggttcaagcgactcctgcctcagcctcccgagtagctgggattacaggcatgaaccaccacacctggctattttttatatttttagtagagacggggtttcaccatactggccaggctggtctctcgaactcctggcctcaggtgatccgcccacctcagcctcccaaagtgctggaattacaggcatgagccaccgcgcccggccaattttacattttttatacccaattttcattgatgcattctcaagacttaaataataatgaagtgcctgcccatatgtaatatttcctgatactccatgggctttagcggtaaggtaactttgtcatataagaacctaaaataactgtagttacacttttaaaatagcttgttttgctagtgttgctatagaaaatgctttataaataacatttcaagaactgtgtttctctgaatctccttatcgttgccagaatgtttcccagtaacttatctgtatctacaaagaaagtgctatgtttagatactggtcagttctaagtcattttcattgatgacaacattaaatataagttatacaaaatagtagatattccaactaaaattttatctcttctttgtgaaggatctgtttcagtccttaagaaatagagtcatttgaatgggaaaacctagaaacagttttaaggcccagggtatggtgaagtcaccaacctgtttcttctctgccagttctaatcttgacataacaagaaagttactggacaatcaatcatgacctttaggggtgtgggggaaggaaaagaaaagacaagtttaggcagctcctctatttctaaagaatgtcatagagaaatttaaagaaatccttgctatactttacctggccccctcctggattaactcatgaggcaaatgagatttcctcactctgaatttgcaaagcgacaaaatttccaccaaagaatcagcatgaatgggatttgaagaatggaataaaaagtgaattaaattactgatcaccctaattttcaatactcattcattcattcagcaaaaatttattaagtgcctcctaatctgctagatagtgttgtaggttctggaaataccatagtacacagataaacatttctgccttcctggagcttatgtaatagtaaggaaaaacagatgaaataaagacattgcaaagtatgttcaaaggcgataaatgccatagggtataaaagtgaagagggagtttggtggtatgttcgtattttagatagcacagagggaaagccttattgacttggtgagttctgaataaggatctaaagaaagttaagtcatgcagatatgtggggaaagagcattccaagcattccaaatgcaaagaccctgaggcaaaaagctggtgtgttccaggaaaagtaaaagtagtgagtccagttgcctgaagctcatgaatgagagggagagtcgtagaagataaggtaagaaaaattgtgaggggtggagggagttgtacacccaaatgatatagaaacttatggatctgccgggtgtggtggggtggctcgcgactgtaatctcagcgctttgggacgctgatgcgggcagatcacttgaggtcaggagtttgagaccagcctggccaacatggtgaaaccccatctctaccaaaaaatataaaaattagccgggcatggtggcaggcgcctgtaatcgcgctacttgggaggctggggcaagagaattgcttgaacctgggaggcggaggttgcagtgagccgagattgcgccattgcactccagcctgggcgacagagcgagactccatctcaaaaaataaaaaaaagaaaaaattagaaaaagaaacttgtgggtcataataaggacctgagctattatttaaagatgagaagccattgaaaggttttgagtggaggagagacatgcactcagttaggtacaaacagaatcaccctgaataatgtgttaagaacagactgataagcaaggcagatgggaagcagggagacccataggaagtaattgcaataatctaggagactattgcagtaatctaggctagtattagtagaggtgatgaaaagtagccgaatacctagatatgatgtaaatgcccagtgggttcaccttgccagctacctagacagagctgatttatcaagataggacagttgcaataaagaaagagtaattcactcagagccagctgtgcagtacaccagagttttattactcaaatcagtctccctgagcattcggggatcagagtttttaaggacaacttggtggggggaagcctgtgagccgggagtgctgattggttaggtcagagatgaaatcatagggagtcaaagctgtcttcttgtgctgagttagttcctgggtgcggggacacaagatcagatgagccagtttatctatcagggtgatgccagctgatccatcaagtgcagggtctgcacaatttctcaagcactgatcttaggagcagtttagggagtttcagaatcttgtagcctccagctgcatgactcctaaaccataatccctggctaatttgttagtcctacaaaggcagtctagtctccaggaaagaagggaatttgccttgggaaatgccgttatcatcttttttttttgggtgggggaggacagagtctcgcctgtggcctaggctggagtgcagtggaacaatctcggctcactgcaagctctgtctcctgggttcataccattctcctgcctcagcctccccagtagctgggactacaggcgcccgccaccaagcccggctagttttttgtgttttttagtagaggcggggtttcaccatgttagccaggatggtctcgatctcctaacctcatgatccgcccacctcagcctcccaaggtgctgggattacaggcgtgagccaccatgccggcctatcatctttgttttaaactataaactaagttcctcctaaagttagttcagcctacgcccaggaatgaacaaggacagcttggaggttaaaagcaagatgaagttggttaggtcagatgtctttcactgtctcagttacaattttgcaatgctagtttcaatgtcagtttgtaccatatgaaattgccaatatttgatcacttttgatcaatagaatcctttttttttttttttttttttttttttgagatggagctctgttgctcaggctggagtgcagtgtcatgttctcagctcattgcaacctcctcctccccagttcaagagattctcctgcctcagcctcccgagtagctgggattacaggtgcctgccaccacgcccggctaatttttatatttttagtagagacggggttttgccatgctggccaggctggtcttgaactcctgatctcaggtgatctgccgcctcagccctccaaagtgctgggattacgggcatcggccagtgcacccggcaagaatccataatttctagtggttctttctaactttttgaaagtagaatggatagaagtttactaaaattatacactagatgtgtgggatatgagaggagtgaaggaaaattcccaaggcttttgagctaagcacatggtaagaatagagttgtcattaactgagacaatggagagcccatggctattaattggacacttctgagctagtcagctttagtttaccgaagtctaaattcaggcagcttttggctgggcgcggtggctcacacctgtaatcccagcacttcgggaggctgaggtgggcggatcacgaggtcaggagatcgagaccatcctgtctaacatggtgaaatcctgtctctactaaaaatataagaaaaaaaaatttagccgggcgtggtggcgggtgcctgtagtcccagctactggggaggttgaggtaggagaatggcgtgaacccgggaggcagagtttgcagtgatccgagatcgcgccactgcactccagcctgggagacagagtgagactccgtctcaaaataaaataaaataataaattcaggcagcttttttgttgctgtatactagtggtcacaagtgaacactggataatatgcacaattcattgtagatccatccacattgctggcaaaaataatcaagctttcctgttacactgattgatactgggtctgtgtggtcatcttcttataagaaatatggtcatcttcatagaaaaataactttatatcttttatataacatggtttgaaaaatgtgatttcaactttgtcatcgtgctgcttctttcaacttttattgtctaagctcattttcttcattttattatattctttcatgacttcctctcactctaaatcagttaagattcagctagaatatatgttggtacatacaatttggaaagattgtctttatgttctgtgatcaaatgtgaaaaatagaaccatggagtcaaaacagagtaaggctttactgtttttttttgagacagagtctccctctctcgccccggctggagtgcagtggtgtgatctcggctcactgcaacatccacctcccgggttcaagcgatttttctgtctcagcttcccaagtagctgggattacaggagtccaccaccatgcccggctaattttttgtatttttagtagagacaggttttcaccatgttggctaggctggtatcgaactcctgacctcaagtgatccacccgcctcggcttcccaaagtgctaggattacaggcatgagccaccgtgcccggcctggctttactgttttgtaaaactgctttcaggaagtaattaaggtagatacacacaagcccaagttgaacaacattatatctcacttactttgaatggcctagtcaggaatattgtatatatccataaacgtgaaagtaaaacatttgacgatgtattttctttaggtgtattaagatataaggccaggctgggcatggtggctcatacctgtaatcccaacactttgagtggctgaggtgggaagatcacttgagcccaggatttcaagacgagcctgggacacatagtgaaaccctgtctctacaaaaaaaaaaaaaaaaattatctaggtgtggtggcgcacacctgtagtcccagctactcggtaggctaagacagggaggatcactttagccctgaaggttgaggctgcagtgtgctatgatcatgccactgcactgcagtctggaagacagagtgagattctgtctcaaaaaataataataataatggtatgaggccagttcatcacagtaaaaaataatattgtggaaaatctatagtgttgagttagattcaacttagaaattagcaaacactgataactacttgtcaaaaatgctgataatgtactttcaatagaggtcacagtatttgtctagaatgagttaaagataagagtctatacctttgctgtgactttatctttttgcctgactagtgtctctttgatatatatctttctatactgtaggggctgatttcttctgcgtttgaatttatgaggcaaatagaattggactgaaaaggtgttagagaatttagagaaatacttaaatgaatcactcagtttgtttaaatttagaaacaataaaagctgtttgttcaggctactattttcaagataccatgttgtgtatgagcataaatagtgccccaggttgctggaaggcaggcttggttttgtttttgagaaatgttttagttgaacaatttttaaaagaagaattgatccacatgtttaacatttcactcccccagaccagcctgggcaacatggtaaaacaggaaaggaagatgagaaataatattctcctattattatggaaacatacctttaatatatggccattgactgaatgcttagttttacttatcattctccttttttgttagactcttagccttcttctccctgcccttaaagaccctataagagagaaaaacaggtatacaagtcagttgccatggtgcacaactgtagtttcagctattcaggaagctgaggcatgatgattgcttgagaccaggagatctgggctgcagtaacgatcatggtgcctgtaagtagccactgcaccctagccttggcaagtgagaccctggctcttgaaacaacaaaacaaaacaagtacacaaataaagcaagtaatataaggcatgatatggcgtaacagagatgcttttgtgttttaagcatttttactggagattaatgagtggatgtgaattttaaggtgtgctccaaggtacccaaggggtttccatcaagatgcatcagaggttgctgatgggattggaaacttatcccctttacccccactcctctacacacatgctcacacagagcagctccacttttatctgttttataaattgggtttttgtgtagcactgtgaaaagaaagtgttctttttgtttgtttgttttgggttgggatgggtttgaaagtgttcttttaaccattttttttttttttaaaccacagctgtaatagaaagaacacgagctttggagtaagaaacatctgagttgaaattttagttttgctcttagatgatgcttacctcatccatcaccataagctcttccttgtttctcaattttgatcttcattttgagtatcaaatgagagatgtgtagagtgcctattgcattgactgatcaaggattcctgttagattggaaaactgtgagttctattaaactattttttatatcatagatattattttaaaaccttgagaaaagcaggttcacatatttattaagccgatgattacattttttaacttagcccaagtttctttatgtaatttggcctaaatatatctgagatcctttaagccatctatcgatatttgtacttgatcatcgcatcatagtgatctcacgatgttgagatgttcaactcctgagcccttggggtagccagtgccctctagcgggttggtttgccttagcaaccttgagcagccttgtccgtttaccctagtgtgccatgtaaataatatcatttcctaaatatgccgtgaagacattgatttaaagaagcatagatgatccttcctgttctgtttttctcctcctctgttctttctcttctcactttcttgtcttcaaatcccctggtttaaggccaaagaaatcagtagactagccgagcgcagtggctcaggcctgtaatcccaacactttgggaggccgaggcaggcggatcacgaggtcaggagtccgagactagcctgaccaatatggtgaaaccccgtctctactaaaaatacaaaaaaaaaaaaaaaaaaaaactagccgggcctggtggcgcgcaccagtagtcccagctactcgggaggctgaggcagtagaattgcttgaacccaggaggcagaggttgcagtgagccgagattgtgccactgcactccatcccgggccatagagggagactccgtctcaagaaaaaagaaatcagtagactagagggtaggcagcataagcaatttgatgatgggagacagtccatttctttttcctgtacctcaagccctatttagatagactttatttacatattaaggaaaaaaaacatgttttgacaagttgactagtttcctcctgggtttccattttccttgagcaaaatctgcaacagtctcatgtagatggggtaaatgggtttatgtgtgggggtccatgccacatgaagaagttagatgtgcactagcttccataataggaacagcaagaattgaaacagaaaggaaatagaaaccagtgcagggtgtctaggcaagatgagaaagcaaattgcttggaatatgaattgcatgatgactattgtaatgcttctattattttctgaaaagtaagaatgtctttatgttgagcttgaaccagaaggattactgagtccattctgtgttcaatctgtaaagaaataaactaaaacaggtgaacattgaaaatgttacaatgtcataatttgttttttttagcccaatcaccacttttctgattgcaaagtaagtccttcagtcaaatccattgtttgtctgtggttcttatgattaacttccttaaactcaaataacgtttgaaactcaacattttaaggatgtttttaaataagcattattctaacggtgcaaggacattttttaatgccttgccttctcttgcctaggaaatagaaggcagaattaagacttgaaacatcattttcctttcttttaagtgatgattcagtattttagttgattgtaaacagacattcctcttttgcttatgattacctgatgataattcaagttaaatcattgagataataaatctcatacattgatttgatgagagaaatcagtgttaacgccaaaccatgttgaaattggtcttagagatataagccattttgcaggagtgtgtttttgactaatcatgccagagagaaattaatcgaattgtggaatattacactttgcattcatgaaagaatgtgataatgccactactcttcaaatgcatgaatgtgactgaagggaacagtaattatctgcattcctttctactttaggagccagtgtatcctgaccttgtccgtgattgtaatcaccgtaacttgattagagattttttaaattatttttcaattgacacattttaatttatttatggggtacaatctgatgttttgatacatagctatattatgatacaaccagtttagctagtgtatccatcacctgtgcatttatcatttctttgcagtgagaaattatataagatacaatattttactgttaaacatagttaccctactgtgcaatagaacaccaaaatttattcttactatctaattgtaactttgtacctattgaccagcctctctccatccttcccttcctcttcccctctccagtctcaaccactggtctatccttttttgtttgtttgttttttgagatggagtcttgctctgtcgcacaggctagagtgcaatggcgccatctcggctcactgcaacttccgcctcccaggttcaagcgattctcctgcctcagcctcccgagtagctgggattacaggcacctgccaccacacccggctaatttttgtatttttagtagagacggagtttcactatcttggccaggctggtctccaactcctgacctcgtgatccaccagcctcggcctctcaaagtgctgggattacaagcgtgagccacaacgccctgccgcccactggtctattcttgattacagttttctttttttttctttactttttttttttttttttttttttttttgagatggagtttctctcttgttgcccaggctggagtgcaatggcataatctcggctcactgcaatctctgcctcccgggttcaagctattctcagcctcctgagtagctgggattacaggcacccgccaccatgcctgactatttttgtatttttagtacagacaaagtttcaccatgttggccaggttggtctcgaacccctgacctcaagtgatccacccgccttagcctcccaaagtggtgagattacaggcatgagccaccacgcccggccgattacagttttcaagatgtcatgtcatccttgctgttctaaacatcacccaaaattggagaaagaatagtggtaaaacagtagcgacattaaacttaggtaaagcttctcagtgatattattaatagaatcagaaataaatgacgttttcttataaggattcaaacacagaaaatcttcaagaaataccagtagctgtattttttttcccttctgagccaaaggttagattgggaggactgtattttgatagactccttacgacattttaaaataaattcttcagatctagaaagttgactctgaatattttccattcataattttgagaattttctaaaattgatgagcaaacagttatgcagtaagaaaaagattgtatagaaattgataatttgttctctttccatttatcgctgatgctccctttctcacttctacaaataaaaagtttcaaatctttgttctttgtctcttccatggcaatatagaagttataaggtaataaatcaaatttggaaaaagatcttttttcctactctaattgtagggctttaactcttatagagaatcagaacgttaaagtacttctcatataaaattcccctttttttttttttttgagacggagtctcgctctttggcccaggccagactgcagtggcgctatctcggctcactgcaagctccgcctcccgggttcatgccattctcccctcagcctcccaagtagctgggactacaggcgcccaccactgcacccggctaattttttgtatttttagtaaagacggagtttcaccgtgttagctaggatggtctcaatctcctgacctcgtgatctgcccgcctcagcctcccaaagtgctgggataacaggcgtgagccaccacgcccggccaaaattcccataatattatttcaaaatagaattagtgcctagtataacacctagtactgagtaggcactcagtcagtatctgtgtaggaaggaatagatgggacatgataaatataattgataataaatattggccggttgcagtggctcatgcctgcaatcccagcactttgggaggccgaggcaggtggatcccctgaggtcaggggtttgagaccagcttggccaacatggtgaaaccccatctctactaaaagtacaaaaaatagccgggtgtggtggtgtgtgcctgtaatcacagttacttgggagactgaggcaggagaattgcatgaacctgggaggcggaggttccagcgagccaagattgcgccattgcactccagcctgggtgacagagtgagactctgtctcaaaaaaaaaatatatatatatataattgataataaaaattgataatattaaataataataatattaaatatactcttgaaagactatgtttttctgctgctagacatactactttgtaaccaaaaaagcatacttatttgtttttgtgaaacattcacaacataaatggttaaacagcataaaggaccgtatgtttgagtgttacctctaaattaactaactgtaggcactgaaggatttccatgaacacaggacttttagtactaaaactagggggtctatcccaggcaaactagaacaaactgatcacccttaaaattatctctcaatttggccaggcgcggtagctcttggctgtaatcccagcactctgggaagccgaggcgggcggatcacctgaggtcaggaggtcgagaccagactggccaattgtggtgaaaccctgtctatactaaaaatacaaaaattacccacacgtggtggcgggcgcctgcagtcccggctgctcaggaggctgaggcagtagaattgcttgaacccaggagactgaggttgcagtgagccaggatggtgccactgcactccagcctgagtaacagagcgagactccgtctcaaaaaaaaaaaaaaaaaaaaaaaatctctcaagttgaggctgccttgaatgtaggttaagctttctggataacttcttacattaaaatttttggataatttacattacaaactgagtcaaatgaaagatcttttattttacttgaaatatataacatattcagcatagaaggagtaaaaagaaaagtataaaaaatattttcattaaaagctatgtctttaatttctgatggaattagtagagattttattactaattcatttagtatttatgagtccactatggttgtcagttatcctttatgacataatttataagattactgataggagcacattttctaagctgaaacatttagaataccattatacaattctttaatagctggagacggaaaagagagtgctagatggagaattaacctctgaatcatgttatgcactagggacttagggttacttttggagtagtatggaaacaaatttaagaatagagtgtgcagtataactttataacacggctcattttcagtgtcagagatcaaataaataatgtgaaatatagcattactgtgcagtagaaatccaaaataatgcaggtagcatatgatataggcattatcataccccttaacgcacaacaaaaggtgtttattattatcataatgttattttccctaatatttatttgctttaataaattattattgcaaaataagtaatataaattaaatgaatttacatgtcattgcattcagatttacatatatacatatgcatgtacgttcacatacattcacatatgtatgtgtttttgttgttgtgttgttatttttttttttttttttttttttgagatggaatctcgctctgtcccccaggctggagtgcagtggtgcaatctccgctcactgcaaactccgcctcccaggttcatgccattctcctgcctcagcctcccgagtagctgggactacaggcgcccaccaccaagcccggctaattttttgtatttttagtagagacggggtttcaccatgttagccaggatggtctctagttcctgacctcatgatccgcccgcctcggcctcccaaagtgctgggattacaggcgtgagccaccgcgcccggccatgtatgtgtcttaaatggctatttgccagatctttaaagttgccttccaattttggctgagaatcatcttagaaactgttttgatttcaggcatatatatacaaatgacatgctagtttatacctttaaaagtatatttgcatgtagcataatttggaaggacgtatttttattaaagtatttggattaataaatgttaatgtcaaatctaaaagcccacagcaatggagttgaaaatttaattttaactaaattttaatgtattcatcaaatatgtgttccacagtatttaatgaagatatattgtttataattcacactttgcagacccctttgaagacaataaaggcatacttttaggacagaaaatattctacatagtttgtgaattggagccaatgttctcttgagtttattcttcttatttttaatgcaatttaaaaaatgtatttagggcacatttctgtaagtttaagcatatgattctttatgggagagtagaaaaagaaatcaaatatattttgcgaggtggaagaaaagctgaacataggatatagaaggggcaatgccaaaaggaaaggaaatgaggatggggaagggccatatttttaattacttccaaagggcactggtgtatgttttataaccattcatctctgtttttatgaagcactaactccctgaagcacaaaaattacatgtgtgtgcctgaaggcatacacaaagaaaacaccagaaaccatagctgactcttagtcactggtttaatatgtacagttttggagaggtctgggagtctatctgaatctactgattttgattagtttttaaagaatgaaaaaacaaacaaaaaaaaaccctttcacatgaaacctaccactcaaaatttaagttggattagagatagtgctttgagatttccttcctgactaaaaagtaggttgttgatagcaaaagatcttttgcaactctagtatttgctgtaaactatgatatattcctacaagtacaaatagaaatattttaacatttattcttaagtttatcccagttcttttttttttttttttttttgagagaagtctcactcttataccccaggtttgattgcaatggctcaatctcggctcacttcaacctccgcctcccaggttcaaatgattctcctgcctctgcctcccaaatagctgggattaagtcgcctgccaccacgcccggctaatttttgtatattttagtagagacggggtttccccatgttggccaggctggtctcgatctgctgacctcaggtgatccgcccacctcagcctcccaaagtgctgggattataggcatgagccaccgcacccagcccctgagcttactttttaagaactggcataggccgggcacagtagctgggattacaggcgtgagccactgtgcccgccctatgccagttcttaaaaagtaagcttggccgggcgcggtggctcacgcctgtaatcccagcactttgggaggccgaggcgggcggatcacgaggtcaggagatcgagaccatcctggcgaacacggtgaaaccctgtctctactaaaaatacaaaaaattagccgggcgtggtggcgggcgcctgtagtcccagctactctggaggctgaggcgggagaatggcgtgaacccgggaggcggagcttgcagtgagccgagatcgcaccattgcactccagcctgggtgacagagtgagactccgtctcaagaaaaaaaaaaaaaaaaaaaaagctcagggaccgggtgcggtggctcatgcctgtaatcccagcactttgggaggccgaggtgggcggatcacctgaggtcaggagttcgacaccagcctgaccaacacggagaaaccccatctctactaaaaatacaaaattagccaggagtggtggcgcatgcctgtaatcccagctactcaggaggctgaggcaggagaatctcttgaacccgggaggcagatgttgcagtgagccgagatcacgccattgcaccccagcctgggcaacaggagcgaaactctgtctcaaaaaaaaaaaaaaaaaaaaaataagtaagctcagaaaaagaggctctttataggctaaatcaaataacttgttgaacctaatttttaaatttggctcttatttgtgtactcagtatttagatctaatttgactctgataataaccaactttaagtgaagcagctaccctttggtgcctacagatgactctcctttcaataaaacatatttaaatagatgacagtgatattttctatgatattcccattcgagaagccccttgctgtggttctggcaaggcttccacagcaggtgatgtggggctcatgagaggagtgccttacttactcctatagaaagctataataaaaggagcaaataaatacctcttgtagctaagaatctgatgtaccacttaatattttcaggtggcaactgcactgtcatttcatataaaattcctttcattagctataaaaaacattgcctgcctgccagctgtttggaaagcatcgtaagatcaggaaaatgacaaaacagcccctcattcgcagtagatacaatgaactagtcaaatagtacatttttaaaatctatcttttgcaaaaagaatttttgcttttcatctcatgcgtttttgtttttaatgacggcatctcaatttttgttcttgtttttttctatctaagctaataaacagattgtgatagtctgtactcaaacacaaaggttcaagagatctggaagaacctgcatatagtagagtataaaaggcctgtgcaacttagactcaaatgtatcaatgcctacaggaaaacaccacaggtcagctctttgtatattctctagtcaggtaatgataacctaaactatctctatgagactgctgaaaagttatcgaagtaaattatttttcttgtcttttttttttgagatggagtctctcttgctctatcgcccaggctggagtgcagtggcatgatcttggctcactgcaacatccacctcctggttcaagcgattctcctgcctcagcctctcgagtagcttggcttacagacacctgccaccacacccagctaatttttgtatttttagtagagacggggttttgccatgttggccaggctggtctcaaactcctgacctcaggtgatccgcccacctcggcatcccaaagtgctgggattacaggcatgagccacctcacccggccaataaattatttttcttaaacatgtatcattcatcttagagtgtagaaacattgaccctggtgatgaccattgttatttgtgcacatggctgtggatgaagaggtaaatgaacagcctccattgtccactgcctgcgtgtggaggaggctctgtggttggccttatgtctgatgagtgcaatctgcatctgcaactctgcttcttatagccataatttgcctaatagtattgctcaaggagagaaaatacatatccatatcttcaggaatataggaccatctggtgagaattacttttaatggctacattgaatattagtagttgattgttaatacagagagtaggaaggacattataatgctcaatagttgtccagtctgggcagttactcagctgtcttagacaagaccaagttttgccttttttagtttttcatcttaatgttattttattttattttattttattttattttattttattttattttattttgagatggagtctcactctgtcgcccaggctggagtgcagtggtgtgatctcggctcactgcaagctccgcgtcccgggttcacaccattctcctgcctcagcctcccgagtagctgggactacaggcgcccgccaccgcgcccagctaattttttgtatgtttagtagagacggggtttcactgtgttcgccaggatggtctcgatctcctgacctcgtgattcacctgccttggcctcccaaagtgctgggattacaggcgtgagccaccacgcccggcctaatgttattttaggtattttaggtgtggtgcctagttttcaactcttgttaaatatttcttaatgcataattctaagaggtttcatttaaacttgatctactttatttaatctaaggcatttgcagtattgtttctgttctttaatttagtaaaaggaaagttaattattgtattctttggagtaggaagtctttgtgaatttaaatatttgtcgtatagaagtctaacaaaaaatattctttttaaaatatggtcaaatacaaattgaaagcaactatatctgtagaaaatttttcataaaaatcattgactgaaggaacaaaagcatgtcattgtatataccaacccttctttatgcattatccactaaaatgacatttcaaaagattcacagtgggtagcatatggaatactccataaacactgattagatttaataatgtttgtatcactgtttgggaacatgtacaaggaatgcgaccgccatatattattaacatcaaaataactcagaagaaaagctcctaattaaagcagggttggtttagagacttagcaaaattgcagccagaaataaccacctacccacctgcccgggacttggggcttgctttcatgcatgcaaaacagacttgattcttagagcttcaagatagctgctatgaaaattataatgggctgtgacaataccattttcagcccgtccagttctgcaccaaacctagtttcagaaggacaacactactgcttgagttgaggtttcagccaagtagcatcaaaggaaagcaagtttgtggtttgcagttctgctgagctgcactcagtgactctgcatgattgattagtatccttttgctttgcaaatgtgcatatattaagttcagcattgcagtttgcaaagattcactcatggcctgccatggtaattgatgcacacctgtcctagggagcaatgtatgagtttttttgtgctttcacataagaagtctctggagtatttttaattggtcatctctagaagagggaaacaggagcagattaaaagtatacaggaaaaggaggttgttctacaagcagtttaaaaatctatttgaaaaagatccccaccacttataagctgaatagttataattaatttgtatccctgcattctaaaataagagtactcaacaggttttatttttatggacaagtatctgtgggcttaggaaatttctttctttcttgtcttttttttgaagatggagtctcactctgttgcccaggctggagtgcagtggcgccatctctgctcactgcaacctccgcctcctgggttcaagcaattctcctgcctcagcctccaaagtagctgggattacaggtgcctgccaccccgcccggctaatttttgtatttttagtagagacagggtttcaccatgttggccaggctggtctcaaactactgacctcaggcaatccgcctgcctcagcctcccaaagtgctaggattacaggcatgagctaccgcgcccggcctaggaaatttcattgttatttattgttgtttttgttttgtttttatttttgtttgagacagtctcgctctgtcgcccaggctggattgcagtggcacagtcttggctcattgcaacctccgcctccccagttcaaacaattctcatgcctcagcctcctgagtagctggaattacaggtgcctgccaccacacctggctactggctaatttttgtatttttagtagagacagggtttcgccatgttggccaggctgggctcgaactcctgacctcaggtgatccacctgccttggcctcccaaagtgctgggagtacaggcgcaagccactgcacctggcctaatttttgtatttttagtagagacggggtttcaccatgttggccaggctggtctcaaactcctgacctcagatgatctgcccgtttctgcctcccaaagtgctaggattacaggcgtgagccaccacacccagcctgttatatgtttaaccctttttccaagttgacatttccctgatactttggctttttaaatagcatacccttccccacaattcatttaatgaatcccttcttaatttacttaaaaacaaagatgttcctccagaagcaaccagtttttttctgtattgtttagggattgtgttttctggttttgtaatagtatcagaacatataggtaaatattattttggagtctagtttaatcagatcactcttttgctatagaaatatgttactagcttcttaacggccaggcggagtgtctcatgcctgtaatcccagcactttgggaggctgaggcaggtggatcacttgaggtcaggagttcaagatcagcctggcaaacattgtgaaaccccatctctcctaaaaaatcaaaaattagccatgcatggtggcgcacgcctgtagtcccagctacttgggaggctgaggttggagaatcgcttgatcccgggaggcagaggttgcagtgagctgagattgcactactacactccagcctgatacagagtgagactctgtatcaaaaaacaaacaaacaaacaaacaaaaaacaactatgttattagctccttaaattataagtcatttcattgctttctctggacctagcatctatcattgctcttgtttacatctcagtaaacatctcagtttcaatctgatttagataaatgtgattttttaagctgaaattcctaaatcagtagtaagtgtgcaaatattttaaagattatttgccatatgttattttagatacttatccctatttttctgcttttaattagaaaaaataatttataaactggatgatgttaaaatatataaataatttattaatttcattcataaaatgagctctaatatatatacttcttatatttctagactaatatacagccacattcatcattttttcctagtacattagtatttttatctaaattaattttcacccgctaatgaatattaggaagcactatacatcattaaaagtatttattccaagatgatttccccaaatgtgttactatgtaaacatactctgtttacccctccctttccatcaaaaatagccttaaggcatcatgataaaaatgatactgtatttatggacaggataaatcaaacacagtgaagatgaaagaatcagattaggcattccatttgcttactcagtatggtttctcttatgcccaggtttccatctttacagaacttattgggcatgtttcacccacactgcaatgtaactgattttcttttctctgccatctgctgttcagttaatatgtgtttggatgtgtgttttatgcaaaataactaacagtctaacattttggcacattttgctcttatgtcttgacaatgtctgggcatttgtagataaaagagatatatttttgttttacatgtaagtgagtgaaaatcactttcccccacccacctctctaaaatgagaaaacactgagaggctaaaaggaaagagcccacatttaaaaaagaaacaaacattaaatcttatttcagagtgattcaaatattgatatccagtagaagcatatatgaacaattagagtgtcttggtttttatttttttgaaacttcactaaactggacactggtgtatataacctgttctatcagttgttggagattttctctacgtctgaaagtctttagaccagccaatgactactttcaatattctgagggagtaacatgtcctccaaggcaccaggacattacaaaagggagagcacatgtgagggaacgagccgggttctccacttatggttggctcaatcatagaacttttctcttgtagttaatacctctaattccattgctgttttcatagtaactctgtgtaacacttagaagcctttgctcgacattgtcacaaagtagctctaaaatgtggatctcatagtctatctgggcacatctattggcattttttctgccctccctgcattcttagacacacacacacacacacacacacacacacacacacacacacacaccccacatgctttctctgggctctaatcaaagcctttgtataatgaattgcctaggggagaaggagaaagtcactgacccctctctcctgaacttgcacagagccatatgactactcaaacatagaaataaaaatttagatttggtgtttgtgtgtgtgtgtgtgtgtgtgtgtgtatgtgtgtgtatgtgtgtgtagagttagtgacctaaatagaagtttgcctatttcttcctttattgtggtaaaaacacataatgtgaaatctaccctcttaataaatttttgaatgtacagtacattgttaataataagcacaatgttgtaccacagatctctagaaaattttcatcttgcataactgaaactctacacctactcaatagcaactccccatttccctcacccctcagcccctggtagccacctactctctgtttctatgagtttgactactttagatacttcatataagtggaatcatacagtatttgtcctgtgactgacttatttcatggatcataatgtcctcaaggctcatccatgtcgtaacatatgacaagatgtgtttctttctttcttttttttttttttgagacagagtcttgctctgtcacccaggctggagtgcagtggtgcaatcttggctcactgcaacatctgcctcccaggttcaagtgattttcctgcctcaacctcccaagtagctgggattacaggcgcccgccaccacgcccagctaactttcgtatttttagtagagatggggtctcaccatgttggtcaggatggtcttgaactcctaacctcaggtgatctacccacctcagcctcccaaagtgctgggattacaagtgtgagccactgcacccagccttttgatgtctttgtttttaaagactgaataatattccattatatgtataaaccacattttctttattccttgaaggacatgtagattctttcaacttcttggctcttgtgaataatgctgcattgaatataggagtgcaactatctcttcaagatcctgcctttttctttttttcagtccaagagctggctttgaataacacattgacattgaaatatatatggttcctaagatcatgtaattttttgagatgtcagagacacctagagacagcaaacacattaaagatagattcacagttctagtttatatccatgtcacaaactgaacactactgaagctattttgttattgtttgttttcctcaagcagaaaattttcacagggcacatttttgtctctaacaaaggaaagaaaagaaaagaaatgtgttctttggaagtaatgccactgtattcaaatagcttcttccacataaagctaaaaatgtctttcagagttaaataatgcagtttcatatttaagacatacattaaattgatactaggaaaaaaacacaaaatccaccagtgacccagtaaaattagtaaattcttaatgtatgtataagtatatacacatacatacctacacgtacacagaaatgcatatattttagggaaaccttaaaagagaaaaggagttgctgaacagcttaggaaatacagtacaaacaaaaagcagtattgtctgcaaaaaaatttttgttgcaaaagtaatattttccttgtggaaattctggtccagagttgggctattacctatattgaataaattcagggaaacattctgaaatgtttgactgctatgattgaagtattatattaaagtactttatatcgtgaaatgcacttgttttcaaccatgcaaacagttttattaagtaggaggatatcagggttaaggttaggtttacatgaccatatgagaaaatttatataaggtgatggcatgaatggattctgatcttcaaactagacaactagaagttggaattctaatgtcaggggtatcaaacagcccacatggaaaagaaatgagagtctttaataagcaattgggttagaaaatatatagtatttcaatgtcattattttatttcagagtaacatgtctgtcattgagatagtttactgtaggttaaattcagtatgaggttgccatgtacttgcaaggttcttaaccctgttttagagatcataagacataaaagtgtgcaaaatatattcattctagaatagggagtttcctacactaaacaaccagcttaaataatatattcaagtgttttcatgagaaaaaaatcaaaatactttttatcaagatgttagtgctttcattttacctgaatacttatagaatctagcattatacagctggaaggaaccttgcagaatttctactcaaattgctttattttgtatctgctgtgagggatgtaaattccacagatcatcttgtatatatataaaaagggctaaatctcttgcctcagttcatagatcttttgaatgcacagaattggctcttatctttattagtaaacttgatttggaagacatttccttttttgttgccacttctttacctcattggtgattttagttaagtaagcaaagataaacaagaagtggaaaagcagtatcagctgaattgaaaccactacttagattgaaaaagcatgattggacactatctataattcagtataattctcaaacctaaaatgggacatttgaaaataagtgtaggaaaaatacttataaaatgggaaaaatggaaataaaatgtccaaagaattcagaaaattatactaaagggtccaatcaaacccaaatatgtacatattcattccaaaacaacagacatatcagaagtacctggtaccataaaaattaaaatacacacacactcacaaagactgcacaatataatgagaaacatcgtctcagacacttggcatcaccatttctaagtaatttcataactgtatccagttattcttgaatctgtagtaatatttcttaaactcctttttgccctagctctgtcactgttcaataaaactagattccccagggaccttccctttggcaaaattcacactgagtacagtttttgtttcattgatatttgtagtaaaatcatcctttataatcattgaaactgttagcacagactgcaggatctgatagtttgctctgtagttagatatttccagaatatcctatatttggggggagtatatcaaggccaagcatattcggactaaaggaatgtccactgaaccaacaagaatgttaagggagccttgttaaagtactgtcctgatctcgatccgattggctaagaggaagtcttcctgtccttgctccttgtacttcttactgctttgtacttcttactgctgccatgcaacctgatctccattttatcaaggagcctatatacttcaactgcctattagatttcactatcccagtatttcacagataccacaaactcaatttgtctaaaactagtcattattctctgcccccaaaatagtgctcccttacttgtttctcaagttctgataaaacacaagctcacacaaaacatactaagagtcacccaggctgtaaaactcaaggggtattgtcaatattcccctctctctagccactaatatctagtcagtcaccatgttccatggattctacttccttcatattccttttttttttctttgagatggagtctcactctgtcgctcaggctggagtggagtggtgtgatctccactcactgtaacctccgcctcccaggttcaagcgattctcctgcctcagcctcctgagtagctgggattacaggcatgcaccaccatgcctgattaatttttgtagttttagtagagacggggtttcaccatgttggccgggctggtctcgaactcctgacctcaggtgatccgcccgcctcggcctcccaaagtgctgggattacatgcgtgagccaccgcccccgacccatatttcttatatctatcccctgctttccatttgcagtactgttctgttagcttcccagatgctctccctatgtccaatctctcatctctccaaattatccttctcctgttgccaaactagattcctaaaaacaggtaaggtcatgttactcctctgattaaaaatattgataactcatcacctgcaaaggaaacttgaaaacattaacatgcatttcattccttttcaggcttatcccctctatagctccctgcttgtgcaagctaccttatctcagaatagttccagttccttaacagttctagatacattgaggccgggcacagtggctcaagcctgtaatcccagcactttgggaggccgaggcgggcggatcacgaggtcaggagatcgagaccatcctggctaatccggtgaaacctcgtctctactaaaaatacaaaaaaattagccgagcgtggtggcgggcgcctgtagtcccagctactcgggaggctgaggcaggagaatggcgtgaacccgggaggcggagcttgcagtgagccgagatcgcgccactgcactccagtctgggcgacagagcaagactccgtctcaaaaaaaaaaaaaaaacaaaaaacaattctagatacattgagacctttgctcatgctattttcattgcctggagtgtcttctctctggatagaaaaatcctttccatacctcaagatggaatttggaagttacttccttgtgaaacttcctaatgattccaaagtcaggcctttctatgtgaaatttattttaccacatgctagtttaaaaaaacaaaacaaaacaaaaaaaaaaacagagcaggcacggtggctcacgcctgtaatcccagcactttgagaggctgaggcgggtggatcacaaggtcaggagtttgagaccagcctggccaacatagtgaaacgccgtctctattaaaaatacaaaaaatagtcgggtgtggtggcaggcgcctgtaatcccagctcttcaggagactgaggcaggagaatcccgtgaatctgggaggcggaggttgcagtgagccgagaacgcaccactgcactccagccgaggcgacagtgcaagacttcgtctcaaaaaacaaaaacaaaacaaaaaaaaaaaaaaaaaagaggaagcaaactatgggctaaacatgctggtttaaaacagttttgtctgaatccaccacatactatctagatggcgatgaaaaagttagttggtctccctgaggctaatttcatcatgtgtaaaatgtagttaataatagcatatataggccattgtgggggttaaataagacaaagcttgttaagcatttagttcaatgcctgcttccttgtaagagttcaataaacattagtttctgctactgaggctctgctgttacttatcgtctcctaacactagtttataaattcagtgagggttaggaaccatgtcttatcactttactttctttttctctatttaatctctagcagtttcttatatattatcgcagcatgataaatgatgctgagaactgagtgtgaggtagggcttggggtaggaccttatctaattaacatctgtgtatgcctaccatgaatattaaataataatactgacattccaaaatatacacatcaatctcaaaaatgtttaaccataactcctgtattccggtaaacacaactatatggcaatcttaatagttatgtattgcctaacacctgttattttttaactgcctttgattctgtgtaacattctcaataatttatcaaatgtactttaattggatatttacatactgcatactcttctcattagtaggaactagcaaatagacttactatcatttagattgtattctatgcttcatttaaattagtctgagagtttttggttgttgttagtgtgtatgtatgtgttttaatttaggcaccattttttataccttaagcaaaggaaatctgatcctaccacttctttgtttaaaccttgtcaatgacttacgttttgggcaagaaagagttttaaatgcttaatagatctatagaatctggttcctgcttacctcaggaaccatctccttcctcactcccacttaactccgtagtctctagtattctaggcctttttcatcttctttgtgttcctagaatatttaatatccttccaagccttccctcatactaccacaatactccttgtggctcttaccatccaggtttgagttttagtgcgtcatctttcaagaagcatttccagactcatggcctacccctgtcccccacaagtctattaagtctcccaaatatacattcttataacaacttaagctttgcagtcacacttttcttttcttttctttttttttttttttttttgagacggagtctcgctctgtcacccaggctggaatgcagtggcacgatcttggctcactgtaagctccgcctcccgggttcacgccggttctcctgcctcagcctcccgagtagctgggactacaggcgcccgccaccacgcccggctaattttttttttgtatttttagtagagatggggtttcaccatgttagccaggatggtctcgatctcctgatctcgtgatccgcccgcctcggcctcccaaagtgctggtattacagttgtgagccacagctcccagcctgcagtcacacttttcaaattgcaatttaaaaaatgttttgtatttgtttaatgtatattttccccactcaactgacatctccttggaaagcagtaaccttgtctgaatattcactactccgtcatcagcacctagaagatacctggcacatagtaggcatttaatcaaaatgtttgaataaatgagtgaagaaatcactctgctgggtgactaaggatgcaaagctaaactctgtcttcgaaggaaggataaaaagacagacacataaaagacaagagagtgaataaagaaagtgggtagagaaaattaagagtgctgagtgtacttcttatctctctaataactaccacatttgtgactttaacaggaggcttatttaaaagcattttttttatcctagctgactcagaccatttatggaaaagtggggtcattgcagaatgtttttatctttctggtagcataattacctcctctatgttaaaaactgaggactttggttcaaaatactcaccactgactatactatctttgttatattatttaaatgtcctatgcctcgattttctttctttcttttctttttttttttttattttaacaagatctactctttaggtagtgagagagcactaagaaaatggctactccaatggggcaggaggtaaaaaagagaagcaggggtacttgatatacttcggatagtacaaatctggtgattctgatccccagaagggattatggactgatatggtttgtctgtgtccccacccaaatgtcatcttgaattgtagtccccataatctccacgtgtcatgggagggacccattgggaagtgattggatcatggggacagtttcctccatgctgttttcatgatagtgagttctcatgagatctgatggttttatcactgtctggcatttcccctgctggcattcattccctcccctgccaccctgtgaagaggcgccttccaccatgattgtaagtttcctgaggactccccagccatgtgagactgtgggtcaattaaacctctttcctttataaattacccagtctcaggtatttcttcataccaacatgagaacagactaatacatggacgtaaccccacattgggtgtcagaataacggaaaaggtgtaaaagtgaggtgactgattctcctctggaaggtttgcagggaggctgtcctagtgggctgccaccaggatagttgctactcacctgtgtcctggcctggtcctggctgagtcctcacccaaactgctctgatgggtggcagtaatgatagccatgcctcagttttataatctgattttttttttttttttttgaaactgagtttcgctcgttgctcaggctggagtgcagtggtgcaatctcagctcactgcaacctccatctcctgggttcaagcaattctcgtgcctcagcctcagaagtagctgagatgacaggtgtgcgccaccacgcctggctaattttgtatttttagtagaaatggggtttcgccatgttggtcaggctggtgtcaaactcctgacctcaggtaatctgcccgcctcggcctcccaaagtgctgggattataagcgtgagccaccgtacctggcctataatctgatttttaacagaatttttttagtctatatcttgaactattttaaagtattatgttgaacccaaatgaaaattaatacatgcattccatattatccttgttaatgcttcatatttgtaaatacttgtcaatgcatattcatcacataatgtgtggtttgtaagtttcacatattttaatattatttttaaagtacatttctttgaaatgttaataatttctaactaaaaattatccaaattaaatggaaaaattcatgttttgtttttagcattaagaggaatcttttctgacaggttttaaaaagtggaaatgctgtctatattttaatagattgtatatttgtgacttccttttatttaaatgggtaattatgccaggttgttaactaaagcttgtgtgaaggttaagtggatctcaagttgatttttccatgttcttcaacaatccagcagtaatgatatttaatatttcaggcttttaaaatgaaaattataagtaactaaggtactacctatgaagatgaaaaattgtagcaactgatttgactcaagtatctatgagctctataaactcttcatttcccagtgctctgctaatgcttattctaattctaatggaacatgttttttgtggtaacaattactccttacatcaaaattaagtaaaatgataaacagttttctacacatagcattgatgaagtgatcctactttaccaataggatcagttagagggcaagggggtataacacctgccttcagctacctgaaatagtcaaaaccaatataaatgtacattaaagtataaaggaaataacttactttctattttggtataagcttatggaggaattacaactatctcaggttgaattttaagtccatactgttagtatattactaaggaatataatctagaaattcatatatagtcacacaaaaacatgagtgataaaagctttaagagaattctatatagtgcataaataccccagtaattctgatcactgcttccctagatgagattccctagataaaaatgctttgtgggctgggtgcagtggctcactcctgtaatcccagcactgagaggcctgggtgggcaaatcacttgaggtcaggaaggagttcgagactaacctaaccaacatgatgaaaccccatctctactaaaaataaagaaattagctgggcatggtgctggccacctgtaatcccggctacatgggaggctgagacaagagaatcacttgaacctgtgaggcagaggttgcagcgagccgagatcacgccactgccctccagcatgggagatagagtgagattctatctcaaaagaaaaaaaaaggaaataaaaatgcgttgtgggacttatgataaatgttttataaattaactttccagattcatgactgagaccaaactgatttcaaattaataacattttcaaaacattagcattttaccttgcagtgttttaaaatgctgcacacattttagtttataaaccccacaaagaacacttctgttagggagaagatgatgtgattttagcttacagttatcttaaataacttcatgcttgaaaaatcagaaatatttgtctttgtagaacaaggaatttgaaaggggactagtaaaaggaaaattgcattgaatttcttattttcctctcatacttgccaagtttatatgtattagatatgtcccacttcactgccataaggttatatttattttaggttataaattactctgaattaccttcatcttggaaggtccattgttttcccagagttcttctctttaaatatttcaaggacttccaaagttgcttaaacagatgggaagaggtcactctacattttgatcctggaatagtctaatcatcctccccagagtgtcctgttctttgaagcttttgtagttgttgtcactctctcctgtggcaccaaatgccaggaaatctgggtattcaggagcaaatgccctttggctgctgatcgtaccagtgccttcagtagtttctcagggaactgtgttaggagaggttctagcattagttatatagtgtgtccataaccagctttcccgtgtcaccctaaatatggccataggcttctccctcagtgctgccaaaacacaactaagggcaggctgcctggccgagtcacaccaatcataatggtctacaatacactttcttaagtctcagttatattcagtcttaaccccaagtgaggagtaacagtaacccagatcaaatctctactgatgaaacaagctttctcctccttctccatagacaaggtcctgttaaagatatacccactttatattataaatagaaatctacaggtagctgtaaagataccttgtatctctacgacatgaaaatgtcattctgtttctagaatcaaaactgcctgtaagccaccaaatagccttgctggttttttgttttattgttttttttgtttttttttttttttgagatggagcctcgctctgtcgctcaggctggagtgcagtggcatcatctcggctcactgcaacctctgcctcccgagttcaagccattctcctgccttagcctcccgaatagctgggattacaggtaccctccaccacatcctgctgttttttgtatttttagaaaagatggggtttcaccacatccaggttggtctcgaactcctgaccttaagtgatccacctgccttggcctcccaaagtgctgggatttcacgcgtgagccactgtgccctggcaattagcctttcataaaatgcattttatagtaagtttttttttttttttttttttgtgaggcatcccactacatacatttaagtcttatttctactgggtatggtggtagatgcctgtaggcccagctactcagaagactgagatgagaggattgcttgagcccgggagttctgggctataatgcgctaggctgattgggcatctgcactaaggtccacattaacatggtgacctttcagtaacgggggaccactaggttgcttaagcaggggttacctagcccaggtcagaaacaaagtaggtaaaaactctcatgctgatcagtagtggaattgcacctgtgaatagccaccacactccagccttggcaacataacaagattctgtctcttagaaaaaaataaaaagacttattttctttaaaccgtattcttaatttctattctctaatataggagataaacaaaatggccagttttaaattttatctattgtattagggttctccagagaaaaagaatatatatatatttcttttttatataaaataagaatattttatacatctatatatagagagagagaattatggaggctgagacatcttgtcatctaacctccaagcttctgcaagctaaaaaaccaggaaaactgatggtatagttccaatacaaatccacaggcctgagaaccaggggagccaattgtttatgccccagtcccagtcccttggcccaaaaaccaggaatgtcaatgtcccagggcaagagatgatagacggctcagctccagaagagagagagagcattcacccttctccactttggtgttttatcttggccctcaacaaattggatcatttcccaccctcattgaggagggtgatcttctttactcagtctactgattcacatgcaaattcttccagaaacaccctcacagtcacacccagagacaatgtttcaccagctatctggacatcctttaactcagtcaaattgacataaaattaactattacatctactaaaatatctactagagcaacattcaggtctaaagacacaaacttaatttaggctgaccatcattctactgataaacatattcactattacatatatagctttaaaataaatatgattgaagccaaccttgttattaaaatgtatttaagatgttcagattgatgaaacgaggggattaaaatgcgttctcaaatacaatgaaatagtactgtaaaaatattctcagtaaatgagttttgctgtgaaattggtttaagattcataaaagggatttcaggtttttaagtactcaagtcagcccatgacccagccttcagtggtgtcatcctatgcagtgttagaatgagcctttactccttcaacaaatatttcttaagaactgtatagcttactggttaagaacatgggttctggaggcacactcagtttatttccatttttgtgacatactagctgtgtgaccttatgcaattatttttttatctcagaaagctgttgtgaagatgaaatgagttagtccatgggaagtcttccacagcggctcacacaatttattttttaaaaaggttaggtacagttacattgtcgttattgttgattttcatttcttttgttactgctactatttcttctctgtgccaggcgcacgtctaggtgttgatgagtcagtgatcagagaaggtctactttcatggaccatatttttaagtagggaaaggtaggcaataaacagattgaaataagaaataagaaaaatagacaaaagagataatgtcagatagtgattaagttctcagatgaaataaaataggtcagagtaacagtgatggggatggatattttagattggatagttggggaaagcctctatgaggaagtggcatttgagctgcgactgaatggcttggtgggaaagaaacagtctaggcagagagaacaagtgcaaaggccctgagttgtctgtgaccttggtatgttgaaggaacagaaagaaggttgatgtagccaggcatagtactttaaagggagaatggcatgagcttacattgcagggatgggtagcggacaaatcatgtagagccttgtaaatcatgggaaagactttggattttcttccaagtgttgtagaaagttattagagggttttcagaaaggaatttacatttgaaatatcaacagataccattttttaaaaaattcaagtagagatgatatgtagacagttgattatgaaagtgtgtgtctcaggggagagattgggataggagagatataaatttgggcgtcatcaatatagatgatatttaaagctatgtgaattgctgaaatcaactagacagagaatgtagatagagggctcaggaccaagccctctactctaacattttatagaagtcgccagaggaatccaggcatggtggctcacgcctgtaatcccagcacgttgggtggcccaggcgggtggatcacctgaggtcaggagttcaagaccagcctggccaacatggtgaaaccccatctctactaaaaatacaaaaattagctgggcatggtggcatgcgcctgtaatctcagctacttgggaggctgaggcgggagaatcgcttgaacccgggaggcggaggttgcagtgagctgagatcatgccactacactccagcctgggtgacagagtgagactctgtctcaaaaaaacaaaacaaaagaaagcaaagcaaaaaaaaaaaagaaagaaagaaattattaccagaggagaggaagtgagaaagaaaacttttcatttctgtgtcacagaaattaagagaagtagctaaatgtgtcatatgctgctgagacctaaaaagaaaaataaaggagttaatattggattttgccacatgaaggtcactattattgtaaacaatacactgctatatgaaaagaactagatatcatgccatggactattacagtgtctacattctaaccctaaatggatgactgccttttatctagctcccacaactctaaaatttgaatggtaatattgctctgcctttttgaaaaggttgttataaagaatatgggatataatggaaggaaaggtatataataagtgataaagtcttatacacatgcaaatcgatggtggtagaattatttgtactattagattataaacttcttcagggtagagattaaggctttaatgatcattctatcgaccacaatgcttagcatgataccaccccagtatcttgtatttagtggcttaaaaaacaaaataaaaatttcccacatgaagccaggtgtggtggcatacatctgtagtcccagctacttgaaaggctaagacgggaggatggcttgagcctgggagttcgaggctgcagtgagctatgattgtgccactgcactccagcctgagtaacagagcaagatcctgtctctaaaaaataatatagataatttaaaataaataataagtttttaaaattcccacattaaatacagggatgatatggagtgatgttgtccacttcttttcttacctgcagtcccatataggatttggtgacatggttgcaattgtgaaaaatttcagtgctgactcgccagccatctatcccttttacaaagtaatctctttgaagataagtgaaggatttagagattgggctgctttccatttgttattttcaagataaaccattctcagaatttttcaggtttcctcacttgggtacgagacaatttctgaaatcagtttttgttctataagaacaaatttatgaaattcggtatcactacatggacatgttttagctggtgaaaaattgtgttatgataaatggggaacatacaaattttcccttttttgttatctttggctttttctctgtgttatacagatgttgagctttctgcaatatgcaaacagtttagtaatttgcattgcaaatagattacaagtaagtgacctttgcaaagtgcttctgcctagcgagtccctggaatgaatctgttttatttagggaagagaggctagaaaacagaaatgtcactttcattctttgctaaaaaatgaagagtcttctttctgctatgcttaaatatgatgataaacattttcttaaaaaccaatatatatatgatgacagtctcaaaggtaaaaatcagaatgtttttatatgaagcattacgtgtacccttccattgctaaaaaggaaagtagagtctgtcagaaatgtgtttgttttttcgggtctattgacacaaaaatgggcttgaggactaaaagatttaatgtggcttgtcagcatgaaagaggctgttgtgttgttaatgtgaatgctaatacttacgtagcataaaaaaagaacataggaagtgggcatctcacttttaaaatcatggtgtattccataagtgtcagctgcaaagtaactttccagaaatggtctgatttccccattgacttccattatagaactagagctgtgttcccatggaaaataaatttggccccaggttataataaaacacagtgaagaattcagaaaatcttataaagtcaagtttttcaaggcacaattatcagtacttgataaaataataacaccacaaaatattaatactctatagtagatcttaaaatagtatgccccagactgcaccattatttttctatacaattccaagtctattacttttgcatctagagaaattttacttctgtgatcattattaatttttaatggatttaactctaatttaaactgttgattttgtttccttttttctttatggttagtccacttacctttttctaaaacattcttatctatgacaatcaaaagttactagccatagaagaaagaccagaaggaaatgctccaaaatgttcacaatacttgtttctgagtgggaaattttagttgatttaagtttttaatttctaagttgtaaaaaagggccatttatatcttctataatcagaaaaaatgtattataatttctataagtataaatttatatatagtgagatatctttagtaggacacatttatatatttggttcattttatgatttggtaatggtagttgttaagatcatttattccttcaaaatttttttaaaactggtaaaattagtttctggagataatagcttctacttaattttctagaacatactactcaaagtgtgggcctggaccagcaacatcagcatcacttggaaattagttggaaatgataattcttaggcccctgatctggggccccaggaaacagctatttgtgttttaacaagccctttgggcgattaaggttctaaagctacagaaaattctctctagagctacagcaaattttctttacctctctctccttctcctccctctccctctgtgtccctctctccctctccccttcatcctctcttctccctccccccttccctccttctccgtcttcctcctttcttgccaggccacttcctctcctttatagaggaaaagtagtttctcttctcacccattgctgggtttgtagctgagacctctaaaacaaaagacagattaacaagaggaaaacttatggatttatttaatataagttttatgtgacacaggagccctcaaaaatgaagaccaaaagaaatagggaaacttgtatatttttatgattaggtttgatgaagagtggacagtagggaaatataatcaggcaaagggggtatgatctaatggtaatgagctgggggaacttagcaaggcatatttgttcagattcttctctgtgtccatatgtctccagagataaggacattcttttccttcaggtataggaggagcagctctgaaatgagggtcttataacctacttcagaggcagttaagagaatcattttcttgcctgcttcaggagaaaaggattagaagatcagagagaacttcctgcttttgctgatttctcaaatgccaaggtgccatattttggggaagtgtgtcttgaaccccatcaccttcttccttctctgtttcctttcctcatgtgggttatgcatatatgtatacacacacacatatataacactcatatacagaattcactataacctctttttttttttttttttttttgagacagagtctcacactgtcgcccaggctggagtgcagtggcgcaatcttggctcagcacagcctccacctcccgagttcaagcaattttcctgcctcagcttcccgagtagctgggagtacaggcgcgtgtcaccatgcctggctaatttttttgtacttttagtggagacggggtttcactgtgttggccaggctggcctcaaactcctgaccttgtaatctgctcaccttggcctcccaaagtgctgggattacaggcatgagccactgcacctggcctcactataacctctatctctacttatatagagatgtatattaaaaagagagaaaaaaaaatatatatatagttttttctttaagttttttgccactgttttctaccttactcataaaaatatatgaggccgttttctggtatttatgcctatatgctttcatttagcaaacattttctaacaaatgttccgtgtggctacatattgaatagttctgcctaatttaaagatcttcaagtctcactaaccaatataatgactctatcaagttattttgggctaaaatgtgtcttccccaaaattcatatgttgaagtcctaaccaccatgtacctcagaatgtgactatatttgaacatagggactttaaggaagtaattaagttaaaatgagctgattagggtgggccctaatccaatatgtctagtgtaagaagaagcgattaggatacagacaggggaacgactatggagagacctcagaagaaactaaacccaccagaccctgatctcagacttctagcctccagaattgtgagaaaatcagtttctgttgtttaagccacctaatctgtggtattttaccatggcagccctaacaaactaatacacaagtatttgtgcattactaatgtatttatagaagtgatgatttaatttaatcttaacatctagtgattgattgcctttaaaaggtactgttgagccatgttccttaacaaaaagctacagctttacaaagactgcccgagaacagtatgaaaaactctccaccatgcacaacaacatgatgaagctctatgagaatcttggagaatacttcatttttgactcaaagacagtgagcatagaagagttctttggtgatctcaacaacttccgaactttgtttttggtaagtaatacatcttaaagcattgcaagacctgttgcttatatttctgaatgttttccttctattgtcattttatgttcctattgactatattgatttcatgtgacatttttttaataagaattgacagatattttatacctgtgacatggataaaaattaagttataagtcatggctggcttaacataatgtggacctaaatgaatcatcttcaatgttaagtatacatgggaaatgttttactgaaattttataggaaatgaatgaattggtacttaaataaccccaatttttatatagcataatattataatttcacgtagcgtaaacattaatatctagaacttttcacataataaattcaaatgctgtgatttataaataagtttctttcacagcctaaatgagaaactgattttgaattggactgtgtaaataacattgaatacctaaagtttctttcacaatgtgggctcttgttttaaactggaactcttgaggatcacagtaaatattagcattaattgggggtggcaattagggtacaagttatgatgctaaaaggaatcaaaggctttgctatataaatgctatggaaatacacgtcctctgcatctaacaaaggagtagcaggaagagcacagactgattgcaatagtaacagaaagatatgcataatagttgatatcaaacaggtaaaggtgtgtgtgtatatatatatgtgtgtgtatatatatgtgtatatatatgtgtgtatatatatgtgtatttatatatgtgtgtgtatatatatatatatattttttttttttttaattttttttgatatggaatcttgctctgttgcccaggctggagtgcaatggcgtgatctcggctcactgcaacctctgcctcccaggttcaagtgattctcctgcctcagcctcccgagtagctgggattacaggcacatgccaccacgcccagctaatttttgtatttttagtagagatggggtttcaccatgttggccaggctggtctcgaactcctgacctcaagtgatccacctacctcagcctaccaaagtgttgggattacaggcgtgaggacctctagcaataatccccaacaggaagatcagttaacaaacaaattcattccagtgtgaggtattcccaaagcagtactttctttgtattcccaaagcagtactttctttgtcaatgctgttgccctgtgaaatcatttgattttggtgtgacttcatctgtgagatatgaatatgcttgtggaaatcaaattgctttcatctcctaacccagggcctataacccagagcatacccgaacagttaaacaagcagctttagtcacagaagttaatccacaaacttccagaagtatgatcatatgtcttcttttttgctgaaaatattagttgatttttgtctttgacccttcatagagacacatactttttagctaacccataactagtagaatgtgttctactggcaatgagaagagggctaagagaagtagtcaaatcattttcaaaacttaaaagctgattatatgctatgaacacataagcgcacaggttatatctacttggattattttcaaaaaggacaaaacaatgaacattaaaaaggaatgatgaccagaaaatatactttagttgacacactgaaatgataaatccaataattttttttgtaacaatgtctgtgggtgaatggatatataagaatatgtatgtggctaggcgcggtggctcacacctgtaatcccagcactttgggaggccgaggcgggtggatcacctgaggtcaggagtttgagaccagcctggccaacatggtgaaaccctgtctctactaataatacaaaaattagccggtcgtggtggcgggtgcctgtaatcccagctacttgggaggctgaggcaggagaatcgcttgaatctgggaggcgaaggttgcagtgagccgctggagacagtgagactctctgtcccaaaataaataaataaataaaagaatatatatgtaaaatatataagaatacatatgattaatattgttgatctccatttagatcctaaaacactgtctgtcttattatatgttcccttacctccccaatacacagacacagagtagtagatggtgtacttgcccccccatgttgcagcattcttctaataattccagtgttacagcctgtgtgtactcatattagccatatgcctagaaggctaagaactctacttgtatcacttttcaatcataacttgttttttaaaaatgtaagaatattattgttaacgagacctgattttgtatcctggtactgccactaaaaagctgtgtgactttgagtaagtcatttgtcctttctagctatccatttctgtctgtcttttgtaaaatgaaagagttaaaggattgatctctaagaattcttttccctgttagtagtctgagtcacagttcgaatttcagagatggcagagtcatatatattacatacatatgtaggatatgttttatgtctttctgctgacttcactgcacatgtagcttgagtacagagtaagaatttttcatatattgtcactgaatgtaaataatttgatattcttatgtccagtttcatgtccatttaagttaatttcttgagaacctgttacgattaactttcaaaacaagtaatcagatcctaaatgtgtcaaccaatctgaaacacttacctaatgcactcctgaccagccattgctatctttgccttatataacagtactgctaccacttctatctacaaatctttatcaacttgctgccatgagaattaggtgtgcaacgtattaactgttttgaacgtgggtgggacatataacctctctgggcatttgtttccttgtctataaaagacggaaaataatttaagccatgtcttcctcactactatctgaaaagaccttgaaacctatgctatacagatgtagaatattattagccattctctgactatcctttccattaactactgaaaaccaacttgattttggtaatgctctgggtcacagataaaaggaagagaatggtttctctctatccatgagtggggacagacaaacaaatgcaatataatttgataagtgctgccatagaaatatgttaaggtgcgataataacataaaggaggaactgcctaactctgcctgtgttggccagagaggccttcatagaaaaagtgacattagggcccggcgcggtggctcacgcctgtaatcccagcactttgggaggccgaggcgggtggatcacaaggtcaagagatcgagaccacggtgaaaccccgtctctactaaaaatacaaaaaattagccgggcgtggtggcgggcgcctgtagtcccagctactcgggaggctgaggcaggagaatagcgtgaacctgggaggcggagcttgcagtgagccaagatcacgccactgtactccagcctgggcgacagagagagactccgtctcaaaacaaaacaaaacaaaaaaaagtgacattagggcagagtcttgaaaaatccataggcgtttgacaagcaggtttgaggtttttatacctgacctttaagtcgaagactcctaaatcaacatcaccaacttcagtcaatcctttgtgctcaccatgttcctgtttcatagtgaacttgaagtgatttcactctcccaggggagggaagaaccctgaaagattggcaaaaattgtaatcgccagaagttcccattttcttagtgctttgtgtgtttggcctcagggttcttagcactaaaagcatattggactatagatggaagcaataaaataccagtagtgctgagaagaaaataagagttctgatgcatgtgctaccaaaaattacttccaaatgagctcagagtttcatcttgggagatctatttggcatatgtagcataaacaaaatgcacataccaaaaaatcttcctccgatagagatatcctctaaaagatggggcaaatacaaataaaagaatttgacattatggattaagatctttttgaaagtaaacaattcaaatgaatgaaagcagaattggataatgtctttggaagacttctattagttaatattcctattctatattactcagctaatgaggatatcaaaggtattccagatgaatgtacaatatattggtatcaaggtatatataattagaaacatttctaaattcagaattgagaccctttctagttagtttctcagagatttcatgagtttaaagaacagcatacaggccaggctcagtggctcaagccggtaatcccagcactttgggaggccaaggtgggcagatcacgaggtcaggagatcgagaccatcctggctaacacggtgaaaccccgtctctactaaaaatacaaaaaaattagccgggcatggtggcaggtgcctgtagtcccagctacttgggaggctgaggcaggagaatggtgtgaacccaggaggcggagcttgcagtgagccaagatcacgccactgtactccagtctgggggacagagtgagaatctgtctccaaaaaaaaaaaaaaaaaaaaaaagaacagcatacaatatagacaaaattaatagcccctaaatttaagttgcatattttgtggaagaaaatcaaattccatgatacacaatggagactcaggagggttttgtggtaggaggggtgtggataatgagaaaaattacttaatgggtatgatgtatgttattcgggtgatggataccctaaaagctctgacttgacgactgtgcaatccatgcatgtaacaagattgcacttgtacttcataagtgtatacaaataaatcaaattccatatttatgcaatgtctaaacatcttttttgcttattctcctttctatgcttcagtcattcttttagttcaaatagttgactgcacaaatagtcttttttttcttttgagatattttgaatagaatattcaaaatcggtgaaccgtatatgtttcaccaccatgcagtatcttgcttaggcataaaaattaatttcagctgttgggaaagtgttcacggcaagtattatacttctataactttcacagctccaaataaattatagaaaatacttcttttctgttttaaatctgtcagtttcctgctgcttctgtgtgtttttgttttgcttttttaaagaacaatatgttacccaggcactccataaatatttgttgtgtgtgtgtcctcattctgtacctcatataccaaatataggaataaggctttgcagaattattagattcattgacataacttgaaaatgttaccgttgcttttaatcatgccagccaatttcccctcaacaaaatcagtatgtgctactgttcatttgataaactttggaacagctcctagatgagcattaaaataactaagtgttaagatgctaaatgatatcaagtaatcatagcgttttatgccattattcaggcttgctgcttctacttcccagattgactgattgattgagaccgggttgctctgtttcccaggctggagtgcagtggtatgatcatagctcactgtatcctcaaactcctgggctcaagtgatcctcccacctcagcctcctaagtaactaggactacaggcatgcatcaccatgcctggctaaatttttaatttttaatagagatgagatctcgctgtgttgcccaggcttatcttgttttcctggcctcaagcaatcctcctgcctcaacctcccaaagtgctggaattacatgcatgagccactttgcctgaccctagataacttttgaatccatccatttctctccaagcccactgacactatttgaattcctggcttcaaccatctctcgtccggactataataatgacctcctgactggtatctgtgtcttcttctcttacccatttccatttcctaatccattcaccccattttagtcagaataaaattaaaaacaaaagaaaccaaacaagataaccttagtttcctgacttaagattctttcataacttccctgtggcctcaggataaatctgagcttttttttgagatggagtcttgctctgtcgcccaggctggagtacagtggcttgatctcagctcactgcaacctccaccccctgggttcaagtgattctcctgcctcagcctcctgagtagctgggattacaggcacccaccaccacgcctggctaatttttgtatttttagtaggagacggggtttcgccatgttggccaggctggtctcaaactcctgacctcaggtgatccacctgcctcggcctcccaaagtgctaggattataggcgtgggccactgcacccgaccaaatctgagctttttaaactaaaatggtttacaaaatcaaaagagctatggttactttaaaggccagaccatctatggttggctctgaatgggccgcagtcacttagattgaactcttctcccaaattgggaaatgttacttctggaaagtagaagcagtagaacaagataatagcaagttcctaagaggaactgtgtctctcagaacaaagagaaactttggaagcaccatatgaaaattcaaaaaaggctgaaaggccaaagtatgattgtcattatgcctttattgctcccatagctggtgtgacatggagagttataaccactgagttcactcttacgttaattctcagggatgttcttccttctatcttaagtaattgttctttaaaaacctaaacttgtctgagagctccctgtgtagccatgttggcttatggagataattaattttgaaaatctctcatctctcttaagctatcttcccttttacaaggcctcagtcatgtctaaatctaaactataattggaaagtcaatgagtatatctgcatttagttaggcttgaaagactaaattgataatatacagaaaatttgattcatttattaatggtaatttacctttaaagaaatgagggtgaatttttacatgaaaggattgtgtatataatccctgatccaaaatgacttaagttgttttgacacatttttaaaccaagcacttgacattaaaaaaaaaaaaaacttcagtattataaaaatggtaggcttatgtgagaaaccaaatatattgtttaacaaagtagtgtcttaatcagtaatgtaaattctgatatctagaatttcatcatccagaaatttctattagatgcctcataagttggtgcctctttgctttgccagtaaaatggtaatattctgaaaacaaccttaagaagctgcaagaccgtgatgtgcttctttaatgatatagttttttttgtaaactagatgtctccaggtctcttcatttatgaattcagagggggtgtccttagtaacagtaatccaaatatcccagttatctcctcttttcccccactggcaggactcaagctctttacaaagtctttacccctaaaagtacacctggagtcatttcatgggtgctgaaaacgtcatctgtagtcaccagttgaaatttgctcaccaatcagcaactgagtgcctttattctagagtgatgaaaatatagcaatgaacaaaacagacaaagcccctgcctgtcctgtcttgctgtagcttcagctccattctgctaaatgctttttgcaggcaaaactgcttggggttgcctttaatgaaaatgcctatgtgtgggccaagggtacagtttcctactgctccaattttgtcatcaatcttgaagtaccattgtggtattatgttcagtgcagaagtagccatgtttcacaggacacttcataaaaacagttcattttgcatctcttctgatccctttctccttggagactaaaaactgtttcaactcctagagacctgaagggaatcctaaaatcttaagcccctccattgccctccttctccccttttgttcaagtgcctaggcatgtatcttccttttcctaggagctgggaataaataaaatgccagcataaatcgtttcatgcaaatagagccctaagggcccaccaactctctctagttaatcatatacacccagataattccctttgagctcagctgggaccaccctgggtatatagccttaggtttattttgatctgttgcaactctttgaaaataggcaatccatggaaaatatatggtaactctattaagcagaatatttgaccggaatacctcattccccagctgtgccagagagcagactttactgtattttacagatatcattgaattcttctttagaaagagatgtcacctatcaaatgttgtattctctttgactgtttactttgggccagaagtggatgtcctatttctcttatatgatttttccttgtatagaaaagctaaatatcatatcatagggaactaaaggaatatgtaataagggaagacatggtttaaggaaaactcaaactccctaacatgataaaaaaaaatacctactagtatggatggtttttaaatatgtatgcattttagattaatattataaaactaaaaaaacagttttttctaaaaatatttataaaagttgacagaattgtttatgacaagctgaattttaccctttaaaaatctgacaatataataattaacaatgaaaatattaacaaaatcagttcaatgccaccttttcctattaaagtctaataagaactagaatcaggaaacagaatgtaatatctttagttccagcaacaacgcctcatgcagaatttttcacagaagtgttccctataaataagttattattgaattatgtccaaacaccaggaagtgggaaagtgtaagataagcaatatggtatacaagctgaccttttccagaagtcttgagattggccagaggtattgattgtgatcagagcatgcctgtttcaacctaagcatgaagatccctgaggttaatactactggtggcaccctctcagctggctgaatttttcttcattctgcttcatcctgttttgtttgtccatttgctaattaatcttctgtcagaaaagatgccgtcacccctgaataaggcagtagaagggaggacttccccggaattgtgcccattgagctcctttggtatgcctgccccctcttcttctcccccctccttccagttgcctaccaacttgttcaagtcatttcctctaagaagccctccctaacttccatttcggtgtagattacccttctctgtgctctcatacctccatcttagcacattttaccctgtaatatgtttatctccataccctcgtgattaatactataattagcctactgtgggtcaaacacagtgctgatctcgaaggatatgtatgaatggcttaatgaattaatagaacaatgagtgaatcaaacaaaaaatcaaaatatttgctctccagagctcacattctagtgggaaaggcagtgaaagaacaaatagtggtaatgaaatataatacatatgtacaaagagcttgtaagcacagagcagtgaggcatttcttctgtctgatttaaggaaagcttcaaagacatagagatatgtgaactgggtctgatcattgttttgctactatatggcctttcatgttttaaggagcactttcctttttgttctcccccacctcatttggtgtttaattttaatggtaaacatacattgtctcctagttttccatgctgagttcaaagtggaaaaacagctattttgttgccagagaagcagttaccagctaattatgatgatctaaaggttatctgccatatgcttagatgagcagtaaccaagcttcagttacttcttatgactgacagttgtcctgagcaataggacaattgatgcagattatctagggcaaaagcaactgcttaaagtctgacttgcctggtgttaatttaggccagtggttctcacccaagagcgattttgcctcccaagggacatttggcaagatctagagacatttttgtttatcacaactaagtaggatctgcaactggcatcaagtggctgaaaccaggaacactgttaaccatcctacaatggacaggagagcctcccacaataaataaatattcagcccaaaatgtcagtaatgttgagattgagaaaccctgtttcaggattacctgcaaaagattttttaaaaaaaattataaaaaatcagtggaaaacaatgtgcaatagtccaaattaataagcaaaatctactagataagttaatattatatctatcatattgatgtaatattttaataatttcaaatgttaatttgatcactgtattgttacagttactacttttttctatagctttgaaacatcccagtttatatggcttgtaaaattttttaattaccaatcatgcatgtaaattgtagaaaaattagaaaatataaataccaaaaagaaaaaaaactgtcgactgcaattccactatccagagttaattaatattaatacctcggtacatatccttccaggcattttcctatgcatgtacataagtatttagattgtgaatttgtttttcttaaaataataataaaaagacttctgaaaatttaagttttaaatttatattttcttgtaaaaaggctagtggatcatgcttatatggatatgtccatccacattcagtgtatagtgccgttggttatgtcttcagttgtgattaaacatgttaattggctcacttcatgatgcccttttacaaacacctggtctttggcaccatgctaacaatcatgactactgtaagccatctgtaaagagatcggtagaatcttgatttctctttttgttttctacataataccctcattaaacttccctgtgtcaaggggccttaaatcagtaattggtgactgtccagttaggctattcacactagtgtttcttaagcactttgctgttgttctctgctgtgcactttgatttaagaaccattacttacctaaactagggtgttcttttttaatcattgcaaattgttaataatataatgatttgtaatctaatcacaaaaattcttaacaaaagcaatgttacgatttaaaatgagagtaagtgtcctatatatgtcctatatatgtgtgtgtgtgtgcgtgtgtgtatttttttcctttgtttctgtcatcctcttcttgaatcaaatttcattgtcatggaatacagtctcctaaactgctttttaaagatctgaaacatggataatcttttttttttttttttttttttttatgatacagagtctcgctctgttgcccaggctgtagtgaagtggcaggtctcggctcactgcaacctccgcctcccaggctcaagcgattctcctgcctcagcctcccaagtagctgggattacaggcacctgccaccacgcctggctaatttttgtatttttagtagagatggggtttcaccatgttggtcaggctggtcttgaactctggacctcgtaatccacccacctcagcctcccaaagtgctgggaatacaggcgtgagccactgcgcccggccatgttataatcttaataatgaggcagctactatttttgctcatatccattttaatttctgtttctgcaaacatacggttttggaatattcagaatttcctgacattgttcatggggtattgggcaaaccagagaatacatagtattcctgaaaagctaatcatccattcaaatcttgacattttgaaatggaagatgctctattattcttcagggatcttatatattttgtgctcaaactactggattactcagtatgacagtgtagttgaagtcattttattttattttttcaaatttattaatcaggcacaaaagagccaaacttcatactggagacactatagtttagaatagtgtattatttgttcgtgctcaattgtctttggtctagtaataaaaaactaaagtctcatatacattggggacatataaaacagcagtaattaacaaaacagtctgggtgcggtggctcacgcctgtaatcccagcactttgggaggccaaggcgggtgaatcatgaggtcaggagttcgagaccagcctggccaacatggtgaaaccccgtctctattaaaaatacaaaaaaaaaaaaaaaaattaggtgggcatagtgccgggcgcctataatcccagctacttgggaggctgaggcaggagaatcacttgaacccgggaggtggaagttgcagtgagccaagatcgtgcctctggactccagcccaggcgacagagcaagacttcatctctaaaacaaacaaacaaacagatgattatgtaaaatggatgaaatcgcaaatataactgtattaaacaatataacctctacatgggagatatgggttggtgttccccaaaaacttgaaactttattttgaatgttaattatttttagtgttgtgagcaatcctccttcatcaaatgacatctacgagatattatttgtgaaagtatttgctcctttgtttaaaatataagatttgtaaataaaaatttaagatgaagccttttttaggtgacagtctccttctgttgcccaggctggagtacagtgatgcagtcatagctcactgtagcctcagacccctgggctcaagctatccttccacctcagcctcttgagtagctaggactacaggtgcacaccaccatgctcggctaatcttcttcttcttctttttttttttttttttcttttttagagacaggatcgtgctatgttgcccaggctggtcttgaactcctggcctcaagcagtcttcctgcctcagcctcccaaagtgttggaattacaggcatgagccaccatgcctggccagaagcattttttaatacatcctaattatatggttgttatttcatactatattaaaagttttagaatagaatatattcaaatagatagacttgtttcatgtgagcattatttaggcaaaatatgttttaggtaactctttaggtaacagtctttaatgaataggccaaattaattttcaattattactataagtgcttgtgtatgtagatattattgctcaagtttttctgtaagtacctgaaaataattgatttaactctgcttttgaacgcactagcatattttgatgtttattcttttgtataatgtattaggatgcctttagctgcctagtgacataaaacataactaaaattagcttaagaatatggttttactctcttacatcacaagaagtgtagaggtaaggcagttacagggttggttaattcagtagcttagtaatattattaaggacccaggatattccagatatttctgttctgccatccttggcatgttggctcttggttgcacaatggctgtagttgttccaggcatcacattcaaatatggggacgtctaacaaaggagagtgtgttgtctctatgaagcttttttttcaattagggagaaaagcttttccagcagctcctgggcagattgattccttcacattttgttgtccaggattgtgccacatgcccatccatccctaaactaatcaccatcaaggagaaccttagattaatccatggctttgccagcaagtaagatggctggcattggcagcgcgcggtggctcacgcctgtaatcccagcactttgggaggccaaggcgggtggatcacttgaggtcaggagttcgagaccagcctggccaacatggtgaaaccctgtctctactaaaaatacaaaaattagccgggtgtggtggtgggcatctgtaatcccagctacttcagaggctgaggcaggagaatctcttgaacccaggaggcggaggttgcagtgagccgagatggtaccactgccctccagtctgggcgacagagcaagagtctgtctcaagaaaattaaaaaaaaaaaaaagactggcattgcatggattgggacatgcaactaaaagtatcaatatagcacaaaagtaaattgttgctcagtattatttgaattgtcaaacgttgcaaattggcaaaagaaaaataaatgagatgttatctgtgaaatatacacttgtgttcaattaaatagtttttaaaaatcttagaaaacagaaatgtaaatagaaaacattacccatttattttgaagttatccttcactgtttgcgttctgtctttcgctagaatatacttacacaaggacattctgcttttctaatttgcttgaaaagctattagtttacttgctttctttttctcattcattcattcaaggattatttattgagtgcctattaaacagtggacactgttctagccactggcattgtttgatttatttcagtaaactaaaacagattttaaagctctgccatcatggagccaaatgtggaaaatgagaaaataaactataaacataattattgggaaaattatattacaagttagaacgttaagtgctatggaaagaagaaatcataccagtggaatggccacatgacagtggctaaaaggtttcaacaatagttataaagttccattgtgcaatcaatttcttaagctaagatttagattttaacagtgtaaatgtttcctaaaattcagggatcactgagttgtcctatttagaagacttcactaggtacagttagatgatttttatacaaacccgaactatttcatcagccatgtatccttatgtgatgtagaagaaataaaaattaattctgtcccactttacagaaaaagtcttgccaagggctttattgtttcagttaaataattgtaacattatcttctggaatatggaggatatacaaatagagaactttacctagaagcccggcatattgtctacttttagacacagatcaaatttaaaaattaaagaggaaacacctgagaagaaatctgtccttttcctaatgccatttcaaaatcaatggctcttgcctttgttaattaagcaagttaaaacctttccttgttcaagagaaaacaaagcaaaacagtatttttgctattaaaaacgccaactaggccaggcgcagtggctcacgcctataatcccagcactttgggaggctgaggtgggcgggtcactttaggccaggagttcgagaccagcctggccaacatggcaaaaccccatctctactaaaaatacaaaaaaaaaaaaaattagcgtggcattgtggcttgcacctgtaatcccagctatttaagaggttgaggcaggagaatcacttgaacctggaaggcgaaggttgctgtgagccgatatcacgccactgcactccagcctgggtgacagagcgtgactctgcctcaaaaaaaaaaaaaaaaaaaaaaaaaaacctaacaaatacagattcagtctcagtcactacttcttcctcaagggaactcggatatcttatttaagaagatagacaataacatcccgaaatgggtttctagacaggaagctctgacaaaaggtgagatgtatagcaaagcatgtagtgaagtaaaagcatatttttagtgccaaaaatatgaaaaattataaggaacttacaaagacatttagttcatcttggattcctttcccctggtccttgttctctgccaactgtcagctagttgatctgataaactaatgcagtactaatgtgtcactcattctgtattacatacatgccctttaaattcaggacaatgccttaattcagcagagcaattctgctgtcaagaacttcttgcaacatggctagctgatagaggaaatattggagggaaagacagcctttcttgtacctctgaaagaacatcatatatgtagctgcacaatcttcctgggtctagaatttttccccccacctcacaccctcctcccaaggacatttcacaatttaacctgtctgttctggtgtcataatatagctttgtcaaattggcatcttcctgggagtgacctccccttcgacatggatcagagaattcaggcaacccaaaaccctgatccagcccaccctgtcttttgagaggctggaaactcaggagtttcattggcagagatgtagtatcaactcagctttgattttccctttctttctgggtgacatttacttttttatatattgtcccttaggcagaaatactacactcaccttgtaggcttagcaggatgtctacagggggttaccccaagcttactgtgtgaaacccaagccatgctcagctcacttactcagccacggagacaaaagacaattagtgccttatggtatagtaggtacaaaagaaatgttttatactccagatttcctccctactctaccttatggtatggtacatatacagcctgatcactagaataatcctttgtcataataaaggcgggatttcttggtttgattttcagtaaaaatgtctcctggtgtttttttttttttttttttggatctccttccttcaatcttaaataaagcatttccaaaggtcttacttttggtcctgcatatttttcttcctgggtagttgatatctattccaatggctcctacactttcctgagttgtgattttattattcagctctagacccaagtttattttctgttggatgcctctaactagatttgccataactacctcaaactcagcatattcaaaagggaactcattacatccttttcaactttctcccatattctctttggctgatggtacaacttgatatcttcttttccctcgctatttacatctgttcagtctccatttcatacccagcttatgcagttaaaactcaagagactctatctgttttttatgatttccccatcagaatcttaccaaagcaccgttgtttgcatgttctatattaagtctcagcaaagaaaaaaaaatcttactttcatcctcactttaacggcccaagtttcagtgtttgtcctctctccttcccatggactactgcagtaatcttttagttctcctgagcttagtcttagcactctctaaactgtatgctgctgccagatactgttttctaaaacgtaggtttcattgggacattcaccttctcagaaaccttcagtggccttccatgggtgacagtaaagcctagactagcatttggaaacccttggtaatctaactctccccagccactaccctttttctctgattggaatacagtcacacgcacagtctcccttctacctggtgaaattgttttcaactttcaaaactccatttagtggctactttccctgttatgcctttcctaataccccctgctgaactccagggaaaattaccccctatttggtatgctcatcatatttttctttttctttctttcttttttttttcattttttttttgtttgttttgttttgttctgtgatggagtcttgctctgctgtccaggctggggtacagtggtacaatctcggctcactgcaatctccacctcctgggttcagttctcctgccccagcctcccaagtagctaggactacaggtgcacaccaccatgcccagctaatttttgtatttttagtagagacagggttaccatgttggccaggctggtctcgaactcctggcctgaagtgtactacccgcctcagcctcccaaagtgctggtgtgagccatcgcacccggtgctcatatcatattgttaatgtggcttttgtaatattcaactaattggtgatgtacagacctgccttctttgtgctgtgaattcctttacagtaaatacgtctcacttatctttgaatttttattacacaacagagtgtgtggcacataaaagtaaccagcaaatatttattgattggtaaccatgtttgtaattggtaatcatgttcctactgttctagaaatctaataataaatggtcttttagattaatatttcaaagccctctagctgtctctctctgcctctctctttctctctgccaccttttcaagatctttcattattttaacgactccttttactcttcgtcaacattgatttagcaaatatttgactcaagtacttaaacttgtctactttcactccatcactctaagttgtgaaatcccaaagtgagctatattttcctggtataattcttgagcagagctaataataggcacaggaagtacctcatgtttactccattttatttctacattctagcatcaaacctctcatttgtcagcctttgtgatttactgttcacttatgattgaccgtgaccatttacatcttcattatttatccatagccagcagacacctgcttatgtcactagatttttttttctctttatgataaaaatcattagagaaggactattcttcaaacataccttcaaacatctttctactttctctaagtcttactagcttcaaagatcctttgaagaaagaattgaaaattccaacttctcttttctggggagttgctatacttttaaaaagtgtaataattctaagtttcacgggataaaattttgtcatttaaaatttcttaagtatattatagtgtcatattttatttttatgagtgcttaagtataagcacaatatgcaaaaagtaacacagatttcattgtactagagtatccatgagtcaaaagggcatacagaagtttacattgaaagaagtcaagtctaacacatgacatttattattgcaaagtgttgtataggaaataaaattcaatgtgtctgtaaatgccctaaatcctcttataagttatttgtccaacatgttaagcctaatggaaaaaaatccctttataccaataaataaggcaacttaagcagaagattcatgatgaagccagaaaaactctataaataatggggtagtacccagggaggagggaggtaaaggaaagggcagtagatcattagcacaataaggaaaggatattcccatcagtaagtaagcagtgatatttggccaaatctaggtcatgatcaaggatataatcacaagtgagatgttttacattgtgcaatgtagctggcatactcatctacagatggaatggcttgcttcccagaatgcaatcactactatataacagtgtccttattatttccagtttggaaaagaggattgtaaagcagaatatctctggttccgacctgtatcccattcaaacatgatccacgctattttgttttcagatatttttacagaccaactctctgctgtatcatacccaagatttagggtgtcaaagaaagatatgaaattgtatattcattgtatttttttgtttgttttataaactaatgactcagaaacatatacctatagagccagaatagcctaggatagaaactaaggaattctctatcggtaaaatatctttttttttttttttttgagatggagtttctctcttgttgcccaggctggagtgcaatggcacaatctcggttcactgcaacctctgcctcccaggttcaagtgattctcctgcctcagcctcccaagtagctgggattacaggtgctcgccaccaggcccagctaattttttttgtatttttagtagagatggggttttgccatgttggccaggttggtctcgaactcctgacctcaggtgatccgagtgcctcgcttcggcctcccaaagtgctgggattacaggcgtgagccactgctcctggccctctatcggtaagttatcttaataactcaggctcctggcaagttttgcctaacccttcagcagctaactaatctttcaaatagttttctagagaaagtagtttcataacttgacttgattccattgctttgccatccttaatgtaaacttctttttaattatcagagtttctctttttaaaatttaaattcaggtcctattattttgacgtgggaaactctggaagatatctaataagacttgttctttaaatacatatccacttcatgtctatggatatagttatatcccttaattcaatcttccctgagcttaattatccatcttttgttcatggtttggcatttcccaaacgttcagcacttcttttattcttcatcggacatcaggtttttacatattctttaaacagtggaggatccagatttgtgaggctgtattttgtataatttgggagcagccatttaagaaaaggaatttttttttaaaagaaatcttttttatttttaaattttagcaaaacacatggccaagtgagcacattgccagtgcccctcccatgcaagttagaagtcctaatgcttttgctcattagcttcatggtgaatctgtctctgccctttgagtcgttcatcccataaattaaccacagctcttttaaaaaggccaaactgtcaaaaagtataagcccaagtaagatattggctatcacatatgcatgctggtctggtatttacactaaattaatcagcattgtcttcattaagtaagaaatagttattgcatgcctcttttgtattaggtgctgtaataggcttatagttaagggtgcttatcttaatagaatatcacacctgaagcaaactaaaccaacagagtctaccctttctttttttttttttttttttttttgagacgaagtttcgctcttgttgcccagactggagtgcaatggcacgatcttggctcactgcacaacctccacctcccaggttcaagcgatactcctgccttagcctcccgagcagctgggattacaggcatgcacaaccacgcctggctgatttttgtatttttattagagacaagttttctccatgttggtcaggctggtctcgaactccctacctcaggtgatccgcccgcctcagcctcccacagtgctgggattacaggcgtgagccaccgcgaccagccagaatctacctttcagaggctgttaaactaagccaacaccgaagcaaatgtgcataaaggatatctatgaatatctgaatgcatgttaaatacataatggatatattaacattatatataaaatagggtgagtgcatcttgtagtgatggttagtgaagcagcccttgaagtctccaatttaatctgagggaggagaggtttaaaggtatgcttgctctataacttcattgcccttaccagcaatattacctagtggcgtgaggttaatttaaggaccaccatgaccactaagtgctatgttttcatacttttccacacctcatcagtgctcctttttttgtttgtgttgctcggtttccattcatttttgatgttttatatatatatatatttctctacatataaagattaccctgagttttcagacaacatcaataaagggaaaggtgctaccccataattactgaaaggacatcttgctgtcaatatcttggaagataggacaacaaatcatcaaacaatcactttctacttacaaaagcacaaggttctgactggcaatcaagaaggctttgtgaaaaacaaattgagcaaaaccatcttaatctacttctttgaaagaatctgttccccatactgcaaaaaaaatctctctgttcactaggatttttattccctcccatgtgacagtcattctcaatgattgaaaataataagaactagactttagagtacgattttaactgatagtaagacagtgctctaggtgggtctgggacatagagcaaaagtagactaaccctctagtgcttcttttgatgatccctaagagccatgagtgaaagaggcttgtttgtgatgcttattattgattccccagggactagaacggtatgtgacagttcatgctggataatgaatgaatgaatgtttcctgcttctcaatgaaggcataagtcactggatattaatcagcctacttttttcttacctttattgcttccctgccctcttcttcctttccctgtccctctcatcacccaaaggacagataaattttcaatggcagtatgtccagagagatttctaacacttcattaaaaaaggaattttattggctgtgtatgttccctcagaaataggatcaagctcagttaggaattagtaagatataaattaagggcaccaagcaggtagcatgcagacaagaacatacataaattcactggaaaaagattcttgatttttagtggaacagtacagtactaaccatgaattagcagtatatgaggtgtaactgttttttaaagaagacaaatcagaaatgtgtaaagtcaaagaaattttaagcctcttgttatcttaattgaaggataatgatattaccctaaatattttgggaacccttattttggatttccctaagagttatgcagcatgtgctttaggtctttccaggagtactaaatatttgtaatctgagggtgcgcttgatttttggaaatagccggaagttacatcaagccaagttttatcaataagatacatgatcaaactgagtaacaaaatatgtggtcaaaaatattgtgaatataaaataatgagactaatttcatttgattcagaggttaattcggaacgaggagtttcaattacagtgtaatagccctcaccaacacaagtttaggacttccaaaggtggctatttgtaggacaggattcagcagatatatcggaaccaatcttctaactttacagttgcacttgaaaatgttacaaaacaaatgctataatattttagaagatttagagcatgaaaaactggtagatattggatagcacatctcttagagtattgtttccagctttgtcctcttcttttttggggaggcaggtgaggatggagaagtctataatttaaaaataatatctaacaagtagagaacacccagaagaaaacctaaacattattaaatgtaggcaaattagtctctatgagaaagttattgttcagaaaatggtattgattggcttaatttaaagtcccaacagtttttctcaagggtctcttggatcccatccttcccccagtactctacaagctaagaaattcacctgcgttgcatttagggattagtttcaactttgtggaattcaggcaatatggcggttcctggggacaagctacacctccatgaaaaagttttaaggaagatattgaccaagtttctatttcacagaggccaacagacaagacgtgggcttaaaaaactgacagcttttagcgaggcataaggaaatatttcctttttgaggaggttaagtatcagaagaggttcctgagggagatcatggaaccctatccacaggcagaacattagagcaagcattcttctagagcccttcctgttctgtgagtctataattctacttgtcaaggtaatttgatattcttatccaagtctctaaggtgcttttgccaccacctaaattggtctcatcaaaaaccttattgattgtgctgcctctcccatcttctaagatggtgacagtattaaggcagtaaactcagatctcagacctgtcacataccacttgttttgtcatttccctccacctatacctccccaagatgttttttcattaaaatattgttaccagtcactttagaatttcattctgttcctttggttcaaaaaattgtaattaatttcctatagtcacttaaagcacttcgtagattttaatcaacagaggtctacattggcatgttgagctcagttgtttatcccttccagatggagataaatattctcaaatacctactaagaaaaatatgtctgcagaaacctgcagcattagaaaacctattctttgctgcagattgcagattaacttctagctaatcagagttcagcattctaatggactgtgacgggagagacagtttttcccccaacttcagatcacatgtttctgcagttgtaaggcaaattttaaaaggccttggggatcacagccagccttcattatcggtgcatgaccgctttgtaaccaactgtaagtttaatatccaaggagatttgcacataacagtcttttttctttcttcttgtttttaataattcacctttgagattctcttcaccaccatgctggtgtgcaaagatctgtttgtctgtcaaacctacagatatgtagcgcatgtgaaagctacattaattttttatttgtttcctaaggaggctgaacaataagctggttttgctgaatacaagagggctacttcagtgaacacatacttgaattcacttcagctggctccctcacctgcagcacagcagtttctcctatgattctcccctctgccaaaagggagtcacttatacaactaaactcaaggactttttgtataaaccatccacctgaacctgagaaggttttgtctgaaaccaaaagattactagaaaagctgtgtaaagcagggcgtggtggctcaggcctgtaatcccagcactttgggagggcaaggcaggcggatcacctgagatggggagttcgagaccagtctgaccaacatggagaaaccctgtctctactaaaaaaaatacaaaaaaaattagctgggcgtggtgtcgcacgcctgtagtcccagctactcaggaggctgaggcaggagaatcacttgaacccaggaggcagaggttgcagttagctgagattgtgccattgcactccagcctgggcaacaagagcgaaactccgtctcaaaaaaaaaaaagaaagaaaagccgtgtaacactgtttgtggatcctgcaagtatctcattcaaaacaaatgcctcattttcaaaattagaacacttcttttaactttggagactcaatgtaaacactaatctctacacaagtgaatttcctcagcggaatattgagctatgtcagtgtgacaaatgtcatggatatcgggcctctgaaacgctaagcactggcatttttaagaaaataaatgtagatgtcagtgaaccataacctatagatgattagaaagaaacttaccattcgaaagtggatgttttcttcaaggctgctaagattttctacaataaagaaatatgaggtgcgtagggaactatgtgtagagacgttctcggtaatttaatgttttgaaaactcccaggctgaaaactattattatgtaaatcaactagctccagctgctaattcttagaaaatggaaagagtatctaaagtttaactagattttgaccttttatgttatgaagactacaacaaggaagaaagaggaagtttgttagggggttattttttaaggtggtcagggaaggcttcactcataagacagacattcaagcagagacttaagggagatactttttttttttttttttttttgagacggagtttcgctcttgttgcccaggctggagtgcaatggcgcgactcggctcactgcaacctccgcctcccaggttcaagcgattctcctgcctcagcctcccgaacagctgggattacaggcatgcaccaccatgcctggctaattttgtatttttagtagagacggggtttctccatgttggtcaggtttcaaacccctgacctcaggtgatccgcctgcctcggcctcccaaagtgctagaattacaggcgtgagccactgtgcccggcctgagggaggtacttaagagcagaaggaacgcaagtgtaaagatgaggagcgagggagaccagtggggctggaagagaatagctgaggaagagatgaggacagagagaggtaacaggaggtcagatcacataaggctttatatgctattggaagcactatttttttttcaactatgagtaggaatagatggcctcactgccagaaaaaaaagaagggaagagatgaggacagggcttcaggggaaggtgaaaattaaagggtgggacagggaagtatagtctagaatggatatggagggaatgcaatgctgtctgtaggaagaaatgaacatagtacctcaggaatcaaagagggaagaaaatttctattttgtttggtttagcagattacctatggtctgttatacttctgtgtttcataccatatttacacaggttaataagcatgcctttaatccctgtctaactacagtatcaatacatttgttcagtgtctgttactgaggcacctaactacttgagcaagctaatcaaggtttcaattaccccagtgagaaagaagttctacttctctgttgcaatcgtagttgattggttgatgaagtatttataagatctttcataagaggaactttaaaggtcacttgtaccataataagtggaaatcgctgggaaagaaaaagtttagcagtattatagtgctgataaagtcttcagaggtactgactctcagagtctagttactgcagctgaaaattctttgccctgagcatttgtcatgactccttcaatccaatatgccctttaaacacagtgaaactatagaaaaggaatatctaatgttgttgggtgttaattaaggagtaggcttccttcctttccttaatggaaagccttaatttgtcttcagttgcagctgaaaattctaaagactcatttccaccatcttatgtaggttttttctctaatgatcaggttgttcaatttcttgttcagatgctgaaaaactcatcttgactcacactgtatcttcctacttgtaacctgatgtgatcattctcaaatgggagtgaaaaagacctgtacaactatatgagtcctgatttacttttgatattctttaagattttcacccacctttactataataacaaataaggacctcagcccaagctacaaatcaggtagaggtaacatacattgggatctgtgtttcctatcacctcttttctccttggttccaggcaagtgcaacaaaagtgtcaatagtataggccaggtgtgttagctcatgcctgtaatcctagcactttgggaggttgaggcgggtggatcacctgagatcagcagtttgagaccagcctgaccaacatggtgaaaccccgtctctactaaaaatacaaaaattacctgggcgtcgtggtgggcacctgtaatcccagctactcgggaggctgaggcaggagagttgcttgaacctgggaggcggaggttgcagtgagccaagatcgtgccattgcactccagccagggcgacaagagcacaactccatctcaaaaaaaacaaaaacaaacaaacaaaaaaaactgtcagtagtagccaaaacaattcaagcacagaatatgttaactatatgaagtagaggaaaagggaagaagaatttttaaaaagaaaaaactttttggtaaaatgatgaaaagttattgcatatagaattgcctttcctgtttcattgtcatgtttaggacatctttgggacagggaaaggaaactgctgctataaccttacctagttcactggtctggacaacctgtccattgctacctattttgcctcctgttatgactggaatgaaatgagaaccccaccaataagcaaaaagtttccacctttcatcctatctcctacttgcaatccctcagtagtgatattccagcacagctaacagcctcctatcagtaaagatgggaaaagtatcagaaagcttagcaaggcctggggtagggaaccaagtgtgggctaattctcctggtccttccgtaaacattaaggcagactaagtgaatccctcattctaagacaaatgttccctaaagaagtaaaattaaactcctattttccaaagcaattggacttttattgtactgtgtgctttattttctgagtgaggtgacagaactagagatgtttaaaaaaaaaaaaaacagtaattcccctccaaatttactacctttccccaggaaccttcatcactcagtttttgctacagtcctgtaaggcatgttgaaacttgagtaaaatgatgcatgaatttgttagtcaaaatagcaaattattctatgacctttattatttcttagatttgtcaaatatgatatcctaacaccaagaattttcccccaaaacctcctgtttattttacctctatcttttttctcttggcacagaaagacgagtcctattatctgttcaaagttggtggcttagagagtgtgtgggtgttttgtttcttcaaatttttacctgatgttgcaagattttcatatcaaaaagaattcttctttctccccagtgtgcacgcacatatgtggacatggtcctggattggaggaaatggagtacagaccctgaaatgcatgggacctttgtattgcccaaatgtggaataatataataataaccaccaccatttattgaacatgttttatgtgccaggcactgttattaatagctttatatgtgattcctcattaaatcgcaaaccaacactgtgaagtacaggtacaatcatgtgttgcttaatgacagggatacagtctgaaaaatgcattgttaggtgatttcattgttgtatgaacatgacagagtgtacttatacaaacctagatgctatggcctactatacatttagactatacggtatacgtaagcctgttgttcgtcgactacaaacctgtacggcatgttactgtacagaatacagtatgtaacacattggtaagtatttgtgtatctaaacatctaaacagaagaggaacaataaaaatactatattaaaaataaaaatggtacacctgtattagggcacttagcatgaatgcaccttagaagattggaagttgctgtcctcagacacaagcacacacattagcctaggactacacagggtcaggatcatcagtatcactgtcttccatctccatgtgttaccccactggaaatcttcaggggcaataacacacatggagttgtcatcttgtgtgataacaatgccttcttctggaggacttgaaggacctgcccgaggccattttacagttaacttgttataagtaggtgtacactctaaatggtagaaagtatggtatagcaaatacgtaaaccagtaacatagtcacttattatcagtatcaagtactgtgtattgtacatcattgtatgcactatacttttataggactggtaatgcagtaggtttgtttataccagcatcaccataataagtacatgagtaatgtgttgtgctctgacattatggtggccgtttcctcactaggtaaaaggaatttatcagttctgttataatcttatgggactgccttcatatatgtggtcccatctgttgtactacatgtcattatgagatgcatgactatatttcacagattcagaaaagagggttagctcagttaagtaaatggcccaagggcataaagcactatggtctctagaggagcttggatttaaactagatctcccagcccttcaaggccatcctgtgttcattatgatatgctgttttacttagaaagtttggattatggatcccgacttaaaatgatccatataaagaggacaatttcctattatttttactctggccataaaattacaggtaagacatttaaaaaaaatcttatcaagatgcataaaattagaattatacttatctaggaaatatggaaatggatggtattctggtcaggggttatttaataaaaattttaagtgttttatttttaaaagaggcgactgaaagaaacaatttaaaaattcttcagtgtctagcaaaaaaaaacccagaaaacttaaaaaaaaaaatctaaaagcacagtctgaattaaagcaaagaaagaatcagttgctcagagagttcaagattaaaaatgtgaaaaatatttaaaaattagctgggcttggctgggcacagcagcacacacctacaatcccagcactttaggaggccaaggcgggcggatcacttgaggtcaggagtttgagaccagcctggccaacatggtgagaccccgtctctacaaaaaatacaaaaattatttgggcatggtgtcacatgcctgtaatcccagctactcgagaggctgaggtgggagaatcgcttgaacccaggaggcggagcttgcagtgagctgagatcgcgccactgcactccagcctgggcgacagagtgagactccgtctcaaaaaaaaaaaaaaattagctgggcttggtggtgcaagcctgtaatctcagcactttgggaggccgaggcaggaggatcacttgacttcaagaccagcctgggcaacatagctgggctccatctgtagaaaggaaggaaagaaaggaaaggaaagaaaaaagaaagaaaagaaagaaactttgccaggcatggcagctcacacctgtagtcccagctacttgaaaggttgaagcaggaggatctcttgagcctaggaatttgaggttgcagtaagctgaaattgtaccactgcaccgcagtctgggtgacagagggagaccctgactctaaaaaaaattgtggaatttcccctattttgttgagttttcattaaaactactatctcagtgactcatatttagtgtataaaaagatttgcaatataatacacaccacgtttctttatattgttgccaaatcatttctctcagtatcattttcaaatccttccaacacccctgatcaacgaagaaatactcctcagtgtgatcacagtattcctctggcaccagagttaccaatttgttcaccatgacatttctaatttacgtaattttatggttatgtgactctactatcatacaacttctgatactgtaatgaactgaaagtcttgccaactatattcacgcgggtaaccagaatgatccaaaactcaaaagagaaaatgaatacattcctagtatttttttttcttttcatgagtgccaagttacagtgatatatatggaatcgtagaattaccttagatgccaatattatggtacagttgaaaatcatattcagtatagttatgagggtagatagtatcaggttggtatatttccagtcatagattatgtcctcataacttccccaaaaagggaggaagggggtttgcaaaataagtcattgaaaacagatgtggtcatttgtctgtcaatgactgaattcttgctgttcaaacttttaaatgattctgttatacataataatcacagctactatataataagcatttcctctgtaccaggctttgtcttaagtgttttatataagcattatttcacttaatctgttcaacagtcctgtgatttaagtagtatcttgattctgcagatgtggaaactaaagctcaaagagatgaactaacttgttcaaggtcacacagtttttaggataagtgatggagctttgatttgaaaccagatttttctgattccaggatccttactaccaatggttttatttctctgtccctgaaatatgccttcagctttcagtgatctcatggtgcttgtaaagtacttgagcagtcagtcatctctggaataggaagccattagaagccatgaaagtaaggaattgtttgctgtaatggtggtggtggtggtagtggtggtttatgttttcaaatatcaaggcaaggttggaagatgcttgcttcgtgtagacctgacctgaatgaggctggcatctgggctccttggaattttctgaatcagtttcatccatttcttaaagcttaattgaaataaatgagaggtcttagcatttacgtgaatttctttctttttttttttagcatatgacatttttagtctgtaggtcttatttagtgattatgcatagcaagggaaataagatttgtaatttattcactttttttttcagtaaggcaatagaggtttcagtgagagattttaaaaattaggttggtgaatatttcgtagtaaatcctagatacatttttcattatattttactcattttgtaccttttaccaacccttaacagatatgccagtaaaactgagacttttttctgtaaacatatttcttatcttgtatgaggttagtaccaaaacactttttcaattagcatccttttaacagaacactgtcctgtacaatgacagaatctaatcagttggcatttccaaccctgagaaataatgattaatgcttacttgagaatgatctttaagtactcatgagttagtgttttaaaatgtttagtgaggcttgacaagtacaaagtaatgttaatcagtcaattatttaggggattttcttaacctgaccttaaatttgctcctactgcttttgttcttttgattatttgatttttattttgtaagaattaggatgatgagaatacatcccatccctcaaaataatttttttcttcaccagcttttacatttttagaagggttaaacaatgtcttaaaaactaaagattattgatatgaaactgtctttaagatttccctttctctaagcatgcattttctatccctaatttcctaaagccagagccaagtaaaaacaccaagaggaatatgttattcttttcagcatgaggccttttcatgaaaacagcactagtgaccagaatcttattctagtctgtgttgcttgaaaaatatatgcctttgtagatgttttcatttactgtcaataatgccaaaccacagaaatggtttttttaattctgttttggcctcttaaagattacacattgccattacaaattgtgattgttttgtagttaaatctattcctgaaacatttcagatataaactgatagacctattacttgttctgttttatcctttagtagatctacattcatgttgttttagtggtgccttttgcaagcttccctctcatataaaaatttaatctctagccttattttcttctatcgcaaattgtatcactttgatttttatatgaactttttttttagttttagcatattttccagaaataataaatacatggagaatgctacagaaatagcatgattcaagttcatgtacaatataatgcctatcaataatctgtatcaacatttctattttcaaaatgtggttttgatttgggcgtttctttttgtaatcatttctactgtctttattagatgatcttagtcgatcaaaggatgcttataaaaaatcaacacagtcttgggaatcggactgccaggtttatgaaatgaaaatataggattcccagttgaagctgaatttcagataatgaataattttttagtatcaatatatcctaaatattacatgattttttttctatttaagtatgttccaaatattatatgagacatacttctactaacaaaagtattcacagtttatctgaaatgtaaatttaactgagaagcctgtattttatctggcaactctatttggaaggcatcatagtagtgaaaatgaacatagaggctaatgccaaacagtcctaggtggttgtgttacttaagaagctgtgtagctttgggtatgtcacttagcctacctgaacctaaatttcatgtataaaatggaacaaataatacctactttgcaggttttctataaagattataaagtatgtatttaagactagataatgtttaaaactcctggtacataatagatttcccttaaagagtagctgttattatcagaacaaagaagaaatacaaatgcaagtaaccagccgttttttttccctccatcttaataaactatgtgaggaatcctaatgggagcactcagcatgtaaacaacccattagattgataatataatagtccacccagatcttggtgactgtttaccaaattagagatttgaccactaataaaatatatacaagcattagccttctttctttcctctgctacttgcctcttttcatgttacttaccaaacattatatagcttattagtatcagggcctgaatatgtgatgccttttcacattgttttttcccttttgagttacaattttacttccatcctgtctttcttagacatctatttattaatgtgattaatttttattgagataatttacataccataaaatttaccattgtagtttatataattcagtggtttggccgggtgcggtggctcacgcctgtaatcccagcacactgggaggccaagccgggcttatcacttgaggtcaggagttcgagaccagcctaaccaacatggtgaaaccccagttgtcaccactggagtgggatcatactggcatctggcaggtagaggccagggatgctgctaaacatcccacaacgcataggacagctcctaccaaagaataatctagcccaaagtgacagtcgtgctgaggttgagaaaccctgctttaaaattatgattctagtatgccagtttatttttaagtggtagtctttgagttcatctacaatagccaggtacctttgtgctcctagcctattgctatggagtctaagagcacaaaaacaatgacaggagaaaggggaggtaccagtgaaggtaaaatcatttagattttgtaggaagaaatcaattcttgcaagtcaggagaattttgaaagtgtttttaaggctattttaaactgctgtgtcttttaacataaagaaaaaaattatttcaatataaacccctccaggcaaagccttgtagacgtattctcgttattgagtctttttctttagggtttctggaacaaaatagtttttgtcaaacagcttgtacatgctatgaagtatatttaatcaatcataatagaaaaaagaaacagagcagcttgatggagggaacttgtagttgatatgtctctgcattcgtgatttacctgaactcaaaggaagttgatattccagctgatcacattaattcagctttgtctaataccaactactggaatgtactcattcacttatgttccacaaataatctatccaaaataaaacagacaatagcttgaaatatgtttcagcatttctaaatattttcacaagtaaaaagctgtcatatttgaaggtatttcttttctgtgataatactgttgattgtttcctgccctgcatgattagatgtaatcattatcaccagcaccaggaccaccatcatcgccatcatagactaaaattccttgattataatatatcaggatctattctaagcactttatgtttgtatcatttttcctcacaaaactcctataaggtagtttttttcttaatctcaattttgcagataacagaaaagtacacaataaaggggataaaatacttgctgagtcatatttccttactatgtcttctcatgtgtcaaactagttcatattttaacaatacataaagtatacttattgttaaatctgtaacattgatgtccttaattttctggcaccctagataatggcaattgaagactgagttatttctaaatcttttttcaagaagagatattttacaattaattgtctctctcaaaagtatatatatgcacattcaggctgctgtaataccttcccatctctgcatatttatataaatttaaaactgtgcaatttctccattatataagtaatggaaaggtttttgtttaactttgtttatatgtataggaagcagtgagagaaaattcaaaactgtgcaatgtctctattatataagtaatggaaaggtttccatttaactttgtttatatgtataggaagcagtgagagaaaacaataagagaagagaaatggaagagaagaccaggagggcaaaacttgcaaaagagaaagctgaacaagaaaagttagaacgccagaagaaaaagaaacaactcattgatataaacaaaggtatgaaaatatttccaatttttacaaaaatgcaagaagtacaaaataattgcagttatttatttttggattataaagtaaattttcatagaaaattcacaatagtattagttacttgtgctaaatttctctcatgatgctatgtgtggtttcctatctccctacgctgagcattcaggatttttgataaccaatgcaagatgatattttgttgagatagtgtttttctccctacttttcttgccatagtatattatattctggatgaggcagtggggagggaaaaagtgggtgagatgaaatgtgaaaaacgggtatggggagataagccttagcttttaacttcattttgttggcacatgtctgttggcagtgcagtaacagttaacagtcttccttggaagcttgaacattttaagtcctaagaaatattgacagcactattacaagttgaataaaatagggaaaggcatcttgcacagctataaacctaagtacaagatgctggcatgtccatatagtttaaagtaagttgtttgaggccgggcacagtggcttatgcctgtaatcccagtactttgggagaccgaggcgggagggtcgcttgaggtgaggagttcaagaccagcctgcgcaacatggtgaaacccatctctacaaaaaatacaaaaattagccaggcatggtggcaggcgcctgtaatcccagctgcccaggaggctgaggtgagagaattgcttgaaactggggggcggaggctacagtgatccaagatcatgccactgcactccagcctaggcaacagagcgagactgtatctcaaaaaataaataaataaataaataaataaataaataaagttgttttattggttagcaagagtgactgtatattgttggtgagttgtttggtttggttggtttactttctaaagaagagagggcaaaaaaagaaagtgattggtatcaggtatctgcacactgaaaatttaggaataaaaaaagcatgcatagtctttgtcacctgaggtttagagaatttaggaacaaaacaaaacaaaatctgaataagatacaaggtaatatgattaatatggaccatgtattactgaagataacaatagtaaaaattgcaagcactctataatattgaccacatgccaagcatggttgtaagacttttacgtatttatttatttatttttttgagtcagagtctagctctgtcgcccaagctggagtgcagtggcttgatctcggctcactgcaacctctgcctcctgggttcaagcaattctcctgcctcagcctcccgagtagctgggattacaggtgcctgctaccatgcccagctaatttttgtatttttagtagagacagggtttcactgtgttgaccaggctggtctcgaactcctgacctcgtgatccacccacctcggcctcccaaagtgctgggattacaagcgtgagccactgcacccggcacttttacatattttaagtcaatcctcacaccatctctatgaggtaggtactattatcatctcattttacagatagaaaactgaggctcatagaaattaaggaacttggccaaggtcacacaaacaggaagtactagcaccaagattagaatccaagtcgtctcactatagaatctttccatttacctatgccactgtcaggagaaaatgataacaacaacaactaacatatagcacttgctatttaccaagaactattctaggaattttacatttaggaaccaatttaatcctcatagaaccctattaggaaagtactactatctcattttaaaatgacaaaactgaggcacagagaagttaagtaacttgcccaaggtcacaatgatagtgagaggtagaaccaagatttgaacccaggcagtgtgtaaccagagttaattattattatgtgtttttaagtgtaattattaattataacaatcattatcaagtattttgcagtaatgtcttaatggctaatcttctaaagtaatatccgtactgttaagtttagtctttgtacttttaaaatatataaacattttcaggaattgactatagtttatatcttccacccaggaaacaaatataacattttaacagaagaaaaaaagtaatattatgtaaaaagctgtgttaaaatagaatagtatcaacataatttagcaaacgaacttcataattagaatcaggaaaactggtcatgactgaggtcactctatcaggaggtaagcactagagtacagcatggcaatatgtgtttataggaagttatcattgaaaaggtgaagaagtcagtagaaaagttctgaaagtggctgggcatggtggctcacgcctgtaatcccagcactttgggaggctaaggtgggtggatcacgaggtcaagagttcgagaccaacctggctaatatggtgaaacaccgtctctactaaaaatacaaaaattagccaggcgtggtggtgcgcacctgtagtcccagctactcgggaggctgaggcagaagaatcgcttgaacccaggaggtggaagttgcagtgagccgagatctcaccactgcactccagcctgggtgacagagtgagactctgtctcaaaataaaaaaaaaaagaaaagttctgaaagttagctcctttatgtgcagggaggagtagtcggagaagaggccagaagagatagtaggggacaggggacagattgtgagctctctttctttcttttttttttttttttaattatactttaagttctggagtacacttgtagaatgtgcagttttgttacataggtatacacgtgccatggtagtttgctgcacccatcaacccatcatctatttctcctaatggtatctttctttcttttctgctatgccaagggtcttaatgctgaaagctatgggaagcccatgaatgtttataaactggaaaatgatgtacatagtcaggattcttagatcattttgtttttgttttgttttgtttttttgtttttgttttgtttttgtttgagacagggtctcactctgtcacccatgatggagtgcagtgccatgatctcagctcactgtaacctcccagccagaaaggtcattttgacagaagcagaaagaatgtattagaaggggaaagccctaagaaaatagaggttatgaggatattgtcatagtcctgacaagagatgatggtggcctgaactaatacagtgacagtgagatttaaaaagcaacaagaggtgtattagtcagagttcttttgagaaacagaactagtaagatgtgtgtgtacacaaacacatatacacacacagatttattttatggaattggctcaagtgattatagaagctggcaagtttaaaatctgcaaggcaggaggacaggctagagacccagaggaaagccaatgttacagttcaagtctgaaaactatctgctgcagaattctctcttgcttgggggatgtcggtgtttttgttctagtcaggccctcaactgattggatgaggcccactcacatcatgaggtacaaaccgctttacccaaagttcactgatttaaatgttgatctcatccaaaaacaccctcacagaaactaccaaaataatgtttgaccaaatatctggacattgtggcccagccaagttgacatataaaattaacgatcatgagagggtgttaaaggacagaattgacaggtgctgatgattgattggatgtgtaaatcaaaggaggcaagtgttaaagaagatggtatgcttcacagagaaagcaaactcaggaatagagcacattttctcaggagagttacaatgactaatatcattttaaacatgtttagttccaccttgtaaagatggaaaatgtctaagaagccattgtatatgtgattgtgaaactcaggaaagaagtctaaactaaccatatcggcttggggatcattggtttttatttgaacattaaagttacagtgtactagtttgccagggctgccataagaaaatgccacaagctaagtagcttagaacaacagatacatgttgtctgacagttctggaggctagaagtccaagatcaaggtgtcagcagggtcatgctccttttgaagagtctacggtaggatctgtgtcagacctctctcctagattctagtagttttctgctttgtcacagcataacttcaaccttcaaatggcattctccctgtgtgcatatctgtcttttcacatggtgtttattttataaaaataccagtgatattgaattaaaggcccaccctactttattttatttctttagagatggagtctcactctgtcacccaggctggaatacagagatgtgatcatagctcactgcagcctcaaactcctaggcagaagcaatcctcctccctcagcctcccatgtagctgggaatataggtgtatgctaacatgcccagctgctcttagttactgtttttttttcctaaaataaatattttagaacaatcacctcttaattacatagttcaacttatagcatgtgtgtttgaatgggatcaccacggtaaagtataaatcagaggttctgaaactatttgatctcagaacccatttacactaaaaatcattgaggaccccaaatgccttttgtttatctaagttgtttatattgacatttatcatcttagagttgaaactgagataattttaaaattatcgattgattcaattaaaataacaatagtaaaccttttcatgttaaaataaataaccttttaaatgaaaactacctatattttccaaaacaaaaaaagaattagaagagaaaaagaataatgtcataaatctcttcacagtctgacttaataagacagcttgattctcatacctacttttctattcaatctgattcaatatcattcttcatgtaacttctggaaaacttcacgatacactcaggaaagaatgagaaatagaaaggcaaaaaagtgtcagtattattatgaaaatagttttcaccttgcaaatccctgaaatgatctttcggggcctccaggagtcccccgccacactccagcattgctggagtgaacaatgaaaagagtaagtggttaaaaatggagcctatcggccgagtgcagaggctcacacctgtaatcccagcactttgggtggcctaggcgggtggatcatgaggtcaggagttcaagaccagcctggccaagatggtgaaaccccgtctctactaaaaatacaaaaattagctgggcatggtggcaggtgcctgtaatcccagctactcgggaggctgaggcagagaattgcttgaacccggggggcagaagttgcagtgagccgagatcacgccactgcactccagcctgggctacagagcgagactctgtctcaaaaaaaaaaaaaaaaaaaaaggagcctatccagttttgttctgagaatgtaatctttctcccacactacagcaattcctacgctcctccaagtgtttattaacctttcactgttctcctaaaaatgtgtctataacagacaaagaaagaagggcttattttgattgtgtctagttgttataggaccaacaagtttgtatgcctgctgcacagtaacagaccaataccctgagacaactgggatgcagcagagaaagacattaatgattgcagggcaccaagcaaagagatgggaggagaccctcaaatccatcccctcaaggagttctgggctgggatgtttaagtggatctcggagagtagggggctggaaaattggagtcattgattgaccagggcaagggggatgaaatcatcaggatgtggaaactgcattctttggtgagtcagcttcttgtgggatccttcagaccagctgacatcagtagtttcattggtacacagcactgaaagaatagctccaatggaaaacttaatgttttataatgttcaagttgttatctacacagcagttaaggggaactataatcttgtaacagggtctgtgtgattttgaagcaataagtaccgaacaactatgaggaagcaggtcaagccggtcagagagcaagctgacttaatgattaacactgaatcactgaatgtaccacaagcttggtttatctttttccctgctttctgtctttttttttttttttttttttttttttttgagacagggtctcactctgttgccaagactggagtgcagtggcgcagtcttgtctcgctacagtctctgcctcccgggctcaaacgatcctcccacgtcagcctccccagtaactgggaatataggcacacaccaccatgcccagctaatttttgtattttttgtaggtgtgtggtttcgccatgttgcccaggctggtcttgaactcctgagattaagcgatctgccttggcctcccaaagtactgggattataggcgtgagctactgtgcctggcctattttcttttcttttcttttcttttcttttttttgagatggagtcttgctctgttatcaaggctggagtgcagtgatgcaatctcagctcactacaacctctgcctcctgggttcaagtgattctcctgcctcagcctcccaagtagctgggattacaggcatgagccaccacgcccggccttggcctattttcatttctttctctcctttcttccctgattaatttttaaatttttatagggatggtttcatagtctgtatgtattttcatttgctaatatttagttaattaccttttcaaatgtcattgagaccgtaagataaatatccaaataagtttttatgcatatgctcagctgagtgatttgagcatgaaaaataaatttttaaaaattggatttattttttatgttttagtaccatagctctatttacgtatcagtcaaatagtaaactactgttaccttcttgactcatggcccatgtgttacaaatattattattatttattgtaatgttactttatacttggactatatgtgcctttgtacttataaatatgtttcaaaaacagatccttccattgcaagtgtgtagttttaattatgaaaatgaaaagatgcaggaaagaaagagtaagaataatagagttgggtgtctgtcaagatggagctcactgtctgagtttctcagagagtgtcttatgaaagatgctcttatcaactagatggaaggcagttgtgagccttctgagagctgggaggaatcatgatggagacatatcatatgtgaatccatggggcgtgaaagcctatggaagatgtgagtgaagtgtcatcagaaagtgatttatataactttaaatatgtccaattagaacattgtaatcttctcttccaccgaaagagagatgatatagaacatttcattgccattgcgaggtatgtaatatatagtacatagaggtatttcatgcatgggaccaaagatacataccattggaaccataggatcttacctgtaacaaaagtagagagttccctggataaagtaagtcacattggaaattacaaataactttttaaaaaagtgtacactttccgtaaagcttctatttcctatcaatgtagcaaaggacaaacacttctcccccaaccttttttttttaacacatctattgcttagtagatgtaacttagcaaaagtaaggtatctttatgtggcatgcaaaattatatacattcatcaaggagaaatatttgaggatttaattattcagaaaaataatagtataaagcaaacacaaagattatttctgtaatctacatttgatcaactgagctcagaattaagtaatgatatcatgaaaaccaagcagccagagaattatatctttcaagttaaatccataaaaaaataccatgtaccaaggctatattttgagagatttggagatcagaaggcaaatgccatgataagaaacagtttttttaattgtaaaggagaaaatagatatgattaaatattaaagagacaggcattttataaacattaagtggtattactaaaaatttaaattctgtgtgttcagaagtgaagatcagtcttagctctgctacctagctttatgacctagttctgttgccttatctcttcatgcctcagttacctcatgtgtaatataggataatgacattcacctcttatagttttagtgaagattaagtgagataattaagtacagtacaaaacacaggacctagaatatacttgctgctgctgacacgatgaaagagtcatttttatgcttcttgaagaatctagtaaaaactcaagaaatagtctccacccttaagaagttttcatttttgtcagagaaataaaataaaggtgacctagcaaacattaaactgtgtgctgatacataatagagattatttgctctttaactctatctaaaaagggaaatcagtgaggtctggtaaaattacataaagtttcatggagaaggctaaatacagcctctgaacataccagtcaagctagaccctgaaggatgggtaacatttggctgagcagaggtgaaactatccaagtaaaagggaataacatcagcagtagtgcacgtcagcacataaggcagcatgctttatgtaggatatgtgtatagcccacaggaaaatacatcaaaacgattaagagaatgggtcctaagttcaagtcccagcaccacagtttgctagccatataatctctgacaaggtgtttcatctttctgtgcctcaattttttcttctgtaaaaccagagactggtgttatttatactgtagtctgtttattgattatacgttaatggcatttggcctattaccagtccctgatagttaaatgttcagtcagtattttctgttggtgtcgttttagtgaagggtttgatttggaaaattgttggaaaggtaggatggagccgggctgtgaaagagccttccaagtcaggcaggggagttgtggcatgatgaggtaggagagctaaggtcattatgggaattcatttagggattttcaagaagtaagccagaagcacaagaaaggagaggagactacaaggaggatgtagctggaaaagaacagtgaaaggtgatgaaaagggagtgagctcatacctgattctctcttcaaaggagtttaaacctgaagcagtttgagaagatggtaacaggaaggaaaaaatttcataaaggagattttaaaagcagttggaagttgcaagcaacagattgactgatgagcaagagacatctttttaaaagaacagcacagttttaccagtagataattatatattgatatattttggcacattaggctatttgatccatccaatcaacgtttattgcaccattttccaaataattataattagagcatgcacagtaatataccacttatttaaatgtaaaattgagaaagctaatttaaatgcaacaaaaatatgctaagtcaacaaatgtactctaaaatgcgtgcaacagtatgcaaactatgtaaagtacttggtctaatctatgttctccaatgtttggctatattgatatagaggataattatgttagggaccactaaaaaaaagattaattagttctgtaggtagaagagaaaaagcttaccaaatatttgtaaataaatctctttcttttcatgtttatggaagtcagcaaattaactgcaaaatcttagaggaagcaataggaaaaagtatgttaaaatgggtattttgaaattgcaaactataagcatgattcttatgcaaatattaatttaatcaggaagagttttactcctccttgtataagattatatggaaatcagaattgcctgtttacttctagtgtcatgataaagaatgaggtaccttagatttgatgaaaaatcagtcttcagagagttgatgagcagttttgccaaataaacctaaacatttaaactctggttgatagcaattttgtttttatctgttttcctagttgtaaaataattacatcttataagtgaataaactcatttcacattatattattttgatctgaataggtcaatttatgtttcttactgtcataccccagacattaaattatagtcaccaaaattatagattagaaaactcacaaataatggaattgattcaagtagcagtaaatcacctccaataatataaattaatgaggcaatatcggtactatcgttccggcatatttttacaactgctaataaacagctcatagatgctaatacaaagtaaaacaagtttgtatgcttggtggacctagaaaacagtctttggcctagcaaagccttacctatgaagagaaaaagtgtatctggctgatactatgtttactttaagttacctagtttcctaccttagcaaagatttcaagaaatctatgtttatataaagatcagaatttttttctctttgttctctagatttgatttttcagtgaaaatttgggttttgtttccccagataaaattattcagtacagtaaagacttacccaggtctttggagcttctcacacattaagatgtttagtatgaattcgtgactttgttattttaatgaaatatctttaggtccatgttaaggcaatatcgtgtcatgctgctgccattcagtcaacatttgttgaatttctaagttcaagcattgggataaaagatattgagatgcaaagaggaggagctcccattgtagcaatcatcaaatgataaaccacaccctgctggttgaatctgctgatccccagtgacatgtaatctgtcagatctctccatcattggtttagcctgtgattgaaatgagtttacccctcttgcctttggagccagacaaaaccagttcacatcatggccctgctccctacatggtgtatccttgaacaactcatctaacctctctgatcctcgaggacagagaaaacaacagcatcaacctcgtaggattttcataagaagtaaatgagaggatacatgtaaatctcttagtacttgcctggcacatggttagcatgtaataagtgttaaatgttatccctttgataataataattatttagtgaacatatcaaggaaaattatcaatggcaataatcattacaataagatcttgattgactagcctaaaagaagtggagttttgattaatctgactttataattatatagaaagctgtttatgcatcagtctttatcatctgaaatctttctcaactctttgtacaactctcctcgcactctcccaaccacctccgcccacaaaaaaattttggctttacatgttacacaggtgaaaatgtgcagcagcatgtggcacatagatataattttggacatgtagccagcacacaatatacatttactggtagatcattaggatttcgttattgtctctgggccattattcagagcatcagtgatcagtatacactagcattggagcatgtgctttatctgtactatttccagaatacactctagattaattgaagattctagttattttttcctgtagcctatttgagccacttatcactagtaattttttttttctgaccccatactaaaataattacatttctggcttcagttctcgggaaataagtgctaaactctcattctatctgccttagcagtaaaacaaatttctacatctactaaaaatattcttttaaatgagagacaaaaataaatatgtgaaacaagataggtaatatactttagatctcattaagagttcttacattctaaatgcagaaactcagatttgcaaaaactgtaagagctgtcttcagtgtgctgaacatttaacaagatttcatcaatttgtatgtagaagatgagtaacactggcagttacaaatttggcttttctctacaatatatgcttgttgctatatatgatttatgcaactttactaggcagaaatctatgaaaatattagagcaggtaagtgaaaacaataaaactgactatataagaaattaccaaaacacattgtaggtggcctaatcatttattaaaaacatgctttgttccatattttaatattctaattcttattacagaaaagtgtcaaatgaataacagctgttatacagcaacattgcaattaattttgctctgttctcagtcaaatgcacttagattcatgtcagtaattacacctaacagattcacagaaccaacaaactgcactgaacccaactgagtctctaatgacttttttttaaattatatttggtccacccacattgaattcccgagcccctgggctgctttagaatcaggacaaaatctactgttacacttggccgggcgcagtggctcacacctgtaatcccggcactttgggaggctgaggcgggcagatcatctgaggtcaggagttcgagaccagcctggccaacatggtgaaaccccgtctctactaaaactacaaaaattagctgggtatggtggcggatgcctgtaatcccagctactcgagaggctgaggcaggagaattgcttgaacccgggtactccagtctgggcgacagagtgagactctgtctaaaaaaaataaataaataaattccgttgttacactgaatgtgcaaaaggattatggacaaaaacctttcagtgattgttaatttaattccacaagtatttattcagtgcctacagtgtgctgatctgtggtgacatatcctaatcaaagtatgattgactgataacttagcactattaacctatttcaggggttattaactatcagcctttctccctctcttatgtgtgtctgttctgtaagaaataatggttgttgcttcatgtagtcccataggtgtatgtatatactcacacaggaccgtatgtagcatataatatttttcacatatcatatataatctcttaaaatcatctatatttctttttttataaatagtcaatcctcagtcctctgttacacccctcacacatgaacaacctataaagtatatagtatcttaacttgttagtgggataaaatggaaaagaagacatcgtttaagaaagcaattatacctttgtcacaatggtattaggaagacattaaaacctaaacttagaatacctgcttgtcatatatatcaacagtaggtttcatatgctatttcgtaacagcttagaagatgatggtatgattcatttgaaaatcaaaaaataattatccttttaaatgtgcaattaactatggatggcataatacttttatttgtttgaaccagcactggaatctactttaaatgtactttaaaaaaaaaaattctttttgtcagactagatatttcagagctcctgtatttgatttagccttttctatttgctgagccctggagaaagttgcgtaggaattatttggggcatcattaaataggatggatgcatataggtctaggaagactcaggcatagccctgctgaggattggacagggtccaggaggttccttttacatccgtgtggttctgtggtataagataaccacattctcagagtatgctggtttaggctgtgttgtaatctgtaaatcatagtgtcttgttttgtttgtctctttagtcccatatttttataatgtaatccctaccccaattttttagctaataattttacgcagttgagtgtttgaagttgaagaagttttccaaatttcctgttgatctcaccaatatctacacattcttggttgagtcactaccttgtctgattttctagaacagtatttctgtgaaaggaaaatgtgttccctctagtcctcttttgtcaaaaaccctttgcacttgctttcttttgccaattgaaccttttttgaaatgcatcagtagggagagcttgcctagcctttgctagacaggagtagctgtaggtgcatttaaacaatccaacttgaaaaggggatttctctctttctatttgaaaacaattgaaaatgaaaagtgtatgtctcaggacagagtgcttaaccgacctcattctactgaacttcagcatggtatatgaaactacctcccctgtgtcttccccagtgttttaaaaagatgcttaacttgtttgaggcaactggttctgagtcagagctctctatccagcatcaccagaatccattatgttgttaggtcttgttataccgttctttgcatctcttttttcttcactcaaatagtcaatacagctttgttctaagggctatctgatcatgttttgaggggaaatcgagattgagctatagagatgaactatggttacattaacctttaaatgtaaccacattccttcccccacagtacattcacatgcagcctgtacttttaagtaatcctgtaagctcctgtggctaaagcatgttgaaagtatctattttcaactgagtaaccctgacagtagatgaaacctccaaaagatacctccctcctcaagggtggaagtgggggtaggggcaatggttggcagtgcagttttcagcctattctccctcatcctctctctttttttaagaccctagaggagcaaggtaaacatctttataaggaaatgtatgagttagctcttttaaaaccacagataagtataatcttaggaaaagagatcatgtgccctagactttagtagttaacatttcttctgaaggatgtgattttttttttttttttttgtgatggagtcttgctctgtctcccaggctggagtgcaatggtgcgacctcagctcactgcaacctccgcctcccgggttcaagcaattccaattctctgcctcagcctcctgagtagctgggattacaggcacccaccaccacgcctggctaatttttgtatttttagtagagacggggtttcaccatcttggccaggctggtcttgaactgctgaccacatgatccacctgcctcggcctcccaaagtctggtattataggcgtgagccattgcacccggccggatgtgattttttttaaagacaaagtaactaaagactaattgatgctgacataccaaagtaaaaccagaagtctgtattgaggagccatctcaaaaatttactttaagacagtatgtcttaaagaaaaaaatgtattatttaaatggaaagtaggaccatatgccaggttttgtttgttttgtttgttgtcatatttttgttgttgtttgagatgggacataagagactagttgcttgtctcacagatatggtagggaaaggaaaccttttggtggaagttagccatctcttcaatctctgatattcaaggagtacccagttttggttcaccaaatgtaagtcctttgttataagcatcctcttttatgttggtttgtttggcctgtagacagtttctgaaactaatttcttatttgcatgtaatgctttcatataatattcatctgtaaaaccatttggatttttcgagttgatacatttttatcattctgctgcacctctctcccctccttctttgggcttgttgcactgtcatgctcctcctgatgcattgcttcctggtgggtgacatcatgatttgtgagcaacccgatatataaataaggtggtgagaactgcctcagcaattcagtttctatttgaaaggcattaagcagcctctttctgttttcttacatttttctctactttgtgttttcacagttttattaggcactgtagaaggacctgtttttctctttcattacatttctgaaaatcattaggttgattcaaaatcttttggaaatgtaatgcccccttatgctataatatacctctcatactgtatacattttggtcacacccagatgtggagtttagcaataactaacaactactaatttttaggagcatcctaggaatacagatgctttcagcagtatgtttttattttcactgatattaaaggagtatttatcttagaagagtggtaggaaagcacacatgaatttggaccttaatccttgactatgtagacattgaatattcataggtgttttgtgtgctatggtaggtgtggaaatatatgtgagatcaatatcacttcacctcaatatcttcaaaagtgaatatggatatggttttgttagctgaactcattagcaaagatgccttttaaaaatagcaaaggttacagtatatataatgtatgtgtgaatatccacatattattagatagattccaacatgagtatttgtatgtgtttctgttaacaatataatttactatcacagcttatttttcaaaattccattgaagtataaagctggttagaaagatatacggcatctttttctttttttcagctctcctaaggtataattgacaaataaattgtacatattgacagtgtactatgtgatgttttgacatatgtatacattgtgaaatgattaaatcaatctaattaacatattcatcacctcatatacttttttggtggtgagaacattttagatctactctctgagcaattttttagggtacaatacagtattattaactataaccaccatgctgtacaatcagtctccagaacttattcatcctgtctaactggaactttgtactctttaaccaacatctgcccatctcttcccccagctgttggcaaccaccactctttctgcttttatgagattgacttttttagattgcacatctaagtgagatcatgcagtatttgtttttgtgtaaacaagcatacagtattgatgtcaaggtcttgtattacccaccttagaacaagacagtaggatcattatttttattcagttaatgttcatttatacttacccacatattattcatttttttttttttttttagacaagggagtctcactgtgttgctcaggctggccacgaactcctgggctcaagtgatcctcctgcgtcagcctccccactagctaggattacaggagtataccatggccctagctccacattttactcttcattcttttttagcatttcagagcatccatctggaattaactctttttgcctgaaatactctttcctttgggcaatgatagcaaagtatttgggcagagcttcttcaggaactttctgagtcaagtcagacccaagccttgtcccacccctcccccaaggcatgggacctttgcccttcttgttaacctcctatgatctttcattcctattgtcccatctcactaacagtgttcctcgtgtgttctgactcatcactttagctgattctctctcatcccttagtttacctggtttcattttctgatttagggccttgcatagtctgattgattagtctcagtttcaagtcataacctccttgctttctcgaggttcatccagccccactcccctcaccccaccccttgttaattagcaggccaatgtactaccatctttcagcctgagtttcttctgaaagaacactgctgttctctgttgatactgtagcatcttggcaggtgcctcaggaaccctgctactgtgggtttagtacttcagattcttgccatgctgcagcttcagcataacctgggaactggttagaaatgcaaagtttctggcttcactctaaacccactgaataagaaactgggtgggggtaaggggacagcaatccattttctaacaacctccctaggtgattctgatgtacactaaagtttaagaaccctagagcccaatgactcatcttatttcacaagtgtggcaactgagttactccaggtccataaagccagtttagtgctaaacagtagagccaggagtagcctacttcagcccaccaccttgtctactaggcttctctatgttacttgtgctgaacattgtttttagttaaatattagaactgagtcatgacattgctgtacatttgcaaatgagaggcttgtcctctaagctttgcattccttctgccagtgacagtatcagtcagaatcaagtagttctcagtgacaaagtgggaggatacccttggcattggactctttacagggaactcagtagagtctttgtgttgttcattatggctttggttgatgtataatatattgccatgttcttaaaactaaaacatgctagaataaactcaacaagtgataaggaatgatcatttgcatcgtgtgtgtgtgtgtgtgtgtgtgtgtgtgtagatgtattaatatttagtttgtaaaatgaattaccagagaatttcttaagtagcaatgtccctgtatattaaaatgtaactctttgaaagtgggaaggaggtagataatgagttggataactgttcaggaacacatctactgaagagcacatttacattctcttagttcctaatatagtattagtatacttattcaataattgtccttgtttgtatgtactttagaacattttgttcacccttgctggatgttctcatatcttctttagataacaagtaaacatgtctgagagtttccatttgttttagtttgacatctttgccctataaaccctcatgtatctgaactttagaggaaaggaaatctgaagctactatttcaatcttttctgctttcaattttatttttaacaaccaaacagttctttctgatgataaggaatcagagcattgagaccattttcttactaaatcatgcttatgtggatggaaaaagttagtgcagcctctaacggaagtgacttaaccagtgggaaattcttcctttatatgattttataaatacaaaagtaaaatcgcattaagaaattatcaggaatagtaactactgcataattttgaagaccctgtaatctttcagatgttataagaaacttgtgaaaaatggacaaccaagatagtttatgatgttacagatgagttttgttttaccataactggctacataatttgtggagctccttgcaaaatgaaaatgtgggacctcttgttcaaagattattcagaatttcaagatggcagcagcagagcagtaaaccaagtgtgaggcccttctgagagcagggccctatgtgactgctcaagttgcacacccatgaaacctctgtggtttacctaattgagacagttaatgagagaagcaaaatgtgcaccactttgttcctggaataaaatgaatgttttgacttgaataaaagtgagaatcttttaacaaaaagccacttctacaaaaggctcttcctgtaagtgacctcttttattcatttcaaaatgtctttttctatcaattccagcatgatctttgtcacaaataaaaaagggagctttccccatgagaatttctgtcaagaaacaatcttcttcaactctcttctgatatgtgaagaaatagttcttatctctcttaaagtaggtttgaaccttattctctgatgaatactttacatactctaagcaaacagcttcaaatttctcacagattttgccgatgagattcccatttctcttttttagtccctaatgactgaaggtatcgtatctagggatagtttacaccacattctctataagtaatgtaataggacttatagcatttcattttgcagcatatctttgggtctgtttgcacttaatgtggagttcgctttgagtaatatcagtcctttgaatttgttttatgtgatttggtttttataaaacattaggatgctctctagattatccagcccagttccctgcctctaggtgtacctgaatgtaactctgtaagacaaatggttatacagtaagtttctaaatgtcccaggaaaacaaaaatgtaatggtacagataatcctttttttttttttttgagacagacttttgctcttattgcccaggctggagtgcaatggctcaatcttggctcaccacaacctctgcctccctgggttcaagcgattctcctgtcttagcctcccgtgtagctgggattacaggcatgcaccaccacgcctagctaattttgtatttttagtagagacagggtttctccatgttggtcaggctggtctcgaactcccgacctcaggtgatctgccagtctcagcctcacaaagtgctgggattacaggcatgagccaccacgcctggcctcagataatccctatatagtgagggatgttcagggaaataccagctgtacttgtattcctggcaagttccattattcttgaatgtaatcattattctttttttaattgcagttatttgatgtgtcttattcctttacttcagtgaaagttttatttgtaaacctaaccttatttatattcttggccgagaaaatagaaagcagacttttctacccagtatagtccactgtgtaaaactcttgaaaactttctcatcacatttgtcagctgtctctgatacatagacagacctgagttaatgattgttattgtttacatttcttttttctttaatgaaaaactattgaattattcagtttttattaaaagttcaatgatttttatatttcagatgctctttagtattcaatatattcacagcatactccaagtctccctcactggtccactggttctaatatttactagaataattttatttaccatatgcttgtgtcatattggaaatgttaggggaaaaattgaattttgaatgtgaaaggtcctttcttcttttatcaaaaggaaaaaaatgcattctctgacattaataaaagtcatgctgacgttctcttacaagaaactcactaaaatgacaaagagcatgaaaaaatgtaattaggtgtttgagctgagttggttggtttgttctcctacctgataaattctaatacacagaaataaaattccagttaatgagaaagtgcaaacatggcagatatatcgatattctagataatattgtcattatttcatgtgcttacgatagaaaaaaataaatttgacttttttgcaaatattgctgggttttcctctgaaaagcactataatgagtggatttatttattcaattctcagtgagttactggctgaatcaaggttttggaaaaataaacatgtattctctatctctaagtatattaactaatctataaaggcttgacattcattaatgcttgctgagggaaaaaatgagttctagagattgtgttttgctcagtactgcataacttactttcacaagctctgcttaagctttgatttctaaatctctccccagtgaaatcatacctcaaagatgtttcattaaaatgacaagataagctccctcgcatccctatgctggagtgggggcaagggacagagttttgggagatcttgcaaaacggttcctaagctttagggaaagaagtgcaaattattgacttcagtgaaaaattgacaacatctccatggtgaagacagtagccaaaagggtgggccaactgtgtgccaagcctccgcttgtcttgatcttgttctcatggttgtgctgatgactcatgggggttggatttgtgtaatgtaggaaccattagaaaatccatgcttttcaagtaatgcattttagaaaaatatttttaaatgcatattttcattgtcataacctgcattgtacaatcttccacttttcgttccctacctcttttctatttggaaatattttctcagagtgttggtagtagttcacatggcttaattatgtctctaaatattagttcaaaccatatgaaattgttgccatttgactgttttttgcctacaaaatgacaatgtaatatggttcaatctaataagaaatatataattcccaaacagaaaggtaatatcctagtattacttaatcactttttgttgtggatgaaactcagattctaccttagttgatcattttctggctgtgagataattttctcacagattgttggcattgaaagagaactcttaaataggaaaaccctctccctgggcatccagggccaccctggaaaacaagccttaatgaagtcacctgatcagtaacctggtctcctgtggatatagttctcctgtttgcattgtacatctttagggaaaaaatgcagtatagttggttaatttatcagtctttatttttgttccagtgaaacaaaatgccctggccattctaattagatcaagagtcactgtgatgtctttgatagagctgggtgttaacaaggtttttctcagctaccagttttcaaattgttttttaaaaatggatgattaatccatccagcacttgttgatttctcccggtttgactctgaggtggaagtgacatcttcctcactttactacccaattcagagtgtaccttaaaatagcttcctctaaactggatataaagatgtcagcaatgtgtagattctctaaatatgcttttccttctttgttcaagacagtgctaatgtgagtgcttagttactaaaacaaatataatgacatttttaaagcctcacacagttggataattgctttaaagaaatcatggtacatttttttacttcctcttcctgaaatagaaatcatagtcctattgaagacccaggattccatacgtcgtaagagtataagtagtgtattccttttaaaggatggggataaatttcccctatactaaaaatcaccagctgccgtagaagtgctgagtgaaaaatggttcttatcatttctttgtggactgcaatttccccctgttgatataggctataaataggaaataaacagccttgaatgaaatcagatatagtatgcaaagatttcactgatgagtttaggtgagcaactcataaaaagaacaaaatattgcctggtcctaaatctttgccaaggaacctttagtaacctccttgctctcaaccattttggcaaataccactttttaactccattttttggagagtaacagatatttgtttttgaatttttttttacataaaaaagagtaaaaataattaagaatattaaaaattatgactgttacacgaacaagcaaaataaacatagtcttgaatatcttttaatataattagcagtttctccctttatgacatttatctgagataatttatcagcatttggactatactaaaatgaattgcttttctaaacagtagaaacttggcttctgtaaatacctgatccatgccgaaagtataatgtagaagtaggcttttctattaactattgtttgaagaaccaaaagtctatagtatttttctgtgttcttcagatatattacatatcaaacaagtaaagatttttaaagaatatttcattttactttattagcaaataattctctttatgattattattactggccatgaattcttttaatctccaaattagcccacatagaggaaaaaaaaaactacacaatttgcctatttggaagataccttacaattctctcttttacatagtgctatctattgagtaagtgcccagtggttatgcattgatagtttgaaagagttaattggaaactacgtaggagtttgctgaaagcatgattgaagcagtgatgatgaactgtatctaagtttgccctgctttcctctctggagcccactgttccaagaagagacatagttaaaaacaaatttgaaattgtaaatcttttctagttaatcccaagcaagaaattaagtgcctatttgcaagtctggctctgaccatacctctattcattttactaaaatataatgatatttgcagacagtagtgacacaacagtaactagatggcaacatagtaacttcataaaatagcatatgatataaatcatggaagtttttgaattaaaaatatcaaagaactgcaaaggtcaagtagacacatcaacttaaagcacttatgaagttaagctctaaggaatgacagtcttttaatgccactattttctctggttttaccagctttggggaggttatttaagcataatttttattcatgactttattttaaaagaaccacatgatgttcagaaattgatataattatatctctgaggtattggtgcagaattttgtaattctataccattttcttacaagtgatcaactctcatgtaattcaatggcatccatattatttattcagtaatctgtaattatagatttcctctaatgaagcaccctatgctttattgccctgggttctcaggagctctgtgggtgtcaattttagaaaatttgaaattgggaaagctatattttcccagatgaacattataaagtaatgaagaggttagtaagtgttgccttgattgtttgaaacaccaaaaggcaataccacccaatatacaattatcatattacttttagtataccatcttctttttttaatttaaaggttagattcaattaaatggtagtagcagtatgttaaatttactgtgagtatatgccttaggaagttatttatctatttattttgaagttaatttttttctattggagaacaacttctcttttacgaagtaaagtatgtaattaaggtctacctgaattttaattattagaacagaatattattaatatgtatttataaaaattgtctaaattacctgaatttagaacatttaagtttctaaagcactcattccctcatttgattccttgaatagatctggtgagctaaagtatatttatgtggtagtctttctaaaagcaatattcatttaaacttggcaagtgtaaagtatctaggcttggtattttttcttttgctattttttagaatttatgtgtatcttttctttccaaaattaagcacatgagggaagatgtataggtgtgaacactcaaggtatgtacaaaatgataaagacaagtagcctaacggggagttgaagaagccaaagaaaaatttttggaagcaacttataaaaccattgtagattggattggatctgatacacattgaatcttagaaaagaggatgatgttattaaacttatagtttagtaatgggagagactagaaacagggaattcaacaagttaatccatgtagtagtaatccaggttaagggttgagtgataatgttggagaggaaactctgattatgaaatattttgcctgtgaagaagtggtatagctgagtcatgttttaaatttggagatgaaagaatgtcaaagaccatgcatagattccaagcctggggaataatcagaaatgaaaaaattgggataagaagtcattaggggtatggttgggtggggaatttgtccacgattaaataagtcttagacatgctaaatctcagatgatgggaaatcttgtaaataacattgtttgagggtagctgataatttagacctgaaatgggactgagcatgaatagtgaggatgtggattccattccaagatggccaaataggaacagctgcagtctgcagctcctagagtgatcgacacagaagatggtgatttctgtgtttccaactgaggtacctggttcatctcactgggactggttagacagtgggtgcagcccacagagtgcgagccgaagcagggcagggcatcacctcacccgggaagcacaaggggtcagaggatttccctttcctagccaaaggaagccatgacagactgtacctggaaaatcgggacactcccaccgaaatactgagcttttccaatagtcttagcaaatggcacaccaggagattatatcccgtgcctggctcagcgggccccacgctcacggagccttgcttactgctagcacagcagtctgagattgacctgcaaggcagcagcctggcagggggtgaggtgtccaccattgctgaggcttgagtagataaacaaagtggctggggaagctcgaactgggcggagcccacctcagctctgcaaggcatgctgcctctgtagaccccaactctgggggcagggcatagctgaacaaaaggcatcagaaacttctgcagacttaaacatccctgtctgacagctctggagagagcagtggttctcccagcacagtgtttgagctctgagaacagactgcctcctcaagtgggtccctgacccccgtgtagcctaactgggagacacctcccagtttgggcctactgacacctcatacaggcgagtgaccctctgggatgaagcttccagaggaaggatcaggcagcaatatttgctgttctgcagtgtttgctgttctgcaatatttgctgttctgcagcctctgctggtgatacccaggcaaacagggtctggagtggacttccagcagactccaccagagctgcagctgagggacctgactcgtagaaggaaaactaacaaacagaaaggaatagcatcaacatcaataaaaaggacatccacaccaaaaccgaatctgtaggtcaccagcgtcaatgaccaaatgtagagaaaaccacaaagatggggagaaaccagagcagaaaaggtgaaaattctaaaaatcagagcacctcttctcctccaaaggattacaggtcctctccagcaacgaaacaaagctggacagagaatgactttgacgagctgacagaagtagggttcagaaggtcagtaataacaaacttctccgagctaaaggaggatgttcaaacccattgcaaggaagctaaaaatgttggaagaagattagacgaatggctaactagaataaacagtgtagagaagacacctgatggagctgaaaaccatggcatgagaactacgtgatgcatgcacaagcttcaatagatgattcaatgaagtggaagaaaggctatcagtgattgaagatcaaattaatgaaataaagcgagaggagaagttcaaagaaaaaagagtaaaaagaaatgaacaaagcctccaaaaaatatgggactatgtgaaaaggcgaaatctacatttgattggtgtacctgaaagtgacggggagaatggaaccaagttggaaaacactctgcaggatattatccaggagaacctccccaacctagcaaggcaggccaacatccaaattcaggaaaaacagagaccgccacaaagatactcctcaagaagagcaaccccaggacacataattgtcagattcaccaaggttgaaatgaaggaaaaaatgctaagggcagccagagagaaaggtcgggttacccacaaagggaagcccatcagactaacagcagatctctcagcagaaactacaagccagaagagagtgggggccaatattcaacattcttaaagaaaagaattttcaacttagaatttcatatccagccaaactaagcttcataagtgaaggacaaataaaatcctttacagacaaacaaatgctgagagattgtgtcaccaccagcctgccttacaagagctcttgaaggaagcactaagcatggaaaggaacaactggtaccagccactgcaaaaacatgccaaattgtaaagaccatcgaggctaggaagaaactgcatcaactaacaggcaaaataaccagctaacatcataatgacaggatcaaattcacaaataacaatattaagcttaaatgcaaataggctaaatgccccaattaaaagacacagactggcaagttgaataaagagtcaagacccatcagtgtgctatattcaggagacacatctgatgtgcagagacacacataggctcaaaataaagggacagaggaagatctaccaaacaaatggaaagcaacgaaaagcaggggttgcaatcctagtctctgataaaacagactttaaaccaacaaagatcaaaagagacaaagaaggctgtgacatactggtaaagggatcaattcaacaagaagagctgactatcctaaatatatatgcacccaatacaggagcacccagattcataaagcaagtccttagagacctaagaagagacttagactcccacacaataataatgggagactttaacaccccactgtcaatattagacagatcaatgagacagaaggttaacaaagatatccaggacttgaactcagctctgcaccaagcagacctaatagacatctacagtactctccacccgaaatcaacagaatatgcattcttctcagcaccacatcacacttattccaaaattgaccacatagttggaagtaaagcactcctcagcaaatgtaaaagaacagaaatcacaacaaactgtctctcagaccacagtgcaatcaaattagtactcaggattaagaaactcactcaaaaccacacaactacatggaaactgaacaacctgctcctgaatgactactgggtacataacgaaatgaaggcagagataaagatgttctttgaaaccagtgagaacaaaggcacaacatacaagaatctctgggacacatttaaagcagcatgtagaggaaaatttatagcactaaatgcccacaagagaaagcaggaaacatctaaaatcaacaccctaacatcacaattaaaagaactagagaagcaagaggaaacaaattcaaaagccagcacaagacaagaaataactaagatcagagcagaactgaaggagatagagacacaaaaaacccttcaaaaaatcaatgaatccaggagctggttttttgaaattatcaacaaaattgatagaccactagcaagactaataaagaagaaaagagagaagaatcaaatggacacaataaaaaatgataaagggggtattaccactgatcccacagaaatacaaactaccatcagagaatactataaacacctctatgcaaataaactagaaaatctagaagaaatggataaattcctggacacatacaccatcccaagactaaaccaggaagaagttgaatctctgaatagaccaataacaggctctgaaattgaggcaataattaatagcctaccaacaaagaaaaagtccaggaccagacggatttgcagctgaattctaccagaagtacaaagaggagctggtaccattccttctgaaactattccaatcaatagaaaaagagggaatcctccctaactcattttatgaggccagcatcatcctgataccaaagcctggcagagacacaaccaaaaaagagaattttagaccaatatccctgatgaacatcgatgtgaaaatcctcaataaaatagtggtaaaccgaatccagcagcacaccaaaaagcttatccatcatgatcaagttggcttcatccctgggatgcaaggctggttcaatatatgcaaatcaatgaacataatccatcacataaacagaaccaaaaacaaaaaccacatgattatctcagtggttgcagaaaaggccttcgacagaattctacaacccttcatgctaaaaactctcaataaactaggtattgatggaacatatctcaaaataataagagctatttatgacaaacccacagccaacatcatactgaatgggcaaactggaagcattccctttgaaaactggcacaagacagggatgccctctctcaccactcctattcaacatagtgttggaagttctggccagggcaatcagacgagaaagaaaaaaggggtattcaattaggaaaagaggaagtcaaattgtccctgtttgcagatgacatgattgtatatttagaaaatcccatcatctcactcaaatctccataagctgataatcaacttcagcaaagtttcaggatagaaaatcaatgtgcaaaaatcacaagcattcctatacacaaataacagacaaacagagagccaaatcatgagtgaactcccattcacaattgctacaaagacaataaaatacctagggatccaacttacaagggatgtgaaggacatcttcaaggaggactacaaaccaccactcaacgaaatagaagaggacacaaacaaatagaagaagaatattccatgctcatggataggaagattaatattgtgaaaatggccatactgcccaaggtaatttatagattcagtgccatccccatcaaactaccaatgacttccttcacagaattggaaaaaactattttacagttcacatggaaccaaaaaaagagcccgcattgtcaagacaatcctaagccaaaagaacaaagctggaggcatcacactacctgacttcaacctatactacaaggctacagtaaccaaaacagcatggtactggtaccaaaacagagagatagcccaatagaacataacagaggcatcagaaataatactacacatctacaaccatctgatctttgacaaacctgacagtaacaagaaatggggaaaggattccctatttaataaatggtgctgggaaaactggctagccatatgtagaaagctgaaactgtccaggcatggtggctgacgcctataatcccagcacttttggaggccaaggcaggtggatcacgagttcaggagatcaagaccatcctggctaacatggtgaaaccctgtctctactaaaaatataaaaaattagccgggcatggtggtgggcgcctgtagtcccagctacttgggaggctgaggcaggagaatggtgtgaacccaggaggcagagcttcttgcagtgagtgggagatcacgccactgtactccagcctgggcgacagagcaagactctgtctcaaaaaaaaaaaaaaaaaagctgaaactggatcccttccttacaccttatacaaaaattaatcaagatggattaaagatttaagtgttagacataaagccataaaaaccctagaagaaaacctaggcaataccattcaggacatgggcatgggcaaggatttcatgactaaaacaccaaaagcaatggcaacaaaagccaaatgggatctaattaaactaaagtgcttccgcacagcaaaagaaaccaccatcagagtgaacaggcaagctacagaatgggagaaaattttcacaatctacccatctgacaaagggctaacatccagaatctacaaagaccttacacaaatttacaagaaaaaaacaaccccatcaaaaagtgggcaaaggatatgaacaaacagttctcaaaagaagacatttatgcagccaaaagacacatgaaaaaatgctcatcatcactggccatcagagaaatgcaaatcagaaccacagtgagataccgtctcacaccagttagaatggcgatcattaaaaagtcaggaaccaacagatactggagaggatgtggagaaataggaacgcttttacattgttggtgagagtataaactagttcaaccattgtggaagacagtgtggcgattcctcaaggatctagaactagaaataccatttgacccagccatcccattactgggtatataaccaaaggattataaatcatgctactataaagacacatgcacacgtttgtttattgcagcactattcacaatagcaaaaacttggaaccaacccaaatgtccatcaacgatagactggattaagaaaatgtggcacatattcaccatgaaatactatgcagccataaaaaacgatgagttcttgtcctttgtagggacatggatgaagctgggaaccatcattctgagcaaagtatcacagggacagaaaaccaaacaccgcatgttctcactcataggtgggaatctaacaatgagatcacttggacacagggcagggaacatcacacatgggggcgtgttgtggggtggggggcagggggagggatagcattaggagaaatacctaatgtaaatgacgagttaatggatgcagcaaaccaacatggcacatgtatacctatgtaacaagcctgcatgtcgtgcacatgtaccctagaacttaaagtataattaagaaaaaaaaatagtgaggatgtgaattaagacatcaccaccatggacaggaactagaagctttgaaactgagataacttcccagaatccaagaaagcaatggccacagactatccagtgacaccttggcctgttttctgaataattatctttcagcagcttgtttcagttttatcaacagacagaagtaagtctgctaagagcacaaatatattctagttaattgagaaagaatccagagtcagactggctatttcctggagcagattattgaactgcccttaagaaattattgagggatttagatcaaggcttaaaggtaaatccttcccccttccatcttgttacatcaaatgtaaattacaatattgagttatgataatccatatcagaagcatataccttcagctgtttttctgaagcttgtgacaagagacaggcttttatacattgctgaccatgttttgtaccatgtcatcctccactactttcacattagacaagaggttgattcttgacccaaagacagcctactttggctgctctactttgtaaaagatagcctgtaatatacacctcttccaaaaggctgttctgtgctggttgaatcaatttgattatttttcttagggagtttggactcaaagacacaaagatagaaaattagttggtaaatggcagaagagaaaattaaaacagatactaagagttaggtgtacatgagtagagctcatgagtaggggagaatggacaccaagatactaaagtcgtaacattaatgagtcactaggactattgtgcctggagggagagttgtggttatatcttgaatgatccttgggttctttgtgaggcctgaccatgcagctgctgaaacctgtttccttttcttctttacttctgcatatatccttatactaacccctcatctttgttttcttgcaagccatataacatgtttatcaaaagggttatagcagtagccaattaagtaacagacactccctcttttccttctccttcttccctgccccaagccactagtggatctaatttctctaaggaaaaagaggggcaggggaagtgagtggtgccacccatttgccccttcaggtacctgggtccgaaagacaaaccagcaatggaggagggaaacactttgaagcatatgtaagattaataattaaactacaaccagaaagttatggaatcttcccaagatgttattacaggacttgaaaggaagatttgacattgtatgtctgggagcaatggtgaagaaaaccaaaaaataattttatgttcataccctcactgaggtgagacttctcaataaactagatattaacagttatacatgccctttttcaaactacttttgcttttttaaaaaagcaaaaatatataatatcatcatataaaaggaaaggatgatacactcctcaatttgaaaagggtggttgtaataaggacacataagtttgcagcagtgtgcattcaaaaaatagggtggtcacacatacacacacacacacacacacacatacacacacacacacacgagatttattgtactttaaaaataatgaacaccggatcacctgaggtcaggagtttgagaccagcttgaccaacatggcaaaaccccatctctgctaaaaatacaaaaattagcctgggcgtggtgtcacctgcctgtaatcccagctacttgggaggctgaggcaggagaatcgcttgaacccaggaggcacaggccacagtgagcagagatcgtgccactgcactccagcctgggtgacagagaaggactctgtcttaaaaaaataataaataaaaataagaaacagttaagttccggcgtaaaaaatagaataaagttgttacagtaacccccacttatctgagaaggatacactccaagaccctgcccctctgcccctgccccagtggatgcctggaccctgtatacaatgtttttttttttctccatacatacatacctatgataaagtttaatttataaattaggcacagtaagtgattaacaaccacaataataaagtaaaacaattcagcaaaataggggttacttgtaaacaagtaccaggataccatgacaattaactgatcactgagatggtggctaactgactcctgggcaaggagcatctgtagcatggagacactgaacaaagggcaccatgctactcagaaaggcatgcaatttaaaatgtatgaattgtttgtttctggaattttccatggaatcttttcagaccatagttgactgtggataactgaagccatggaaattgaagctggataaggtgggatctactgttttgccttcctgcagttatgcaaggagttggcaggggaattgattcattatttaattttataatgaaagaaagaagaacattaggattcaaaagttggattaccaaatgatgacttgtcaactcattccctgcactccaagtatcagcaaattaagagtaccagttccttcatttgccacatttttatactccgtgggctgccattactattctcatgtgtcacttgtgttacagttacctgactgcactctcataaggacagttcttgaaaagccgcttccataccatacttgctttgtgcctgtgcttggcactgaagaagacacagatacacatttgacctcctgatggtgctctggaagccaaaatgattcctttccctctcaccttcctgattaggcttgtgtttgtgtgtcttatgaagatggttagctatattttacggtgttatattctgagatggcaatctagttgaagtccataggtaaggagctaggtcttttgtagagaagctgagtttattcagtgttattcagaggcagtctcagacagcaaagcaaaacttgaaaagcagatttccccttggcttttgaaaaacctctcttctcttttttgtgactgttcttttggaactggactttatgggctctaaaatgtaaattcagaaagaaatgaatgtgtaattgttgcttcattatcttgtgtcattcttggctttggctctccaaaattgctctcttcaattgcaagtagacttatattgaatgttgatgttctttccctccttccacctgtgatgaggccttgttttactgatgtggctggtccttgccaaggtccttcagcacctcaaaagcagattgtgagatccacacatatctgtacctagcatgatttttttttttaaagacacagcatctcactatgttggcccacactggccttgaactcctgagctcaagagatcctcccactttggcctcctgagtagtggaggctacgggtgcacaccaccacatccagcaattagcatatgcttgtcgttgacagtatatgctctagagcaggggttggcaaacattttctgtaaagggccacgtagtaaatattttaggctttgtgggccataaggtctcttactgcaacaactcaactctgctgttgtggcattaacacagctataaactaaacataatgaatgatcttggctgtgtttccataaacatagggactaaaatttgaattttgtgaaattgttatgtagcacaaaatattattctttttaaaatgtcaaaatcatccttagcacatgtgctggtaaaaaaccgccagtaggctggatttaatcacaagaaatgtagtttgacttcctctactcaaggcgtctcggggtcctaaagctggttctgtcacttcacaactatgtgaccttgaacaagttaattcacccaaattaccctcagtttctttacctggccaataaaataggttggtgtggaaatttcaatataaatctcttcgaacactgcctgccatatagtcagcattcaataaatggtagatattattaatattcctacctccaaagacatctttgttttatcttttcagagattaaactcagattactttggtacatcattttgaattgagttagatttgttctttttccaaatttgttttttacttacttttcccttcacaagccttccatgctcttagtaagtaaatgattctgataagacacacggagtatttcaaagctctctttgaaatattaattatttaaaatatcgaatgtgagatttttttttccagaggcataaactggtttttctggtaagcgttaacatttaggtttattgggtgcttgtttatttatagaatgtgtaattttcatctctcaatcttctagcatataggtaactgggaaaaaatgaataagcataaacatttttttaaccaccatttgctatcaaactctctcaccttatgcaaagtgtcaaaatgtgcctttggctgaaatgtttcttcactgaaactctaccattagaaataacaagcttctctttaagatatacatacattagggaaagttaactcaccaattcagttcccctaacaaacttttaggtaacacctaccatgtagacattttgggagaaatcacttcatccatccttcatcatttatcagtttggggtataatatccacttatgacccctaatacagtatttattccatggcaaaatgtacctaaaacattaattttaaaagtatttaggaacagtagtattcactatgaagtttatctgggatttgatgattcacctcactataggaaactgttaattacctgttctggcaaggagatgagatactagaatgaatgaactctctaaccgacattttcccctatggttttaactttaattgctctgagattaattttctttttagtggataccactgtgcaaggcctcaacctgggaatgtaatgtttttctgttttgttttacaaactttcgactaccacatcatgtaattactacactgcccctagctcatcctgtggattctagtaatttcttctaagctcctgtgtcctcttttccatcttgaaagttttcttcttttgaataagagcatctgccttcattattttccatagaactttatactttctatttatgccctcttctaatctctttggaatatcttgatttccttaaacactttctggctgtaaataacttcatagactattatcttagttaccatctgttgattttccaagtcaccattaactccattcttcactcacttccaattaaaccacaaactaacaaaatcctcttgtcgcctaaaggctttctaggtgcttgtggactgaaatataagttgctgaggtttttttgatgactattgacacagtgctttgccaaatggtttgatttctcttatttctgattcatttatggttttactattactcttactgatagatattaaagtcttgcagaacgatgtgttattttcaccatattgtggtaaccttttacttagtctttattatctcctattgtttcatgttaaattctgagagttatttgtcagccgtgggccttcatgtttgttagatctcagagaagggatttttattttcctcttctttaataaatgagcagtcttcaattttgtgttatctacaaatctgtataacttgcagcacgttcttaatctggaccatgatagataccgtgaaaaagattgaatctagcactggtttttcttgcactccacttgtcatcgccttcttatgctgtcaacttccatttactactgctgatgaccttgctcacaaaacaattttgcgtttctatttattcttttaccaataatgaccaaattggccatctgactgtacctagagttctatgcagaataatatttgtcactgcaaatcaaattgtatttgtcatataattgatttctctcccaatctggtccactttgcatgctacggtgaggctgatcttaaatgccacctttgtcatgtcactgtcctgttgaagatcaatcagtgggtttttagagtccactgaagcacattcaagtttcttaaaatgatatccaagctcctttagaactttgctctgatattacctatccaactgtaactcctgtatctttcaactctgtttctctcctcatgctttatcatggataccatccatattttatttcaggtggctatgctgattcaaagtggcctcaactcttttttacccccttaaaattatgtgatataaatagacaaaactaatatatgatgatagatattcagacatatgtttcctctgagtgggcaaaagagaattttctagagagttggaaatgttcaatatcatgattgtggtggtagttacatggatgtatgcatttttcaagactcttcaaactgtacaattagtatctttccatttcaacatttgtaaatttacacacacacacacacagtgcacatgtatgtgcactaggagttcagatatttagattttattatctgtgaaccagtatgatctgttttttttttaaatctgtttttgtgtcttttacatgaaattataataaagtgctctagaaatgtaatgttttcagaggcttaagtcccatttcttccatgaaatcttccctaactcctcaagcccacagaaagcttagttttatttttaaaaatgatttcatatgtgcaagtattatctcacataaagaagggtcctactttcagtaagaagccttttgcttctatgggatcatttaacagtgattggttcatagcaacttttttcaactttgagcagctcaacttttgcagaaaactttaattatacaatctagaattcaaggaggctataacagtgaattaaaaccattatgcctcggttaagattttaggaaatgatttttatagtattggctttacttcagtaattttcaaggtgtgataaactggaatacagtcttaggaaatgagagagtccagggcacttggtgcttaagtgcctagaggagtaaggggtattctaattaataatgtttgataaaaaggaaggagagcacagagtaatttcaaaaactatgaagggtcagagattttgccctacttgcatgccaacaagttagcctgctgcagtttcagcgatgctggcagaacacacaagactcctgggtcagagacacataactcttgttattcattcatgatacagcaagcaatatgagcttcacgttcacattgttttcctttgccctccaacccccagagttggaaagcaaacctagaccagggttgggaaggcaaacctaggtggatgctgcactcacggtgggtttgtgtcattgctgaggaatccctgcttagggaacccaaatcttttataatggactgaacacaaacctgcctgacatttttcctagagggagatataacctgtctgcaaagcaaatgaacctgtcgtcttctctagaggaagacactgtatcttccaaggttgttttctgtaaaaacatccttgaaaagatagtacagaaaaaggccatcagtgcctctgttcacaaaatgtgcagaaatgtgagaaacccatagagaattgtctgtaagtaagtatgtgctagccaataggaataggcttgcacaaaggtatagcagaggtaattcatttacctagtgctaattgtaatctgtatcatctccaaacccttttgtgaaaattaagacaacacaacacaagtaaatgctgatactgaaaattaagcagcaggcattcggcatctactaaatgacaaatactaagggaaacatgaaaaagaaggtacaacccataccttttatttgatatgatgataagtagctcacacaaagcccacagatgcatgcagcccacctaagtccttagtaatatctgtgactttcaagctgagtagaaagttgcttctaaagtgttacctctcagatatgcccataagttattattttagtggctaaaagcattacaaaattttcccttgatattctttcactcagttaaataggtattgtatgttgtaaaaaacacattttttgcacgtgttcaataaagtttttgtcttttttaatgaaataaacacataaacaattttttttcttgaggttgaactcgtagaccaaaaaaaaccctactcactactaattacatctaagtaagaattaatggttctatgaacttggaagttctaagtgaactgtcaacctcaaattaaatcacatacaaaatttcactgaaatgcattcaaaatgaagagtaacttctttcaaaggatcatgttgacttccattttgttttaggaagactaactgaaatataatcaatcccatgattatattcataaaaccttgattcagtaaggttagacattttatgaaaaatactcagcttctttgaaagttatcgtggagcaaaagaaaaagtaatgggggactgaagcctacatttctttcctttaatacatcagtgatatttacaaaaattttttttttagcagaactatttggcatatatgttctcagaagggacaatattaccccaaaagggatgaatactggttcttgggaatgtgggtggaaaaacatcttagatattgcaatggtttgtagccttccaaaggaccgcggtacataaacagacgtacaagatatctgtggcattaaatgttaacaataggggtcattagaaaaaatatctaaaaagactcccagtgggaggaagacaataatgaaaaaaggttgagagacgttgctctagcataatatttcgacaagtatagtgaggtagcaactactaaattaagcaaaggtatttatttttattcccacttgactttatttattttgagacagggtctcactctgtcacccaggctggagtgcagtggcatgctcatggctcactgtaaccccaacctcccaggctcaagtgaccctcccgccccagcctcctgagtagctgagactatacatgcacatgccaccacacccagctatttttttttcttttgtattttttgtaaagatggggtttcaccatgttgtccaggccagtctcaaactcctgagctcaagtgatcctcccaccttggcctgccaaagtgctgggattacaggcatgagccactgcacccagcctcctctcaactttttgtcatatttgtttttccatctttttatctaattacaatataatagcattaaagaattttaataaaacaatatctataatgttatacatttttatgtttgcatattatttaggtaaatcataaatatattttttcagtaatttacatatatttacttttctacatagtctttataattatcatttttgtaaggatacataaaatttcacttgtgctgttgtcctcaccttcttgtacttatatatctctaaaaattccttccctgtcttctttgcaattctgcttctcctgactgcctgttaaaagttgggtttctctgattctggggaggggattaggaagacattagtcaaaagacacaaaatttcagttggacaagaggaataagctcaagagatctattgtacatcatggtaacagtagttaataacaatatattgtgtattcaaaaattgctcagagattttaagtgttctgactaccaaaaaatggtgacatatgttaaacagcttgatttagtcattccacaatgtttacatatattaaaacatcatggtagggtgcagtggctcatgcctgtgatcctagcaccttgggaggctgaggttggctgatcacttgaggtcaggagtttgagaccagcctggccaacatggtgaaaccttgtttctactaaaaatacaaaaaaaaaattagctcccgcatggtggtgcacacttgtaatcccagctacttgggaggctgaggcaggagaatcgcttgaacttgggaggtggaggttgcagtgagcctcgatcacaccactgcactccaacctcggcaacagagggagactcggtctcaaaaaaaaaaaaaaaatcatatactgggtgtgtgtgtgtatgtatatgtgtgtgtgtgtgtgtgtataatttttacttgtcaattaaaaattcttaaatattttttaaaaagttgaggttctctggaattgcatcttctattctatccttcttctaatatactttttcagggtaggtaatctcatccaccatccaatgacacccaaatctttagctccagcccagagttcacttttgcatttcggacccacatttccaacttctttttcattatttctacttatatatttcttagatatataaaatagatcacattttctcatacttgtttatccctggtcatctaaactcctctccttaatctcaccctccttctcttgcctgctaagtcctattgactgtattaatgccttcaaaatatccatcctctccattcactttgctctctgtttagttcaggatatgtgttatttagacaattatgctatgcacctaaaaatttccctgcctttttttttttttgagatggagtctcgccctgtcacccaggctggatggagtgcagtggcgtgatctcggctcaccacaacctccacctcccaggttcaagcaattctcctgtctcagcctcccgaatagctgggattacaggcgcctgccatcacacctggctaattttttttatttttagtagaatcggggtttcaccatgttggtcaggctggtcttgaactcctgagctcaagtgatcctcccaccttggcctcccaaagtgctgggattacaggtgtgagccactgtgcccggctaaaatttccctgccttttgtctcaccatcctctgagtcattctccacaatgctgtctaacaagtctttctaaagaataaatctgatcaggttacttccttttgtttatagctgatatgcccagtacagtaaccaccatctgcatgtagctattgagtgcctgaaatgtggctaatctgaactgacgtgtgcagaagtaaatatgtactagatttctaagagttagtctgataagaagaatgtaaaatacatcattttgaaaatacatttggttgaatgtttacttaatgtactaaaaatcaatttggccaggcgcagtagctcacgcctgaaatcccagcactttgggaggccgaggcaggcggatcacttgaggtcaggagttcgagaccagcctggccaacatggtgaaaccctgtctctactgaaaaatacaaaaattagccgggcatggtggcaggcgcctgtaatcctagctacttgggaggctgaggcaggagaattgcttgaacccaggaggcggaggttgtagtgagcagagattgcgccactgcactcctgcctgttcaacagagtgagactctggctcaaaaaaaaaaaaatcaattttacctttttttattttttaatattactactagaatatttagcattatttatgtggttcacatttatggcctgcattttatacctagtgaatcctgttaacttatcgaatagtgttcaagccccatatcatagaattttcatctttcatcatctgggcactaattcctagttcatttcaacttcttccagctattgagcaaagagcactgggcttggtatcagactgatctgagttcatacttgggcctctccaccacagttgaaatacatatagttcttatctcagtatgttgtgaggattaaaatatctaacaactgtaaagtgtcaactgcatataatttaattctcccaggtacattctagccataccaaactaccttcaggtctttttttttctattgaaaagagcaggtgatacttcagatgtgtctgtgagcttaatgaatgttgttttgtttgttttgtttttgtttttgtttttgtttttgtttttgtttttgtagatggaatctcagtctgttgcccgggctggagtgcagtggtacaatctcagctcactgtaacctctggctcccgggttcaagttcaagtgattctcctgcctcagcctcccgagtagctgggactacaggtgcccaccaccatgcctggctaatttttatatttttagtggactctgggtttcaccatgttggtcaggctggtcttgaactcctgacctcaagtgagccacctgcctcagcctcccaaagtgctaggattacaggcatgagccaccacgcccagcctcttaatgaatgttacaactacacaatcccctttccatgtttactcaatgggctctacttcatttttcctgttttcaccaaatattagacctgagaacctcagtgtttctcttcatttttttttttcattcaataccccatcctagagagtttattttaaaagaataaattattataacattggagaagtttcagatcaaatgcagaacataatcaaaaaatattttagcttgctcttgtcccataagaaaatgtattttcagctgggcgcagtggctcacgcctataatcccagtactttgggaggccgaggtgggcggatcacctgaagtcaggagttcgagaccagcctgaccaacagggagaaacctgtctctactaaaaatacaaaaactagccaggcgtggtggcgcacgcctgtaatcccagctactcaggatgctgagacaggagaatcgcttgaaccccggaggcagaggttgtggtgagccaagatcacgatcacgccattgcactccagcttgggcaacaagagcgaaactctgtctcaaaaaaaaaaaaaaaatgtattttcatttgtgatctcataccccatagttaattttttaaacaaagtaggatttagatttaactttggaatagcatcagaaacaatgtcctttccctcttccctccttcttctcttaaccctcttgcctgcaaattgtcatctacctcacactcacacatttagctaccctcaaggtagccacctatttagggtccttttcatcagctaggccagttaggaagagcaggctgagctcactggggattatgcacagtgtaatagagactttctggccattgacaccttgagacaaacactctaacaaatctttaaagtgtttttcatggctagagttgtcaaagataggaggagggtaaaatgttttaaatgctgtttctgttaggaatttccacgaacatcttctgagcatcccacttatggctccttaacagttctttcccataggaaaagtttagacacacagcagcattctaaaaaggaagtgggactctggctgatgtccctaaaagttaaaatgtggcctttcagataatgtggtcacctttttctttatacagtgttagcatctcaaaatggtaaaggatatggattaggtaagaattgaatgcaaatgtgttttgcaaatagtgttttctaagataatcgcagatgatggttgaatgccgaaagtattaatacaatcagtatttaaccttgtgtaactccgcttcatcaaatcacgccctgcacattgattgcattaagctgagtcagtggtttcttggttaggaatatcttataagaatcttaacaggaaggcagcagtagctgatcagctactgtttatttgcatactgagcgtgtcatcaataatacaaaagacaaggtctttaagttgaaagaacagtgggattggcatgaatttttcttaatggtgcataataagcaaagtagtctgtggtgccagaaactgacaggatccattatgttaaaacagatatatgtctttaatttaggggtattatgtaaatctgacaggagtttttccctttattttcctgtagtttaactttaattgctccaagattaattctgatttctccctttctccagagggtgatgagactggtgtgatggataatcttctagaagccctacaatcaggtgcagcattcagagaccgtcgaaagcggattccaaggaatccaggtaaaacacattccacctcacatagtattgtaaaatatgaatgttcagagcaaagtagcaacaccaaaaaaaaaaaaggaaaaataaaaatacttcctcatgaagactttttttaacagttgatctcagctcatgtgtgaaatctcagcaggcatctacatgattgcaagtttcaacttggtaaatgtatcttcaaataactgtagactttacaacaaaaatcagaaacaaggactcccactgtgtttaatattaaatattttaattgttattttatgagcatgtggtttaggtggaaagtagtttaaaaccataaatgtaattaaatcattaaaagtaattggccctaaggagatcacattagctattcacaggtaaggaaactgagacaatgcttgtttctagagaccgttttggttttgcagtgcagtctgttctctgtgatccatgttaataaagggaggagaggaacagatactccaagatcccctcaaatccca

SEQ ID NO: 1237 - DNA, 745359 bp, mus musculus; identical to SEQ ID NO: 1236

SEQ ID NO: 1238 - DNA, 337 bp, mus musculus
tgtcgcgcctagcccctccccgccttacacagctcccgggcctcgcgggagcccgccgccgccgcctctctctcacgggaggcggccgccttagcgcccggtgcttgggtcggcgccgggagcgaggagcgagctacttcaaagccaccaggcctggagcggggacagaggcggcgactaggggaaggtgaagccgtcgctgcaggaggaggagcaggaggaggtgacgcaggagaaacgcaccgcccggagcccgtctgagctcagcgagagccccagcctgaggggagaaggggaagagggccgtcgccggccaaggaggaggaggaggcgggcg

SEQ ID NO: 1239 - DNA, 226 bp, mus musculus
atcaggcctgacgacttgtccgcctccccccaccctcccgcgataacccgcagtttctccccggccctgggctcctggagtgggagctgggttatcggcctcctacacctccttcgccccgctttatttgcagagggccaaagccgtgaaaggggtttttgaatgcagaaatcgcttccaagctagcttggacctattacctttctatttttaactgtttctgcaa

SEQ ID NO: 1240 - DNA, 64 bp, mus musculus
ttactaatctcattacaatgagaaatcctggaagagatctcaattctttctagtcagacccttc

SEQ ID NO: 1241 - DNA, 118650 bp, mus musculus
gcggccagtagtttgcggcatccggaggagcagcagcagcagtagcggcggcggctggcgcagcgcggagacggacgagcgggcacagacggcagcacagctcccgtgcaccatgcctggcttgcccgggaggcactggcacccgcgtccctagcccggcgctggcccttggcgcgttgcgctccgcagcattccggctgagcgatttcatccgaaatcctaaacctcctaccccaaacccattgcctcctgcttgctcatactccacactcacactccccacaccacacactcactcttcctctctctctcacacattcacacacagcccgagacagacagagaaagcgagacagacctcccgagtgcgcgagcgcccgggaggaagggagcccaacgcagcgcggccagcgcctctccgggaagatgaaatcaagacgctcctgcaagtaaacttcggcggcgacaaaatcgtcgactgtggcagctgctgaggcggaccccagcgacgtgcaactgagctaggagggcttcctcccgcggcggcggcggcggcggcggcggcggcggaccttggagcgacaccccagcccaaacggagagaagagaagcacccggtacccacggcggcggccccgcctctcctggccggtactgttgttgcctccccttccctcttccccattccccgccacccccggccattagaaagaccggggctttgattttcttggacaaattgccatctccccgtttccacaaacttgacgtggagggtcggactgcgttgttaactttgatttcctagacgaaaacgcccgcagaccctcaactgctctgtggggggaactccgctcccacctcggatcctggacagacgcgcccccaagcccttcgaagccagccttagcgcgagggagcgcgctcaagctctggcagcctctctcccctcccccttcctctgctggccccgggaccgccatccgactcaaccctataaccgggtgcccgcggcgcttgccagtaactgactcccgtctgcgacaccccctttctcccgaacaggcctcgaagaggccagtgtggcccccccagaccccggagggcgcattccaagcgggtactctctccgcagtgaactgggagcgctggggggaggtctttgcgcatgccaggtgcacagacagcgagttcgccagcctcagtgccggtgcaccgcggcgggccgggcagtgcctgaaaggctgcgcctcctccgccctctttaccttcgcctcaagtactgtccggactcagcggtgcgtcctccaggccgcgcagacgccgcccgacccgcagccctgggcggctgccgacagtcgcgcccggctaactttgaaggggtaaaactgagtagccgggctggagggagggggctcggggccgcgcggcgctcccttggcccctcggagcccccggggcccccgcgagcccccgccgcgtccgccgcaacctcagcattggagccgccgcgggtgtcccccgcgcgccgccgggccgccctgggcgggacttctcccgcggcctccggggccacggggcgcgcgcaacaggcggcccgagccggcgggaagctggagcgccgacggcgtcggtctcggaggggtgtggagaggcgaggccaggcagagccccgtgcagccatggagtcgctcctgctgccggtgctgctgctgctggccatactgtggacgcaggctgccgccctcattaatctcaagtactcggtagaagaggagcagcgcgccgggacggtgattgccaacgtggccaaagacgcgcgagaggcgggcttcgcgctggacccccggcaggcttcagcctttcgcgtggtgtccaactcggctccacacctagtggacatcaatcccagctctggcctgctggtcaccaagcagaagattgaccgtgatctgctgtgccgccagagccccaagtgcatcatctcgctcgaggtcatgtccagctcaatggaaatctgcgtgataaaggtggagatcaaggacctgaacgacaatgcgcccagtttcccggcagcacagatcgagctggagatctcggaggcagccagccctggcacgcgcatcccgctggacagcgcttacgatccagactcaggaagctttggcgtgcagacttacgagctcacgcccaacgagctgttcggcctggagatcaagacgcgcggcgacggctcccgctttgccgaactcgtggtggaaaagagcctggaccgcgagacgcagtcgcactacagcttccgaatcactgcgctagacggtggcgacccgccgcgcctgggcaccgttggccttagtatcaaggtgaccgactccaatgacaacaacccggtgtttagcgagtccacctacgcggtgagcgtgccagaaaactcgcctcccaacacacccgtcatccgcctcaacgccagcgatccagacgagggcaccaacggccaggtggtctactccttctatggctacgtcaacgaccgcacgcgcgagctctttcagatcgacccgcacagtggcctggtcactgtcactggcgctttagactacgaagaggggcacgtgtacgaactggacgtgcaggctaaggacttggggcccaattccatcccggcacactgcaaggtcaccgtcagcgtgctggacaccaatgacaatccgccggtcatcaacctgctgtcagtcaacagtgagcttgtggaggtcagcgagagcgcccccccgggctacgtgatcgccttggtgcgggtgtctgatcgcgactcaggcctcaatggacgtgtgcagtgccgtttgctgggcaatgtgccctttcgactgcaggaatatgagagcttctccactattctggtggacggacggctggaccgcgagcagcacgaccaatacaacctcacaattcaggcacgcgacggcggcgtgcccatgctgcagagtgccaagtcctttaccgtgctcatcactgacgaaaatgacaaccacccgcacttttccaagccctactaccaggtcattgtgcaggagaacaacacgcctggcgcctatctgctctctgtgtctgctcgcgaccccgacctgggtctcaacggcagtgtctcctaccagatcgtgccgtcgcaggtgcgggacatgcctgtcttcacctatgtctccatcaatcccaactcaggcgacatctacgcgctgcgatcctttaaccacgagcagaccaaggcgttcgaattcaaggtgctggccaaggacggcggccttccctcactgcaaagcaacgctacggtgcgggtcatcatcctcgacgtcaacgacaacaccccggtcatcacagccccacctctgattaacggcactgccgaggtctacataccccgcaactctggcataggctacctggtgactgttgtcaaggcagaagactacgatgagggcgaaaatggccgagtcacctacgacatgaccgagggcgaccgcggcttctttgaaatagaccaggtcaatggcgaagtcagaaccacccgcaccttcggggagagctccaagtcctcctatgagcttatcgtggtggctcacgaccacggcaagacatctctctctgcctctgctctcgtcctaatctacttgtcccctgctctcgatgcccaagagtcaatgggctctgtgaacttgtccttgattttcattattgccctgggctccattgcgggcatcctctttgtaactatgatcttcgtggcaatcaagtgcaagcgagacaacaaagagatccggacctacaactgcaggtaaagccaagttttctttctttgtcttggatgaataaggtgtgtttatctgtgtctctgtgtgaaaatcctggtgcttttgtttcctacttaaatgcatgcagcatacttgcagtgcttctttttgtagggtgaaaagtttgtgacagtccaagttgatcaattcttttgatctgacaatttgctggaagacaatcatttagtgtttgaatggattctgtcacataatgatggtgagcagaaacgcaattatcattttaaaatttgcatagctgtctccatgaagttatggtaggaaaaacagagagagagagagggagggggagagagagagagatcatatttttaggaaaaccaccaactaccacaacttggtgtctggggcacagtgtttttgggacaggtactgaatgaaaggagagggagtgttggcagctaccctgtcttgttgcagtgatgaactctggagagagactgggagtgggagtgtaagatgggaaagggagatgagggggaggagagaacaggagtgtgtggagatgcaggtgattagtggtttttagtttattcttggcttgttttttatctagtccccaaacatctggctatataaagtgaaattctatcaggcatctgtatgttttcaaatatctggttggttggtagtgtggagaccaaacatcccaatgaggaacaagactttgcatccagatgtttcagtaaaaatagcaatcttctagagttgatgatgctttcctctaatgtgagactgtgttgtggcattaagatctggttcctaccagtggatgtcactgtgggctattgtgttacagtttctcttgaagtgtgtgaaggatgtgtgtgtgtctgtgtgtgtatgggggggggagggagagagagagggatagaagggggaggaaaagggagaaaagaagaaacacagtattttttaaaaagatttcctgataagcacattagaaggtcttactgaagccctttcttacatttggatagagcacataagtctaagcatttctagaatcctagaatccaatttaggataatacatgacattttttttccagcagtgtctcatcgaaacagttgaaaaaagttgtttctttagtttgctgaaaatgaatgatgctgctatttacaaccaaggtgtgtgtgtgctttcaacacacctacacatcagtgtgtcttttgtgccatttgtgtctgcatgttaatcagtcaaaatatgttcctgtaggttcagtttgtatttgacaccgtctgaaatgcacacttctgtgaatcagagccccctgaatatgtaacagccatgcaattattgtttcccttttactattctctgcgttacacaagttagtagacaaatgctaaccacacatgaatatcaatcaggtgccataaaagagcagctgcaatgcctcataaatgctttaatcctgttactagtgaaatggccatgacttttctttccttcagcaccaagtcatttcagatgggagaaatgtaaattaatattgctcttagctttcaaacctgtgactgctagtggcgatttttataggagaaaaatgtggggtcaataaaattttatttatatggagataattatggagaggactctttttaagccatcttctcagcataaagtaaatgcataagatcctttccttgatgaaaaagaaatcagcttgaaataaagatattgaaggctttgccacctcttggtgatgtatgactagaagtgagagccctttctgagaacttgccaaggagatgattaaacaggaggagagcatctgaatattgaaaaaaaaaaaaaagagtaaatctcagtgctctccaacttcacccaaatgtgtattttgtgaagcgttctgtttcctgtgatggtttgggattaatgaagtacagtataattaaataattggttaatacagaaagggctgcacaatgaatgcttcagctgaataatttgatggggcattgccaaagttactcatcttgggtaaacaaaatgattaaaatttcccattgattctgtaaacagattagaatagaaaatcaaccttagtactagggttttggggattttatctgctcccaaaccccagtagtaccagtttgccatcactgcaaatcttcctgagcacagagcgaaggggtgaggggaactcaattgcttaactctaggtagatcctggggacagagcaagaatttgcctctgtagatgtgtagtctccctatctgctcagactttttagaaacctaaagttcaggagcgtgtctttccatgtgattaggcagaggtttctttttctaagcctccgcagaacctcttcctgaaatgcattcatttatgagacttgcgagatgatctgcaattgctgcttgaattgggctccctttttgtattcagacaattagctttgtcgagtgagaataaggcacagtctttcccttgtaaagatcaacctgtattacttattaaccctattgttttgctgattattgcccagaaatcgaatttccaaaaaagaaactgaatcattatgtgcaaagtaataaatgactttgagaatctggctacatttaaatgtatttcttttgacaagtctcttaatgcctggtgtctttggtgcacgttgctgggtctgtgtcagtgttaattaaattgagctctttatgttccagttgcagcacagctgcttgtaggtacacctgaatggagaaggatgctgaatgcactaacctttaaattcctttgcagtaattgtttaaccatcacttgtctcctcggctgttttataaaaggacaaaacagcaagtgtctgcattgcatctcggtttctcccattagcgaggagcaagacaaaaagacagaggagaaagtgagcctaaggggaaagaggtaaaaaggcatttcccctcatttaaatgggtttggctattagatttttctaggagaggagggggtcggggggtgagtaaaagggaaccgggctagggcagggaggagggtgtggaggagacgcgaaagaatggggtctgatctcctaccccagtccaaaactgatcgagtgagtcatagaggaagctgattgagggcgtgtgccacatggcaaatgcctggaggaactggcaagggggtgggggcgggtattttttattttcctctatctcctctttggtgacttgctttgtatttcacctaggagttccttttggttccagggaagctccagatttgagcattttcatgctttctctcccataggctcaactttccctgtccccccacccgtgctcacaggccactcacaatgaaaaattccaaatccaaagtatagaaacttttttagggggggttggtgggaggttactatgtttaatatgaaaagtttatggccctcagcctgttttcccttgtaaaaagcacagggagaaacccgatgatgtaatgcaccagaataaggagctggagcggagatggggtgcaaccctctggggtgcttaatgtttattaatcagtgcatgatttgggagggtgttagtgattcatgctgccttttctgtcacatagaattgctgagtactcctatgggcatcaaaagaaatcaagcaagaagaaaaaaatcagtaagaatgacatccgcctggtaccccgggatgtggaggagacagacaagatgaacgttgtcagttgctcttccctgacctcctccctcaactattttgactaccaccagcagacgctgcccctgggctgccgccgctctgagagcactttcctgaatgtggagaaccagaatacccgcaacaccagtgctaaccacatctaccatcactctttcaacagccaggggccccagcagcctgacctgattatcaacggtgtgcctctgcctgaggtgagtgcagctaagtggctctgtgaggttctcccaggtctccttctttagctgctcgctggataccataagctgctgtgctggcacatcccctggcaggggtggggagaatttctctgcttatgcccattttcatactaagggtttgctatcagtgcttcttggagcaaaaggtaacccaacatactgggcctttgtgtaggtatgggtattggaattggtaactcaaagagtctgagcccttgaaatcattatcctggcataactcaagtttgctccacctgttgcaaatatagcatgcttgacagccagcagtaccagtatgccagtaaagtggcttagaaagagtcatcaagtagtgttgaaaatggatgaaaccctctaatgccctgggaccaattttccagtgtgagagtgattcagcctcctaaagaccccatttgctttttctttcgtcacatcactgttctctagcattttggtgagagaatatggataggctggttaaagggaggcaaagcaaaaaaattaaaaagccactttgccatttcttagcagttctagtggtaacatttgatggttgaggagattgaaactgtcattattgctgaaaatttaagaattagttggctggttgcagtggctcacacctgtaatcccagtactttgagaggccgaggcaggagaatcggttgagcctggaattccagaccagcttgccagcctgggcaatatagtgagacttcgtctctaacaacgaaaaaaaaaaagagtaagaataagaataagaattatctatgcatttgagtgagctctgtttctttctcttcactgggaatgaatgtatttaagtagaattttttttttttttttgagatggagtttctcttgttgtccaggctagagtgcaatggcacaatgttggctcaccgcaacctccacctcccggcttcaagcaattctcctgctccagcctccagagtagctgggattacaggcatgcaccaccacgcccagctaattttgtatttttagtagagacggggtttcaccatgttggtcaggctggtctcaaactcctgactgcaggtgatcctcccacctcagcctcccaaagtgctgggattacaggcatgagccactgcaccgggcttaagtagaaatattttttaaaatgtgatgtggtcagatgtttgctggctattgaaatattttagggcagtagagtggtatatggatgatggctggtgggtggctgggaggaaggctataagtaacatttcttaagttgatttcatttttccatgaattgcttaagtccctctttggttagaaatctgatgcactgggaggcatatgtcctcttccaagctaccagcgaaaagaatactgcatacttagagagcactttcacatctttcaaagcaccttcccaaacattgtttcgtttgatcctcacaatcaggtatcttgataggttgcccttcagtagatgatgaaacagaggtccagagatgctaagggacttactcagactcacaaagctggtcatcaagagagggaggacgagactgaaggactctatactgcctggcaaatgtgatttcagtgacaccttcctgccttaaaagtaattcagcctgacatacccaggctatgatgcatacataaaatggcctcatagtatttgtgtcaattttgtaggataaggggtcttaggaccacttacattgattgcttcttctagttcctgaacaataattcccatcagaattaatggggccaaacagcagtgcttttgatgagtaactgatggtattctgccagcaacaaaagcaccaatattttcaatttataactctataaataaggattttttgaaagtccagtattgtgctaggtaaactcagttataattattaatgtcagtgaatactactaaggcctaggccgtagactacttacaagactacttgtggatcaccaatagctcagcaatagaaagtgagaggtagtggtgtgtagtggaatcagattgatcatgattttgaatccaggaatcactgcttgctgtggaacataagactctgtttctttatctacaaaatgggcacacctgtcatgcaaagttgttccaaggaatatgacttgtgtagtgtagtaggttcaactcattggtgtccccaaaatagtagacctcttcactatacagttggagaatcagtgttacaatggcttgcactactgattgtgtctccctaggcacttgtaaccaaagaggaatttaggctgcttctatatagatacatcctacaaagtattatggccatactactcatattgatcatttaaacaatagaggtgaaagatgccaaagttgtggggttcagttgttcacaagtaacggcactgttacttgtggagatggacaaaagggttgaatcctgaggacttggtgatcacttaggcaatcaattcaaggcactagagaaatgtgagttctggtgtctatgaaatagatggagaggacagaaaacatatgacgacatctgattggtttacctaagacttagtatcatttctgggattcttccatgggctgaatgaaacaaaatattgcttcaattatttagaaaagccgtttaaaatctcagttctgatcctgtctctgactcacaaagccagatgcttttccttggttaacaaaattacacagttttggtgtgtacagctggtcatggccaagacagtgtgtactagacatagtgaggttgtgtgtatttctaatattcagtccctcctggagagttcaactggcaaacccattcagaaaggagagaggcccacttacagctgaatacagaccaggccatttaacctgaatcagtcacaatgccctgcgtagggaaaatgacacttcttttcttttataccaaaggccactggactcggtggaatacttaggtccaatgaaatctatagaagagcagggatgattgatttgttcattcaactgatatttgttgagcctactctttgtaaggcactgctctaggctctggcgttagagagatgaaaaagacaagaaatgcacattctaaagtgtgagacaatcaagtaaataggtgatttgcaatatagagtaataaatgctaatatagggtgcaatgggacattctccattgctaggataataacattttgatatatttcctacattatctttatattttcctaattaattaattaatccattcaagaaagcaacatttattaagcaattatagcatagaatgataagtgctatgatgtggcaaatataagattctatagaaatttctctatattatgttacttacattgttctttatattatttcattaaaccattctttcatttgttcattaatttatcccattagcagttattatacatttagaatgtgccagataatgtactacttcccggggatcaaaaataataaaacacttgtttcttgaacccagggagcttacagaaatacagacaagtaaacaggtaatttcaattcagaataacatcctattcctgagcacgttacattcttactctccaggttgggacaaaagggtactacatagtaggttcctctgttgggttacctgtgtcaaacccagtccctttatgagctgtagatccagttacagggcttactctcaaagggattatagacgagtccactcagacctgttgcgtgctagctgtactcactctatcacactttgaaatttatcaccatggcattagatcaagtcagcaagcattgttggagtatccactatgtgctcagctgtgtggcagggaccatggagattccaaataagtttaagacgtaacttctgccctcagagagttcacagtctagttggggagctaagatcacccacaatgatttcacgggcaagcaatacaagatagtttctgatcacctgtcgctttgtagactcctaagaactcctttctcctcctttaatggcagccttacattttatgtagatttgccattgaaccctcaaaatttagtgctgaatggaagatagctcttgtatcagtgtccaaacctagccacatctgaacattgttggctctagaagctaacagaaatatgactttgaatgcagttaggtaggcaaggtaaagggaatggaacactaatcaagaattggaactcagtttacagtattgcagagataatcttgtgtagaattgtatatcattatttacttgtcctctgatgttggctgggaaatcagctatgtggattttgtggtttcgtacacaaatttgaggggcaaagtggaggatgcctttgctgtttacagaagacttttgtagaattattgatgtcaggtatcttttacatattttaaactgaaaggtgaggtttgcattccttggtatcctggtttattttactcatagacttagtgtatatgtgaatgaattagagggcgtgtgtatgtgtgtgtgtatgtgtgtgtgtgtgtgtatgagggcgtagaaaagagtgaagagagaggaaaggaggttgaaaaagaaggaaaatggagaagaaagatagtaggtttgtcagtttgctaagatctttctaaaaatagtccaaattttttgagaggctccttagtaaggcaaatgatttttcttccggtcttatggaatggagacatgcctactggtgtctctggatgctggaaagtgttattcctttgtacagcagcattgctgcattaccatttttgtcacctggctgcagtcattattggaggaagaaaatgcaactcattgcttctactggaaatggagacttgggtgaggcttcttcttgcctccaggaggggtgaaatggcccaaacacccagtgtctttgtgcagtatttttaaattttagttttctgatgttgaatgtttctgagctgacagctgtaagggagtgatagtaggcaaaaacttagagaattccagtcataggtccgtagggatttaaattttggtttcagtctcaatcttgaattctattttctacctttcatcagcaaactgtagtttctttgatatgaggcatctaaggggtgtgtgtgcatgctctgctatagccactcatgcaacagtcttcataagtagtgacgtagccgtggaagagcttgcagaacaagaatgtgtgtggcagccaaattgaatgcttccaattatcctacaaaaagtctgaatgcatggtcatcttagtggaaataatgaaaataaaacatcagttaggctttgaaaaaaaatagcccagtacactttagttcctaaaacagagttttaaagttagagatttgcagtgacttgaatgaaattctgggctaaattagacagccacaaacctatcaggtagtagattcagaaggcactaaaaaataataggtatgataaggctggtttggatagcatggaaatgacacaaagcatcacctctaattaaaagaaaccaacaaaccctttagtgcgcgtcttgtttgtttgtctccttattacagtagggtcttggaatcatttaagtcctatccctaagggtcaaaagtaaccctgaaggagaaagcaatgagaaacaatgcagcccacatcttttcgagcattctcatttcagttttcttcaaaaatcaagggctcaatttctaccagcagtcattctagggccacccattgcctacattgtatcttattggcatgtttcacctctagctgagacagccggtttcccagtggggatgggcttgcaagatgtgttccagaataaactgttcctctgttgtctccatgcaactgccacagaactgcagaactgagttagtttacattagtatctgctaatttattattatcattccttatcggcaattaactggttaccttagagatcacctctctccccgtacaccttcactgaagttgagctcagccagagctcttgctaatcatcctgagatttttctccccaaggggctggaggcaggacattttccacagagggctctaaggctttggaattcctcttatcagaggaccacttgttttgggtccaggtggctccacctggttttttctctgattgtcagtcagacttacaaggtaggatgagctgcagacctctctctccctaaccttgccccagcttgtgctgtggcttgggcttattgtgcccagcgcagaagctaagggcttaggggattgcttgttaggaattaggggactgaaaaaggatgaagtcacctcctggcaaagctggagtctttcaattgtggcagtgctgtggctcttaggcgtctgcctcgagtttcagatgttggcccctctgcatgtgtacctcagcttccaggatttaggggaggccaagcttggttgaatcgagtgtctcagatttgggtaaataaagccgtttttacaagaggcctgtgtgtgagaggtgggaggatggctctggagcagccattttcccccacggagaagaggcttgatttcttgatgcgtgactggctggcctttgatgtgagcctcatttacttcgaacaattgagaggcttgaagtgaaaatcccagaggatcagttgtttgcagagggaaatgctcttcaagttacatttcctatttggctgttgtgtatttagagtagtttttgtgtgggctgcatagtggggtcactcagcttctagtgggtgtacccaggctgctagcacctccctgtgccccccaggggaatgatgaggaacattcctgcagctgtggggacagcaactctgccaactccgggagcttgagctcctgtgcagaaaccttacttgttatcattaggcatattggttaggaccacacagctccacagcatttctagaagaggtgtcagaatggaccagtgtttccactctacagtaatgaaaatggaaaaggcaaatgacttacccaggcacacaacatttgcggccaaacaagcctccattttgcttcacagtagttcctctggtgcagcttccaagcgttttctgtcacataatgaaaaacctgacaggactctctaggaggacctgcgggtatactttcgatggtagttgtgttcctgaaaagctggtcagccaaagggtgtttgttttgtaaattagaccccatgctaatcacagcagtggaattctgtatttaaagaaagcctgtgatggatcctttcataaaggagagtccttatataatgtgaataatcaactcctaactgatttcttttgtaagtctggattttcacatatcttgtttgcttaaaattagattcctcaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtggtggcgggcgcctgtggtcccagctacttgggaggctgaggcaggagaatggcgtgaacccgggaggcggagcttgcagtgagccaagatcccgccactgcactccagcctgggcgacagagcgagactccgtctcaaaaaaaaaaaaaaaaaaaaaattagattcctcaaattgacaagatttacaaaacctttgaaaggtgggccaattcatttttcccttgattgaaatctggcccttgaatcctcactggttagccttcctgtttgatttttacttaattaaacaacttgcaactatgtaatatttaaaatatagtgtccagaaaagatgggtacgtgtcattgaaatttaacaagtattagcatttaatatttgcttcagattctaaaaaaatgaaataaaatatgacagctgccatcttcccatccttttctctcctttgtaaataaacccttggctcaaagaacagaagcccatcacgaatttttttttgtcttcacctgtagagctcgttcctgaagagatggcttcccctttgctgtctcagattatgaaagctccccaagtcagtaaggatttcctggattgggtagagcctgggaattactttggaaagtgaaagagctctcttagacttgcctttaaattcagtgtttggggagggagaaaaatcacttttcagaatggggaaaaaatgagaatgagagtgagacagacaaattgacagacacatgttaggtccagctacctacagaattttgagcagaccctttgggactgaagcaggcaggaagcttggtgtcaagtctgtgttctccttgagctcagtgttcatggactagcaccgcggcttctttttgttgttgttgttgagacggagtctcacttcgtcacctaggctgtagtgcagtggtatgatctcggctcactgcaacctctgcctcccgggttcaagcgattctgctgcctcagcctcctgaatagctgggattacaggcatgcaccactatgcccggctaactttttgtatttttagtagagacagggtttcaccgtgttggccagggtggtctcgaactcctgacctcaggtcatccacccgcctctgcctcccaaagtgctgggattacaggcatgagccactacgcctggctgcatcttggcttcttaatgttagatgcttaagcactgtcttgatgtgcatagtcttctgatgctccattaagtctctgagtgccagggtggccagttttcagtttctcccactgggccccatctggccgctgttctgtggcaagctgctctccctcactgccaccagcactggccttggcggtctctgccttctggattattttcgctcccaaatctgatttccagagcatgaagggcacctcttctcagattgtgtagtttgctcttctgagcaaaatggattccctgtgtaagccgacaggaagaaaagttcaatccaaaggccagatccctctttaggggagtttgtgtgtgtgtgtgtgtgtgtgtgtgtgtgtgtgtgtgtatgtatgtatgtgtatgtgtgggagagggagagggggaaaggagagagagaaagaagcaggagggaataaaatgaacattatctgcttctctcactcactttttttgcctctgtgatgatggagcctttgccggctgggctgaccgtacacatgtctatgatattaggtcctcagagcccccttcccaactctttgacattctgctggttgtctccctgaggaaatgctcataagcttagttacagcagggtgtgatcccccaaatgtgaggccatgacaccccaatttgatatagctcaaggatagatctctcagagactctttttaattgagatctcggtgagtaggaagcagccaaataatcattgctgtgcatacaactcagcttaagaataccttatagtgcatattttcaatttattagaaattattttctgaggcttgctttctctttttgtttcttttgggcacaattctgtatcaagctttcctcttctttaattctcttggcttgagggagtctgctatggactgcctatgtgtacaggtcgtttgctataaaaccatatcttttctaagtgagaagaatggacagggagaccctgtcaaactgcattcagagggattggcttaacctttaagaggcttttttataactaaaaatgtccgtaatctagcattcatatttgaaacttgacatgcttgagggaggcagggctctggagatacagggacgaacagaggcatatggctacaggtaatggtgaacggcttgttggaagactgatttcctcctctgttctgccaggcacagaggccatggtaaggacacagacacactgcactcataagactggcattgactatgagcttgctgttctgatcatttctttaattagtgcatttccattttttcaagtatagacttttgagtgatggagtatgctaatggtaacatttgttcctaaaagcttaggggagagaacacagtggcattcgtactaaataatggttttttcgtagtgaagattttgcctgattttaaaattgcaaaataattttatggtagttatggctttttggaaacgaatctcaaatactacatatgaaacaccaattttctgtgtggcttgtgcacttactaatggcatgtgtgtgcttacacttctaggtcattctattttgcctttactggtaattctttagaaatagaaaaagaagtgtgctttgttgcagtaaaaaatataataattttctgaaatggaaagaaagctaacctgcctttgcaaaaactatgcattatgtagtggcctgatggagcaaaaccttataaaactggtaagctataaataccatggcactgggcgttgttggaatgacatccggggcttggtctttgcacatctgatcaccaggtaccctcaagaggagatcatggaaggtggagaaaaatccgtacctgtaaaggtttgtggctatgcatggtgtcatatttggaaatatgggatcaaataaatgtgtgtgatgtttccaacactttgctgtcctcactctttgagcctagcaaactctatcaggacagttttctctagtgtgtgagtgagcccaagtgactgtatcatcaaagataaccatctagaaatctgcagttctgaggtaggggagatcactaccaaaacagatgaaacaattaaaaacctcataaaagagaagctttagtttattgaagcctgttattactagggaaatcagaatccaagacatagagaattctgaaaattccagacaaatgccaaactacaccaaacctgcaacaatatgtgaagagattgggttgggggatctccaagttatctttcagctctgggtgtaaatgtgtgaatgtttgcagcattggtttgaagggcttcatatagctgcctgcattgaagtttgagtccatgtgatgacaatggttgctctgtaggtggtattgaaggcagaggacttagctatggcaggtgaaacaataggtacagcacattagcttttaatgagggcagcatattctgtgtataatctgagttgtgagtgtgcatgccaaaactcagagcctctctgttcaaatatgtcttcctgtccaacgcgagttctgccataaaggcagcaatgggtattctaaccttgcttcatttggtttgtacttgttctagggatgaataggagatgcacgcgtcttgcctggcaaactagacctttcaggagagcacaaattcacttaaacataaattatgttgattatcactctacctaaaaatttatagagctggaagtcaccgagatctccttttaagttgggtattcttgaaaactgttttgtatatcatgataaattatctaaccttttatacagttgaaggccaacattatggaaataagcagctttttattccattctaaggtcagtctaaccaaattatgcaacttctaatgcagttgcttgaagcttccactttgaaagttttttcattttaataccttgcaacagagataaatattttagctactattcatgcttaacaatatatttcactgattgtcattctctttgtgggatttgttggcgtgagaggcagtccaccatgcctctgctcattttgatgtttgttataggttatcagaaaagagccagaattcaataaaaaatgtatttttgttcttgctgttatttttaatttcaggccataggaggctgactgagccctacagaatcaatatatacttggcacttggggtttgacttaagagccaaaaatgtggtagattttcttttaaactagatttgattccagaattattaaacccaatgcatgttggaggctgatggactgcatccagcaggatttggggcactttctgtaacaaagcaatttatttctttcagggagtcactgctacttcaggggaaggtgcagtcggtggggacgcccttggaagttctgttctatcctaggctccctaaacaataatttgtaggagctccttgatggtaggatcaactctatgcagtttcttttggatagtgtcaggtgtttattaaatgtattttgttactgatgactagctctatagtggttatagtgccctgctgttagagagtattcatttattctgggtcaaaccttgccctctatgatgatttgcctccagactttagtgaatggacttactgtttagtagttaggctctttaaaaaaatattttggcttgaaaatatccactcattcatccatccaccaaatatttatagatcatccttcactgaccaggcctgtattcagcccagagagacatagagaaagcataagtagtacctcaccttgtagtttatattgccactgaggagacaagatagaagttaagcacattttctttaagtcaatgagaaaagcagagatcatttactaaatggtgccatgtaattggttaacaattggaaaaaatatgatttatttcccactatatgacaaaaataaatttcacatttattaaagagttaatatgaaaactcaaataataaaatcattagaagaaaatataaataaatatccaattgattttgaagctgaagaggacttcaagagcataaaaacaatgaaaatgagcacaaagaaaaataccagcagctctgactatataaaatttaggaatgtctatatatctacaagtatcataaactaaattaaaaaataagccataagctgggaaaatattttaaatttatagcgcagagaacctatatttattaatttgtttttcagctttattgggagtgtaattgacaagtaggaattgtgtatatttaagatgtacaacttgatgttttgactcatgtatacattgtgaaatgattgccaccatcaaactaattaacatagcctttacctcatatagttaccattttttaaaatggtgagaacacttaagatctactctcctagaaaatttcaggaatacaatacagtattgttaattatagtcaccatgctagacattaaatctccagaacttatcttgtataactgaaactttgtatcctttggccaatatcttcctatttcccccacccacaacccctggcaaccaccgttctgttctccttctatgaagaacctgtgcttattaattcattaattaatgcttcaattatttatagagtgcttaccacatgttagtcactattcaaggtgctagggatacaacagtgaacaaaaatctctgtctccattgagtttacatttttatggacagatggtgatacgaagaaaaataaggaagtatgaagcatacatgttttgtcgagaatgaggattgctctaggaaggtcagggaagacatctcaaataagaggacttttaaacaatacccttatatataaagagctcttacaaaacaatgaaaagacaaacaccccaatataaaaaatgtaaaatgaacacaaatgggtaattaataaagaagccattcaaatggccaatagatatataaaaatatttcaaccatagtaatcaaataatagcaatgaactgctattaatttttaattgcaaagatgatgcctacttactactaaaaagtcaaggaacacaggaatgtgtaaaacaaaagttaaagtctccacaactatttcctcaccaatctgttacctcaggggaatcacagacaacgatttgatatgtaagatgtcattttgtacttatcaaataagcaaagattaaaaaaaaaacagtgatggcaagagtgtggttatgatacactgcaacatggagtataatttaaaaaattgatataatctttcctgggggcaatttggcaatacacattaaaagccctaagatatctaatatttctacttctggaatttatcctaaggaaataattttagatcagcgtaaaaattcatgtacagggttgttaatctcagtataatttatgaggataaaacatcggaaatatcctaaatatcatcaatatgttaatagctaaatatattatgatatatacatatgctagaatactgtgaagccagtagaatgttttgaggaatacttaattacacatgaaaatatggtataatatacattaattgaaaaaatcagaaaataacacacatagattaattccagtttaatgtatgcatatattattccaattgtttaactataatacaatatataaatatatataatatataaacaattccaattgtgtgtatatatatgtgcgtgtatgtgtgtgtgtacatatatatattcatacacacacatacacatgcacatatgcacacacataagactagaaagaaaattaccaaagcattaacagttatctcaggttgtaggaagtcaggcaatttttactttttaaatggtatacttttttaattttccaaattttctgcattgaacatgtgttatttttgacatcagaaaagcaattacttaaattaaccgtaatactatgcagtaggtattaagggccaaaaaggtggcatagacagtttttaatgagttattccgaggaggggcagaccaaaatgttccttattttcattttccaattagatcataccaattttttcttcttaattttcttctcttggaggtctctctcagaaggtaacaagtatgaagttttacattttaaaataactattttatttacagtttaccttttaaatgtgagaaatgttatgaacaatatttgtttcctttttcattctttttgtccttgtgtatactcttgtaaaagtagatttgatttgtctcaccagtgttagacatctagttcacatactttatttttagaatgagaggttttaaaatagtaaaatttaactgcaacttatacatatatttaatactatagaaatgatataggctttatctaagggccacttttggcaaaatatatttttttcagtgcccttttcagtaccaaatggccaatttggagggaagtgcttttttagtattctccaatacttgatttcatgttcttgcttctcggctctgaagcatcctgtttcaacatgatagccccaaccatgtggaacacaaaaaagaaggagtcaatgatttggtggtcattgagatgctaaaaattttaaattcaaccttgactaaatgcactatttgtgttcttttttcaacaaattagaatgggttcaatccttttctgaaaggcagatttatttgattgcttcctcatctagtaacctagttttggacagcataaatacaaaagccaacatcctttggaacacctctttaattgatggctgtataaacttctcacatcctaagcagcacagttaagggcaaaatatttaattcagtggtcctgtgtagatagacatcagaactacttagatattgtaaagaaaattctcatggaaaaaaaactcacacagatgcttcactctccaccccatagccaatgcatgagaaccctgtacaacatcactctgattgtgaatgaaatctttgctacaggaaagtgtctgtggcctaattctgtagtctgtcccttggataaatggagactatgactttcagcaggactatatatttcttatatgtgcaaccatttaactagatgggtttaaatttgaattataaggttttcatgttacagcatggagcatttgatagaaagaaatatcttgattttttcatgtgagtgggcatgaaagaagggtctaaaaattgagggacctcccaccccagcctcctttgtagttcagttccttaaagtaaaagtcttcatttaaagaagtattgagaatgtttgaaacttgattatggagcaacttaagattcatattttctcttcagatggcttaaagttgagattgtttggattagaaaagaatttccatgaaattaaaatatttaattgcagttaagccaggatttggaaaaagttaatgtgataaagcagagtgttctagctgaaaaaaatttatgtaatattatgtaaattcatatcagcatgaaagttaatataaaaccccagaaggtgataagaagatcgaaagcaaggaattttgtttattgaattcaaattctatttacacttgccaatcagtgagggttttggactggctgtgaagagagccctactaagcacacgatgctttattcgatgtgtgtgaaggcctgactctgaacttgcttatgggccccagacagaccaaaaggccttgaggtacccttagctcccaccctccacttcctatggctgctgttcgctaggtcccaagaacagaactgatgggatgatgtgactgaaatgtttttatttaccagtgccgatgagggagatagaaccatgtagggagatatagatacacaaaagctccctgcaaccaatactaatctcaatgagttggtatttttgaaaacacatatattaatgtcatgactaaataaatgcccaataaatgtttgttgaattaatgagaaaaacatccatggttttaatgttttaaaattttagttgagatcattctatttctcttttctcatctttacattatgttataagattttttctttttttttgagatggagtctcactctgtcacccaggctggagtacagtggctcgatctcggctcactgcaaactctgcctcccaggttcaaaagttcctcctgcctcagcctcccaagtatctgggagtacaggtgcctgctaccatacctggctaatttttgtatttttagtgagacggggtttcgccatgttggccaggttggtctcgaacacctgacctcaagtgatccgcctgcctcggcctcccaaagtgctgggattacaggcatgagccaccatgcccagctaacatttttttctatgtcattagagaatatttataagcaattttttagtggctgaattgtattctgttctacagatagggtttagttttactcaaacaatcgctagcattgaactttgaggttatttaaatttttgttttatataaataacaccatgatggctatccttatatataaattttgttgtgatctctgattgtttgcctgtaataagttctctacaagtgaaattgttttatctgagggtttatatatttttaaaagtggtatttcccccagataagttgtagcaatgtgtactcccactgacagtgtatgaaagcccatttcactgtactggcaaaacattattatagttttaaacgtcaccaccaccaatctggtgaagctgtgggaaaacaggcagtcccatgcattattggtgggagtataattttttttttttttttttttggagacagagtctcactctgtcgcccaggtctgagtgcagtggtgtcatctccattcactgcaacctccaccttccaggttcaagcgattctcctgcctcagcctcccaagtagctgggattacaggtgctcaccacaacgcctggctaatttttgtatttttagtagagacaggttttcaccctgttggccaggctggtcatgaactcctgacctcaggtaacctgcctatctccaccttccgaagagctgggattacaggcgtgagccaccgggcccggcctgggagtataaattagtaccagtcccatagagggcaatttgacaatatctctcaaaattacaaatgcatgtacactttgacccagcaattccacttttagggatttaatcttatagatatgcttgaccacatgaaaaatgatgtatatacaaggttcttcattgatgtattacatgaaatagcaacaatggaaacaatgtgtatgtctgtcagtggaaagttttttttaaaggagtgttttatatattgatatggaaaatctctaaatatattgttaactaaataaaaggaagattcaaaaaaaagcgtagggcacactattatttctgtgaaaaagggagggaaaaagagaatatatatcttattggtttatatatacatgaaattgtatggaagaataaataggaaattaattagaatggagacctgttgggagaatggccaataagaggataggggacaggggtgggaaggagaattattagtttcatagatggaaaatgagtatctaattttagtggaaatttgtatttctttgattactaatatatatattaaggtaaatccctggtttaatttattggaaatacttttcttcagtttgttgaatgacttttaatttgttatgcttatttttgacatagtgttttggaatcatatgaaaaaacaatttgtcagtgctttaatctgcgatttcttctgttgcttttaagctattcaactttctaccaacaaagagactatatatataatatttcttccagtatttttatgaattcacttttacattacattttaaattcattaggaatttattttgacatatagttggaagtatgatgtaaaaaacattttcctagatggttaattggttgagtttgtaccatttattgtttatttcttcttcttcaccgtaactttctggtgcttctgaaaaacatgttgagtttttatagagactaggccctttcctgggctattcatttattttccactgatctgtttgtctactataccaataccacactgatttgattattgatactttataatagattttaatagatagtaggtttagtttctccttattctttgtctttaaaaagagtttcaatttttctgtttattgtttcagatgaactttggagtcatgttaagtctcaaaaatgattatgttgggattttgattgaaaatgtaccaaactgataaatttaggaacaattgacatgtatataatatttagtctttttatctagaaatatgacatctttccatttagtcatgtttcattctaatgtcatcagtatatttacatagttctccttacattttttgttaagattacttctggctatttaatggtttcactgttattttgagtgggctctttattccattacattttctaatcaggcaaagctggcagagtacatacgagagctcttgacttttgcatctctatttcgtatggagcgctccatgttttcttagatacggtttgtcacttgagtgttcatgtaatagttattttgatttattgcatctttgcttttagaagttagagtcaggagccaagtggctttagggaaattacttcctctctgtgcctcagctttcttatctgtaaaataagagtaatgggacctacctcgtagattcttgtgaggattcaatgtgagtgttcaagcacctggcacataataagccatcagtaaatgttaagtagctattactattatgatctctttttgactaggaaaatatctaatttgtgcctcttaatctggaaggaggcaatcagattcttactgcctctagcaatgtactgtagagggcaacacaattgaattttgaaattaaagaaaactttcatttgcctctattctgttactgcaaacaaattccacctcagtgtgcttttctgcttttagttacacaaattcctttttacatcacagtattcttttccttagtggctccttcagagtttctcattgttccttactgtgacacccatctctagttcaaatgtgaagtgggaggaggtcctacgtgaatcagagttagctagatgtgctggccagagagccagaagccctcttctgatgttatcccttagtattttctttccagagtcagtggatatcaatttaggccttaatctggcatttttcaacctttctcctgcatgactctgtgctgggtatctccattagctaggaagctctggagatggcaatttcatggaccactggcttggggttgtgacctgcactttaataaatactaccccaagcctttcttatcctgtgacctgctgcttccgcagacctgggctctgtttcagggccactgccttttcttctttctttcatgcaagtgacttacaaatgaattttaaatagccagttcatggtgaggaacttttgagatcatgttcccaggactatgctctgtctcagacatgttttacttctacccaggaaaccagcttcttgtatctcttatccaagaatattttatactcttttctcaattttggggtgaagtgtagtggcctagggcagggactccaatttcactttggcaacttgtggaacaatttatgcttgtggggggttttaaggaagtgctaggtggcttggggagggggagaacaaaagcttggttatctgttataatatttaacctgaatgtgaaatgtgtgaactctgccaaacagagtctcactgtaagtgaagcattgccaagaaaataataggtaggtggttgtgtctatttctttttttttttttaaattactggatattgttcccaatagtcagcagttgagtactaaccattttctgttcatttcagtacaggctgattattttccttctctagcttatagagttgtaatccatgcacgtataattaaaatgatatccaaatgcagttttcctttgaatttgtagtggctgtgtgtgtagggaaggttgttgctttgctataaaccacagacccagagtaaacctcagctgtgctgcagctattttggacgacagctttctagttgcttgtgtgtaattgcccatattacatcatcccaaccattgtgaaatgtgcaaaatacaaggcttatctaatgattcatttcaggtggacagtttcttttaaattaattttaggagtggttctctgcactaaacagatctccctactttgttcttgcttttttgttcaggcctacggtaatttaatggttgataattgatgtagcagagagaagtgtatcatattcattgtgccagtaacctttacagtctacctaaaatgttccatgggatgtgctttctcttggcgtaagtaaagaaccaaggggagaaaaattccctccacagcatatcaagtaagcattaacctcaaatgaaattaatttccctgtcattgagtagcagagaaaaaagctatcttcaacggctacaagaggcttggtcttactggggtttcagtttgtcatattatactgtctttcattatcacagacatatactatagggaagactttcaatgtctctgttggtggattgcactaactcatctttaagtcaggtatgtgaaattcaagtaagccaagaccttccagtttttttcttatcaatgttgaacattcataggctaggtaatattacatgtttagtcacctactagtaagatgaggtgtttacaactaatatttatctttggccttggaccttctacgttgctcacagagtacagttttgtaaaatgctttataggtaatatttcaaagtggacaaaaaaagaagattgcttagaaccagaaaggtcagaaatagatcaaataatcctgggactttttattgctgaataatggactttgtaaatatcacatgtgactattagaccaaatgagactacatagaattcaatattaattggttcagtatccgctgatggcctgtttgcaggattcaatgaaattatattatcaatacaatgttttattgattccttggtttgcaaaattaaataaacatagcgtaagcacttgcagtggtaagttgtagcagggaaacgggttttgatttggaatttgaaaacaaaattaaaggtgattgaagcagaaagcaggctgtggcataacatttctgccagcacttttgaagtaactgaatatatctgggtgtttgggaggaataagaatcagagaacagagactttggaggaagtgtttcaaaatgctttcttaagggttatttcaatactagcaactcattttgttgaatagtttagtttgctttactatggatatattaatttatttcattctatgctatttttttccagtatctatgccattctttgtgttgttctagataatggctaaatagtggtcagcaaaactgacatagtcccctgccttcatggggtggggggacaaaacaccaacaatataaaattataatgctatgaaagaaaagagcatattattatgaaagagtaaaatggggaaactcaacctagtctgggggaagggaagtaatatttgagctgacccttgaagggtgagcaggagctgtgaggcaaaaaggtgggggacaggaagatggttgacggctggctgttgacattaaactcttggcctaatctcagggaaccatttcccacccctcccccaccaaggtggtctgaatttgagtgccaaagtcttgaatccaacacacagccattcgttaaaaaagtggaaagaggctgaggcaggaggtggtggttgtggtaacacacagagtctaccatgaattctgaaaaaatcaaattcatttcagaaaagcagccatgaaaagaatctgtttcaaagtaaagaaagaagcagcctgcagccagcttcagatggatggtttgtggctcaaatccattcctccagttactgctcgatggcccttttgagtccatgccacctcccacccccaaccaatgtcaatgggtggtgtgcagatgcagctcagtaagatagtgttttagggcatgcaaggctcatctagtcacatttataacatagaatcagagtactgtcaaggcaatatttatcattttatattctttcttggctactcttgataaataggaggtcaagggcctcttcctctttatattccctctggataaacagacagcagtctccagagaagaaaggcgtctttccttccctattttctgcttccaatctgtttctttttccctctttctgctccaactttttttctgtgacgttctgtctgacagtcagcagagggcgtatagacgcatcaaaagccagcctttattcaacttggccaccgtaatttcattgtctttatctcttcatctttacattcctcaaaggcagggatacatcctggcgttttctctttgtaatagtaccatcaagggcaaccattccttacctattttataaaggtgggcaaaagctactgtctagataaagggaaagaagttgtgttcctgagagctgggaggaaatgtgtgtgtgtgtgtgtgtgtgtgtgtgtgtgtgtgtgtgtgtgtatgtgacagatctcagagttgttggtgccctacgtgactcatttgggaaggactcgttttgccaatagcaaagcagacagtctgggttcctcttcttctttgctttcccggggctgttgtcctgatagcagctgccctgcttcctgacatgtcctaataatgaagatgatgtggccagggggagattcatcttcttccctaatctgacttcttcattgaattttccccttactgaagtccaaagaggattgtcccctcttaactgtgtgccctttttactctgcccaaggtcagagaatccagctgtggcctgtctgcctcccacatctctggctgcagagagtgatccatgtttgtctgtgacagctgtgtgaatggtacgtgagaggcagaggagagctgtagtttaagctgctccaaagatgtcttggtatggcagtgctgacgaaaggggagacttgtttgtgtcgatgacataatcagagaagacatccatggcccagctgcagggagtgaagaagtgtgcagcttagtatagtcttctgacaaaagcccacacacttcaggtttatctgcccgtagtgctaatctccttctgatgtcttaacctgacttttgttgtagtttgttcagacggttccagtgacagaaagaattgcttggcttgtggtggttatactggctagcacgttaatacaagtgcagggtgttttataaccaactagtctcataataactacacatgaagaacaggcaaggtttagtttagcatattctgcctattggaaagcatcagacacggttatagctcctcataaataatactgatggctcctaaaggccatttttcatgtaaatttccttactgttagtgagcttgaaaaagaaccgtattgacgaacaggttattttaaaagtagaatgattactcaataaaatacttttcagctttttcctttggggctctggggttcccccttatctcaaggatccacgtgggcagattgcatgttagctggagaacccaatagacacattcttatttccatgccagcaaaacactaataatctaaacacaaaggacatttaacacagtaactgtttctgatggagcaagtggtactgccagctcgctttctcttggatggcttctgtacggtgagagcaggattgggagttgagcccaggctactccttagtttgtgtggtataaatgaacaacttaagaatagtgtttgtatagtcagggtcatttctgccctttctcaatggacttgaaatcctgggctgaatatttatccagcttggttttgtgtttttggaacaaaggaaatttccagtgaccagtctggttaatcaccaacgcttattccctcttcaccactatttcgtattggatttccttctataccagtacattggatttccaatcacatcgaaccctatttggctgccttccattcacagaagattagattcccttacacctcactgcctctcaggatttttctctccacaacgtgtagagtattaggttcccttacatgagttgctgcttgttaagttgtgttcagtgctgcgtagtatcgaattctctttctcatcagcagtcactgggttgttaattacacacttgcagattcacttctcctgcacatgctgtgacacacagctctccaaagctctgaactcacacttcaatgccttagccatatctgcccagattcagtttacttcagctgtgtggtattgaacacctatgcatcagtctgggctagatactgcggagtttacaaaaatgagtgctgaataatccttgccctcaaagagtttacaatctactggggtggatccagggcagggcagtgcataagatgaagaattatgtgcgtgaaggttaagtattggttttactcttttcctagaaacagtttagtatctggcgtatttaaagcaccttagaaggcaacatgttcatcataatgccattattgccaccattctgttccataatgggaagaaaacattaaaaacacaattgtgtgaaaaaaaacccttttaccaggttccaatgcagttattggtagagttggtagaaaactcttaggtctcttaacaaactcttttaacagccctgccttcatacagacttaagacagtattagaaatcatataattctaagagacataaattaggcatagagaaataaacattgctatgtagactgtgctctaacatgccttgacattacttgcaaactaggatctatctctgttgtatttcttttggtaccaaaatactgtgcaattttattcacccctggaaagagagggaaccaaaagtaatacaaagtggagcaagtcatggtttcccacaagcaacagaaagtggagaaggcattaccagttgtgattttattgctcagcattctcaacttcattgcaaattcacaatctagtgtctcacaatggtgtaaatattgcctaataccttcttcatgtagcttctcattccttgaatgcttaacatgtgccaggcactgttccagatgctttactgtagaatcccagttattgctcatcataaatgaatcttctctgcatttgctgtagataaagaaaaaaatctaagttactggcaacaaagggatgtgtttttatccctttctgccaattcaaccagagcacttcattaatgccaaatttctaatttgatgtgaacagcactcctagcatagtctgaagcttgaaatgacagtgatttaaaaagaaaatagtttagaaaaagacctagctaataagaaaagctatttgctataggaattcagtaaaaacccaagctttggtttaagttttttctttaacaataaaatattgtgtcattttaaaaaaaatccctggaaggaagggaaccaaaagtaagtcaaagtggaaagaggtcacaggaccaatgcttttgctgtctacccaatcttttctaactactcatatgtattgtgtgtctaaaattcagagtatgatatctgtcttttcttttttcttttcttttctttttttttttttttttttgagacggagtttcactcttgttgcccaggctggagtgcaatggcgtgatctcggctcactgcaacctccacctcctgggttcaagcgattcacctgcctcagccgcccaagtagctgggattacaggcatgtaccaccatgcccagctaattttgtaatttagtagagacggggtttccccatgttggtcaggctggtctcagactcctgacctcaggtgatccacccaccttagcctcccaaagggctgggattacaggcatgagtcactgcacctggccgatatctgtattttctaacctaattgtgtagcataaagagactttattagtatggaaaagtgacagcaacatttagaactcatttttcaaaggtgtgttactattcaaagcctttggaccatagcaccatttcattagaataatagcatgttgatcctcaattgaaatgccctactttcttgtccatggttatcaccagtagtcagggaggttttcttttccgaggcttgtctttaatcatatagggcttgggactgtactagttcaaccactgtggaagacattgtggcgattcctcaaggatctagaactagaaatatcatttgacctagccatcccattactgggtatatacccaaaggattataaatcatgctgctataaagacacatgtacaggtatgtttattgcggcacgattcacaatagcaaagacttggaaccaacccaaatgtccatcaatgatagactggataaagaaaatgtggcacatatacacaatggaatactatgcagccataaaaaggatgagttaatgtcctttgtagggacatggatgaagctggaaaccatcattctcagcaaactatcgcaaggacacaaaaccaaacaccacatgttctcactcaggtgggaattgaacaatgagaacacttggacacaggaaggggaacatcacacacctgggcctgtcttggggtggagggagggggtatatctaatgtaaatgacgagttaataggtgcagcacaccaacatggcacgtgtatacatatgtaacctgcacgttgtgcacatgtaccctagaacttaaagtataataaaaaaataagaaaaaaatcatatagggcttaatatgaacatctagacacagactttattcttccctaatgctgtccccaaacctttctggagctcctgctatgtgtaatgtagcatgttcctaccttcacaaacattcctgccagggcatgtacttccatagctcaaatatttcatttttttttctttttttttgagatggaatcttgctctgtcgcctgggctggagtgcaaaggcatgatctcggctcactgcaagctccgcctcccaggtgtatgccattctcctgcctcagcctcccgggtagctgggactacaggcgcccaccaccatgcccggctatttttttgtatttttagtagagacggggtttcactgtgttagccaggatggtctcgatctcctgaccttgtgatccgccagcctcggcctcccaaattgctgggattacaggcgtgagccactgcgcttggccaaatatttcatatttcatcttcttttgaatccaagacttgtaagcataatttatggatgatggcttcagagaaacaatgagttacaatgtatcttatgattccttggacatgccttatttaatggtaaagtttccattttccccctgttgctcatttttagctataaagaccataatgccagtcactgcctgaaatctagccaccccctttcacattaatattaatagcataatggcaaacattctgtacattgcctgtgactcacataatcaccatgcaaaatgcatcattcataaattgtttagtgcgacctttggcacagtagcactaattattattatcacagaagcccagtaaactagactggtaattatcagggatttatttgaatggacagctaagctattcttggcaagttagtcaaagcagttgtcatgacagccatacaaatatgtcttatgaattgggttaattagggtaattaataactgttatttgttccccttttcccaagatattgcctcagcattatcaaaagggtgaggggtgtaaactttaaaataatgcttgaatccttctgctaagaaagctactgacgaaatcaatgaaagctacctaccttccaaaggtgctcccttagagaaaccctcatttttatgggaccttctcctacttttggatgtttcagagtcagcaagcacaagccatactgaaaaaaagtagttaaaaagagaagctaaatagtcagttccccgaggctgctgctttccttttagtcacctgtgagaactcccaagagaccatccctctggcttctacttttagcagagccctgctttgttttttgctcatctagaactttcttgccttgctctgcagcctgttcattgtataatttttttttcttatttttccctcacaaggaaattctgagtttttctcacccacatttctgcccctctgaggttttccaagttttaattttgttggaggccttttttaatttaatgccttagggaccatctaacattgcctgatggtggttttgctcttttttcgaagaaaggaaaataggctagctctgaagagctttctctttctcttccttaaaaaagtaaaggataaaagtccaagtttcttctctctgcatcacagcatattaagttgtttttcttattctagtgcaaagaagagagaaagggagaggttaaaaactgaagctgattcttttccccaatgagatgattctttctttcagagtaaatgttgttcacaaaaggactttaagactttttgtgatggttttgaacagcaaatcaatttctctccatttcctgcataaaactaggagaaggaggctgggggaggtggctcacgcctataatcccgagggaggctgaggggggcagatcacaaggtcaagagatcgagaccatcctggccaacatggtgaaaccccgtctctactaaaaatacaaaaattagctgggcgtggtggcacgcgcctgtagtcccagttacttgggaggctgaggcaggagaattgcttgaaccccggaggcggaggttgcagtgagctgaggttgtgccactgcactccagcctggcgacagagcaagactccatcaaaacaaaaacaaaaacagaagagaagggacacaaggcagaaagagaactgaggatgttaattaaacatctaatctatgtcagtttctgggctcagtacttttcatatattaactaatcctcccaacaactctttgagactggaaacattattatcctagctttacaggtaaataaactaaattatatgaaagttaagtatttttctgagatcacacataaacaggacttgaacctcaagtctctgatccagagtctcctttcttctacaccagctagaacagagtttccccaaaaaagcaagaggcttttagtacttcatgaattccagatgccttgctcacgccacaaatttctattgaatataaatgcccatttattttgtttgtttcaatgcctgttcagcaattgagatttctaggtcagtgccagcattctggctgacccataaaattcaagtttgggaggaattctggtaaaatgcttttagcagagggtgttagattaataggttagaaaaagtgccaactttcttcccatgtcatactggaatctcatgatcagaaggtagcttcctctattttactttcagttgccctgttagggaagaaaggctttctattgcagaagtggcttggtggtgcttggaagctgcacaggatatatggaagatggagtggtttagggttctccaggtgtccctgtcctactaagtcagagatcaggatcaggttctgacatcttaggaagctgaaaactgacacacagagacccatttcttttttctttttttctgaggtggagtcttgctctgtcacccaggttggagtgcagtggtgtgatcttggctcactgagcctccacctcctgggttcaagggattctcccatctcagcctctcaagcagctgggattacaggcgtgcgccaccactcctggctaatttttgtgtttttagtagagatgaggtttcaccatactggccgggctggtcttgaactcctgacctcaagtgatccatccgccttggcatcccagtgtgctgggattacaggtgtgagccactgtgcctggcctccatttcttgatatgttattattaaatgggccatggtatcatatatttagtatttttaagttttgtgtgggtgtgtgtgtgtgtgtgtgtgtgtgtgtgtgtgtatagtcatttgtctcgtccatgaaggaccttcattcacttgataaacactttgtgccaggagctgttttcagggttccaggaacagcagtaaactaaacagacaaaaaattcctaacatcatggagttaacattctagcaggggaagagagataataaacaaaataaatatgtgaaatgtatggtattttagaagataagtgatatggagaaaaataaggcagaaaaggaagataatgagttttggagaaaatttgcaaatttaaatagggtggttaggtaaggcttcaatgaggcctaattttatttcttaccacttcacacacaaactttcttctccagcaaagcagatggttcattcattcattaatgcctactctacctacctttatatcctaccaggtatagaatacacatttaaggacaaaacacacttgcccctacccttttggagcccaaagtacaggagatagacgttgaaaaaaataattacacagataattacttgcaattgtgataagtgtgatggaagtagtagaaagtactaacacatactacatatggaggccaatacacagctactaattgtattaagctaaaagccacagatggaccaccaaacatttggtatccctggattctagtaggaaggaccacgatgacatgattacaaagccacaagtctcatttggtttaacctgtgtctagggatctgtgaatttgtgatttcaaatgtttgattgccataattttattagaaaccttcagcctccaacctaggcaattactggcatttgagtttaaacacatgcatacacacacacccacacacacacacacacacacacacacacacatgcacacacactgttgtattctttggaaaacaaatgaccttttgatttggtgtattgtggaactgctagaaaactggcttagaaggagggaaaatgttaatgaaggtaatggctgatttttagagcagagtacctatttgttttttcttgtcctttcattgtgcctccaaagcttcaaaacctcctaaaaatgaaagattataggaaaaaatgcatcttttactttttaaatggtagacagcaaagtattttaatgaggaaatatattatattattctcctacaaaccaagggctaatagtctggaactggtactttggctgcataaaaagtccagcaagacaagccaattatggactctgaaacatttttatttttagttccttgtaatagcgattcattctctgctatggtacattaactgggaaacaagttgaaatgagagttttggcaactttagaataattgactatatttaccaaattcttaatcgtgcagagaggttagcaggggaggggcatagaagaacaaaagattaggtcagggaaaaatacgtctaggagagtctgactttcaataaaggctaaatagacagctttagaatacagttttagagaactcttttttcctttcagtttattcttcaagtagacaacagtttggttatttgtgctgatttctgcctttatgtatgatgtggtgttacttttgtgagcagaagtaattagttgtttacaaatgaagaatgcagtaggcacagctgtgatattcttttccctaccacgagatctggtagtccccaaatttccctctacatctgtgtgcattggtaacactgttaactgctctgttccctttcttttccagtagaatttcttttgtttgggatgactgttacttttccttttggtcctcttttccttcagtggctctgcttgcctatctggtggtcgttttggaagttccaacccagcaccaatccagagtggagctggtgatgccgaaatggaaggagtgtttgggaagggtagatatgttatgagggaatcacgttgaagttaaatgaaccgctaaaacaaatgtaatcttaggcctcattaaggaggtatagttttctgattataagaggtattagtccctctgaattctttgctgttaagactacatctggataatgatgtctgattctggatgccttattttatgtgaaacactgacacactagaatgagcttcaagggaggttaagagactgataaacggcctggagaccacatcacttgtggaacaatgttcatactgcttaattatgagagaggcaaaaagttgtatgaagccaaccttaacattgatctgcagtaggcaaatgtgttgaaatgaagagactaaaactaaactttcacaaaagcatgacacattcttcttagtgtttggcttgttaattagttacgttgagtacaaatatttatagtatttgagtctaggaccagctaactgaccagcacaacagctttcacatactcagcaagggcaattcgttcttaggtataaggccaaagactgacccttgggtgatcatggagatttcccttccctttgtagagtgctctgtatttaatcttctaatcattaaaaaacagatgctcaccactgacagaggtggggttcctagaaaagatggactgatggctgttatgctgtcttccatcttcttgagacccttagcagctttgtagtggtatgctttagtggggttaggaaggagttaatatcttggaaaaaccttggatgtggcttgatttcctcttaggaatattgagaagatgaacacatagtgggaaatttttaaatttactggtgctacaggcttttttccaaaaggcatttgtagtagtaataataatagtaataataatatgcccaaatgacagaagaaatattaacttctgaaaataaaatttcaaaaggcaaattttataatatggttgaccaccttattctttttagatcacctagggagaggtcattcatacctttatttattaattctctatcttctcatgccttattgatttacttttccaaagcacagcagaggaaactttggggggaagagataaaagtaatccctgtttgcacagcaacacaatgtgtacattgttggcttaaggcctgtggtggacagaaagactctggccttagagtccttcaggccctcttatccaggaagagaagacacagaaacatcgttctcagagtagagacagtgtttctgagcgacccaagatttctcgtttcttcttgtgaccttcttcctcttttgggcactgaatggggtcaggcctctagggatggcacacagttagttggtgagagacaggaagggactcagggtccagcagctcctggaagggagaaaggtgacccagtaacttttcagcttcttttggagaaaaggcacagtgtcaagcaatcaggagaggaagaaaacaagcataaaatccacatccttaaagtccataaatggtgaaaggaaagctctctctgctccccaccaagtgtggaagttttatggtgtattctctattcatagggctgacagagagtgggactgacctgctcaggaaggtgaaggtctccacctacaggctgctgcaggaaagagctcagtctgcctttcctatccttgacaaggggagtagagccagttttcagaggctatccaagctagggttgacttgtctcaggactcatctttatgcaaagtctgcaaaaagaatttgaaattcatgaacatctgaccactggagaaaacctttactggctcaaaaaataagtctctgtggtttaattagctaccccttcggatattgatttttctagcacttgtacagaatgtaactcatcttccaaactttacggaagagccaacccaaatccagctggatttgtggctgtagagaagttgcttgattttattaagcatggcttacgttctgtctttctctctcccctgacatttatatgtaacttgcaaaatccaaaatcacagctagagagaagcaaactcttcccccaaaccaaatattttccctaggtctatcccccttagatcatatagtctgagggcacttctgatggcatgtgttacccatggaggctttcttctctgttgctctctcctccgtgctcccatggcacactgtatataccacttgctatggcctaaatgttggtgttccccacaaatttatatgttggggacctaagacccaatgtgatagtattaaaaggtggagcctttaagaggtgattaagtcatgagggttccacccttatgaatgggattattggccctgcaaaatggctccagggaaccaaccagcacctttttgtccttccatcttctgtcttgtgaggacacagtgttcctcccgtccagagaaagatacagcaacaaggtaacatcttggaagcagagagcagctctcatcagacaccaaatctattgataccttgatctgggacttcccagcctccagaactgtgataaataaatttcctttctttataaatttcctagtctcaggtattttgttatagtagcacaaatagactgagataccactatggtagcacttacaaccctgcattataattgtctctccatttaactgtccccagcactagaaatgtgaactccttgagggcaggagtggaatcgggttaatctccagatccctagcgtctcccatggggcctgacacatagtcttaacagtatttgttgaattgaattaaattatttcagccctgagctgtacaagctgtcatttgttctgcaacagtcagtcgaggacagctagggagcatgaggcaaatcttttcaattgtggggaagcctctgaatgatctgtttttgcctttttcttctacccttctcatcgattccatctatcccttttcattactggttgcctgcaccttgtgcaaacagaagtcttaaacagtgcaggatcttcagtgacttttttgtcttttgatccggggctgatggcttttcattttactcatgctttatatggcatagtcaagtctgattgagacttatttggtggtagggcagtcagaattactggtagaaaagaaatgcaattttattactttcaagttcatagaatgagaagaagtagactaataaagtctgtgccaggaagttttgccaagtagaagtccttggacttgttttaatgaataaataagaatgatgtgcaattaacatacttattgtttgtaaattgcttctaaagtgcctaaaaacaatttattcttgttagtttaaacattttccttgtaaccttgtttataccacaatttgcccagcaaacctttataaaaatagaaacagcagcctagctctatccgaatgctcaccaaatatgaattactgaaatctgaactgcaaaggtatgactccaacacgggaaagcaagtaagcctgagatggatgcttttaggaagtgagcagaacagattttcccttttctacttaggtgttagttgcaaaggcagaaggttatagttagttgctcagtactatttagagaggaaaaatgctcccttcaccagggagcaatacttgtcatcattccagctccccttggtggtctaatgccagagagtttctttccactgaggcagtaaaaatgagaaaatttaccttttagataatttcactacgatcaaacaatccccagtgggcaaaactaatagaagatactgtattttgattgcagtttatctctagcaattataaatgagcaatttaagtggcaacaaagcaagttgtttgctagaatgaggccgtatttcacagagctttatcattcaatattctctggatcactcagctaaaggcagtctatttccttgggtggatcatacatcctctttctacagtatccctaggaacaattacttttcttaatgatagggtattgagaagaagtgatctacaaacataatttacactaattttcacttttttcctcccatgagaaatttagttgacaagactttgagtattaggttttattcttccaggatttcttaagagaactaacaagaaggagctgggcaagtagagagaatgtcagaagagctcagttctgaatccatgcctgagtttccaataaccagctgcgttgctttgggggtggttgtaagtttctctgggcccatttccttatcttcaaaatattgtgtgtgtgcacgcacacgtttgtgtgtgcgcgtgtgcaagagagataatagattagatgaactctaaggtcatattgaattttaatgctttacgagtatatattctgtgattgttcatgagcccaaaggggaatttttcagtttttcaaagctttcagtggacagcatagcattgtcaggttgcagtaatgatttcgagaacctttgcaaatgactacatttggcaataaagctactgtaggctctaccatggcctgaagaaataattaatattgcataaaaatatatattttttaatttatgaaggatagatctcaaaagggactatagattgaaagcagaaacagtaagtgagccaattgggcttccattttctactgtttataaatttagactgggtggaaggtcccctggtttggaaagaaggagtcttaggttcttgctctgactctgccagtaattggctatgatcatggattcagaaacttttgggcctcagtttttccatctgttaaaaggggaaaggagtattttgcctatatacatctgcagactgttgtggttattagaagggagcataggtcaaggctttgtaaaaaaaaacaattgctatattaatgcaaggtgttatttgagaaaataatttttaaaattgggacattgagatacacagttctacaggtgtttctcattgtgctagattgtgaaacattgtctttgaaggtgtggattatatcatgttcaatattatgtatattacacattggcatttcaatggaatgggaatagagggatggggaaacaacattagtttggttttgacttaaagccagttttttctactaagttcttgggaaatgttgaaagaaatacaagtctaggaagcacatcagcctttcttaaaagagctttgcaaactttgcatttctgattcaatctatgaaagagacaggtgagaggttcctatcagctgttaatcagttaaccaacagtgggtgagcatttagccagtgccagggacagtgacaggcactgaagataccaatactaaaggtgtggttcttgcccttaaggagttctccaacctagtgggggtgagatataactaagcaacacaatgtgttaggtgatgtgatagaggtaagtatattccttatatttccttaggtaacatttcagaaccggcgaatcctgggtgacaagcctccggtttctctctaaggtactgctgtccagtagaactttctgtgatgatggaaatgttctatgtctgctctgtccaggacatggtagccacatgtggttactgagcacttggaatgtggctactatgattgaaaaactaaaattttaatttaatttaaattttgtgaatttaaatttaactagctacatgtggctaatgtctatgctattggacagcacccccctgaggaatggtagtgtgagcccacagtcaggctccaaggaggtcctgagttggatcatagaaagctctggtcaatttgcccctgtcctttaaccctgttttcctatccaaatactgcactagcccttgaatggctcctttccagccgacaactctgaattatgcatgctaatgtgtgttactcaaccatggcatgaggttccctcactcccctcccccaaccctgccgtaaagaaagggtactctgtgacagttcaatcatgatgaaggaagaaaatgggtcgaagaaaactagtttataaaagcttttaaaatgtctgaaatcttgcttttcacataatttcagatggtgtgaggtaatttcaactctctttaagctgagttttagctctctttctctctccctctccctctctctcacacacacacacacacacacacacacacacgcacgcacattctacctaaagtgtctgctgtggtagatggggctccttgtattcctattgaatcagcaattagagaagttgggtatataatatatttattttatatatatattatttatatatataaaataaatatattatatataaaataaatatattatatataaaatatgttttatatatatttatcatgtacagaatatatattatatgcccatatatatatatatatatatatataaaacttcccatgccaaaaacacaactcttcatcacattattctttttctgatagcgtagataaagggagactgagataaaatatcctagtaggaaacctcagaaagaaaactattcacaatattcaatgggagtttagttggacatagaaataaatattcagaagaaatcaagtttacgacctggtaagaagacttgccatttgtctggtgattcacagttttggaaagtgcttgcacatttggtcctaaaaaaaaaaatcccctagaaggtatttgggacagatattatttccattttttttttttttttgagatggagtttcgctcttgttgtccaggctggagtgcagtggcgtgatcttggcttactgcaacctctgcctcccgggttcaagcgattctcctgcctcagcctcccgcgtagctgggattacaggcatgcgccactacgcctggctaattttttgtatttttagtagagacagggttttatgttgggcaggctggtctcaaactcctgacgtcaggtgatccgtccaccttggcctcccaaagtgctaggattacaggcgtgagccaccgcactcggctgatattatttccattttatagattaggaaatcaagagtcagagaggctccatgatgtctgcaagggcacacagctagtaagaactttttctattttcatcttgaaggctctgtgattggaggctttgtaggatttttcttttacatttttttcttatgtgcttttttttttgaagcttataaccatctgcaagaaacaatcaccagagtaactttttttttttttttgaatcggagtctcgctctgtctcccaggctggagtgcagtggcgcgatcttggctcactgcaagccctgcctcctgggttcacgccattctcctgcctcagcctcccgagtagctgggaccacagcacccaccaccacgcccggctaatttttttttttgtatttttagtagagacggggtttcaccgtattagccaggatggtctcaatcagctgaccttgtgatctgctcacctcggcctcccaaagtgctgggattacaggcgtgagccactgcaccgggcccagagtaacttttgaccctaaatgaagctgggtctaccaggaaccaacatttaaaaatacctatacacaaaggtacatcattgtttccttcacaaaaattatatataatatacgtatatatagacacacacacacagttaagaaatgactgcccacacctgtttctactggtttagccccgataaaagtgtttctttgctatcaaatagacacaggtattgagccgaccaggatgaggaaagggtgtaccagcttccttcgagagaaaggtgtgtacataagagtgaaagaagaaaggggtctctaaacatatttgaaaaattgaccaagagagagctgtggagggaggaagctgagaacaatgtggggaaaggaaaggacacatcaaccacactggttgaggagtatgctgtctgacacagtacagcgttatgtttctgacagtgttaacttttgttttttgaaagttaagtttaaaattggtcctgatttttgctgctgggagtctgatggtagaggtagagtgaggtgttcccctcattatttcatttcttaatcttcctgcaggaggaaattgctctggttgtgttcactgcctttgaacctgtcgtgtttaagcaggctagtgtattttttttctcccaaatagtatacctcgtcagccagtcctatttactttgatttcactgcattttccagaatcctaatgaggtgtggcctagtggtgtgagcgcaggacctggcaggaagactctcaaattctagttgcagatgctagatgcttctatgtagtagagggcaagtctcttgacctcttctgtaatgccgttaacagggttaataatatttatttagctcataaaggcagcagggggattaaatagttaatgttgtttaaaaggctttgagaaaaagaaaaggcaagtttttttgtattgtgtgcattttcaaatgctaattcttattaacaggaagcatctgctccattacggtcattcagcacctcatgaaagtcttgctggctggatgggaaggaaaattcttcaattttgtgccatgagatctgagaaaatgtagctaccttcagccccagttatgaacttggatgtctgttttctccctatctaaaaacattcttcttctttatgtggtttttctaaggtttagtagtttttctctcttttgcaatcttttatgcttaccattactggtgcaaaatgactattgtgtttcagctgtggggggaatgaaccctttttataataggcagttagacattctggaagtctttgtgataaaagatttcatagaaatacaaggtgcttcagtaattgttctgttggtgccttgcataactgcattacagatttctaatactctggcagtttcaagatgctgatgatattagccactttgtgaagggtaattatggctttctatgcatggttgccagcactctcatgtcagattatagtagccttttggttaatctctattttaaatcagatcaaattctaacccaccctcatccctcctcatcccccttcccaaataaaatgagaagcactgtgaggatttgggagaaggacaggtggggtattttagagaatgagaaaacatttctattattattttttgagtcatcttcttattgcttgtcagttatggtttatgaagtgatgccaaagtataaggtctatcttgcctccaacgctgatttgctgcaatgcttgtttaagttgctagaaactggaggctcctgtgggtttccttctgtgcctaataatttcaacagagccaaatgccctttatttactacagtcataattagagggctgccagtgttaagcaaccatggaatctgagtttgagaaatgtttattgtgcctcattaaatctgaaatgagtacttaaaggtcagaaataaataatctgtttatattttttgtgacagtaaatataagtgaatgctgtgtgtacatatccttgactctactcatttcagtgtactgagacacccctctgtttgccaaggcagtaatcacaatatctgcgacaaaagagaactatggcaggtttcattgatcacaaacaagaaaatgatctattgtattgtatctaattagaaaacatcaatattagaagctaatgcattcactgtttccaagatggtctatcacttgattgttttttgtcagcatgatcacattttacgggcttgagcaacaagctggtacaagggaaatgaatttagaatgatatgccaaaggctgttgctccttcagtcttaaataagcttgtagaggcaactgggtttttagtggcacataatataaataatgggattggggttggaacagaatttgggggtgttgttttggcccaaaggcacaaggccacccaccgctttctctctaaatattttgaaagtcttttcagctgacaaagcttactcaatagaaattgtactctgcacactccgcaggcagtcagggctctgtagctggtaagtggcagagaactgaggcactgatataatagaatttagcagaaaggaatggaccagctcaggttctgagggtgctagtccttctgtgagccagaagggctcaaaggtaggctggatccaggagagctcatactgtgggtttctggatcccattgcttgtgggagattacacagacacacacacacacacatacacacacacacacacactcttatatgtgtgtacatatatgtatatatattatgtatatgtatatatgtgtatatttatttctttattagagatgggctctcgctatgttgcccaggctggtcttgaactcctggccttaagcgatcctcccacctcagtcttccaagtcattggggttacaggcatgagccacaatgcccaaccctcttgtgggagatcttatatgggtttcttattgtcagtttgaccagctttaccaaatcatagcttctaaaattgaaaccaccatcatgactattaatcttacatcttaggtcaccttctaacaatggttgccattgcctctaaagggcaaccaaaatggtcaccaaggtttcagggaacaaagtggctcatttctggatcccttgggctctgtgagtaggccctccagctaggtctggagaatgatttccagttagtgtgtgccaagtttttcctttgtctaactgctggactatagtcccctgactctttcattggaattagccaaggaaatcactcagagaaacataggtaggaagcaggctaatcacttccctgatgttactgttttctgattgcttcctatcccagtagcagaaaatgccaaaaacggtgctcctggggtttctcttattgtccttgttgcggcatgctctagctgagttagtacttaatgtggctgtagcacttaacgtgtgtgtttgttttcatggctctttaaaggggaaataacagttggcacttgcttgtaaagtgctttgatatttggggatgaaaggcactctgtgcctgcaaaatagctttaatgtgttgtagttacatgtttggtagggcgattggactccagaatttgttccactggcaaatgtggttgagagctatttggttctccattaagttctgtttacatgggattaaatagtttgacttacatgactgaatttttcattttatttgctcttgaggtactcttactcatactgagatattgttgattctgcatttgtacatataataggcattaactggttccagagagctttctataagcagatactatttcagagtgcactatgccccacaaaggacttagaaaagggtcgagggccttattcagaagcctgtatttgttttatggcatggtgtttaagctcgtctttcagcaggctttgaattgtatggtttactgcagacagctgctaggtttctcaaggaggcctctgtagtgaaattcacaactgggttgctcttctaaaggcataactttgacccaaagatgagagcaaagaaaagtgctttccctaagccatctttgccacctctaggtagggtgaccacatcaatggtgccagtgaaacaataggaatgacgatgagaggctgctaggaggggaattctttcaatttaatttgttgaatgttaaccacatggcctgtgtttctcattgatagtcctgtcctgacagtcactgggatgctagagttgtttaccacctgtagaaaagtagctgccacactgtccgtctgtgactcagaggtctacattctggtgaaccctcgtcttctcacagaaacgctatcaaattgggttcaggaacactatcatatgttgtcaccaccattcccagagatgtggcaggactgatggagttagatgggcagaaggcacctaactgtgtcatcttatccctttcagttatatataggctattgtgtatttataaggtagtagttgggagtgataacagtgaacaaattgtaactacagaaggcagtgtgcagagtggatgctttctgaagaagtagaaccaccttggcctaataaacttcgtcacctgccttaattgtgataagtagcctcattcttaatcccttccatctcttctctgatcattcattgatgcattatatgaacgcatgctaaatgtttagcgttgtggcagatggcacagggacctcaaaagagagcttccagtcccgttgagggatgaactgacacactacacatgaaataatcatagaacctgaggaaatgcataattacattgtacagtctgtatacaaagtgctgagaaaatgctaaggaacgtgggatgatcagtgatggagatatattagaaatgagggaaattagatggcttgtgttggatgactgcttagctaaggacttcatgtagatttaatgttaattgcaacaaggagctactgtaaggtcttgaaaagagaagtgatgtgatgaaaatagtgggtgaggaagattttccaaacagcattttgcagaatgaggtagaacaaatgcaggtgagaaaaaaatgacacaaggtgatgaaggctgtggaaatggagccaaaaggacagataatatgggctatttctaagaacgttatgaattgtataacctatttgataggatagggagatttcttgccttttatgatgggggttatgtacatatgacacatatgagggccaaattctcccatgtgagtcacctacagccattgagccattagggtgttatttagttctacaaagtagcagtgtaattctccaagttgcagtccagtagcctgcgtacaagtatatgcctgtatctgcaggtacataggtgccagtctgtgtatgtgtatttacctgaatgtctgacattttgatcatctctggtaaaagatccattagtttgtgagctccttgaaggtgcaggctatttttttttaattcccagggtttggttcatgcttactggatagataaatgaataaattaagaatcactttgttttagaagcctagaattgtggagcttgaaggcaacatggagtccttttggttattctcctcattttaaagaaagataaattaaggcctcaagagggttaatgtgattcatccaaggtcatctgtaagttaatgacaatcctagggagagaatccagctgtccccactataccacattgctttctgtagtcaaactgtgtgtgtttgtgtgtgtgcgtgtgagtgtgtgtgtgtgagagagagagagagaatgaattagggctggggtgtgtggggagcatacaactgacaataagtggttagtaggagtttacctagcacgttttctagttcagggcaaatatgaactttgtaatgttggcagctggggatggtgccttttattccaccttcactaattcctgcttcagttgctgctgtctggatggatgagtctttgaatatacattctagctggaggcacgtcagctttatttttatacagaatttgcatattcatttttatgtgttgggggtaggaagtaggcaaaaactatttattatctcatttccaaaagccatctttgtgaggagatgaccatttgaacatctaaaacagcaaccagctttaggaaaggttatgtgtcttttcattatggatcaataggcacaattatcattattggaagtcagcagttaaaaaaagaagcagcgttttataatcactttgttgtgtatctgatacgggattccagttttcctgttttgattgctaaaatgacttaagagttaaaaactttaaaaaattaggtagcaaattatagttataatgcttttcagctcgatgggactttaaaagtgtaacttaaaagttcgttcattttcaaatgaaaatctaaagatttgagtaacctcagttttaatcccaatgtctgcaaccttttttttttttgcttggtatagtgacctgggatttgtgccactggacaaagagtctagtcctggatatctgcatttattgggcttccttctccttaggtttgaagtctctctgctgataaatgtggtgctgagagagctgcagtcactcttctagagactagggcacgattcagtgaactgtaaaagtaatgcaaaatgacaattaaagtagggcattctctggtaccttgggggcctgacaaagtggaagtatttgacttctgatatgccagacttactaacgtagaaatgtaataacatatcccccacccaaacgtcttactagaatcctcctatatccagaagggacctgagaacagcaagtagtaagcaaagaaagctcccaagcagctaacaaacaaacacagaaacaaacaacgaaaatcaaaacattgcacaaaggtccctatattaaagatcatgtgatttcccccttaggagcgcaacatctcagctgtctatgcagaacgttacaactcttttttttctagacacaaatataattgtatagtttccaagaacacagtagagtaaaagcatcaaacttgaaatggaagaaaagctacttttgatataccaacagcactgaaaagttaaaaacgctgtgtttgatagaaggttggtgacgatcctatgttaaaaattaaagacaagaaaaaaaccacagcagtttggggtccttgagtatacaggcaaaatctgcatggggtaataatttacatttataaagatgctcctaagtaaccaataagtggttaaattatgttttttataccctattttaaggagggcaactttgtgatatgtttcagaaacaaggcagatggttaggattttaaatcaaagttttggttcttaaaggataacaccctaagctatctggaaaactgagctgtctagaattatttattgtttgagaatttttaaaaatcaacattttattaaacctaggtcatgtgagacacctgctttcagtgttatacccaaggataaagaattcgaattagaaaaagaatttgtgataaatatactaaataataagaaagtgactcttatttaccactgagatgaaataaaaaagtttgctctagacccatttttttttaatgtgacaattaggtttttccaaagcaaatgttgttcttatctctttgctgtgttcttgtgttaacctggctgtctgattagaaatggggacatttcctagtgaaattaatgtgacatttagagaaaatttcctctctcaaatgtttcatgttgtttgccatttagcatacttagagaaggtattggaataatgtcaagcaaattttgattaaataaggctaactaggagccaatacattcatgcaaaaaaaaaagctcttgtattattttaaagaatgtatttcttctgtggttctttatcccatattgagatgaccttggcaggtaatctgacaaaagaaatgacatcttctaaacagctgggcttgctttagaaaatgcagcacattaggtcagagcctgtggccagtcctttgctcaagacagttacttgccaccccggaggtacactaaaatttcctggaaagctttttaaaaaaatcacccagtgcctgggtccaattccaggctaattacctcagaatctcttggagtgggtccttggtgacagtatttttatttttatgttttacaagaagaagattctgagatgattctcatgtgtagttagggctgagaaccactggcttaagacatacaaactattcattaagaaaatatttccttcttcaggatgatctgatgatctgagtctcatcctttgctccaccagaagtgtgaaaaaatatactctctcagtgcacaggagttgggtttgggcatacaccttgaaccagtatgagctagaacacttgatgtcagtatacatagacccataatataatagcccatctatggccagttaactcagttgtttggaatgtagtactaatgaggccagaatagtgtattctatccaattagaataattctgctgcatagatttttcccataactgtaacccaactgcctcacaaagagacctgagacggattacaaaggcacaggacaatgggtgaatcagcatagccccatccattctgggaaaatcggttctaggaacctgccacattgactagcgctactaattgcattaggatgcagcatgagacatctgcccatgatggtttgtgctgatttgggggaatgatatattttcatttgaaggtcaggacccacaagaatgggtggtttattccttttggagttaaaaaaggaggataaaagataggaaggttacaagcttctatgatattcttctctttacagtagcagatcatgcctggcacatctgcctggggttaactgacctgtatttgggggaagaattgttaaggtaattactaacaagccctcgagacttgtctcttctcaactcagtgcctgggagtgggaatcctcatgatgagatatattatggcttaggaccaagaagtagtattttcattagtgatacaatgtgcatggtattgcttctttgcctgaacacgtggctctggcaccatgcctggaggtcaggtctccgcggagcttcatatttgatgcagagtgcacacaggttccatgccttcatttgcaaagatatggaaaattttctacttgagaactgtcttctttaaaggcagtaaagacagattctttaaatacagtagcttgggttgctgcttatccttttcctgcaaagccagtatcctctagatttcctttttgtatttttgtctctttaccaatcttcttgaaaaaatgatttagtttgaaagatgagatggaacatgcatgtgccactattttattgcctgaatgaggtcaaattcctgatcctacttggagttagttgcaggttctgtataaagcaggggatcaggattcccaccattcctgtcatgggtctgataaatgcagctgaaattctcctttggattcatgttctattatccctattttacagagagggaaactgaggcatgcaaggattaagtaatttgcccaagatcgcagagtgaaatgaatatttgaactgctgagtgcttaatcaattccgggttttaacagatgtattagtccattcttacattgccctaaagaaatacctaagactgggtaatttcataaagaaaagtggtttaattggcccgtggtcctgcagactgcacaggaggcatgatgctgacatctgcttagcttctggggaggcctaaggaaacttacaatcatggtggaaggttaagggggagtaggcacatcacatggccggagcagcaagagagagagagatggggaggaaggactacacacttttaaataaccagatgtgataagaactcattcactatcgagagaacagtaccaagagggatggtgctaaaccattcatgagaaaccgccaccatgatcaaatcacttcccaccaagccctacctccaacattggggattataattcaacatgagatttgggtggggacacaggtccaaaccacatcaacagggtagcataatttttgtggggtagtgaacttcccacttgttaaattatatattgtactgaatatcgtagatgaacacatttaaccaacatcatttttacctgttatgttggtacaacgaattaactcaaagagtgtttgttggttgactgactgttggataaacttcttccagcaaatacttggattgtattcctaacacagcttccaagtttgcctcctattcctgtttgtgacaatttcagcattcactctctatgaagaaaccagaaatgaactgacccttttgatttttaatcccccaacccatgcttccaatagcattaaaaattgcttgagtttacattaaaaaggagatataaacttctagataaaagcagtgtgagtagatattacacagtgcatcttcaaatgaggggcatgggtgggcacatgaacatacctgagtaagtgcagggcaatgttggggtttagtttccttttaagtactgtctcctcctctctctcacacattcaccgtcccccttcctacctattgtaggcacttggggtctgtattctgactgctggctgtttggtgcccatgtggtagctggatctgctattgcctgttctgttttcttctccatcaaactgtgagctccttggaagcaagggctgcatctaggagcctagtacagttagtatctgacaggtagaggtctgagaggaatctgctcttttgtttgctagacagaaattgtgtttccttttccaaacactcccagttgaagtaatttcagaaggctcctaaggaatggtgggaacagtggagatttctagtgggatggcaagagggtgggggagatgtgtttgggtagtttctagatcatacaatggttcaagaagagtggtactttagtgctgggggcgagatccactttactaggacattcagttactttagtgtcgacttttctctggatttcacccttctaaggcttttcccctctagttctcccaacctctgggtgatcattagctgtttttccatctctttcatctggcaggtattctgcatttgcttttataaagccattgctccagcagtctgctgtaaccagattaaacaggggtgctctaatgataggagctgagacaggggtttgcttgcaaacttcatgtttcacatgaaaggctttggcaccccctgtggactgcccttcaccctgttttaggcatagtatttgtttgcttttgtatctgtgataaaacaaaggccttcctgcataaccagtgctgagcaaatgtcttgaaacaaagggaagtgcagagtttaaatccacagtggtgtattaccttgcctgcatttccatatctttggaataaatattttaacatgttaattatctactactaataaaaatacctttgaacttccagtcaatttgatgggccatagaattgtctccactggggaatgggaagtaattagtttctgtaaggattgtaggtcacgttgtctcttctcagtaagtggttgcatggtcagtagccagtcatattctagggaatgtttgtgccaaggccgccctggtctgcagcggggagctgctgcctccacggagcccctagggcctgaaggaggcagaggctgctgctgcactgtggccttgggttccaattcactcactgcttcttgacccagaagaaaaattccttctaagtagggcagttcgaaatctacttatgaatcatctgtgtaacctttttaattttttcttctcattgcagactgaaaactattcttttgactccaactacgtgaatagccgagcccatttaatcaagaggtatgttggtttgcttgcttattgctgcaactaagcttgatttaacattaaaaagcaaaacagattaaaatttttaaaacgtatttttttgggggattttaaaatgaatgtccaacctactatttgtagaaagtttggaaaattgagaaaagcataaaaaagtaaataaacatcactggtaatttcatcaaccaaaggtaatcactgttgacattttacatttcttggtatgaaaatgtacgtataaacactcaacaataaaattggaattatattaaaatatagttttatctagtgacagaaatctgatattacaaatattcactatttctaatatttctaatttctaatattatttctaatatttctaatgtgatattagaaatatacaatagaaaactttcacaatcatgttgataccaaaattcttgttgctcttcactttaaataaaggaaagccttaaaaatgtttttcatgtagaacttcccatgagttttgagattgatgctatttcaacaactttgaaatcattttaaagatattttaatgacagagaagccaatcctttcctttctagatgagagagaaaaagaaatttgcctgattcttcttaaaatttttagaagtgtttcagaggaaacattcaaagttgagatttatgtgattggttgatcataatttagtatccaaggagccataatggatgtgagtacagagctgaatcctgccaagaaagatcccatctggtgcagtgggctgcacccaatgggagaaggacaaggggtttgggaagccctctaaaaggtggaaactgagcaaagaagagaacctcttgcacagaaagaccagtcctaacctttcaaatgatgcctgtattgctgtttcatgtaaatatcacttaaatggtccagtggttattctgcagctaaaattgaactctgagtatgtttgttaaaataatagaaatgaaacagagaggccagcagggtatgttagagctgtagcagagaaggcttgcaaattgtattattttgctggctctaatcccataaatttacatcaccagaagagtagaattcaaggaataaacaagcttcaagtaacttgcattcatgtctgatttaattcatgaggcttcagtaacccctaaaacatgctaagtttatctgtattggtctggaattgcttgtgaccttaagtgatgatcattagttgtctgaaaatgggtagcccttgtattatcagtgaaagcacagttgagaattttttttgaggggttgggaggaatccatttagaatattttcctgggtcacagaataaaagcaagaggtgaggaattcaaaattatctgacgaatttgttttagaaagaaaaaaataaccctcttatgtgcactgattagagtgcctttgtagcagaaatctgctttgtttctgcttccgaattgttattttcaaagctccattttaaaactttgataaaaacagtgacttgccttaccctcacaggtccctcgggctaactcagggtacctgggaattctatagccaggttaaacagataacatgatgctgggcgcagtggctcatgcctgtaatcctggtgctttgggaagctgatggtggagaactgcttgaggccaggagttggagaccagcctgggcaaaatagtgcaacccctcccccccaccccccaccatctctaccaaaaagaaaaataaataaataaaataaaaaaacctgatagtatgagtctgattgtcacagcctggaagaaagctaagactcccagggacccttgcatcttacatcagtcctgactatccaatttacaaggtagactgatagataaaaacttatgtttgaacatttatctttggggatacatgtatttccacagcagcgttgagacttactgggaacctctgattttggttaattactttatatgttttttgtttatagacacatacacacaaaaggcacaacctagacttaatgggctcttggtgaaaaagtctcctgattttgcatgaaatcaaagatagctttttcttcttttttttaaataaaaccagggaccaccttgatgaagaggaaacatctgaaaactcagggacacatgcatttttgccagggttctgtttacagagccatgagagctttgggaaactctgaaggccttgaatttgtgtggtcaattgagtttagatgaagcataatacctagaaaaatacagggaatcttgtgtgctatgctgttctggggaccaactgtgttaaatgtaaaatgtgtggaaaatgttgagagtggtggctaacaccaggtgataaagtcatgcgaagcctgttcaaatagctcacaacagtgtttgaaaagggttttgctgtatgtggtttcttgaagatccatttacatgcatggtaaacgctcttggccaggaaattctgaatctgattatcagttttaattttactatcaagtccctgtttctttgaatgccaatacaatacaatttcaggctaactttgagaacttctttttctttctttctttctttttttttttttttttttttgagacggaatcttgctctgtcacctaggctggagtgcagtggtgtgatcttggctcactgcaacctccacctcccgggttcaagtgattttcctgccttagcctcctgagtagctgggattacaggcatgcgccaccgtgcctggctaattttttttttatttttagtagagatggggtttcgccatgttagccaggctggtcttgaactcctgacctcaaatgatccacccaccttggcctcccaaagtgctgagattacaggtgtgagccaccgtgcctggctgagaacttatttttctatccatgttctcttcttctattcactttctacttatccaaggatgtttcttggacccttcttttcggcattctctagcagttgttagcattcttagccagactgtttacatacaggcatcttttcctcttttacatctatctaccttgagtagttgaacagcagctaccactgtccacctctggttctttccttcatcagtcagggttcctacatgaaatagttggcacgcctaaattggaatggcttgaggaaagtttatttacaaagaggaccatttacaaaggcttgggcacggttagtgaacctcaagggatactgcagtattatggcactggaggagctaaaaatacttcagacaggaccagggaagagagcatgtagggaacattgacttgagagtaacagtgacttctggttggccaagggatccagtcatcatgaagtgaccctggaggaagggagcagagacaatcaatatcctgatatcactgtcctcccctgctctgatctcccgctgatgtcttcctttggctaaacccaacagaaagccagagggcaagggggttctcataggcacaaatcaaggttgagaaggatctcaactgtgggaaaaggaagtgatatggcaggctccccataattttatgcaccaaggaatctagcattatatttctgtagttttttttttttccagactgtcacttgcaacccgcaggtgtacccaaggaggcttatgtgagggccccagattaacaaatcatggcagtgcagagtttcttctgaatggacttccttcctgctctgtttgtttcttgctgtcttctcagagcaaggaaagccagcagtggtactttgtcgctgctgcagcactctttcctcatgcctgttttgtgggctgctgtctgatatccactcctacagtgctttgggaacaatatcaagcagggcataaggctgtggcccaaagaaaatgaaataggaaatgaacaaagcactgactcagcgtggaaaggattaggagctttggctccctaaatcatgcacaatgctttctttttccacccaaattgtcctggggtttttccagcacttcgtatggtgccttgtatataataaatgcttggtacatgtttattgaatgaatgcatgagagaaatggaagaaaatcttagcatttttctattaaagactagcactagatttctctttaagccagtgatttctggattttaatgtgcattggaaacacctggaaggcttgttaaacgcaggtatgctagctccatccctagagaacctccagttgtaacaggttcccaaggtgattgtgatacaggtggtccagaaaccactctaggattttccttgtattacttaaatacagttataataatcttcattctcactccttgctcattcttagcctcagatatcattccctgggtatgtagtatcacctactagtaagatataacctgtttccattctgagtcttatgtcttttggaaaagagttctaatatttcagatggtaaatatgggtcagaatttgtgtgatgttcattcgtcatgcatctgctgagtaactcttctgtgcagaaccctgttctaggtgttttcaaacatatctgtctttttgttggccaccagagcagtaatagaaacatgggcatttacaataccattggaaacaggaacccctaatttattgtcccacaaaagttgttttacaagtccttcatctcccaagaggtatgcaggtaataaagcaagtgaaatcagcatttttatgcctggcataaattgttatttgttttgggtgagtagccatttaccaggctattttacaatatgtggcatcttgctcactgggtcttaaactgccttacacaaatccattcattaaaccactaaatgctcttacaagatcagtgtaagtggtgcttagtttgtcagatgggcaaactaatctttaaatgagttaactattccaaggtttgggggagttgttataccttgctttttgttctgagaatacacaacttctcgtgctcacactaccagtcccttacatcctagtagctaatccttcactgttttattatttccataatttctattcaaaaagcaaaatctctgaggttgtttgtaacattcagatgcctatgaaaaagatgatcaattttttaaaaggcagatccaaaaccaattaggagaagtaaggtagacatccctggcatccagggaggtaactgactgcaattaaacattacatttatgttgaagtttttgagaagtgaagacaaagcagtaagtacaccaagtgatatagttttaattattcattaaaggaaggatggccatttgacaggagaactattattttctgttctttaatgttagaagaaattaacacacacacacataatagtgtgtgactattgtttacagaagatatagaagtgttctttaaatataaattttctgtaccaatcctataaaaactatggacataatatttaattgtaactcagtgaaaacattactacacagaataatgatggtattaaacaataaccatttatggagcatctatgtgtatctggtacttcatgtacagagtctctttgagtcttctaaatggccttgtgaagggggttttagcaaacacattttacagataaagaaactgagattcaaagacatcagatatcaggtccagggtcacacagatgaagtggcagattatagattattacttgtcctaatgactccaagttcagtgctctttactacagtctgctatagaaataaagaacctagagcagttgttctcaactgtggggtgatttggcaatgtctctttggagacacttttggtttttttcctttaagtgggggtcactactggcatccagtagataaagggcagggatgttgctaaacaccttataatgcacaggacggccacaacaaaggattttgtagccccaaatgtcaatattgccaaggttgggaagccctgctccaagggctggttaattacattgcccccatactagatccctcaccatcatatgtttcaagcaagtttcaacagctgctgaattcagagttgaattctctggcttaaagtgacaactttgtgttgtggattaaggacattttcagataccagaaaatatacaggttggaaagttaagtatttgttataaaaatggacctgaatatcatccaggcaggtcatttcctttctccagaggtacaggggtgcttgtaggcaggcactcacctcacgtgacagagaataatttctaaaaaacaaactttacatctatttaaactgtgggattataatagtatttacagaaaactccgtaatatgtgccataaagctagaaatggtgaaacactttaaatcatgtgtttccaattggccatcatggccataaaagaactgtaagataatttgcttgtttgtttgttttttaaagaacggcatcctggtgggtccataaggctgagttagctgtgtgacataaattgaaggagctgagtgagctggcctattgagtaattttaattttagtgcagttgatgctcagttattctttctgaaaataattagctaacaggtcaatgcttcactctctcctgctcttcattttcttataattatggctttccagttactggcctcctggtctttcctttttatattcaggtcagcaagcattctacatctaggttggtcatatgttaaaaatctgctgtgattcttcttgactaagtgtggagggtgacaatgtatccattgtgtccatggcatagctcttcattatatgtgctgaatcttcttatcagtctcagagagccaggcctgtgaatgtccaaggttgagcagatcaagtgagtttgcggtgtcatttccacagggctcttttctcagaggcataggtctattagggtttgtgttaattcacaaacatgccattcttccttgttgaggcaacaacacattttcttgagtgtgcctttgctgcttcctcaccgactagggaatggattcaccatctactaggtatttcagatgcataatttatggttcatggtgtagcaaagctggggattctgtcaggacatacaaagtattagaaatagtaggtgggtgccctatagctgtaccttatgcattattctccatttcatgagaaatggtgtgaagttcttggattgcatgcatagtgcattgtatggtagattgatttaataaatgcaagaatcattttacctatcaacacttgagctgaaagttttcatgttcttagtataactatactcagagttgcattagtgctcactctctggctctcacttttgtcttgccttctatattagtcagggttctgcagagaaacagaaccaataggcatatctaaatctataaatatgtagaaagagttttattgtaaggtatgggcttatgtgattatgggggctgaggaatctcataatctgccatctgcaaggtggagaaccagggaagatggaagtgtagtttgaaggcctgagaaccagagagccaatagtgtagattcaagtctgggtttgaagtcttgagaaccaggagcgctgaaggcgggagatgattaatgtcccagttcaagcagtaaggcagagaacaaactcaacttctttcttaatttttgttttattcagtccttcaatggattggatgatgcccacccacattggagagaattgtctgttttactgagtctgccagttcaaatgctaatttcttctggaaacaccttcatagacacacccagaaataatgtttaaccagctatctgggcattccatggtgcagtcaagttgactcacaaaattaaacatcacaccttccacgctcagctactgactctcctctttttctttgaatatgttcatctatttttctcagataaaactgacttactgggttctctgatcctgataatccttcctattttagttgcactacttcaatttctgctacctttgctttttacagttggttagtagacatcttttaagaatcagtgtacatagtggttaaatttctaggcaggctctggagctagactacctgttttcagtcttaggtctgctatattttttaccagctgtgtgaccttgggcgagttatctcacttccatgtacctctgttttttttcatctgcaaatgagaatattagtagcacctttctcttacagagttgtgatgatttcaacagttaattaatgtcaaacacttaaaacagtgcctcacgaatagtaattgctcagtaaacactagctattattattttactttgattttataggaagagaaaagtcttctgaaatgatgacattctttagaggcagttttagaattgtagcttcttccaccttgtctgtagtgatgcattgaagataagtgaacgaaaatattagctgtatcagcatccaatagtgggaacctctgtgcaatgttaagttttattatctttaagcacaaatttctcttccccttattcctaccctattggacagtctagccactgtttgcctcattacagagccgacatcatcctggctcagaaagatttttaaaatcagatctgtcacggtcgtaaattatcattctgtcttcaacccagcagctccaccttcaaggacttagagggcaacagcctgaaggatagtggacatgaggagagtgaccaaactgacagtgagcatgatgtccagcggagcctgtattgtgatactgctgtcaacgatgtgctgaacaccagtgtgacctccatgggatctcagatgcctgatcatggtaaggactggttggatgtaagttgcagcaatcgactccaaagaacccaaaatgtttgtaggcacactatactactttgcttaatgagtgtattatcaaggtgtctacagagctcacacctcagcagcatctacaggtttttgagatgtcctgacacctagccagattcttctttgccctccctaagtggatcccctaggtctgtataaagttcaggcactttagaagctgactacatgtgcatattacatacattttcttcaataaaactgcactgagctcataggagatgaacagatgccttctctccaggaataaatgcctatttttgctttagtacatgaattcagctgatcaatcgaattgcatagaacacagcactaatgagaccaaaggggtgggttttatttccctatcagactggttagctttacccagagtgagactctgttctctcattacagattgtgtactatttactgaggatagaaaataccaaacttcccattttgtctatggggctgctatgccaaatccctccctctagcttccacacaaaaccatgccattagtcataggggagaccagggtaagagaacgtggctgagtcaatgtaaaatattccgttaatgtgaaaggcacctcaaagcacatgtcaggagtggcatcctcatgtatgaagaagagtctatttctgtgaactcggaactcagccacacatgctttatcgagaggcactatttaaaactttgctaggcagaagccagggtataaaaacattagcagagttcagctaaggcagaatgtttagatggacttgggcacaaatgtcattttcaatattttactgatgcaaacatgctatgcaaacagcctgtctttttcaattaagaaatatgaattcaacttggtggttaggctcagtgaagcttcagaatgcttggctatgtcttgagaaaagctagactcaagctcagctggaagccctactgctaaaagacttaaaaatgagaaaacaaaatatggtgattatgtgctggtcttcagctgtttcatttcactgtaaacatcattaaatgcttttgttttggtttttggaaataagtccaaaggaaaaaatgtactatccacaaaacaaaatgtttttcatggaaaaaaattagtcactgtagattctattaaattgtcttaatccattccctccccagcagacccaagtgtcaaagtctattatatagagaggtcactatgaattgtgcactgctgtcttccctaattggtgagtggtgacatctgcagagataatacactttctgggaaaccttactatgactaaagatgaaaaaaattaaacagttatataactgaaacagagacaatttaatactcagaggattagcagtatgtcacaggatgcaaactgatatatatcatttactagttgtgtgtttcaaagaaatgctttttcatttatatcaagaaagggttttagttagatgctctctaaaatgaaatgactccaggaaaggaaatagtcataattgattctcactttatgcctggctagaacaacatctgttttatttttttgtcacatttctctaggaaaacagtatcagggaactgcagctagttttttctgagagagtgtttcttacaaattggatgtattacatatatatgtgtgtgtgtatatatctatatatgtgtactgtgtagattggataataagacgagtattcttttttgtgaatgcatacctaaattttatttcagcttagtcatttgggttgaaggtagagaccaccagtctccatataggtagagtgaccacataacccagtttgccttgtatacctcactttacatctgtgtccttggcataatcaataatgagaatattctaaaggaaatgtgtggcaatactccaagattcccctacatataagatgatgattttacacacacacacatgcatacacacacatacacactttctgctgggccattttggcaacactttcacattttgtttcttactatttgatttgcatgtgtgtatcttcattttttctattattccggcagtggttaaaccttgagccaacccttgagtgagttcttttcaacttgtgtgattgcctaaagtttaggtacaaaaagaatttgggccttgtttatacctcagtctctcccttgtgatatcccactacttctgaagctttctgtaataatacttgtgtgtcccatagcaacttcaggcttgccacagattccatcaccagttcacttggactgatactgcaacctcaaaaaagagcaacaattccaacaattaacatttcatagcattttaatatctcaagtctgcatttgcataataagtatatcacattttatcttaaggtacagtggttgaaaggcagtcactgggtgatccaccatgcatgcctgatcttatagccattttagttagattgtcccagggtaacatggtattgttgcttcaaaggattaccaatttagaaaggtgagaagggaaaatagaatctgcactggactgagacctgtactgaaaatctcaagaattccttgaggagaaaaaaactagtccccaatccccttggttcattgacagtgtgatgggaatcttaaacccaagtgttctgaaattcttggagttccagagcaactgttcttgaggtttgggtaggtgtcactggagcagaatgaagaatgtagtgaatttgtcaggctaactctgatcctggtatttcttttagtcctgccagaaccactccaaagttgggccaaatgtatccaacaagagcgtaccttacacctttgttttggggagtttggctcaccttgtattccatgtctgtagttctctctgtgacttttctaatttggatattagtactgcatatttccttgcacgtatgtggacacatgattgaaggggaatctcagaatttcaaaataaagataattttgtgcatctgttagtttttcctttgagcaggaatggtttgttcaaggagctggtattgtgttgcctgtgtttggggtaaaggtataaactatatttgctcctctttttaagagatacctgggccctgtgcttttccacactgccaaaatttctatgggatttgtccttaagattttattgtagcagaagaatgatcggtgtgaatgacaagggtgctttgtgactctgagtaagggcccaaattccttaattttcagtaacccttctctgagaacattcctagaggtgggaacccagaatcactatatttaatgaaggaaggagaatgttatattcaataaaggaaggagaatatctagaagacttctttttttttttttttttttgagacagagtctcactctgtcacccaggctggagtgcactggtgcgatctctactcactgcaacttctgcctcctgggttcaagcgattctcctgccttagcttcccaagtagctgggactacagatgcgcactaccactcctggctaatttttgtatttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgccccgctaattttttgtatttttagtagagacggggtttcaccatgttgggcaggctggtctcgaactcctgacctaaagtgatccacctgccttggcctcccaaagtgctgggattacaggcgtgagccaccgcgcctggcctagaagacttttgaactcaaagggcaaaagtcaggtatttagtcactaggaagtttggattatgtgtttccttttcaatttttaaaaatgtctaaatttattttttattttgtttataattgacacatcataattttacatgtttgtggggtacaatgtgatgcttcaatacatgtatatgttatataataattaaatcggggtggttagtatatccagcaacctcaaacatttatcatttctttgcagtaatagcttttaagatcctcttttttagctatcttgaaatatacaatgcattgttataagctatagtcaccctactatgtatagacaccagaaggattgtgtttgattgtccaaccagacacattcgtgagctcagtgagggtggaaatgagagagaatgacaggaatctctgctttctggattactgtcaatcttggtatttctcttgacatgcctaagaccaggtcagttggttgatgaactggctaagctgaatttcctggttgccagctgactgaattacaaattgatttgttatccagtgcccatgaattaatacgtttcagtttgtccttagtattcagctcttgttatggcttcccagaaaagaagatgatagagaattctttatcctgtgctttctactggtgtattgtagaatggcaatttggaatgctgtctcttaatagctctgagtggcttgagaccaagtaagtgttgtcattggcgggttttaccacttgatttggttcttgaggcaatttggtgctgagcttgggagtcaacactcaaattttttaactgatgccttctgtccctgagggaattacttggcttgagggagtctgagttacctggtaaaattaccaccctttggtggggataagaattttgcctttatgcggttcctgcagagactctctaaaaagagtgattgacaagtagagtagtgagaggtgccagaggctcatgggtttgttgcgtgattaggggtatcatggggcttgaatttcttcctatccgggttatctctgagctaagtagtgggggctggggtctggctccttcttgcttctttgcataacaatttttgatgatgtggatatcccattattcttacttaaatatgtaatcctgatatgagattggggtttatagggatcatgccctagaagtgtacactagtcccaagctcagctattttgtttcaaattacactcagtccctctttccttatggttttaattattgattataaattcatcagatgaaaagatgactctaattgctctaatatgcacccaatttggagttcgctacaacactgaattggtttccctccatgctaactgataccaaatggaagcaacttacagaatttttttgtaagatttagctgcttttcatatccaaatgcgtccaaatgcaatataatgattgctttatttctggaagtatagattcttctgttttagtagacttgtttatttaccagtttcatcacctgaatagcatttaacatgtttgctgtgtataacatggatttgaagaacttgatctgtacctaatgcaactgctgttaacaaatttgccatgaaaatgttctgtaggctgcgtactatgcttattctagtgtcaaccacaggtatattaagatgtttacactttcaacactctaccaacaatatgtaattttgtttcctctagccatttaaagaaattatgattccatgactgaacatccttcttttatcttcttatctgtcccccgactcacctctctcctcactgaattttgaaacactcatttcaattagtctcttggcaaaatagggagttctcaatggagactattttgtgtcattgcaaagcagtgtgctgctgggctccagatatggtagcatgggccagatgttcatagagtaattgaaaattccattttatcagaatagcatttgctgtcaaaaagttttatctttacgtgaacaaagcggttgattagatccccctggacctgaattagcatctttgaggctagatacactgttttgcaattcatgtggttatttctttcccagttttgctcatatagagactttaaaaaatgtcttcatcctcttgcaaatatacctagtgaaatttaattacttgaacccaggaatgtgtatacagcgtttctatatatgtgatttccagctgctttcatcctgcctctggtatactaggcaggaataaaccatgaacagatatatatcactcattactcagtaatatttttgagtgcccactatgtgcctggctctgggaattgaatgtgtcaactactgctgttattgactgtaaaagttgttatctttttacttttattaatctggggtttactgaggtgaccaaggccagctcaatgatgaaatgaataattctattttaaaaaattataagaatagattttggggccattaaaaaccttgtgaatattgtgccagtaaagcaagagaagcaatatgaaaagactgttacaatcaagatcttattttcaatgggaatgtcatgaaatattcctcctttgatgttctaatttggacagtatcacattggtaaacatttttttttaaaatccacctgttgtgaggttgaatttcctactcatctttggttaatgtcattgtaggatgctaagtttaatctctgacatgtccaattaccttgctggtttagaggcagtcagtagcactcaatgcctagtacccctttttttctgatgcccagaaactttatcctttctctcagtctcagcagtttttgggcaggtaggaagagaggtgacaggtggagctttttcttttttttagttcaaaaccaattatctgctgtaccacataattggattttttccaaggcaacatttacattttattggaaaaataatcactaaaataaaaagttgttcttcactaatggaaacctccctgttgttagaatttctttgctagtattcttttggcatgggccctttggtcaaataattgttttaggacagttcaccattggtttcttcatgcaggacattaagaataatatcaaccgtttgtctaattttaaatagatacgctattgtgttatagcatatctatttaacatattgtgttatagcatattgtgtttcccaacatatatatatatatatacagacatatatatgtatatgtgtatatatatgtgtatatctatatgtatatatatcgggaaaacacatgcacacacacactatacacacacacacacacacacacgttggttatatatatgttatgcggttcctgcagagagtctctaaaaagagtgattgacaagtagagtggtcagaggtgccagaggctcatggatttgttgcatgattaggggtatcatggggcttgaatttcttcctgtctgggttatctctgagctgagtagtgggggccagggtctggctcctccttgcttctttgcataaccatttttgatgatgtggatatcccattattcttacttaaatatgtaatcctgatatgagattggggtttatgggaatcatgccctggaaatgtacactagtcccacattcctggattcaagtaattaaacttatatttgcaagagtatgaagacatttgtaaaagtctctatatgagcaaaactggggaagacataaccatatgaattgcaaaacagtatatctaacctcaaacatttatcatttctttgtggtaatagcttttaagatcctcttttttagctatcttgaaatatacaatacattgtttctttccatatgtatatttatgcttgctttcttactctctgtatatgtagtgtgtgtgtgtgcatgtgtgttttcccaatctacttggaacttttagttgtctgatattcaaggttattttaatatttattattactaataattacttgtggtgggctgggcatggtggctcatgcctgtaatcccagcactttgggatgctggagcaggtggatcatttgaggccaggagttcaagaccagccttgccaacatggtgaaaccctgtctctgctaaaaatacaaaaattagctgggcatggtggcacatgcctgtaagtccagctactcgggaggctgaagcacaagaatcacttgaacccatgaggcagaggttgcagtgagctgagattgtactactgcactccagcctgggtgacacagtgagactctgtcttaaaaaaaaaaaaaaaaaatgaagaggaaaaaaacaaacaaaaaacgaaaacaaaaacaacagaaaaaaaactacctgtggtaaggaattcattactcatcaaaaaataaatgccaaagcttttcttgattagttgacattaagaatttccatatttttaagcattttgaaagcattagaggatgcaggatatgtaaaaggagcacaatgaacaattaagaatttcattctccagtagtttatggcccaacagcaaaaatggtccagtatggaatagactacataggatcggtgaagaaagtaattaagatttttgagctggagaccaaaatgcatttaaaaggacactttggtgtaatgtgatctctttggaggaatggtggaagccaggccccaacatagtatgctagataaaattatgctctatttgggtgatttactaggtgaatgttttccagtagcttcatgaaaaatcaacttctataggccatgaaaagtagggacactgccaataagttaatagatgagagacaaatcaagttgttttgtgggactttccctttctttctttctttctttctttctttctttctttctttctttctttctttctttctttctttctctctctctcccttccttccttccttccttccttccttccttccttccttccttccttccttccttccttccctccctccttccttccttctttccttttttctctttctctctctcttttccccttcccttctcctccctcctttcttttcttttcttttttctttctttcttttctttttttgagatgggtctcactctgtcacccaggctggactgcagtggtgcgatcacagctcactgcagccttgacctcctgggctcaggcgaccctcccaccttaaccttctgagtagctgggaccataggtgcatgcttggctaatttattttggtagagacgggattttgctatgtttcccaggctggtctttagcccctaggctcaagcagcagtcctcctgctttggcctcccaaagtgctaagattacaggcatgagccaccgctcccagcctaacattatttctgtcctgtcataagatgattaagagccataaactcttatcaggatgggaaatgataaatctaaacatggattttaaatatttgtagagtatttttttctgtttattttcctcttaatccttttgttatgaaataaatatggggaattaagtccattcatagccagtttaagggattgataccaagcattttttttttttttttgagacggggttttgctccaggctggagtacaatggcacgatcttggctcactgcaacctccgcctcccgggttcaagctattctcctgcctcagtctcctgagtagctgggattacaggcctgtgccaccaagcccagctaatttttgtacttttagtagagacggggtttcaccacgttggccaggctggtctcgaactcctgacctcaggtgatccacccgccttggcctcccaaagttctgggattacaggtatgaaccaccgcccctggccccatagttttaaaagcaatttcaacaataccaaaattatgtatcatttatttattctgtggacaaaatagtcgtgagatggctttcctcttttatgatagatgctttttgtcatccagggtcaggacttgcccaaggtatttttggtctcttgtttttatcagatggctcagtgccctgtatactttgcatcaaggaaagcttaattgatacatccactttggaaacgtggctttttgacaagaaagcctttttaatttctctttctttatataaggcttatccccagtaaaactccagcctagaaaaatcattgtgttactccattctcacactgctataaagaaatgcccgagactgggtaatttataaaggaaagaggtttaattgactcacagttctgcatggctggggaggcctcaggaaacttacagtcgtggcagaaggggaagcaggtactttcttcacaaagtgacaggagagagagagaatgagggaatgagaaagtgctatactttaaaaccatcagctcctgtgagaactcactcaccatcatcagaacagcataggggaaaccgtccccatgatccaatcacctccctcccttaacaggtggggattacaggtccctccctcaacacatggggattacagtttgagatgagatttgggtggggtcacagagctaaaccatatcaatcatcaagcaccaaattagaaaaggtttgagctgctctttttaggaacatcagaaaagttgctttttaggggatcacacacaggttcttcttctgggcatattttcaaagatctgacataatctaggcttaggtcttagatggacttgtaaagctcacagtggatagataaaacagactcttttgcaactggacaaagtggaaccccatagaccaatcattctgccaggtagagagaatataaagcagttcctcatagtttgcgatgaagagattattaatgaaatatcagtctccagagctgttttggagcaaatcctttgggactgtaagtgtgtgtgtgcaggtgtcaatgtcagaagggtgctgtaggattttaggttttgtggtaaacactggacttcacttaacaatgtgccattcagagatctaatatgtggttggaagtatgtgtaggatggtgtgtaaaataggtaattcgaaaggcagtgaatctggaaggggccaaaagaattgatcagaaaatgaactctttgtgactgaagttactcaaagttttgtcacattgaggcggcctaatgacaaatacttttttcttttgagggtctctggtcatcagaaacaatagttgtacttcattatccttcatgacagtttagacaacaaaaatgcaagctattaaatttgaaataatagacaaccctgttttatcattagtttagttctttttaaccttagtaatactcattttaatggcaaataaggctctttaggttactgccttagtttaacaggaaaattttcaatctggctaaagaactctagagttttagaactctaaaagcaagtttatctccctctgcccccagtaagctaagccttagggcctttctaaattatggtctagtccctagactctaagtaatgcaggactgcaactgtaatctgctttgaataaaaatacaacttataatgttgctttctttttaagtagaaatctgtaaacatacagtactctaataatttggagaaacttgatactcttgcagcaaggcagcttccaagtcatgggtttgcaaatccaagtccaatgccagagatatattttccaatttctgtggtcgcttttccacctctaagctcatatattctctccttttctatccttaacttgcataataataaatgtttgacaacttgctttctttcctcctctttcagtctctatggagtttccaacctgtgtgaacaatagaatatttcccttttaatacatggaaaagaggaaaaagaggaatgatgtatgtttcgagatatttaggctggtcaaactgttccaaggcatcaccacctgctgtttttaatcattaatgaggctgtcagttgctctaatctgggaggtgaaccaaaagaattgttttgactttaatttaatttaaaaatcagcttattgaaaaaaaatgcttccagcttctatgagtcaggttgcacactgttgataaaacaaagcaagtcaaatgttgatgctgaaccatcattcatatgcaaacgtgaaccgttttaaatttgcagaactcttattattaccatcactagccagaaattttagttctttttttgtttgtttgttttaaacagcgtctccctgtgtcgcccaggctggagtgcagtggcgcgatctcagctcactgcaacctccgcctcctgggttcaagagattctcttccctcagcctcccaagtagctgggactacaggcgcctgccaccacgcccggctaatttttttttgtatttttagtagagacggggtttcgctatgttggccaggctggtcttgacctcctgacctcgtgatctgcccacctcggcctcccaaagtgctggaattacaggcgtgagccaccgcgcccggccaaattttagttcttttaattcaagtagtcattgtattctggagacatgctgcgtgtaaatatctgttccattttttagaagaaaaactgatgcaccaaaattttaaacactctattaatgtcagaacacaaatctatagcaaagtccagagtgaagcctaaagtgcaaattcttttgcttgactcaatgctcatcacactgtttgtatgttttagaagtttagtgactatctgtgagtactctattaagttggagttttcttcactggatggttttgcttagtgacaaaatgagaactcagaaatacagtgtctgtgcacaagtggattttaacgacctagagccagacctttgtttgtgccaactgtcaatttggaaggtttcattatgcctctctcagcttcatcaaacactttcagatttataattgatgtcaactgaagttgaagtcaaagaaaaccttctttttttgactgtagaaaatatcaccttattgttgggccctggttagccggagggtaggtgtatcaaatcacactagccttctgctaaaacagcaagtgagcacttgctgaattcagctgataatcaatctgcagctaatgagtctgcagacagactgagcggctggagctggcaccaggaaaccaccattccaactaaccatctcttattaaccttttggtgtttcctttgtgacgctaattagagacccataaaactatctgctctagatcttccgtttaaaatacaattttcaaagaaacacaattcactttaaggctcctgttagtatggccttttcaaacctcatgaaggaaaatgactgacttgccatttaagtaaagtttggataattaatctgtaatgttttggtaattaaaatgccaggaaaagttggttctgtagttggtataatttataatactctccagattccggtggtactgaagtaggcggcagatgtttctaccaccgttatgttttgactgtctgaaagtacccattcccacgctgtagccctgtctgccagactgcctgtctgcctcctcctttggtgtgaatttgttttgattgcctgagggggttagatgtgtgctttgcttcctttctgggggatgatgagccaaggaatgagctttgtactcttgggagagggaaaagtcttcgaagttgacatgctgtttagctcaaaatgagttatcaaatgggcccactcaacgttcaaactgttacatttgcatgatgaagatggaggagcaccatgccttcctgctctagtcccccatctcatttcctctttaatattttttacacccagaacaagagcattatgagataagtgttctaagcgtgttggacccatgtattcatcctgtgctttcgtttacctgtctacagcaccttttagtgcctcatttctctcatttgtttaaaataaaaaattacctagcataaatgacttacatgatcctaggggacagaatctctagatgaggaattgactgactattaaataagtgagatctgcaaagctggacattgttttatttgatttagcaaagaggtactcttcgagaagcccaatattaatcatctaggatcctttagagattaaaatatccataccagaaatgcaggcacagaacccaatattcttgcagcattacctggagcccctttggtatcttaagttttcattgtcatcaatatggaatgttcaaagtcctaaaaagtccctgaaatcattgtgatatggaactcatgttataatatatcatttatcccttacagcaacactgaaagggagagacaagcatagaattccaaatagtcaacagaggaatgacagccatctatagtgaggatcaaaatcagaatcttggctgatggggaaaggttcagaaaattagaatgaggtgataagagagaatgaaataagataaaaatatctatggttgaaaccgagattggcagggacaaaaggggtataatccagatttccttttatatgtactatctagctaatactcattgataaacctaagaattctaattctcattggagtcttccagacagatagtgtccaatcacttcaggctccaactaatatgagccagtcctaatgaatcagtacaactatttccactctactccattatattcaagattgacatcattagtctgcctgtaaatacaaaggcaggcagaacatcatagtggctaagagtacagactttgaaataatacagatttaagtttcatgcttatctttgccacttaatagctattgaccttatttgttcgaatcctcaattttcacaactgcaaaatgggagtaatgatagaaattacctatcagaatgttgtgagaagatccagataaatacttcctggaatatagcaagtgtccaaaacatagcaagtgttattgtggggactgagtcagtggaatagccactttataggatttcaggtaccctaccactcaaagcccctcatctgtttgcttctatctctgatccctttaacagaaaatgaggcatttcattttacagttactgttcacactttaagcagtccatggggagagaaaatgcatttatttaaattcacactaagttgtaaatagttgctattagattgtttctaagcttattatttgagaggagtggtggggggaagaggatcgtttctagaatattgaactttaaaagtctcagaggggagaatcagaggggagaaatgcatagaaatggggtgacaacctcatgagtttgccagagctattggtgtccaaagaaagtaatttgatttactcactgtgaaatgtctggatgctggaaagctgcctttactatcaaatcatttttctgaatcagcccagactttgagaaattataacatgtctgccaaaggtttgaaaagaggttgtgttcatttacattgcaaaatatacatattcttgagcacttactgtgaggtaagagaagccctggttcctctctggaggcattgactccactttgccctccctgtatcaaaagctgcataccccagccccaggatccctgctgctcttccctgctctccctctcttgcttcacggttcttaaatggctaatgggtggtagacgtcattttgattcctttattttctctcccactgcatgcccagactttcattaaaaaataaatgaggggatgcatttttcatttttagtttattttctaaaaaagccacactgcaaagaatcccttctattctttttttctaacaatggactgaaaaatgctcagctcctacctgaaaggtcatatctccttgccatatgaatgagcttccagcaggtccatagggagagtgtcatctgagaaatgatgggaatttatgtgcctttggattttggcctcattttgtagtggaaaaataaatttgttaatgatagaaaaaaaatctcaaccaaagccctttataaaattctctctctataactcccaggagggagcctctcagacacacagttgataaatgaaaaaatattttttacccttgccttgcttagagctgtttctcttatattaatgtaagccaggtggcccaccttcgctgataatatggtgttgaatatagcaacctgcagttctattgcataaagtattttggcttgtaagggaccttgtgacatgtttgtgtttgtcaacatcctattggaaagtagggcttggggagacatgtacacacatagaactgtgtggaattagggatatgaaaaaaacaacttataacacagaggcaagcactgtgtttttgaaaaaggcagattcattgtgaaaataaactttcttttatagtttgaacattccatgaacaatgtaactggaagtgcatactttttgccttccccaaaatctaaatccacgtgctatatacaaaatgctaagatcattatagtcctggccgggcgcggtggctcacgcctgtaatcccagcactttgggaggccaaggcaggtggatcacaaggtcaggagttcaagaccagcctggccaacatggtgaaaccccatctctactaaaaatacaaaaattagctgggattggtggcgcatgcctgtaatcccagctacttgggaggctgaggcaggagaattgcttgaacccaggaggtggaggttgcagtgagccgagacctcgccactgcactccagcctggcaacagagtgagactccgtctcaaaaaaaaaaaaaaaaaaagatcattatagtccctaacatactttaatgccatgacctactgggaaatgagaattgtagttttcattctattgtttgttcattgtagagccttggataagtcactaacctctcaaagtctcaattcgtatatttacaggtgggatgatgagcaatgttgcattaatgttgataagaccaataatcaaagtgtctatctgtctatctatctatctatctatctatctatctatctatctatctagtattttttcttagtacaatataattgtgaatcggatggctaggtgttttgccggtttttggtttttgtttttgtttttttgttcccttctcttccttggcctgttgacctgacctgagaattgggaactttatgtgctcatcatattccacagattcatagcctataaacaagttacttgtccagtctggtctttggatttctcatctgcagaatggaggatactggtagtacctgccttgtggggtggttgtaaggattaaatgagatgacacatgtaaaacacttagtgcagtgtctgttccacagtaggcacttaaaaagagtagcggcaagatgatgctgatgaaacattctccctgggttcctgtctcccctcttcacttatctacgtctctttctctctttaaaattacaagcaaaatttaagtcccagaaagcagcctcttttgactaatggtttgtcctgatctctcctttacttggcgttctttaatatccatgtacagagtttatatcatgttaatttgcttttttcctgttttttaaaaatgtaaaatgagagagttgataattgttaagacatttcaacttctgagcttcttttattctgattttgggttctgggtacaaccttttcagattcctgagcacacagccatttgccaatggatctgtaatgagtgccacactcaaattaacagatggtgtggtgcgcttgctttgaggggtaattactctttcatcttaatttcctccctttggcattccttctttggatactgttcaatggcaatgccacgaagcataggatgaaaatcaaacaagtagcaggtcacttgtctatctcagacaaaattattgttaaaactaagaaccagtgaaggtctaccaagtgaggggcttgtaacttctagtattagggaccaagtaactcttaagggtacttaattgtctgatcgttcctcctttcctaaacaaggtggctatttctagttgataactgtctccatttttcttaaagtttaagtagattcctcctctatggccatcatgtcacacctctcacagttggtttgttcttaaactcttaacactgtaagccaaatctgatgtcctttcatcgttggagccagttgtaaactgctaactttactatataaactcctttcccctatcttcttcctcctctctcgtcacacacactttttcccctgatgcttcttatttagttctttctccaaccctccctgctttcacctcagcctaattctatccttttcccctctaggcaatttctcattcatcactgtgtttttacagagaatagaaataatttttaatgacattgagaattttttttttgggttttagtggttcagtcttcccttgtgaagatttttatggcttatttttatttggtaaagttaccttctttactattttttctctccttccacacaattcacagtatactaccatgagtgaggaaaaccctcagtgaataagcgctgatcaatttatttctctgaacattaccaaacaacagatgccatccaccaatgtttgatccccagggcagttcttatctaccttattttacagattccagaggtgaaatgatctattgtaaagcagtgcaaggatcagaagagagtttgtgtttcctggatatattatgtgacttcagggcattgttctgctttccatttgaaatctcaaaggctattggactgacaggaagttttcattcctgttatgaaagggttactgcctccagtttggaagagatgttgcttagggaaacagcagcagattatagcagtaaagccagaaagatcagggagtcagaagtattactatgagatggaaggaaatagctggtgtgcctaactagctcaggggcatgtttgatagtacccaggtatgtctacagaactggcacctgtatagatattgacctctcagtgtgtgttttactttttactctttgagttggactgctgtgttttctgtgtcactggtaattccattgaccaaaacacttcagttgaatcacagcttgagtcttcaagtttccttccctctaaccttgctggtttcttgctcatgttgatatttaagaacgttttctttcaattcagcaaagtttccggatacaagattaatttacacaaatcagtagttcttctataccacaacagcgaccaagttgagaatcaaatcaagaactcaaccccttttacaatagctgcaaaaatatatatatatatatatatatatatatatatacttaggaatatacctaaccaaggaggcaaaacacctctacgaggaaaactacaaaacactgctgaaagatatcatagacgcaaacaaatggaaatacatcccatgctcatgaatgagtagaatcaatattgtgaaaatgaccataatgccaaaagcaatctacaaattcaatgcaatccccatcaaaatactaccatcattctttgcaggattagaaaaaacaatactaaaattcatatgaaaccaaaaaagagcctgcgtagccaaagcaagactaagcaaaaacaaaacaaaacaaaacaaaaaacaaaaaaacaaatctggaggaatcacactacctgatttcaagctatactataaggccatagtcaccaaaacatcatggtactggtataaaaataggcacatagaccaatggaacagaatagagaacccagaaataaacccaaatacttaacagccaacttatcttcaacaaagcaaacaaaaacataaagttggggaaggacacccttttcaaaaaatggtgctgggataattggctagccacatgtaggagaattaaactggatcctcatctctcaccttatacaaaaatcaactcaaaatagatcaaggtcttaaatctaagacctgaaactataaaaattctagaagataacattggaaaaaccttctagacattggcttaggcaaggatttcattaccaagaacccaaaagcaaatgcaataaaaacaaagataggccaggcgcggtggctcacacctgtaatcccagcaatttgggaggccgaggcaggtggatcatgaggtcaggagatcgagaccatcctggctgacacggtgaaaccccgtctctactaaaaatacaaaaaattagccgggtgtggtggcgggcgcctgtagtcccagctactcaggaggctgaggcaggagaatggcgtgaacccgggaggcggagcttgcagtgagccgagatcgcgccactgtactccagcctgagcgacagagcgagactctgtctcagaaaaaaaaaaaaaaaaaaaaaaaagaataggtgggacttaattaaactaaagagcttttgcactgcaaaagaaacagtcagcagagtagacaggcaactcatagagtgggagaaaatcttcacaatgtatgcagactaatatccagaatctacaacgaactcaaacaaatcaatgagaaacaaacaaacaatcccatcaaaaaatgggctaaagacatgaacagataattctcaaaagaagatatacaaatggccaacaaacatatgaaaaaatgctcaacatcactaatgatcagggaaatgcaaatgaaaaccacaatgcggtaccaccttactcctgcaagaatggccataatcaaaaagtcaaaaaacagtagatgttagcatggatgcggtgaacaggtataacttccacactgctggtggaaatgtaaactagtacaaccactatggaaaacagtgtggaaattccttaaagatctaaaggtagaactaccatttgatccagcagtcccactactgggtagctatctagaggaaaagaagtcgtcatacgaaaaagatacttgcacacacatgtttatagcagcacagttcacaattgcaaaatcgtggaaccaacccaaatgcccatcaaagaagctgtggtatatttatatgatggaatactaccagtgataaaaaggaataaattaacggcatttgcagcaacctggatgagattagagactattattctaagtgaagtaactcaggaatggaaaaccaaacatcacatgttctcactgatatgtagaagctaagctatgaggacgcaaaggtgtaagaatgatacagtggactttggggacttggggggatgggtggaaggggggcgattgataaaagactacaaatagggtgcagtatatactgcttgggtgatgggtgcaccaaaatctcacaaatcaccactaaagaacttactcatgtaaccaataccacctgtaccccaatcacttatgggaaaaaaaaaggttaaaaaaaaaaaaaagaactttttctttcaaaaaaatgctgatgaaatgcaagtttttagcttctttttttcttgtcatttccactgatctgggctgttttagataggatgttttcaaaagttttatcatatggctctattctttttggcttattggactgcaagtgtgctaaggcccagtcattcaagattgattagttctttgtggtactatatgggcattttggtgattgtcatttctcaaaaatgatccaaaaacgattttccacattgtttaaacacactgttattactcttaacatcccaatagttattgaggtgtttattattgcctttttcttttaattggggtttttattgcataggaaaggggaaaagccctgattcaagcatttggattcaggtcctggaactgccactaactctgtgtgatctcaagcaacttgcttcctcgctttgggttccagtttttttcatctgtaaatgaagagtttggattggaatgacttataggtgcttattattgctaatactctattactgtttattgtatatttaatatggaaagattgtttggaaagtggatgacattttggctggattttcctgtgtatttctaaagaccagggcaaggtgggaaatctgactcttactcctggggctttgggctgtaataatccttccgttgtggcaagaggaatgagggtgagacattggtgaagttggcttttgttcaacattctgagcttattccttcttttaggcttttgtttgcatatgtttagcttaactctgctttcaagtgtgtgtattttcgtggaaatggtcctcttttccttttacaccaaattcatgttctcatcttccttctcccttactgaatcatccatttctgaatagttagcaattttcaacttaatgaggtctttcccctaagtgaagaacacagctgttcctcctctgatactttggcagctgcctctgcctttcccaaaatggaatgattagctctttcctttgattttttagctggccattagttcaggactactagcccatttcctgtgtgatggaactaccaaatcccatggccagaattgttccaatttgcctttagtgtcttttagtcttctggggacttaattcatatgaagtggaggatttatcaatctttcagaggtccatttgcctcattatctccagtgatttcattgttcagccttttgagatgctgatctacgaggagaacctagcctggtgtccctgatgtggttttgctggagaaatagcagataagaagatcctcaatgtattttgttcctgaatcaaatagccctcatttgtcacaggatctccacttcagtttctgaaaagcccttttgcctattccattttagtcttatgtacctgtatttaagaaagtgattactgtttttcctcatgtactttgacttcatctgcccctccagcctttaattttatgatttcacatcccttgttaattgttgggatttccttttatcatatgtgtcccttacacttaagatatcaagtcaacttctccactccactccaattcccctctcacattatgctccctgttaatcaatcaaaagcattgtgggtttagtagtgctgttccaaatgtgtgtggtgcagcccgtttttgcttccccaccccaaacgcctcattcaatttaattccatatacttagcatattaggcatcttgtcaatatttcctttctgaggtctatttttaaaatttgaatgcattctgcatgtgtaggtttttttttttcttaaatgatgagatctactgcaacagagagccagaattagctctgtgcctaggagaaaaggaaagcacagagggaaagaatatttctcacattctcagaaggtgtatgcaagagccagcccttggcacaattatttatacagtgccactatatctatctgcgtgcaccttcccctccatttgggagcataggcatccagtattctccttgggttttcttagtttctgtcaccattaacccttctactcagggccctgcattcccagtctttcctcgtttcctactttccccataaaaaacttacctggtccatgttccatttccccaaaatcctaattatttcaagggacctgttaaaatgacctgttctttctttccaaatagtatttgtatctcaatgtgatgataatccaaaagaatacctaatggtggcatttgggtcaccaatgcagcctgatggcgtgatgtcttcaggatatggccttttccccagcatcagttcctttatatcccaccaatagttggctacatggtcaaatgataaggctagcttggactccatttatcccagagaattagagctgcttgatgaataataatacctacctaacatatattaaattcttccttagtgcgaggcactgtgtagctcagcttccatgcatttcctcttttagtcattccaacaattccttatgaaggtcagtgctattagtcctgacttatggaagggaaaaaaggcacacagagtaactttaagtaacttctataggatagggctgttaagtcttagatctgggactctaaggtagtctcgctccagagcccatagtcttagactctgctgcactgcctctgggaaaaggatggtacctttttcacatgtacacctcactcagaagagctaacttcagatgtgctgctgggtagtaagcttccctttggcaaggaacaaatgaagtcttgagttgctccagtagatctagcttatatctcatcctttctggagagaagtttgcctttggacacaatgctacagcagaaaggtttgcctttgcttttctgcaccccaaaacttagcagtattaaaaactttcttcaccagtccctgtagttgtaagtcatcagtagggatatttgccaaatgcttaggaccaagcttacactctatcttttctctaccttcagagctgaaggagctatgtatgtgtgtgtgggaaggaggctctctttggtgttggtgagcatgaatatgacagactcggggtagggggatacatgaaggggagagcagactcatccacactctcaaggcaagtatggttagaaaccctgcttcactcaggtagcgctagtctcttcactgtaagtaggttttttttttttttttaaatatggtgatacaatgaattgttttctgaggtggatggttgtgttttctgttattactgcttttccttctggaccgaacttttattggctgctgcttacttactagtagaatgcttcacacctgtgggctgctgcagtcatgacaatgaacattctgttcagaaggggagcattcattctctttcccagcagctgttaccccaacattgggaatttaatgcattcatttgttctttagataaataggattaaattcagaatgaagcaaggagtagtcttagtctgtgctttgcatgattttcagggtctgtacagttccagctgtgtaaacatgattgcagaacttaagtatcgtctaatgggggaggatttcaatttaggagtggcacaccatagctgggctggagccagacattcttccacccacttcagtccacaccctgcggagtcggcttgctcagctcctagagtcagaagtgaagatggggcagctgtagttaattatactgtattatagcttcttatcagtaggggatgagaactaggcaagggctaggaaaatctaaaattatatcctcaaatatgctccagttatggcagtaggaaacaaagaaatggaagacattggacaaagtagggcagccccaaatattaaatatgacaagaaaaaatccaataaaatatctattgaaattgtagctacatttatattccaattgattcttttttgtggtcactgaaagcaagagtagagaaatattgtattgattgtaaaatattgatttgttctaatatttggactcagttttgttttcttgagatttgtttaaataatgaatagctaagtaatgctaaagacttctaataaaggagcactattattatggaaggaaatgcaatttcttcataacaaatacaaatattatggatcatccaattcctttgtccttgttcctccacccacaattatgtacagtgttggccctgctcagttcaatagagtcttagatccagtaattattctgtctctctaaagaggaacatgggcatacgtattcctgagccctaaaggatgggatttctgatgatatagcaggttttgtttgatgccatagattctccaggttattcttgggggagtatcattgatagctaacacaaaggtacttggcttcctactggatatgaatgtcaagacatggtcctgatcaaggaagacaacaaagcattgccttttgaatgtgctggggattgtaatgcatttaggaataacccaatcaatgatattcgttcctattacaactggctattgaaaaactatttttctgagaagctcacttcaaaatgtctctgagacagaatattcttttataggatggggagctctggattgaaaaagagaaatgctaggctgataaatcactgagtttgaatcatatggaaagtgttcaagaacagaaagagaggaaaattcaataaattactgttgatgcaatattggatggtcagggtgataagacactcactagagatttccagtctatgatgtacacacatgcattattttgtttactagttgtggtagcctgaagaggcagaaacatgcctccagaataccagcagggcataggggaacctctccatcatccatcatattcaactgtagtcggggggtgatcctgtcaatattgcctatgtggtatctctggaacttgggactgggatgcctattagtgcttcactgaattctgtatttgtagcatgtgcattgtagcatgtacataccatagcacttagctcgtggatgcttgtctgaatcattaggtatgaacattatgggtgccataatagcacaggaattactgcaactaaaaaggaaacacatggcttgtacttcatccacaatcacttacacttaagctattgatagttgattgggatatgtgaactgctgggcttgtgccatgggacttctaagcatatttggtgggcggaacagacaggaaggctgtagattttggcaagctgtggttcccattagtcaggctaactgtatctgacagtagagatcccaattcaccaagatgaagcttacttctctaggttttggctgatggcccaacaatattgacgtgaaggacaggagaggaccaatgttacgttaggctgtgagtttctaatgagcaaatagttgaatggtttagtgaataccctgttggttttttggtggggtaaacacaaaattcataatttgagagacatgtaagactcgaaattttcttttatagtacatgttaaccattcattctcctaatagggaaatgtgggctcttttatagggtgtgcatattatgtagttgtacagttaatactcttctctgtgtttttcttgtaaggggtgctgataacataccctactaaggaaattccaggcacagctgtttctaataataggtgccccaccccacagaattgtcaggcttactctcaaggttctttggtgggaaggaggattttctggcagagtcttggccactgccattgtctcagattgcctccctgtagcttccttggaggtatgagtttctaagcagaaagatttgctgtgatgagggaaggccacaaaactgaaggaagagagatgaggtcttatagaactaagtgagaggctgttttggtcatggcagagatgagttgaacactatggaatggagacaagatgagaagaggagtgggaatcaattcatgaaagcacttattatttataagttggaataaaaggttcattgaactccaggggacccttcttatatgaaatgcttgtgaatatgttgaaattttgtaacggcaattccatcttaaatacactgggggagctgacaacctgcagttcatggattattctatctagtgtacaatcactcttctattctaccctggacattcttccaggtgtggtcaagagaaagcggatagaacagatggaatatttcctctcaggagagttcaagagcttccttaaacaaaggcaagatgtgagcataaccttttactttctaaacaactttttctgagagctacctggaaaaatttctagcttcctcacagatccaagtaatttctgaaaatatttagagactagtaatcgtttaacttctaaaaatcaaagttggtttgtgctaaaaatatcatccggacagtctgtgtctagttgagtggggaagaaaaaaaggcaagctcttggtatcaatctttattccctctgtaaacacacatgaccagaagagaaggctgttattaatggtaatgcagaccagaaaaaagggtattattttcagtctgttgaacagtacaaaaatgcttctcaagcactgtgttcagatgtttctttttattagccatcacacaaggaattagactcatttcaaacagttcgtttccctactcttgtctccgtaaaatcgttactcatgagtggtttctttgttgaaatactgctgacctcccatattggaatgcacaacagggtgttaaaaatataaactttttagtttgcataaactctggaagaagggggacaaagattccccaggagaataaaaccattcgccaatgtccttgtttattagtgtcctataagcatcttattcaggaagctatgtcagcattacaattctgtatagactttgtgtgtgtgtgtgtgtgtgtgtgtgtgtgtgtgtgtgtgtgtgtgtgtgattaacagcagagggctctttgaattccagcaggaggttttaaaatataattctgcatctgcccctctttcttgtcctttccaacccttttctacctcccttctcatcaccgacccatccagggccattaggatagataaaggagttgtgccatgtcttaatatatgagcaaatgatgatccttagctctacagctaggcgctgtttgcattttgccaaaggtgattattttatctgcagttttaatagcaaaccagattatttgctgttcactaactaataaaagcaaataaaaacagattgcaaagtggaattaaggggataagaaagtactagagccaaagaaggctttttctttaattaataatttccatttactcttagaatatttttatgctagagttcaacatcttatattaaacatgtgtgcacccttcctcttataactgccgaattggaatctcagaatggaaatcatgcaggcttgaacggagcttcaaattctcccagtgttgtcttattgtctgtacacagaactagactcctcagggcttcccccaccacagcatggcattcctccattagccccatgtttcccagacccagtcatgaagaactggcattttaaccaacaagtagaaaacacaataaaattggagttcaggagatgcaatgttttggagaaacagattattccaagagtgtaaagatacatgatctaaagatggacagaacatttaaatttaccagcctggttttcagtgattttttgatttgttcaattaatttgtgaatgaaaatgcatcttaaggatggtgaggactggtggtagtggtggtgaatgtgcgtgtgtgtgtgtgtgattttgtggccatgatccaggcttactatgcatcagctcctaaagagatttttacagagctgtgtctgagtgtcttaattcaggtcatctcaaccagagagccttctgctactcctacgtgcaaaggctcgagttaactcagaaaaagttctcacagctgtggcccagatagattccaagacttctctgaaacttcagatggaagagcctttctctttaatagagagccattctctctattaaagaagagttgggcaagctggaggccagaggattatattgtaatcttcatgtgctgaaaggtgtaaagaatcttttcttcttaataagagcactgggacaagcatagggtgccttcaaattatcagacttcctcaaacaatagatcaattagcctttcttctgaatttgtgtaattgtttttgaggcaacaccctgaaaaaatatagcttactttttccgactagtataattaagcggacaaatggaaaaagaatcattcaaagtaaattttaaagaaaagagcaaaagagtaaaatttagcattgtccatgtaagatggataatgacaagtaaacacagaaggtggtgtttgatcccttcgattttggtattcattattcatagttattattcataaattccaggttaggcttgtgccccagtgacacatttgcattttactttaagttgatttctacctggttttgcaaacaaggatttaatgatttgggctgcctctcactcttcctctgttgcttgtcttttcatatacagtgctggcttctagccccttttacaccctttgtctccatcatcagtcttgctctcccatccaatgttttactctcactctctttctctcttctctcttctctctctctctctctcaatgttttaggaaaaaagatttctaacgtggaaaactgatatttgaatagagtcccctaaggctatcaatttacttttaatttgtctggagctaagcttttctttgttgcaatgaggaaggattaaaactgctgtaaaatttattagcttccagaaagatatttgaaatgcatttttttaatgattgtgctgtttgctgtacccagaagcagtgtcatcacaactatagtattccagatggttcccgaagttacactgaaacatcaagataatgctagacttttttatgacgcctctattggtaatgaatagtccatcccaggtagctaatatatattaattaatatatatttgtttccaatgaccatttctagtgatacccagctgatgacaaaacacacacactatccctttgaatcattacaggagacagtgattggtttactgagctctttattttccaaatgtggaagaaatgattggagatttactaatgctgtttcttagcttccccacccagtcctaggaacatattggtagtcaagaacctttaaggaatttagaagttacagttgcaacatttttcatggactcatgtatagtatggcctattctacaaaactgaatgtcctgggacttgactgaaggaagtgtcagttcctgttaaggggaacaccagctgctgggtgccctttttgttccattcaacagtaagttttcattagaaaagggaagatttttctcttggccaacgtgctctgtctactcttgctttctgtgtcagtcttatgtgtgccatcttcactatgtattctcctagaagctcatgaccatcatgaaagtggcttcttcacaagctgatgatctgctagcagtttccttattttccacaaaagagtgaaaccaagttggagataagtttaggttcagaactattttttaagtgtgataggctctgtgactgggcgcggtagctctctcctgtaaaccctgctactcctgaggctgaagtgggaggatcctttgagtccaggattttgagaccagcctgagcaacatagtgagattctgcctctaatttttttttttttttaattagccaggcacctgcctgcagtcccagctacttggaagaccgagccaggagaattcttggagtccaggagttggaagctgcaatgagctatgattgcactattgcactccagcttgggcaagagtgagatcttgtctctaaagaagtttttttttaatttttttattatttatttatcatttttttgtaaaggctctgtcatcctagatgtataactgcatgtagaatgcatctgacttttaaatctacaccaagtcaaataactgatttgaactcttcagagaagtgacaagatgttgtaggtatcccactaatataggtttgagggacttaattctgtgggcgtctttatatgaaactttcaaaaacggtcctatgtttttcagagttgtagtatctcagtgttctatcttttggggaatagctcattggccttctgtgtcacctcatatttactagtaaagttgctttttcaaatggtttataagcacctagatgaagtccagcactttgtcagattattttctccatcacagaagccaaaatacaaagatttcagtctagtcaatctctgcttatctcagtcactgtcagcacctcttatttcttagtctcaattttccaggcagccttttgcttgatttccttgctccccatgcatcagcacaaatgatttatacttatgtacatcttgaaatctcttctttatggattgaattgaatcgagccccagtacaaaaatgaaaactccaggaactgttgtgattgcccaaattacaacttggattgtatgactgtacacgccacactctcatctatcataaatattaaattctcaagcacttatacttcaatatgttttaactttgtctgtttgaccagctcagcactaaagattccattgaagataattcaattgctttgaattctgaaaggggcatctttttaatctattttcatgttgcactgggagttaagtgaatttcaggtgcatagcctgtgaatgatgggagaggcctatgtgccatttggcatcacagaggccaaatattgggtgacatttgctaactaatgctgatcagtgaaatggtctaggacaagattggggttcatcagtcttttcagccattctccctatctcaaactaaaactaaactttgcagaatttctgctgttttgtcagccatactgaaaatgccaagttatgctaaccagggctggccttttttcttctgtcttgtcttttggcaacatccctttgccagtctcaggaactttgttcccacaccccatccccatccttcatccttcctgaggcatctccacatccagacatttctagtgtttttaaccccatcaaatctctcttatcctggatacccttattcagggctctgttatgtgacccaaaaaaatctgataatctcagttcgataatggtgcctcttctaaacatttttttaaatttattttttattttaatagtttttgtggaacaaatggtgtttggttccatgaataagttctttagtggtgatttctgagattttggtgcacccatcacccaagatgtgtacactctacccaatgtgcagtcttttatctctcacactcctcccaccctttcccctgagtctccaaagtccattgtattattcttatgcctttgcatcctcatagcttagctcccacttattagcgagaacacataatgtttggttttccattcctgagttgcttcacttaaaataatagtctccaattctatccaggttgctgcatatgccattattttgttcctttttatggctgagtactatttccatggtgtgtgtgtgtgtgtgtgtgtgtgtgcatgcatcacattttctgtatcctctcattgattgatgggcatttgggctggttccatatttttgcaattgcaaattgtgctgctataaacatgagtatacaagtgccttttccatataaggacttcttttagatacctagtagtgggattgctggatcaaatagatacacttttagttatttaaggaatgtccacactgttttccatagtggttgtactagtttacatactcaccaacagtgtaaaagtattcccttttcaccacatccatgccaacatttattatttttttattatggccattcttgcaggagtaaggtggtatgacattgtggttttgatttgcatttccctgataattagtgatgttgagcattttttcatatgcttgttggccatttgtacatcttcttttgagaattgtctattcatgtccttagcccactttttgatgggattgttggttttcttcttgctgatttgtctgagttccttgtagattctggatattagtcctttgtcaaatgtatagattgtgaagattttctccctctctgtgggttgtctgtttattctgctgattatttcttttgctgtgcagaagctttaattaagtcccatctatttatgtttgtttttgctgtgtttgcttttgggttcttggtcatgaagtctttgcctaagccaatgtctgtaagagtttttccgatgttacctttagaatttttatggtttcaggtcttagaattaagtccttgatgcaccttgagttgatttttgtataagatgagagatgaagatccagtttcattcttctaagtgtgacttgtcaatgatcccagcaccatttgttgaatagagtgtctttcccccactttgtttttgtttgctttgttgaagatcagttggctgtatttacctttattcctgggttctctattctgttccattggcctacgtacttatttttataccagtatcatgctgttttggtgactatgcccttatagtatagttctagtcgggtaatctgaagtttccagatttgttcttttgtttagtcttgtttttgctatgtgggctcttttttggttccatatgaattttaggattgttttttctagttctgtgaagaataatggtggtgttttgatgggaattgcattgaacttgtagattgcttttggctgtatggtcgttttcacaatattgattctacccctccatgagcatgggatatggttccattggtttgtgtcatctataatttttttcagcagtgttttatagttttctttgtaggggttctttcacctctttgcttaagtatattccttattattattattttgcatctgttgtaaaagaggttgagttcttgttgattctcagtgtggttgctgttggtgtatagctgtgctactgatttgtgtacatttgattttgtatcctgaaactttgctgaattcatttaccagatctaggagctttttggatgactcgttagggttttctagatatacgatcatatcatcagcaaacagtgacagtttgacttcctctttaccaatttagatgccctttatttctttctcttgttggattgctttggctaggaattccagtaatttgttgaatagaagtggtgaaagtgggcatccttgttttgtttcagttctcagggggaatgctttcaacttttcgccattcagtataatgttggctgtgggtttgacatagacagctcttgttaccttgaggtatgtcccttctgtgctgattttgctgagggttttaatcataaagggatactggattttgtcaaatgctttgtctgaatccattgagatgatcatgtgatttttgttttaaattttgtgtgatgtgtcacatttattgacttgcatatgttaaaccatccctgcatgcctggtatgaaacccacttgatcatggtggatgatctttttgatatgctgttggattcggtcggctagtattttgttgaggatttctgtatctgtgttcatcagggatattggtctgtagctttctttttttgttatgtccttccctggttttggtattaggatgacactggcttcatagaatgatttagggaggattccctctttctctgttctgtggaatagtgttaataggattggtaccaattcttctttgaatatctgatgaaattcagctatgaatctgtctgactcttgttgacaattgttttattaccatttcaatctcactgctcattattggtctgttacgagtttctatatcttcctggtttaatctaggggagttgtatatttccaggaatttatccatttcctctaggttttctagtttatgcacataaaggtgttcatagtagccttgaataatcttctgtttctctgtggtatcagtagtaatatatcccgttttgtttctgattgagcttatttggatcttctctcttcttttcttggttaatcttggttaatcatttttattcatttttttcaaagaaccaggtttttgtttcatttatcttttgtattatttcttttgtttcaatttcatttagttctgctctgatcttggttatttcttttcttgtgctgggtttgcatttggattgttcttgtttctccagtttaatgaggtgtgaccttagattgtctatttttgccttttcagactttttaatgtaggcatttaatgctatgaactttcctcttagcaccgcttttgctgtatcccagaggtttggataggttgtgtcactattatcattcagttcaaagaatttttcagtttccatcttggtttcattgttgacccaatgataattcagaagcaggttatttaacttccatgtatttgcatggttttgaaggctccttttagagttgatttccagtttttccactgtggtctgagagtacttgatatcatttcgattttcttaaatttactgagacttgttttgtggcctatcatatggtctgtcttggagaatgttccatgtgctggtgaatagaatgtatgttctgcagttgttgggtataatgttctgtaaatacctgttaagtccatttgctgtaggttatagtttaagtccattgtttctttgttggctttctgtcttgatgacctgtctagtgctgtcagtggactattaaagtcccccactattattgtgttgccatctatcttatttcttaggtctagtagtaattattttataaatttgggagctccagcattaagtgcatatatatttaggattgtgatattttcctattggactagtccttttatcgttatgtaatgtccttttttgtctttttaaactgctgttgctttaaaatttgtctgatgtaagaatagctattcctgctcgcttttggtgtccatttgcatggaatatctttttctaacccctttaccttaagtttatgtgagttcctatgtgttagttgagtctcctgaagacagcagaaacgtggttggtgaactcttattcattctgccattctgtatcttttaagtggagcatttaggccatttacattcaacattagtattgagatgtgaggtgctattctattcactgtgcaaattattgcctgaatacctttttttcattgtgttactgttgtatagttcctgtgagatttatgctttaaggaggttctattttcatgtatttcaaggacttgtttcaagatttagagctctttttagcagttcatatagtgctgtcttggtagtggcgaattctgtcagcatttgtctggaaaagactgtatctttccttcatttattaagcttagtttcactggatacaaaattcttggctgataattgtttcatttaaggaggctaaaaataggaccccaatcccttctagcttgtagggtttctgctgagaaatctgctattattctgataggttttcctttgtaggttacttgatgcttttgactgacagctcttaagattcttttcttcgtcttgatttcagataacctgatgactatgtgcctaggtgatgatctttttgcaatgaatttcccaggtgttctttgagctccttgtatttggatgtctagatctctagcaaggctggggaagttttcctcgattattccctcagatgtgttttccaaccttttagatttctcttcttccttgggaacacccattattctttggtttggatgcttaacatagtcccaaacttcttggaggttttgttcattttttaaaattctttttctttttctttgacagattgggttaattcaaaaatccttgtctttgagctctgaagttctttcttcttttgttcaattctattgctgagactttccagtgcattttgcatttctctaagtgtgtccttgatttccagaagttgtgattgttttttgtttatgctatctatttccctgaagacttttcctttcatatcttgtgtcatggttttgatttctttaagttggacttcacctttttctggagccgctttgattagcttagtaattgaccttctgaattttttttctggcaattcagaaatttctccttggtttggatccattgctagtgagctagtgtaatcttttgggggtgttaaagaaccttgttttgttatattaccagaatactttttctgcttccttctcatttgtgtagactgtgtcagagagaagatctaggactcaagggctgctgttcatattcttttgtcccatggggtgctcccttgatgtggtgttcttccccttcccctggggatggggattcctgagagccgaactgcagtgattgttatttctcttctgggtgtagccacccagtggagctactgggctatgggctggtactggggagtgtctgcaaagagtcctgtgacatgatctgtcttcaggtctttcagccgtggatatcggcacctgctccagtggagttagcaggagagtgaagtggactctgtgagggtccttggctgtatttttgtttagtgcactggctttgtgttggttggcctccagccaggaggtggtgctttcaagagtgtatcagctgcagtactatagggtggatgctggatcatcttattttaacaggcattttttaatgcatgtatccagatgaatgaaaaatgtggaaatttttctccatgctgcaagggctggttcttggatagcacttctttggcatctgtcaggtaacaccacataggtgttttgaatgccaatcagtgctggcatcctttcccttctgcctgatgtctgtctgtcattccatagtgttgtaggggagggctgctaacaaggacgaggctagggaacgggagaacaaaaagaaagttttagggagcaaccaaaagtggagaaaattgctgaaaaaaagggaagaagggagtgagaaagagacaagtagttgtttgtagtgtaatttgtgatgtgcttcttgtcacatagagtgactacaggatagcttggtatcattggttcatgagtgtctacagatatctcagccttcactggtgttcccttgaatgttttacggatggaattccatcttttttttgctaaaattttactttagaatacgactgtaaaccccctgcaacattacagcctgggagggctctaggaagttgtcattacgctcatattgaatttttgctagatacataacagatattttccatatgatatctaaacacccaaataagcccaatcctcaagatatcaaacatatcaaaaccaaaataaaatgcctaaagccttggtaatattttccttccttccttccttccttttttccttccttcctttcttccttccttccttcttccatttccttcctttcttttccattgatcccgttgctgctttacttgccttgttaagttacagagatgggattgataatagtgcaggagagagcactattaactattgttagtatagaaaacttgcaggtctatggcaaatgtattttcaacgggatgttagagggtactagatctctctaacacctgtatatagtgtgcaggaaaccacacagaggctaagaggacacttaatgtttctcaagttctaaatttactttacgcctctgacaaagctacatagtttactttgtaggtttctgtagtatttatgataaaatagttatttccactttaggagttgcacagtatctggggtgggacagtatctggggcgttgaccaatattcttccttctttctgtgcatttttcattcaattaaattaaactattattaacagtttaattgacagctctgtgctggacgctttgctaggttgagatagatgtaatctttgctcatccagagcttaaaaggtagcagaaaatatagacatgaaacaagtacagttgtctcttggcatccatggaggattggttccaggactcctgagaatacgaaaatctgtacatgctcaagtcctgcagtttgccctggggaatctggtggaacctgtggataaatgaaaaggtgaccctacaaatctgagggttttgcatcccacagatgttgtattttctattcacattttgtggcagatgcagaacctgcagatacagagggctgaccatatttatttttaaaaacctacatgtaagtggacccatgcagtttcaaacccatgttgttcaagggtcaatggtaattacgcgtgtgatgaatgttataaaagggaagtgctgtgagatctaccttagtctaaaggatcacagaaggactccctggggaagtgaaatttaaatggagacttcagggataatgtattaatcatgaattgtgtttaaccgctagtaataaagatgcccctctcctactaaagaaaataaatcaatgacttaaataagagatatttatttttcttcttattaaagaagttcaagtttggtgagggtagctctacagtatctttaataacccaaggtccttatatctttctattctgccacccacaggcacatggcttctatcttcagggttgcctcatggtagtcagacagatgttgcagcatcagtcattatgtctccattccagacaggacaaagcaggaaggaataaagacaaaatagtctcttacctaagtcagctctccccttttaaggaattttcttaacatcttgctttataatgttggtccaatcttatgttacatgtctgcaagggagcctgtgaaatgtagtttcttttagctgagcacactgccattcctaacagaaatggggctttgtttctatttaacaaaaacagataaagatatttggcaggcaattagttatctctgcttcatagagtaggagttagataggtcaagggtgggtggtgtacttctcaacaattaggtttcctcgattaggcacatgtgaccaattttaacagcactaaacttcttcataatcattgtcataatctcctccattatatctcacaaaaaatggccctgctttggttacagattgtcttgttcatgaggtgatgcagaataaactaagtagatgtataagagtacaattcaggaagcttgtctgatatacacatcacttgcttgttggttctactactgctgccacttagaagtagccaactacttgagctctcaggaactggaactcactttaacttttttctttctgattcattgattgcagattatttctgaagaggaaacatattgctcttgtaactgtaaccttgaactattttagtgctggattttcgtctgtgatcattaggatctttgagttaatacacccaaactctgaatcacagtaaagaactgccagcattatcaaacacatccattgtgactggatatctatacaaacccagcagagcctcttagctcttctattccaccaggacttggaaagttttagcaaagcctgaaatgatgttttcatcattttcttttattactttggtggggaccatgggtaggctctttctagtgtggaagtacattgtttggccacatctgaggagatggcagtttcatgtcctgaggagagtagtaattgctgcataaagttttgctattatctgcacaaaatagcatattctggtctttttctgtttgaattacttccttaatctatcatgacttagtcattactgccttactgcctcttttgcctcttgtaccctcgcaagactgatgctttaattttttttttttttttggccaggggttttggaattctctcaccaagtttcctgatgacaaattgtgaccaccaaatacttactgctatgtagattgaagaaactttcacttttttctgtattttttatggtctaaaataatcagatttgttttgaactaaggagttctctggtctcaagatttgtgttcctcttccaaatttatgcactctgttcttgtttcttttgcaaatcctagggacaacttcagaagcagggaaaaccaatttacaaattcatcagtcaaccctcatcatgagtatgtttaaattaaagacacctgccttcattcatctatacgtgaatttccacaactatatgtggattttagaatgccacattttgctttgcctaggttcaggtcagaactttcagataaaaatgtagcaaagtatcaggtcacagataggttcataagaagaatctcagcaggaacttagtgaatcgtgagcccatctctctatataagctggagccagcaccttgacagtttgtgatgctacaaaatggttcttctctagtctcatagctccattcccagccactatactacatgaggactggcacataatctttacaagtcctatacaattacagaagtagtctttttaatttttatttttttacatctggtctgtcttcattgctatttttaaggggctttgtattgtgactttctcacatttactacacaatttctttactaaactgaaattttgatttttgaaaggtaattcatctgcagtatatttatgaatgtaaattaccctgtgctgggcagagatgttcttcctgcctgtctatattgacaatttttatttcatatataaagtggctataaacatatttaagctaagttagacttcattgtaactgtatagacaaaaatgtcacaaaatatctgaaacacaaaaataagaaacagtaactcagtgcccttggtaaggacttaaaaaaaatataggtatcagatccaagccaaggatgagacactgtgagtaaaagagtctcttagattcaagtcttcacttgcgtgaggaagggcagtgcatataataagtttacataagtaatctgagaaaactgcatatgattccagctcatatggagctgaggtaggctcagtgagcttggtggggaggcttagactgattgcattgttgggtgtgtcctgagttagtctccgtttctcttttcccaacagtgattgtttcatttagacagtgggtcagctgaaggcaagtactatctatacagagaaacctcagagaagattgaattccctgctctggtcttccaagatttataagatcttggaggtgtctgtctctgggctctctattctccctccccagatattctggggatccaagtctcctcatgctgttcatttgaggcagcctagtatagggaaggagcattgtacttggattcagggtgacacatgggtggtattctcctattgaatgctgttgaaaaaaactaaatctcaaaattagaggacagtcacttcatattaaaaaactcaaagaaataagagcttcgtgttgaagacattgggcagatggtactcaattgtacttcactactgctctgctctagaagtgtgagcaagtggcctgaaatatcagtcttaatcttggctgggattttcttttcttagttggtcatatgtccatggtttcagggctcaagggttaggtctttatgcttttatgcctttcaggtagggacaaaaagggcagagatcttatagccttctggacatttttttgctggcttccagggatttttactctgatttgtagaaatggaaataatttattgaacttttcccccacctgcaactgcttactctctctaccctgaaacactctcactaattttttagaggtattatttggaaagttaccagataggccttggaagagatgaagaggcaaaaacagcttattgggaagccctaaagatgtgacttctgttctactgaagggatcttgggacctcctgtggaaagcactatatttggaggaaactgattaaaagtagatcaactaactcttccactcatactgtttagtctacacaaagtgcttctcaagtatatcccaaaatgcttcccttactttcatattttctgcctcccaggtacatgcatgttgaatgataacagggtatcagatggcaacacagagagtttgcagggaaggggcggagaaagggccttgacagacctttcattttgcagaagtggccatgcagcctgatgtggaactgagctggagtttgcagaaacattgtcctaactaggtggaaggcactttccctgttcatgatgttgttcatttgttatttggttccactgtacaaaattctgagtgtttcattgcccagcactgaaagggggatgaaagtgtccatcttaaagataaattggcaaattatgtcaaggtacactgaagaggtcttgtctttagtttgcttttaagtagcttaaatgaggtcaagggccatgcccagaattgtgttgaaatctggatttagcttggattaggtccttgatatttaacaggcttctaatgtctttcctccaaataatgaagtgtacagccaattcaaccattattccttgagccctctgccttgtgccccttcaccaaagaacctttgatgaatgaggcatagcagtaccttgctttgctatgccatttactctttaaaaacaatgaagaagcaaacaaaaaacaccaaaaatatagaaatacaagtatacaaggaagatgtgttatatatagactgatgccaagtaagactctgaattgcagacatcttccccctgcaaaataagtcacaacataaatatatatattttatatacatatgtatatataagatatatatatgtattttctgtaaatgttaagctgctcatattttgatgcattgcgcaatgttttcattaggtcatcctcttgtaagaatgtaacataaatataaatagatctggaaaactagggctataaaacaaacattgagattaacagttttccagtaacaggcagaagttaaccctgggtccatgccttggtaaagcctgtgcagtaagcctctctgagagccagattgaagctttaacccttagtgaacctgacctggaaagataaatctatgtctgcccaataattatgaattgtaactgctgagatcttccaggatggagttaaaataatccatgaaagatttctttaagaaatatttctctaacaaaactgcagataagaaagataaggagggatggctagttgggtctaattaacaatgaccaacatgtcactgatgtttgcgtagggccaattgaagcttatgggtcagctggatagaagggctctcagtttattccttctgatgggaaatcaagtcatggaagtggcatagtgaggagattggctggtgggactggtggtcaaaaagaaggggtgtgattgggctttcacagagagtaggatatcaatctaaaattaaattaagcactgtgtatcagtgatgggtagggtggaagggtgtttggcagtgctgttgttcaaaaatatggccaaggcttcttaaatacactgactgttggattcccttccctgcctccactccctcatctgctgaatccagtttcaaacacaggtgatttttagcaggagttgttgattaaaatgctgactctcagcaccttgacactccagatgaactttagaatatatatgtattttcatcataacgtgtttccctttaggttttttgttttgtcagtagtgggaaccttaaaaaggatatacatagagggagatcttcagccttttaaaaaaatccagttcttcacacttgtcccaaaaggcaataaaggactacctaaaagtgccatttcccacaagggcctgtggatatctaagaaaccagaacactggggagtaacagtgaatcctgggaaaagctgatgaaattgatattttcttttttccaaacagatcagaatgaaggatttcattgccgggaagaatgccggattcttggccactctgacaggtgctggatgccccggaaccccatgcccatccgttccaagtcccctgagcatgtgaggaacatcatcgcgctgtctattgaagctactgctgctgatgtcgaggcttatgacgactgcggccccaccaaacggactttcgcaacctttgggaaagatgtcagcgaccacccggctgaggagaggcctaccctgaaaggcaagaggactgtcgatgtgaccatctgcagccccaaggtcaacagcgttatccgggaggcaggcaatggctgtgaggcgattagccctgtcacctcccccctccacctcaagagctctctgcccaccaagccttccgtgtcttacaccattgccctggctcccccagcccgtgatctggagcagtatgtcaacaatgtcaacaatggccctactcgtccctctgaagctgagccccgtggagctgatagcgagaaagtcatgcatgaggtcagccccattctgaaggaaggtcgcaacaaagagtcccctggtgtgaagcgtctgaaggatatcgttctctaaaccagtctccaggaagaagagaaagaaaccacactggctagtgaagaagcaggagcttcttgttttaattgctcaccaatggttggttcttgagtggctatatttcagagcttttcctaaatgtattgtttataggtgattatcattctgtgacagtcccttgtttcaacaggcagcaggggtgttcagttggagcaaattagctttggcttgagttgttcatggggccttgatgttggggaaacagagacaaattcagttgtgaaaagtattatgtattaagtgtttgaatttatatatttttctatgtcaaaattataatataaattaccattgtttgtggaggattacatttaaaaaagcaaaaagtgaaaaaaaaaagctctggacacctttaataagctcgccactgttttttgtagtgtagacaagttaatggtcatttattgtgtactattcattgattcagtgatgtgaaattgagcccccaaaaggttgtttctgaagctcgagtacttcccaatgccgctactttgctgtggacacccctgctttaaaaacccttttgctagctgtgctattgttgtatttgatattgcaaattgctatgtgtgtggtgatggcaaaaggcttttaaaagttggtgttttctttttcttaaaaaaataataaaactacagacaaaaacaaagtgcaaacaactgagacagcaaatgaatgagcaacaccatgcatatagattgagtacttggagaatactcacgttttttaactcatgtagtgattgctcaccactttgcaaagtatttttcctgcctttcagtggtctgcccaggtccatgatagatcattgcagaaagtcatttttggataggctgctatctaatttgcagttgtcagaaatactgtgctgaaagttttatgacatccatcttttaaattttcaggccctgaacaggaaagttgctcctgaagttatgtttccaggcttagaaattccctctctccaatcatctaaaattgaagatgactgaatctattttaagatctaaattagcatctcttcagacacacacttcctgattcagtgtttcccaatcatgattagaattagactgcaaagcacgtcatgggctgggattgagaactccatgttgctctgtatcttaggcttatatacgtagggatagagtaagcagtacaaagtgtatattttggaaaagacaggtaacaggtaacagcatcgctaatccaattactgtgccttctaaacggagacactcagacacttgaactcatctttttatgactaatagttttttgattaaaaatgtgaacaagaaaatactaaaataaaaatcctttcgatttagccaactctttttgctgtaggctaggaatacaccctttttaaattaacacactgtagatcctttttttctgttttaacattcctctaactcccccatttatcttttgtctattaatattcactagccaacatagtatttttgcagcctaagagttcattatttaaaaataaactaaagaaatatgtcacctttgttctgccttggtcttaagagagttgtttctagagaaacaagttttatggttctgttttcatttgtttcattttttgaaattcaggaatacacagagagaaggcctagaggttagagcactagaatgcaaaagaggatttattttcttaagtttaggtagataagtcagctcttttgaatgttttacttatttttgcctgagttcctagctttacgcattactaggaatattttcttttacaggagggagaagggttttgagggagggggtgggtaaggcagtagggatggggttaggtaggggagaacatttctgaaaaagaacttataatgaagctacaaatccatccttatttcttattcagtgctgaatactacctcatgcaaaatattggtgtggctgcaaatttccctctgaagctgacacaattaaggatgaattaccataacatcttcatttttcctcatttcattgcctctcatacagttttctccctctgatttatttcattttggtagtggattttgaattaagtatttatttctctttgcaagtgactatttgattaacacattaaaaattttttaaaaatttcccctttaagttatgatggctgcctatagaatttagactgtttctcaccctgatccatcctgatattatgttattagctacgatttcaaggtcactttgaagtcagacttcacagttttctacaggtgtatttcttgctatgctcagtgggaaccagggagcagaaaagattgtggaaagtgggaacattaattgtcacgtggctgttgagccagagaggccactggctgccatgcctcttaccagccaagttttaaatggttagagtggcattggcattgattttgcttttctcttgggttttcttcatttcttttcataattcatcttcaagctatagatccatccttcttccctatccaaatactttgttctcagtgggcagtcagatttttttggcttccaaacctcactgagcatgttcagagaattcctctcattaaggaaatatttttccccacaattgtctgatgtatgagtcctctcagaagcacaagtgcatactaggaaggctttgtaaactggttttgtaggcaggctgtacctgcaaataggcattctgagcaaggatcctaaatttccctttggctcatgtcccccccgccccaccccaccttctcctttttggcatgtctggtgaaaagctacaaggttcacagggccaaatattctcccttttgttctctaaacatgttgcacacataaactcaagggagtgatttcggttcctaagtcctagggagttctattccatttattctgatgtcccttttaaggaggagttggtgttgaagtgtgacatgctttaatgataactgctttggcaattccccagacaggtatacttcttcatccaaaattgcacctaaggtgttcatttagacaaaattgttcgcttagtgatccactgatctctaatcagaaatatttttaaaaaatacaatttagatctctgaaaattggaaccactcaagagtatcatcttgatagtgttacttcagcatatgactgactgattttatgaagggagtttagctgacttttccctgtagccctatcatattaaaaacaaaaagtggtccacttgaagcagcaaggacaaagggcagtttagggagaggcagggtgaaggggatagctcgattgggcatccagagtggaaaaggattattattgtacataatagcagttctggctggaattccaatccactttctggggatcattttgatgttgaatgttcccccaaagcattctgacaagtttggtccacttggctctttaccccgggtaataagacccttattgactttgaaaaactggcataaatgagcttaagaaatccattgtatacagtcctagtgtttgccttcttggtaaaattacatttaaggatgtcatttcatgagtcaaattgtatctgctgacactgaagtgtattgagatgttgttctttagtttaagtatgtaacaaagtaatattcaaaggggatgtttgggggtggggctgggaccgggtggctttatattgataatgaaatattccagagcaaaacacattgtcctaatgaagttgttgcagctctcttcgttttcttgtgccgctggaattggcttgtgggtcacttgttgtgcaaaagtgaattaatttcaaataggaatcatattgcttttgtgaaacaaagaaaatttaccaccttgtctgatacatagattggaaggcgctcttggtaaagaataacccacaaacacctgatcttgattggaaagcattgtaggtcattagggaaaactgatgatgctgactgttgctccagctgtgttggcaattcaagatgaccttgttactaactgaaagttgctgtcaaccttagcaaacaaaccagctaacaccattacagcactggttaagtagatttttactggcactggctggcgttcagctgaggaaggctaggatacagactttaatgaccaagagccagactagctcgagctagaaatcagcaacaaatacctccttgtgctatttgaatgctaaggtattagttgcaataggcttacgccttcgctcctctagtgaggggaatgagcctgatgacactattactgtttacctgtcaaaccagggtggaaatttagagggatgcaagtacagtatgtctcattaagcagtctctgttgctgattatatgaagataaaattgttgtatatgctgatctgtatgttatgtacattttcacagtgattgaatcattgtaaaaagaaaaaagacaaaaaagaatcaccactgtctattttatgaagatgataaagcagctttattaaattattacagttatgtttcaaatggtgttatctgccacattgtttccttttatctggtggttctctgtttccccctttaaatgtgttttctctgcttcaaaaatttaatgcattttagtattaaaggctattatggaaaaagtattgagtgtttggtg

SEQ ID NO: 1242 - DNA, 118650 bp, mus musculus; identical to SEQ ID NO: 1241

SEQ ID NO: 1243 - DNA, 9729 bp, mus musculus
ctacgttccgcgcgggagcccacgcgcggttcgtccggaacccacagaccagagacgcaggtcccagccttttcggtgtcggcgccagttcccggaggagcgggtgagtcgggcggccgaccgggcggccgggaccgggtcagcgccccgccagtgtgcaccccgccgcggtgcaccccgcagccctccccagccagcctgcacagcgaggcgcgaaggctgggacccgttgcgacctgttgggcctcgcgagaagttttcaagggaaagtggatcaaagcctaggggtcaaactttctctttgaaagcttagtgccccggggataaggatggaggtcagtctcttaaactgcagccggagactgcgaacttgaaaaaacacccatttaggcgtgtactgacttgcatggcctggagcatgctgccaggcgccctccagccaattataattccaattgtaattctgctaaagcgagatggaactagaggtgaatggtagtaaggggtcctgttaatttaatcaggcatcaaagagtgcttgctggaaaaaagtggatgctttttcttaaagtgaataccgtacaactagtcttttaggtaaatgcaagtaaatttaaaaaataattaaaacccagttcaaccaggattgtctaacttttctcccaccagactttttattaggtctgtttatcaaacaaatacattgaaatagtttcagttcttacattctttcttccataaaagaggaattaccaaaaaggcttggaaatgaacaaaatgccccagttttagttctgctgagaaatctaaaagttactactgatctgataaaatcttgcttagcagctagttcttcaaataatctgttcctgctcccagccttaattgttactatgttctgttagggaatgtgctcagcccccagattttttatttatttcgatcaactctcttcttgcatttacatttctcttttgtatttatatatgcatatatatacatatatatctgtatgaaacaagaagagaagaaattacaatcacaaataatgcatctttccctctcccatcctgggtgtctgcttttctactgctgactttttttgttttgttttgttttgttttgtttttgagaaggagtctcactctgtcacccaagctggagtgcagtggcgccatctcggctcattgcagcctccatctcctgggttcaagcaattctcctgcctcagcctcccaactagctgtaaagatacagctaatttttgtatctttagtagagatggggtttcactatgttggccaggctggtctggaactcctgacctcaggtgatccacctgcctcagcctcccaaagtgctgagattacaggtgtgagccacagcgcccagctgtctttccacctttgagaaaaatcttcctcagaagtgtgggcctggctgggcacagtggctcatgcccacaatcccaacactttgggaggccaaggcgggtggatcacctgaggtcaggagctcgagaccagcctggccaacatggtgaaaccctgtctctactaaatatacaaaaaaaaaatttagccgggtgtggtggcaggtacctgtaatgccagctactcaggaggctgagatgggagaatcacttgaacccgggcagcagaggttgcagtgagctgagatgcgtgccattgcactccagcctggggtcaacaagagcaaaactctgtctcaaaacaaaacaaaacaaaagtgtgggccctaatacccaaaatgcagggctctacaaatacatcccaaatacatggaaaataagattagaaataaagtcttggttcattgtaagaacataaaattgaaaaacaaataatgaaaacaataaaaaataataaaataaaaacttgggatccagcaatcccacgtctagatgtatatcctaaaaacttgagatcagtgtgtcaaagaaatatccgcacacacatgttcactgcagcattacaatagctaagttatgaaatcaatctaggtatccaacaagtgaatggataaatatgtggtatgtgtacccagctgaatactattcagcctttaaaaagaaggaaattctgtcatttgcaacaacgtggatgaatctggaggatattatattaagtgaaataagccaggcagaaaaagacaaaaatcacatattctcacttatatgtggaatctaaaataattgaactcatagaagcagagagtagtgttggttattacaggctggagtagcgggaggggcattgaggagatgttgatcaaagaacagaaaatttcagttaggctggtccaatagtagtgggatattatcacaacttattaacattaatgccactaaagttggtatacaatctcccacttccaaatttggcttttaaaattaaaaaaaatgaaagttgcagttagggggaataactgataagtatttaaggtgatggatgtgctcattagattgattcagtcatttcacactatatcataacatcattgtgtaccccataattatatatgattataatttgtcaaaaaaagattaacttggaagaaagtattcacttcaccaaaggtatatatatatattttaaataaaaagatccatcttaggagttcttttaaatagcttttgggggcattcgaagtaagtggtgattgtgaggattatatgaaatgatagacctaatgcactcaatgtagtactgggcatacagaatgcacacaataaagggtagtaatgaatgaaagggtagtaacgaataaatcaaatcagattttatgttctccataaaactccatctcaaaaagaaaaaaaaaagagactccgtctcaaaaaaaaaaaaagaactggattccatgctgggcgcggtggctcaggcctgtaatcccagcactttgggaggctgaggtgggcggatcacttggggtcaggagcttaagaccagcctagccgacatggtgaaatcctgtctctactaaaaaatacaaaaattagccaggtgtggtggtgcatgcctgtagtcccaactacttgggagactgaggcaggagaatggcttgaacctgggaggcggaggttgcagtgagccgagatcgcaccactgcactccagcctgggcgacagagcgagactctgtcttgaaaaaaaaaaaaaagaactggactcctaacttttccccagggtagctcaaagctgttgttgctggctctagagtcataaaaaactgcctggtctcccatggactgcttaatttctactaatccattaatgtaggtgaaatattgaaaatcaagcccttgtttacttcaaatcatcacagaacatttatgcaagtggtttctaggcgaatttcagcttttggtttgcattcttccctacagaggttagtttgcttaggtagccaccaacgtgttgttgaattgtagtcttttacctgagagtctaagaatatgattaagaagacgaaatcatgtttcataacagctcttatttcatttgttcatcaaattacatcatgtaatttggattgactttggaaaatctacacatattggagaggagctaaggtaacgtctagaaataattaagttatgtcaaataaggtattgtctaactgtacacacatcattctagtgaggattatgggcaagatcttgtataatttagccagtactaccagaagtggtcaggagagggagcaagaggagtttttagtgatggttttctttttgctttcatgaactcaaaatcaagacatgagtgaaagccaggatgaagttcctgatgaagttgagaaccagtttatattgcgtctgcctctggtaagaacttgtatctcagaacaaatatcttcataattatagtttaattataattatagttctacttggattctgacatttctatttcaggtaggctataaaaactcagaacatttgtttcccaggaatcatgttctgttaagcagtcctatcatagcgtgtacttttttggcagcattttttcctcctgtacaataccacctatcatgcaggttgatttcctggcaaaacagctgtgacaatgatggacccattcacttaccaccaatactaacagcctgttccctggacagccaagatacggctcctctgaaatcctttctgtcacctcaaaaggggcagtgagaagggccagcattattcaccaccatgcaagacttttaaagctcatctcaacaagtatttggctctcttcccccacactgatacctgtattcaagcaattacttagtctaggcagctatattaaggatggggttcagaaacctatttccctaattagggttacttaatataccaagcaaactgcaactaggtaagcctttctttagcaactacaacagaagggtagcagtgagaggcaggattgtagagctaggagaaagcattaactgtagctactaagagacaattatgagtttagagtcagcttcatcctaacttgacttatacagtgcacagtatctcatggtacatggtcttgttagtaacatttgggaggtgtaaagttttatttaagggagggctttctttgatatatctattctgttagctgccaagtagatgtttagttcttctgatttttcaatttacctcctttttaggaacatgcttgtactgtcaggaacctagcacgttctcaaagtgtcaagatgaaggataaactaaaaattgacttattgcgtaagtagttaatatccattcactatacattgaacaataatttattaagggattgctatgtgccatacactgtacttggtactaaggatgtgaaaaatgatagaatatggtctctgacttgatggactcatgctttagagaggcttaagtcctcttcttttaagaggaaaggaagtaggaatattgcaccttgagttgagtgattatcatagtgtgtttaaggaaacttgggggtcaactgtggggtttttatactgctggtagcctcccatatataaactttatgatttctgaacatccaagggaatgacaaatggatatgccattctttgtttataaaggtgacatgtatttctttctttctttctttctttctttctttttttttttttttgagatggagtctcgctctgtcgcccaggctggagtgcagtggcgcaatcttggttcactgcaacctctacctcctgggttcaagtgattcttctgcctcagcctcccaagtagctgggattacaggcacatgccaccatgcccggctaagttttgtatttttagtagagacgtggtttcaccatgttggtcaggctagtctcaaactcctgaccttgtgatccgcctgccttggcctcccaaagtgctgggattacaggcgtgagccaccgtgcctggccagtgacatatatttttcttttaaataatatttgttatattggcaaattgtacatccaataaagtggttaatatccaaatatataaggaactcaaacaactcaatagcaagaaaacaaataacctgattttaaaatgggcaaaggatctgaacagatatttctcaaaagaagacatacaagtagccaaaaggttcatgaaaaaatgctcagcatcactaatcattaggggaatgcaaattaaaacaacagcgagatatcacctcatacctgttagaatggcttttattaaaaaaaaaaaaagaacaataacaactgttaatgaggatgaggagaaaagggaaactttgtaccctattggtggtaatgtaaattaatacagccttttttttttttttttttttttgagatggagtcttgctgtgtcacccaggctggagtgcagtggcgcgatcttggctcactggaacctccacctcctgggttcaagcaattctcctgcctcagccttccgagtagctgggactacaggcatgcgccaccacacctggctaatttttttgtatttttggtagagatggggtttcaccatgttgaccaggctggtcttgaactcctgacctcgagtgatccacccacctcagcctcccaaagtgctgggattacaggcgtgagctactgtgcctggcctacagccattattttttttaaatggtatggaggttcctcagaaaactaaaaatagaacaaccatgtgatccagcaaccccacttctgtgaatatattcacagaaggaattgatatcaacatgttgaaggcatatctctctgcactcccatattcattgtagcattattcacaatagccaagatatggaatcaacctaagtgtaaatgtgatacgtatacacaatgctatactactcagccttttaaaaagaacaaaattctgtcatttgggacaccatggatgaatctagaggccatttgcaccaagagcatgtgtaaataaataagtaaataagtaaataaataaataaatgtttccacacaagtttatctgcctaaaaaacacacaaccaaaaataaataaattttgctagtttttttttttaatacagagaagcatataaaggagaaaacaaaaagtggctcataatctcaccagttagttaacacttactgacattttttaaaaaagataatataagttcatagttagaaaattcaaataaaacaggctgggtgtgatggctcatgcctgtaatcccagctctttgggaggctgaggcgggcggatcacttgaggtcaggagttccagaccagcctggccaacatggcgaaaccccgtctctactaaaaatgcaaaaattagccgggcatggtggtgcacacctgtaatcctagctatttgggaggctgaggcatgataattgcttgaacccagggggcggagattgcagtgagcagagattatgccactgcactccagcctgggtgacagagtgagactccttctcaaagaaaaataaaaaaatcaaatgaaaaagaaaagttcgaaaggagaaataaaactcttcttccttatggtgccccaacctcaataccacagataactgatactgtttcttgttacttccttattgacaaaactcttatgcataatactagaattgaagcaatctctctatttttagagttaattcacacaaaatgataaacattgttttgtatctttcttttttcacataatactagaagattatacctgaatcctcttgtgtcaaaagacatttatgtttgggacatctgagcagcaatattcagagtttagtatatggctgttgtatagaattttatctttatgaagctaattagagatttaacttgagatttattagcaccattctagggtcagtcaacccttccctcacccagccctttgaaaacacacatgtacaatgacacgattgaatgcttctaaaaaaaaaaaaaaaggaattggttttaatgaatggaatttgcttttcaggatgagaatgaaacatttattacttcacctatatttagttcacatccattaacaagaaacttagctacttttgcacaagtgacgtaaactaggaaaaaagagctccatatactttccatttcttttctttaggaagctattaattgtgtacacaattctagcattatgagagatagtaggtttcttggaaagactaatctgtcccacataagtcttcattattcaaaccttaggaagtttaagagttcactgggaagatatcaactttaatctttacttctcttcagctgatgggcgccatgcagttgttgaagtagaagatgtcccactagctgctaagctggttgacttgccttgtgttattgaaagcctgagaacgcttgataaaaaaaccttttataaaacagcagacatttctcaggtatggactagttttctttactagcctcacatccttcaaggaattcttttctcttcctatttttctttctttcagtactcctttccacttggtgaatggctgcttggcatttctaatttccagattgactgcacaggaatgaaatgtcatgttctcgtttggtgtttgatccttagctttcagtattgtattttgaccaaatagcctatagagagtcccatttgccacttatagtgacttttcattaattgaaacatatgagctgctgggatcttctgaactttgtattaaaacagtatgttgttaactctggaggtttaaattggttcttattcatcatctctgctgttgatttcttatttcctctctaaatcaaaatgctgagataggccagacacaatggctcatgcctataatccctacactttgggaggctgaggtgggaggatcacctgagcccaggagtttgagaccaacctgggcaacatagtgagacctcatctctacaaaaacaagattagccaggtgtggtggcacacacctgtagtcccagctattctagagattgaggtgggaggatcacttgagcccaggaggtcgagggtgcagtgagccatgatcacgtaccactgcactccagcctgtatgacagagcaagactttgtctaaaaacaaaacaaaaaacctaagctaagttccaagatctgtttccaatatattccctctgtagtggtaaacactctcgtggaaaaaaaaaaacaaaacaaagcaccttcagagttcatatgtagtgctgctggtggctggtggtggggaggagagggagagagagagactgcaaaaatgagagaatataaatgtacattacaaaatacttggttttctggaaatggcaagtatcagtctcttctgtgcatttctagtggtaagaatgattatgattgctaacccaaaattcgtggtcatagtcaacttctttgtctttgttaaatgtagatgcttgtgtgcactgctgatggtgatatccacctttctccagaagaaccagctgcctctactgatcctaatatagtcaggaaaaaagaaagggggagagaagaaaaatgtgtctggaagcatggcagtaagtcaccagccccttgctcattcctgctgactaaaatttatttgctgaatcctaattccttgtgaaacagggacgtcttaccacacttaggtgtttggttcattaggttctcagatactctttaagaggagtcacgtcagctgggcgcggtggctcacgcttgtaatcccagcactttgggaggccgaggcgggtggatcacctgaggtcaggagttcgagaccagcttggccaacatggtgaaactctgtctttactaaaaatacaaaaattagttgggtgtggtggcgggcacctgtaatcccagctactcgggaggctgaggcaggagaatcgcttgaacctaggaggaggtggttgcagtaagctgagctcgcaccactgcactccagcctgggcaacagagtgggactcgatctcaaaaaaaaaaaaaaaaaaggagtgatgtcatgaccctttggtttatagcatgatctttgtctttatcaaattcagctatgtgactaccatcagtcatataacgtttcactgtgttgtatttattttagttacgccaccacttaagaatgtcagaaagaaaaggttccggaaaacacaaaaaaaggttagttacatgctatttgtgtgtctgccgggccgattagaagaggatcatgggccagaagaaaagagaaaaagtcagttgggaattaatttttaattcatttatatgttcaataaacattt

SEQ ID NO: 1244 - DNA, 7809 bp, mus musculus; identical to SEQ ID NO: 201

SEQ ID NO: 1245 - DNA, 183 bp, mus musculus
gatccgttcggagccgggcgctagagagaggtgcgcagtgcccgagatccctggctatggggaggcggtgactggtgcgggccaggccggaccaagggctgaggggctggctccagaggcaccgtcagatcgtctggaggagaaccgcgctgaccgcttcccagccagctttgcaggcgcccg

SEQ ID NO: 1246 - DNA, 77 bp, mus musculus
agaggcaccgtcagatcgtctggaggagaaccgcgctgaccgcttcccagccagctttgcaggcgcccgcgcgcagc

SEQ ID NO: 1247 - DNA, 2428 bp, mus musculus
ggaagcggcggagtcgggagagccggagagcctctgggaaagcgcaaggttgaggacctggcccccgaatcaggaaaaggcaggtattggaacccacggcctgggtgttagtccagccgcttagtattctgactctattctgcctttcttgtctcctaagaataactgtgcttgaagaagaaaattcccaacatggacaaaccacgcaaagaaaatgaagaagagccgcagagcgcgcccaagaccgatgaggagaggcctccggtggagcactctcccgaaaagcagtcccccgaggagcagtcttcggaggagcagtcctcggaggaggagttctttcctgaggagctcttgcctgagctcctgcctgagatgctcctctcggaggagcgccctccgcaggagggtctttccaggaaggacctgtttgaggggcgccctcccatggagcagcctccttgtggagtaggaaaacataagcttgaagaaggaagctttaaagaaaggttggctcgttctcgcccgcaatttagaggggacatacatggcagaaatttaagcaatgaggagatgatacaggcagcagatgagctagaagagatgaaaagagtaagaaacaaactgatgataatgcactggaaggcaaaacggagccgtccttatcctatttaatgtgttcggcctttaattctgttttgcctgctaatagtattgccattgccacctggactttctgtttgcattttcttaatgccttttcccatattctgaattttaactttttgtgaggctttattttagatgtttagcatgtaactcgcttaaagttgaggtttccccctaaaatctacaagtttccctctttcagtcatgagccctacacatttgcatgaaagatgtacattatatattgtgaaacgaaaaaagcaattttcaaatggtatatattgtatcccatttttgtaaaaaaaatgtatatttatatattaatatgcaaagaaaaagctaaaagtatagacttcaaaggcataacagtggttgtgtggtaagataataggtgattttttaaatttttgttttatctgaatttctcattttttcaggacaaacgttttacttgtgttgcaaaaatatataatgaaaaaatcacacaattttgaagaaaactgtcaatcagcttataacgacaatgtggcacttaataaatacttgtcagaactttaaaaaaagtgaatcctatgtttttttctgaatctcttaggcacaaatattagccagatatggattatatttaatagtcattttgttctcatttaaataggaataatacttgctttacagtgctactgtgggaccagatgagaaaaaggttgtgtgagctatgttcggggtctttattccacctgcacaggcaggaccccaacccctatagattccctgcagacatagggaaggtacccaaaggagatctcacttgtgctcacaaacaattccggtgagattccaagtgagtgccacattctattcatgtcctgctgtactctcagatacctaccgtatctgctaggcacagctgctccttctcctgggtcctgatccttccactggctctcatccctgctgacgtgctggactgcttaaggtacaaagcctcactgattgctctggagtccctggtgggcccaagctgaattgtgtctcctgcagatatatgaatgcccttcttccagctttaatattgcacttagctaggaggctaccatctcaatgctgcttagacctcaatgtctttaaaaaatgcttagtaaggccaggcgcggtggctcacgcctgtaatctagcattttgggaggccgaggcaggcagatcacgaggtcaggagatcgagaccatcctggggaacacggtgagaccccatccctactaaaaatacaaaaaaaaaattaaccgggtgtggtggcgggcgcctgtagtcccagccactcgggaggctgaggcaggagaatggcttgaacccgggggacagagcttgcagtgagccaagatcgcgccactgcattccagcctgggagacagcaagactccgtctcaaaaaaaaaaaaaatgcttagtaaaatagttcttccattttttttttttttccatttaggaccttccttttctccactggactcaaacatgattccaccttttctccacctgactcaaacatgattccactaggtcctgggctaggagacaaaattattgagccagacaccatgctgtgtactcagaattggaacttccctcccaaatatccaaggataactatcattttaattgtctaacttgccttaagatgagttctctctcaggggcttctggcaagcttgccttgccaattcagctgacttgctcaacttgtataaattaaagaggaagataa

SEQ ID NO: 1248 - DNA, 920354 bp, mus musculus
aggtggacaggcagagtctgcacctgccgcctgcacctccgttagggcgacagggcagctggtgtttcgctcctggagtgtgcctacctcgcaaggggggcgagggccacaggctgaggcgcccgcgtcccggagtgcaccgcttggccgaggcaaggtgttgctggggcaaggctgctccgaagcgaagtcgcgcaaaaggaagagtctgggaggcaggcgacttaggagagtctagtcactgagagacagaggcagcatctgccattctaactacggagctgagtaatttagaaaccctccttaactctccctttccagctctccccaaagtccacagaagctctgctgaactctagaaatcttccctggctggggggaagtttactagtatcctctttggctaagacagggagtggaaaaaacaggcggggctgtactgtccgctgtttggggagacgcggtcttcctcgcgcccccttcagccactccgactgcctgggaagtcccagcccgcgctctccggaacccggctcgccgtctcgccctggacatggaactacgcatctgagacctgctggacgttttgctggccgttttgcaagactcaggtaatgtccactcgcagagctggagagttgactggcaagggccaggggagaacgcgctgcgctctcagttggcagcggggcaggccgcagccaatggaggctttatctttcctgcagctctggtctccgcgcctggaaatttgccagttggctttctcttcctttagccttcccagaaagtttagggaatagagctccgaaggccaggggctcttcgcctgggaggagcgtgcgccgtccttcaggtgcccgcgagcccaagcgttgcgtttccgcggcgggatcttcatgctctctgcggctggcgcgcgggctctgcagcctggaaggcaatttccaactgggcgcttctgactgcccacatttctgccgcagctgggagagcaactggagctgggaagaggctcaaggcggctcctgggtggagcagcgaggggttccccagcaatacgctgccgctcctgggattcccaccaagcactaggcaggggagatcgctggatatctggggccatctctgtgctcctgcactgagagcctgaaggtacttcccctgtggttcccgagacgccccctttcctcttcccgcaagaatccccgatacccctagagtgggtttcccaggtccccactgctgctcaggcgtgaggatctgcccgcgccaaattgcgcttcagactccttgtgaaggaaaactagagtgggagagtagggatagccactcgcgagtggctcgccttgcctctctgggcctggcattggagcaaacagcttgatctgtcaccatcagacgtttaagaaaaatgctttggcaaggagaccctggcaagggaaatgtgtattataacaaatgtctgcttcaggggtttctcctggtccctgcagccatcccctctccatctgtgccgcccaaggacttagagacattagtaaacaagtattcaagattttccccttgccacccacaaaagttgtgactgcacagaagtattggaaaagtacttctcagttgaaagctactctagagcctatcacaggtgttttttttagggggagtctatttaggagtatcttgtccccgaatgaggaagcgggacctgcccaccaccactaccttcaatcgaatgtgtagacctccaagaaggaatcctcctttcttttcctggccaggggaatcaagctgtagattattaaacatgcggcatagctgggaacagaccccaaggaagtaagggagggagggaggaaaggacacttctctgagcctgcaagttcagcacgggcgtcctacagttcaggaagactacctcagtgacagagtccctgggaatgaaggagttaagtttttgggacaagtgtctgggactggggtccattttcccactgacatcctcatctcccaccccaccgcagcagccgacccaaggttttggcttcatctctgagccgacccgtacggtgtgaactctctaatttgcgggccgccctgggctagatagcccacaattacccgccgtggaagcagattatttggggcactagtatccatgcattgttgtaccactgggctctttgccagcagggtctcggatacttaggcttccaccccttcttgccgcacagaacgcgttcttctccatgcttccggcttccccaaagatagcaattgggcaactaccctgggacttagggagggtgaaattcccaagtattcctgagccgaggcttcagcagaagtgcctatcttcgccacttgcatcccttctactcctctcctccgtggagcaacccctgctctatggccagtacagtcgcaccgtgaggctgctggacccgatgcggagactccagtttgaaaccacctgcttacagttagctctccaatttgagggctgccctggggtagacagcctgcaattactgaggtggaagcagctgatttaaatagcgtttaaatgtggataaagggctgtggcatcaaaggctcctggcttgcccactctaacctcagctggtctgaaggagaggcaagttgcgaccaaagctgcctccgtgaacagacagctgcagccgcttctgcttctgccctataggtcaaggccagacctttggagcagtagggttgaggatttaaatccggctttgtggaatagcctctgcttccctctctgatatctggccagtcttaggttgagcaattggccatttttagtttctgcggggcttctaccactttgacctctctgtgcagaggctaaaggtactggtcaggggtggtggatagcagggtgcccctggactgtggcatttacaggtaaaatcaagtctgaatcttgatttacccattcatttcctgagaaatagttcctcaatgttgtagaacattcttgtttgccaataactggcaatagagtccatacacacatatgctgcttattagggtgaactgatggtgagataacctggagaacagccccttataaccatctggaacatgtctccacagctgcaaagcccattgaaattttatttagctttaaaaagacatgctgtaaagaatctgaccatataaaaaagatgaattatgaagtgactatttcagttttgtttaaaagaataaacttcactttatcaaatacactggcttccatagtttattgaagtgtctcagtgcaaacatttgctatttgggaagaaggggaaagattgggaaggtgaaatgagttaaaatatggttgaaatgatcgtatactttggtaaaacagaactttgtgttcacatctgtgccttaaataaaatcatcacgatgtgatgtgaggccctgagtagattctgtgacaggttgtagcactatgatgaaaccaaaggggaacatatatttatcctttgtatttggaaatttcctgtaactgcagcagtaatgattacagctgggactgttggaagacaaatgtacacactgccttcttcgtttgagaagtaccataacctcctttgtgaaaatgcactgtaatcaagtggaagagataaaaagtcccaagtttgaggtcttcactaataatatataaaagaaaaatcattgccaaacctcgagatgtagactaacagggttttttcaaggctggtttctagctgtagtcagaaactcacaccttttaatctctgagaactgtcccttgatcctaggtcagaaagctgtgattggagccaacttggtagagaaaggtaaatgtggaatgtgcaatatgtgctttaattatcctgagctaggacttgaaaataagcctctcattatctttagacttggagctgcaagtgccaaggaatttgccaaaataaaatgtgtctgtccaggctgggcatggtggctcacatctgtaacaatcccagcactttgggaggctgaggcgggaggatcacttgagcccaggagtttgagattagtctgggcaacatagtgacaccccacctctattttaaaaatgtgtctaatgtaaggcctgatgcaaggatgtaacacatggatacatctggccaaagctaccgctatttgggctggttcactttgagttatctcctaatgacatcagaggcactagagtgagtccactgtggggcagtttcttttgggcttccccagccacagacatggttccaaatcttttgtcaaatgatctaaatacatattccctgtgccaagaagcctagatttagtagccttcttgctttatttttcccattaatctcacagcttcgtgtagctataccttggcttctctcttgagtttcaaaatgctttttagctggtttgctttattcctgtatttgggtgttctgttgtcatgaaaatgtattaagacactgacttgacattttccccaagcaaacttttgttttttttttttatcccttccttttaatgaggtccttattctctaaccctagcacctctgatctcattcatctgtgactgctcctgtgtgcctcatccatcactacctcgtgcatcctgtcttttattaaatgccctgaattctgtctctagaataggttttctcctttgcatttgtactgccaccacttgcagttaggtcttctagattcttgatctggcctgctacaaaagccttttcttgctgtctttgatctgctctctaattcagtatatcctacatgttaggattaatcttcctgtagctcatgtagttctttatttaaaagtgttacttagtgagtggttgttaagtcatacagattgttattgaatctaaaataatctctaaccatttgagttgcctgatgcattaaataagttgcattgtaaccttaggaagtgatatggtttggctgcgtccccacccaaatcttaccttgaattgtaatagtccccacgtatcaaggatggggccaggtggagataattgaatcatggggatggtttccccactactgttcttgtggtagtgaataaatctcacaagatctgatggttttataaatgggaattctcctgaacaagctctcttgcctgccgccatgtaagacatgcttttgcttctcctttgccttctaccatgattgtgaggcctccccagccatgcggaactgtgagtccactaaacctctttcttttataaattacccagtcttgggtatgtctttattagcagtatgagaacaaactaatacaggaagttctctaacattgcaggtgagtacacagcacggccaaccatttggtgggaactcaaacatcagatttgggacatttgttgcctaacccagagagtccatatcatcctttcaatatccagggacccaaatagtgtgttgtttcctatcagttggcctgctgaaattacaccttttaaaaattattagaactgtgttttatagtcttttgtttgttaacagtctattgctatgcccaaataggtcattttgctctggcttacttgggtgtgcatcactctaggaatcatctagatcattgtattatgttatgaatttttaacatttatgttgtgcttgctttatactttggggaatgcccttcccctttctttaccttgcttaatatttataattatttgtgaggcaggtggtctgtccaaattgggaaactttgttttattggtatcacaaagctattattgctctggggtcctggctcagatagcactagactaaagggattttattctctcctcattagctgtaaaactaagtccaaattctttagccagaagtttaaggctctttaatatttagcctcagtgtacctagtaagccatatttcttactaccttcctgttcacataatctagccagactggatcactcaccattatccagttataacctttgttatatatcttttgtgcccttgcttatgccattcttttccctgaagtatttttcctcccaatttccatctctacttctctgcctgttgaaaacaaaccatattcaagaaacagcttaatgcaactctccctaatttatctctcatacctcatagctaaaataatctgtcccttttctttttctttcttttcttttagacagggcctcactctgccacccaggctggagtgcagtggtgtgatcacagctcactgtagtcttgacctcacaggctcaagcaatcctctcacctcagcctcccgcccccagtagctgggactacaggtgcatgccaccatgcccggctaatttttgtatttttttttgtagagatatggttttgtcatgttgcccacgctggtcttgaactctgggctcaagccatctgcctgccttggcttcccaaagtgccgcggttacaggtgtgaaccgctgtgctcagcaatctctcccttttcataactctcttggcacattgttgatcccccttttatgatatttaccttgttctgcaaacattattgttatttgtgtatcactctatctcctctactaaattttaaacttttggaaggctgtcttttgttctgcagagtgccaagggtataggaagcatctgttacatacttatttaattgagctgcctttgagatctcagtattagccttagcattttactatgtaaatgatagtttcaggttaagtaggaaattgccaaatctattatttgccaataatgtcatgaagcagtataatagggcactgatttttttaaaacagctatgctctagaagtgctctattcaataaatatgcagttgtataaatttaaactgattacaattaaataagactaaaaatttcggttcctcagtcacctagccacatttcaagtacttgatagccacatgtggtcagtgaataccatattggaaagtacagctatagagtattcccatcaccagagtaagttctactggacagcactattatacaacaatggttctcaacacttgtttccaccaaaaacacgttcacaaaggtgactgctttcatgggtttatgcagaattcccagtgccatagtgctgccacttttcttccttctcagaacacaaattagtaacattacaggaatcatcttgactctgtttgggagacaaattagatatttatgtcatatcaaacaccagaataaattccagataaaactctgaagaagaaaaaattataaagaacttgatctatcacgtataacttatattggaaattataatgattaaaatactatggtacttgtgtaggatcagacacattactataacagaacagtgtccaaagaaataatcttaagtatattatggattttaagaaatgacaaagatttcaaattcatgcgtttgagggaaaagatagatttttcagtaaatgtgattaggacaacagctggtcattgaggggaaatttaataaagctacatctatacccactatttaaaccaaagttaattccagctttctcaaagatttaaatgtaaaaaaaactataaagacactcaaagatattttagattatttgaaaatctatataattacaatttaacattttattttatgatatgtttatagtcttgagatggagaaggtttttctaattatgaagactgaaggcttaaaggaaaagattgatacatttaaccttcaaaaaagtctttatggtaaaaaataccataatcaaggttaattaaaaaactaggaaaaatatctgtgacacataacaatgggtagttattcttaacataaaagaacttccacatattaattacaaaataaatctcatagaaaaaatggggaaaattcatgaatagaatactcaccaaaaaaggaataccaaactcactttgcaaataaaaactaatagttttcacatatcagattaagaaggcttcaaaaccaacataaaacatggttttggcaaacctgtgaggatatggatgatccaacgtactgtttaaattggtccatttccaaagattgcattggcaatctgtataaaaatgtaaaataccttctatgacttagcaatttcactaagtatttattctaagaagataaatgcaagtactaaaacatgtatacacaaggatgttcattaatgtttcatttatactggcaaagctttgaaaacaatataagtggctctaatagtgtattgactaggtcaattgggatgtatcattttaatcagttacttggacacattaaagacaaagcagacctacatttattgatatggaaatatatccataaatataatttaatggaaaaggtagcttacaaagaaacacaattcaattttttcacttgtttatgtatttgtgtacatctatgtgtgcatataagcatatgaaatgtatagaaagtttttcaccaaaatgttaattataggtgaaaagactgaattttctttaaaaaatcagcctgtgcttttgtttatttacagtgagaataatacaagcatatattttataatgcatttaaaatgcttatggtactcaatactctgcttaaagcacagtggcagttattatgcttatataatttataagataagctagtcaaagttaaatgtgaacttcagaaggattcaagtgttaaatgtaaaaaaaggaaagtatataataactaaaatataataaaagtaacctgggagcaggactttctaataataataaaagaagaaatcagaaaaatcaatagagcattttacataaacatagaaaatgtatatggataaacatataataataaagataaattggaacaaacaaacaattgtaatatttgatatgtaaaggtttatattagctcaaaaatataactttccatcagctaaccacccacaaataataaggtgttatttggactcttattttttatattataaacatattgtatatatcctataaatatatagagttattgaagtattttacatgctagctctggtaacacttgcagtgattctagaggaatatggattggggaatatggggaaaggaccatgtagtgtaattttctgctctaactagacaaggataaagcctcataagatagtggcagatgctgcatatcttggcatgaacttacctgctccattgttctctatagatttacagctgccagtgccactatcggtacagggaatggtcttgccagtgccactatctatacagggaatggtcttgccagatccaaaaatacagctgactttttcccctatacaccattagttttttaatattcagcatctatgtcaccatatttccatttaaggggatgtttagaactaacagctctcctggttcttgaaccaaactcagaatcaaaaaggtcacatcctcatctgaggaaagaaaaccagatcagggcccagatatcctttagtgaaatatctgctttaaactttctagaaaatggaaaaatcaatttccctaacgtctatttcctaggtcttatttaatgcccctaataatgggtagttgtgacacagaatttagactaagggctatgaccacaaataatgatagctaacattcagtggagactaattatattctgggttctattcttagtacagctttatatgtattaaatcatttcatattaataattattttactgggaggtaggtggtatttttattacaatttttagatgaggaaactgagacacgagttcagtaatttgcctagtcacaaagctattgaaatggctgttctggggtgagaacccagccagtctcgctctaaaatccatgcatttaaacgtgacacaaaagtatgtatactaagagtagtaacagatactatttagctcagttatgtagctttcaaattttctacaattaagatatgttacttctataatcacaaaatatatgatattaaaaattaaagcttcagatggagccatagacatagccctctcaactcttcaattttgtctttatattcttttttacaaaagtatcctaaggcgttgtaccataggatatatcatttaaaaagcctacttaatatttggaggtggtaattgcaatctgttgaccaaagataattgcattttgcaaccagaagggatgatggggtaaaacctctgaaacttttgcttcagagtctaaaatgtacaattatttcccaattgaacctaataactgctttataatatcatttcctttgttatccagcctaaactttgtagtattgtccttttgctaatatcttcatctgattctagactcattatcttgtcactaaatctgcctacaacacctccctctccgtttttggatcaatctaaccaccactttctctgttccaacatctctatggctgaactctagagaagttcatacctgtgccagaaacagtacatggtctaaaacctcatttgggccctgcagaggtgctaggaagaccttttacatgtacatattcagctttctttcccatctgtttcccatggtagttatttcaaacacccactgctcatctcagactacatttttccattcaggcagttgttcttgcctttgactttactttcagacttgactttctaactccattcattctcttgcctcctccccttccgttcccatactcacccaattccctagtgttttgttcaaagtgagtaattccattggatcctgtgtttaagagttccatgtcctcagttatcctctgttttctctgggaagtagcagtagttgggaaggaagtctgaatagccaattggagcattggagcttgggggaaagaggtcattaataaatgcagaagaatatttaggtaagagtgagagttccaatgaggttagggatcatgactttataagtgaaaatagtctacacagctgtgcagttttttcaagctctgctcaggtgtaagaatggaggaagtggacagttgtgttgatccagaactgagttttgccaggatccatcacagggacaaaagaatgagaaggtgaagatattagtacaagttgtggaagtgatggattatgaattgaaactgtatagggaaggaagcatcagggactgataagtaaggtaaaaactggttgtgaggtgggaagaaagtacaagggtggtcggggactgataattaaggtaaaaactggttgtgaggtgggaagaaagcacaagggtggtcggggtctgtatgaggaggacacaagagcagggtgatgatgcagcccagcagtggctagggcttatgtcaggagagtatatgagggatggtagccttgcaggggtcaggactcatacagagtggggtggcagtctggcaaggccggatagttgactacatgctgggagaatgagcaaataaatatattaagagtaataggagtgggcttctcactgtcatagaaggcagttacaaatatggaaaggcgggaggctagaagggactctgtggttttgaattggaattatcagagtcattcatggctatttctgtctccatctatgtatatatttatgtttctatttgtctatgtaaatgattatatatcttacacatatgtatatttcctaactttgtccactgagagggccaggaatagcaacacattagtagtgataaacataacaaacacccacatcttagtttgtcaatagtaatcttcactaaaagtaatcagagttctttgaagaaattgcttatctcaggcctggggcagagaagcaaaaagatgagggtgggcacatcttgtgctgccagaaagtaagaagtgctcaaacaatgataggggcatgtgaaaagacagaaagagagtttgaaggggctcctactagtgctatctccaagaatagagagaatgctaaagctgaatggcatgagcctcaaagaggcagaggtttttacatgaaggcagtgatagaagtggcagtgtgaagacaccttacacatttcctgatcctgagctggatctaccagagagggccgaagggggttcttttaatgttgaatcagtcccaaggcagagatcacgtgcagaatggtggtaagggatctggaagggcacacagaggggatccagcacagtagtaaagagatacaggcaacagggaatacaacaaagataagaggtgaagagaaactctagcatttcagttgtgcaaataggtcaagggaacaacttattgagattttcagcaggaagagagagggctccaggagggatgttccaggaaaattattttcatgagtttttaatgatctgttggaaagtttgggggcacttggttatagagatatagaaaaatgagtcacgtgaaaatgagacaattttcatattataactgcaggaaaaacaaaaagttcaagaaaggaaatgaaatcataatatactatttggctcacaacttaatattcataataatgtaaaattatcacatagctatatttgaataattgagagaggacaactggttattatcttctgtattaggaactcaatagataatatgtaatattgactaagaagcagaaatatgaacatattgtttataaacatggagatacataacagatgaaatagcttaaaaagttgaagttgtctttaagaaaaaggacttggggtaggggcagagaactgctgttttatatgtattatagaattatgtataaagatacatgtcaaaaagttatggtgcagagaaatcaaagacctaaaagcaaaaataccattcaactcagcaattccattactgggtacatgcccaaagaaatataaatcactctatcataatgacatgcatatgtatgttcattgcagcactattcacaatagcaaagacatggaatcaacctaaatgcccatccgtggaagattggataaagaaaatgtagtacatatataccatggaatactatgcagccataaaaaagaatgaaatcatgtcctttgcaccaacacagatggacctggaggccattatcctaagcaaactaatgcaagctaatgcaggaacagaaaataaaatcccacatcttctcacttataagtgggagctaaacaacgagaacacatggacacaaagaggcgagcaacacccgctggggcctacttgagggtggagggtgggagaggatcagaaaaaaatactcatcaggcactagccttagtacctgggtgacaaaataatctgtatacgaaacccctgtaacacatagtttacctatataacaaacatgcacatgtatccctgaagctaaaataaaagttagaaaagaaacttagggcaagaccaaagtgaggaggactattttaaaaacagaacaatctactggggagttttgaaggggggagccaaaggagcaagaggaaaaaatatgcatgtcaaaatctattttaaccacttttctcaaactagagctcactctgtgctgccctcagcactatttatattagaatcttccccacccctatccccacacaaacatccattgatgtgcaggactcctaattaattgcccaaattacctgattctactcttctgccacagtttcagttacattctacagcacttagagccacaaaataccaagaggaaaacaaagcaaaacatgtttatattacctctcactatattcaggattgatgtattgattaaacctctctgtcacttccatagtgaaaggttgtcctgccattggtccattgtattattttcttcccccagtactttctggcttcttacattgcaaatactcactgtcatccttctcccactatgtcaccttctatatagacatctgtgttctgtcacagcttttacatttgaacaactattcattttatagacattacaagtaaaatacattgtcctgcaaggaatattacagttgtacttcaggcacgcctgctttacaatgtcaacaagagggatccattaatttatagttttgtgtttggtaggggaaccatataatattctacatatatttagttctccagaatgtagcttaatcaatatggcacctcaggcaacctgaaatactgaaggcaacataagattgtcagaccaagaaattttatgtctgctgatgggggtttaactcttttggaggctgcagaaggtatatatatttagaagattatagtaaagtcgatgataggaaagaatcaaactgatgtgtataaaaggtactgagggagagagaagtctgtatttaggaccccaaggcagaaacttccaggttctaatccttgcctgccaaccttgagcactgtagaggtttcaataatattttctatctctgagtgtcattagacatttataaagggaatgcctcatgtaggaaaacctgcagtaccaccttgagccaaccactgacctctatgcctgagtttggcacctgccaagtgagatgggcagttgaactatgtgcctttaggtgcctttgaatcctgtggttctatgattttagtaccatgctctgcttatctcaaagagctattctgaggctcaaatgaaatacttgacatgcaaatgccacaaaagtttcaagtgctatacgaatgaatgtaaaagtgttttaaattatgcatctctaaatataaccaacaacttgcacatgctctcccaaacaaagcaaatgggcttctgggcttcgattttcaattagtctcaaaacatatgattttacttgttccaattttcagaagcaaaaggagcaaaagattcaaattatgatctttattaagaaggtactaagccacttagaaatgctgggcacattatgtggctcggccaactttttcactgttgtattgtgtgggtctcccaaatagcttttactgtgaagactaataaaaatgataggaaagttaaaactgagcagaattagattaaatctcaatctgtattctgcaagggtttttatttgtgtgtgcatacttttctatatgcttctaatctcttcatatggtttatagatcagctattagttaataggttctgacatgtgattaatatgtaggtatttgaaaattcatgtggtgcatgcctatgtctatggagcaaggtgctgaatctgcacattcacctcaggaacattggggatggaaagtcaagcccagaattatcttttgcatgaaggatgctagctagggcctttctaggtccccaagggagacactgaagatcttttttcattaaataaacatccactaagaacccgataggcttcatatactatactattcgctgggaacttctgacctcaagtgatttgcctgcctcagcctcccaaagtgctgggattataggtgtgagccaccatgcttggcccagctttttctttcagataaaaattttttctttcagaaaaaaaattgctccttccttaaaagttcatcatgaattctcaaagagagacacaatggtcagctcctatgacactaaaatttagataccagaataaagaatggaaggtaaaaactgcccaaactctttctggggtggtggtcaggaggatcagtccctgagaagacagagaacttaaaggatatacttgaaatttttatttaatgcaaagtataacactttctgcctaaatactgctgcattagaagcattttattgtaaaatctctttccaggcacatacactccgctgctatgtacacaactacaaaaacaggcaaggccaagagcagtcacaccagctactatggtttgttagtggacagaagtgcttgaatttgattaaagcaaatgcaacaaaggtttacatactgtgagtaaaaaaaatgcttcagagcacccaactagcaaacaggatgtgcacacctcaggcctacctgaaatggagagcaaacagtgatgtaaagtgtgtttgcatgaaaaaaagactgctaaaaccggcattaggctgattttcaatttatattaagggttggtatacttttttctaacttggtgaacagtcaacaagtaatcatacagctttttcttttctctctctctctctctctttctttctttttctttccttctttccttccttcctccccttcctcctttctcctctttctttctttttctttctttctttctttttctttctttctttctttctttctttctttctttctttctttctctctttctttctttcttttttttcttttttctttctctttctttctttctttctctctctctcctttatttctttctttctctctctctcccttccttccttccttccttctttctttctttcttttttctttctctctctctttctttctttccctctctctctttctctcctttctttctctttctttctttctttctttctttctttctttctttctttctttctttttcttttcttttcttttctttcctttcttattgagatgatggagtattactctgttgcccaggctggagcacactggtgtgatatcggctcactgcagcttcgacctccaggttcaagtgattctcctgcctcagcctccctagtagctgagattacaagcatgtgccaccatgcctggctaatttttgtatttttagtagagtcggggtttcaccatgttggtcaggctggtctaaaacttctgacctcaagtgatctgcctgcctcagcctcccaaagtgctgggattattggtgtgagccaccatgcttggcccaggtttttctttcagatagacatgcatatacacatatattatcattattgaggtacaatttacataacataaatttatccatttaaagtgtataattcaatattttttagtatattcacagagtcatgcaaccatcaccacagttttagatatttttatcatctcaaaaaggaacccaataccaattagcagttacactccatttacccaacatgatgcctcaagcccagacttacgcaaccattaatcaacttactgcctctatagatttgcctattctaagcaattcgtataaatggaatcatacactatgtggcattttgcatctagctcccttcgctctggcatgatgttttcaaagtgcatccattttgtagcaggtgtattttattcctttttaattgacagataatatttcatagtatctatatatcacaatttgtttaccattcatcaattggtagacatttaggttgtttccacttttttgctatcatgagtagtcttacagcttcttacatcagtttctaattagcatgcacatcactaagcactgatccagatattaaaagatactagtcttcataagctggccatcccccaattccttgccaaatcaccaaaatcagttaaacatatttggaaaactagacaataggtataggcagataataggcacttaatgtttcctgactcaggaattaatggatgagaaaaatcattccttcagttctaattctccttacaataacatccctaccagtgccacctggatattgtgtcaaggtatgctagagctggaatgaacgtggagtcccgggttcctcaaagtgtgggtcaagaaccacatgtgtcagatccaccaggggagcttattaaaaatacctatttctgtacccccaccccagagaatctgattcaataaatctcggggtgaggccataggaagctgcctttgtaataagcaccccagataatacaaatgcatgttagagtttgagaatcattgatttagtccaacctccctactctataggagaagaagtttaggacttgggtggggaagggacatgctcaaggttacagggcatggtaaagataatgcaacagggagttgaggttatgaatcctgatatagcactttccattaccttgggtactcttctttatcacatctccttcttttcctggtgaatacatgcctccctcacagacttgctccataagtgtcagtgtctgacataccctaagtgctcaataaatagtttttttttttttaagcttagtcctgtgtgaactgaatgactaaaggatctccttttggggcagtgtttgctaaaagtataaagtaacaagtataaggcttaagaaaagaataccagacccaggagggagatctcagtggttcctgacccaaatgttgaaaagctcctaagtgaaaaactgttcaaccatgggtttttggtgaacccatgaagctatgtagtgacatttcctatccaaggtccttaaaccactctatacacccactgtgatctatttaaaggagccaggtctttttagaaaacagtttctgccaagttttctatcagaggaaaatcataaagtaggtgagctacagccatgactaaaaggtagtggaaatttttctaactgaaagttgttatgcctgtcaaaaagatagactcagtaaaaacccattactgtgcagcagaggaaaaaatcatgggagctattttaaaattttttcttttatagttttttaaattacaaaagtagtgatttgttgtaccgaatcaaacaaaacaggagtgaataaagaaacattcagttatcttttctttttccttctggtcttcctctttaaaatggattcatttggaatcaatccttccacactttctctatctttatataaaccatacataacatatgcacaaaaagacatatatacacacacacatatatatacacacatatgtatatatacacacatacacacatgtatatgtattatatatacacatatatgtatatatgtgtatatatataatatatgatatataatatatatataatatattatatatattatataatatattatatattatatattatataatatatattatatataatatatattatatattatatatattatatatattatatatattatatataatatatattatatataatatataatatatatataatatatatataaatgaaatcatgcccccttcagttctctgcaccttttaagttcaggggtacatgtgcaggtttgctacgtaggtaaacttgtgccatggaggtttgttgtacagattatttcatcacccaggtgttaaacctagtacccatcagttatttttctcatcttctccctctttccaccctacaccctttgataggccccagtgtgtgttgtttccctctatgtgaccgtgtgttctcatcatttagctcctacttataagtgaaaacgtgttatttgtttttctgttcctgcattagtttactaagaataatggcctccagctccatccatgttgctgcaaaggacacgatttcattctttttttatggctgcatagtattccatggtgtatatgtactacattttctttatccaatcttccattgatgggcatttaggttgattccatgtctttgctattgtgaatagtggtgcaatgaacatgcgtatgaatgtgcctttgtgatagagtggtttatattcctttgagtgtgtacgcagtaatgggattgccgtgttgagtggtatttctgtttttaggtctttgaggaattgccacactgttttccacaatggttgaacacatttacactaccaccaacagtgtataagcatttctttttctccacaacctcaccaacatctgttattttaaaactttttattaatagccattctgactagcgtgagatggtatctcattgtgggttctgatttgcatttctctaatgatcagtgatgttgagcttttttttcatatgcttgttggccacatgtatgtcttcttttgaaaagtgtctgtttgtgtcctttgcccactttttaatggggtttgatttttgctttaaaatttgtttaatccttatagattctggatattagacctttgtcacatgcatagtttgcaaatattttcatttattctgtaggttttcctgttttttctgttgatagtttctttggctttgcagaagctccttagtttaattagatcctatgtttcaataaacaagattttcaggccaatattttgagagatgttgcttaaattcatctaaattcactttgtctatggctccacccagctcttaaataattgctaccaaactaaactgctacttggactgtgaaattttatttcctgcagtagccagctgtcagatcacaagcaactttactgaacacccacaagaattttctttgggttgtaaagtcaagcatcttagttatcatgtaagcattaatttttaatgctttaatttgaccaaaagcattgtgttgtttgtgaaaggcctcccacttcttttgctgtggaaaaaatctggagtctgagtccaagcttttttcctttcttaattagaaaagcaattttctcaccttattttctttctcctgagaaggactgaaagtgtttgactaagaaccttgtgcacctcttctttttttagttgctttttgttttattcattggctcaatccttcttaggttgctgaaaaacagctcctcaattctgaacccagtgaagggaagggcagcatcattctgggatctgtaagccttgcaatttgggaggatcagagtacttttaagatgtaggtgccctaaaataaatttctaggacaggggtactgaaccagcttcacagagcatcaccacttactagctctgcagctctgggtaagttgcttaacttctttgaccttgtcccagttattatacatgtacaatgaagacagtaatgatacctacctcaaagaattgtgtggggaataaatgaggtgaagcgtataaaggatttagggcagtgcttgctttgctattatcacattatttgtcttctgcaaccaccaccacagatggccaggcctgccctcagaagacatcttgacatagtagtcctggaactgtggcacaggcatgtgcattctaagaaatctccttggggattctgatcactatagacagtgattctcaaactttaatgtatattggaatcaccccactcttagaaattgtgctactttagttctggaagtgggggcccaagaatgtgcatcctttgggaaacactgctatagaggaatcgcatgagcacccctccttctctactgtatatatctattgtgataatcttttaagactgctgacatattgttggaatagacataccacacaggtaatgctgccaactcactttcagtgggacaaaaggcataaactacagagtgttttctttttcaatcatagtaataaattagcacagatacacatcctctatctcctgaacaaaggcatgtagttgcaaagtgactgcatggggtatagttgtatagccagtttaccatgtgggaagatcacctttgacaatagaaataataactttgaccattatcgatagccagccagcagccacaagtaactgtaggaagaagggagcaggattgcttagagtttatgttaggtattcattatgtaactggtgcttaatgggcctggtgattttttttgttttagtggaaaaatgttttatctgatttgtttgaaatatttttccattctgtcacacctgaaaagagaaaaatgagggctttgaggaattttgaaccctcatttgttcttagcccatgctgcgtatcacctgcctctctactcattgtagaaatggaacttttcattcagtaattttctagatttctatagcattttgaaaacccactaaccactaagttgtgcgtgacttaatgactgcactcccctccccgcccctccacacactcactcatttaagtttatcatctctacttcttgagccctgttccttttcaagtcaacagtaccacccctgaactttctgagcagcatgtacaaggcaggagtttctggaggtatttatcccccacttgcacattcttatgattcaagtcatatctaggatcatcccctggctgtgttggtgctaagaattgaaaatagggaaagaacattcttgaaagttcatctttttgaaacttagtagaaatctccagtcttaaacttacttctagaacttagaaaaccaaattatcttaatgcccattaagtgttgtttactctcagattttccaagtgttgcaaaaaaaaaaattgtttagaggtttggagaattaactcttgcttttaaaggatgatctgttttgaatagtataccaagcaaagtttaataaagtaagtgagattaatgaaggatagtctcctgaatataagcaaacaagttgcttgtttatacagatctctatatttcttaagtccagtggaaaacttgacttctgaataatcttcactgtggctttcacagatagcagcaaaccttgctttctcagtgcctgaatgtttgctttggggcaatcatgtttcttgaagtatgcatgcaatttgagttttaagaggtgaaaaaaagattatgtccaagacatggtttatataaatagaaaagattggttgtttagtttcttcatttttgtaatggtatgaaatatagctgtccaaccatcttgtttttggaggttgtatcagtcagggttctgactgggatagaattaatttatctatgacggaggttgcaaatttttttgtgtgaaaaatcagactttggcgatgaccttgagcagcaggatataaataactcctacaagtttagcattccaataatggaacactaggcaaaaatggattaataggctctgcatataaaggggagttcattaagcagtattaactcacatgatcacaaggtcccacaataggccatccgcaagtttagaagcaaggaagccagtccaagtcccaaagctgaagaatgtggagtctgatgttcgagggcaggaagcatccagcacaggagaaagatgtaggccgggaggctaagccagtctatccttttcacgtttttctgcctgctttatattctggctgtggtggccgctgattaggtggtgcccacccagattaagggtgagtctgcctttcccagcccactgactcaaatgttaatctttggcaacaccctcacagacacacccaggatcaatactttgcatccttcaatccaatcaagttgacactcagtattaaccatcacagtggtattgagaaaacactttgaggttaattatatatttttgcgacatgtaggcataaccttatctcttaataccatttgattttatgatgtctttttttcactttgtgacatggggaggggatttgtataattgttagtagccgatgttatgtgtaaagactcaaaaggggctaacctgacacattttgtgtcagcactttgttttgagaaagcgaaccacatgtttgccttagtaagaccctctaatttgagaccagttatcagattgaccctttgttcctagagtgaaataaaagactcagtgaaattttaacaagttagcatttgctcacttacactgaagaaggcaggaggctttagttgaaacaaattgttagcattgacaataggaagaaaagaaaattctaattaatataatagttaccctttctaccatccatagtagcctaagttgggttttttgtttgtttgttgtttgtttgagacagagtcttactctgtcgcccaggctggagtgcagtgacatgatctcagctcactgccacctctgcctcccgggttcaagtgattctcctgtcctggcctcccgagtagttgggattacaggcgtgcgccaccatgcccagctaatttttgtatttttagtagagacagggtttagccatgttggtcaggctggtcttgaactcctgacctcaggtgatccatgtgtctcgatctctcaaaatgctgggattacaggtatgagccactgtgcctggcctaagttggctctttatccttgacacacttatcagactagttttgaatattttatcacatgatttttgatgacattcttttgaaaaatcacagtttcttgaatgaatgaacctattgttcttatctagatggaacattctcaaaaagatgatgggcactctaaatcatagtctttcttcccctatctaaatagaatccaaactggtaccaacaacactcaggaaagaaacatctgcatgtgactttcttgtgtgtttttatcaaagtgcagcacctatcaagagagacaagctgtgatctgcatcttaccagtaaccagaggtgctgggctatgggtcaggaggtttgtgttctaggctggcctttgctgctgacctcctgtgtgacttatcacagatcatttttggcctcggttttctgacttgttttcaaaaagaaagattgttttagatgactacttaggtccctcacagtactaaaagcctatagtctgtacttttaatcacaatctatgagatgattcgattgtcttaatttgttcatactctcttcctttaatcccactgagtgtccttaacatacaggtaatggaacacattgacctttatttttgaagttagtcccagatcaggaaatttctcataatgccaatgatttcttagaatacaggactcttctgcatcccattaccagtaaaggtacacatacacaggcaaggaaaataagtatattcttcaggctatgggggcaagtgtctgaaattattctgatctacctagaaactatcttactttttttccttctctgctttatgagttgagagagcctggttgatctgcttcctttcgtttgactttgtaattattgttcaggcaaatataaatagtactagtattggactagtaggtagccaagaaagagaaactggaacagctatatgtgcccacctccccactccccactcccataaccaacagaaagtatagcaacaaaaaaaggaacaagcactacagtggatttccatgccccgctagcatgcatgtgtaatatactatagcctatcagatggtttccacatttgtcctagctgtaagtcacaaggcattttgatacaaataatacttgcgaataagctgtataaaatactcaccaagcaacactgaagctgtccctggaagtgacagtttgcagtcatgaatgatgaaatatcctttgtgtataaggcaattgtgttggttatagaaaaagaaatgagacttcctaggtttcttccttctgtggcttttttttttttttttggaaacaggaaagcttcctatacaatgatgttaggacctatatttcatttcatttcaactttcatttacagttgttgttgtaaagggaaaacattttaatcagtttctgcatgaaggtcagataacactgtgaacaaaagtaatttctttatgataatatcaaaacaaaagcattgctacacttaaattatgaagcatgtttcccttatctgcagtacaattgtatgacttaatagaatctgggagcgtatctcatttatgctactggtaaactcaagaaattctcttccttttaaggtctgaagttgtgatatcgcctaagaatgagaccagataatattatgtcctgggtataaattaagttactttgaaaaggcatgagaattattttaggtatttgtttgtttgtttgtttgtttgtttttgtaaactgaagcagtgttgacattttctatccttttgtggcttagaagatgccatatgattttttttaatgcccgtatatgtgtgtgtgtgtgtgtgtgtgtgtgtgtgtgtgtgtgtgtgtgtgtgttattggaggtaatgaagtggggcagaggtattcataataaagtcacttttatctggttttggagtgcaaaaagattcacatttagtagatacacacaaacacgcatatcctgaacttctgcctgtacacgtcttcttcccaacctccttctacattgtgcttatcagttgcctgcaaaggaaaatttgagactgtctactccaagatcgtggagaaattgattagagttgcaaatgcagactattgcctgaagtaccttcaggaacatggtatagagctaggtgatgtatagtgataatacaacatatgcatccacccacccacatccatactttcacattctccaatatcctttctggtccatcattttaagaagttccataaatttaggctgcagtctaaagcacaagaagagttttaacagtcgcacaggatgtcacaaaaattgtggtacttctaagaatttaatccaggagaattattccatcccattcttaaactgtaaccacaaggcatttccccagaccctcaaattcttatccatatctttatggcaccatatatgtttctagaagtaagaaacatagccggttccattttggaagtcttcttaagcattgtgacttcatattttactagtgagaatgctggggaaaagtaacatttcatctttcatgaacatttctaggattatgtagagaggaaagaatatttgaaatgttttctagccactgaaaagtactgtaacactcagacaaatcccatctcccatgatatctaaaagtgatccagagacttattacagtaattttagatggggtctctgaaccacattgatcagaaagaaagattatctagtaacataggcaaaacaaattagctgtccttaatatctagttgaaatccttaaaaaggagaattactgtctttcagtatctgcagggctgctaacattggaaattataatggtgactatatacatctttataatattatatcaccaggtccctgggctactctatcactgagcttcttaatctcctttgaccaaatagcaatttaaaagggaattggtagcattcaggcatctgctaccctgtagaaatattttaaagcattttcatcttgccttcaaggatccaatgtaatgacttaaaaaaatattttggggagaaaccattgctagaaagagcactaaacttcaacttcagaaaacctggattccatcaataagcagttgagtaaccttgagaaaatcacctagaaatttgaacttcaatttctttatctgtaaaactgagtaactaaaactaggtgagttattgtgataaccttctaattgaactgtctgcttctgggctcagccccatcccctattttgcatccctgttgtcaaaaataacatacaagtctgaccatttcatctcttccaaggactgttacaaatttctccccatccttctttcacttccagttttatttcctaccacacccatttttgttttatgctacagttataccaaaaaaattgaaattttcttagtttaacatgctgctttacctttccatgcatctgcacatgtgttattccacctgcgtggatgacccttcaacagtgtcctacactctggtattcccaataaatttcctttagtctttgaaatcccagctcagattgatgctccctagcgaagccttttctatctaccaaagaccctactgtggactatctttgtgattttttcacatttctattattgtatttatcccaaaatgttgtaacatatttatttcttatctgtcttctctttaatattttttcagccagggcttatgcctgctttcttgcctgccttccccccaacaaatacttatagaaggcttacttttgccagacagtgttgtcagcccagagggatacaacagtgaacaaagcagacaagaatacctgtcattatggagcttctgtgtcttattcaggtctgtatccctagaacctagcacagagactagcatttagtatgtaaacaagcaataattttggtttgaagccaagaaatcagaattatggttacattggaaactcccatatctttctctttcttactgcctacactatgcatttagtgttctacttgtacatacattaatatttagttataatagttaatcagtgtgtcttacttgcctaagtttctatataactttgtttccattggtgctgtctgtcaaacaccattgtctgtcaatcagcttctgggggtgctatgctctcttagttgttcagacccaacacactaaaaggggtgccctttcattcatttattcaatcaataaatatttattgaacatctactattatgtcaaataagacatatgtgctcctgcccttttagaacttacagtctattgagcaagacaagcaatgaacaagtaaataaataaatatgttattacaacatatgattgttgctatggaggtaatgaccatgaagctgtgatagagagtaatggggacagctaccaactttagagtaattgaggaaggcctctcagaagaagtgacatgtaggtcaccccaaaggatgaaaagtatccaaccatgtaaaaggttaagggacagcatcaggggacaaagggacagtaggtgcaaagctcctgaggtggcaaagagcttagtgaattggttttggggaaaagagcagtgtagctggagtttagatagtgagaagatgattaaattagagaagtagcaggtggcttcgtatggcatgttgaggcacttagagtgtatcctaatgggaatgacaaaccgtcgaatgaatgattttaagctggagagtaacaatcaaatttatgttttgaaaatcccattctgaagactgtgtagagaatggactgtgtgtgaggatgcagggacagcagtatggacctgctgcagtggtccaggagagagatggtagtcacctcaatgagtgtgaatccaggagagatgaagagaaatgtcagatttgggagacattaattagacttacaatcgtatttaatgttgaggtgggaaggggaaggagtcaaagattatgcctaggctctggcttgagctagtagctggctggaggtgctatgaactgagatagggtttatggcggggtgcaggagacaagttgggtggatagaaaatgcattttaatgatgacaaacatggtggtggcaatgatggtggtagtggtggtgatgttggatttactatagttggaggaaagatttaaaaatcttgcaattgtcaataactttctttagtgtgttggagaaagtccagtatatgtaatgtatttaaattttgcaagtcttctggatgcttgacctagaaaatatgcctttgtcctgtcctttatcccttcccaaagtgactaggattacattttctctaaatataccattaggaattaaaagatctcttacaattcaggaagctatgagaatatttaagacacaaggaatagagagagtaattcttaaaaggtaacaacttttcatttgttttcatcttgtgcaaatggtttattttctcaaagttaggtaacatttttaggccagtctctatcaaagtaatatccaaggatctcttacataaaaatcacctagggatgctggttcaaagtgaagatccttgtctacacaactaatcagaatctctagggttggggcccaggaaccttttttatttttttttttcaggctgacatttaaaaagcattgcttgagacaaggtattcttaacctttttggtgccccagtctctttggtagtctggtgaactctgtggatcccttctcagaaaactgcttaaacatgcattcaataaaatacaaggaaaacaagtatattgaaatataatgatcaaatattttaaaaacaaattttatataatattttacatacttttaattaacatattaataatgagatctaatactgggtctaatactaccataatttgaagtaataggtgaacataaatagtattttaactcatttgccacaattctaatgtgatatgaaattatctgtaatttctattagtgacaaagttacaggttcagctaaaaccactgtgatttgttgcctagattcataatggaaggaaatgctaaatttcagtcagaagtgaatgaaaataatggtataatgtttttcccatccaagttcacagataccaggcttagaatccttggctttgagattgtgaccaactagtacagagactagtgagggtatagtgaagacaaactggaatccagatgctagtcaacagaacaaaactcagggatgaagtcagtgagcctcaatatttggtattattaatttaaataattaaaagaagattcagggaccaaaaaaattgtccctgcattgtttggcttttaattggttggtttggctgttttgcctgagtgtacctggagaggcttgtctgtatactcttgttattgtccccttctcttgaaccctggctctttcagagggtagctatggagaaaagtttagattttgaccattttggggtgtttaattaagaacgttttccagaatggagagagacattcaaggatgaggaagtaacatgcgcagtaatgacagagtcaggaacaggctagtattagaaaacagaaggaagttcaaagtagctgaggcatacagtgggtgagtgagagagaggcaggagatgaagctggagagatggattagcctaagtccaaagagggccttcagacttcatgtacatgtacgagtttgggtatcatgatagagtcagcaggaagccaaaggagaactatatgctgaaaagagacatgataggccaggcatggtgtctcacgcctgcaatcctgtaatcctagcacttttggaggctgaggcaggtggattgcctgagttcaggagttcaagaccagcctgggcaacacagtgaaaccccatctctaccaaaatacaaaaaattagctggatgtggcagtgtgcacctgtagtcccagctactcaggaagctgaggcaggagaattgcttgaacctgggaggtggaggttgcagtgagccgagatcaggccactgcacgccagcctggggcaacagagtgagactccatctcttaaaaaaaaaaaaaaaaaagagagagacatgataaagtgtattatttcttaggaaaataaatctgatggcaaaatgagggatgggttagaggaaggcagaccacttttgaggctttggtaagaatgcaattgagaaaagtatggttctctgaagtaaggctatggtcatgagacagaagagggaacagctatgagagatgttaatgactgatttggatatatgccatgaagaagaagagtttgggatgactttgaagcttctagcttgagacttcaggtaaatggaagcaccattaacagaggataccaatcatgagaggcacagcaggtttttgggggaaggtttttagttccttcccctaaagaagaagaataagagtttgggatgactttgaagtttctagcttgagacttcaggcaaatggaagcaccatgaacagaggtgccaatcatgagaggcacagcaggttttttggggaaggtttttagttcagttttggataagctgagttttaagtacctattgaacatcaaatgagaaatgcatggagtttccattttaaccatttttcatagtaatcttttaatgtaggtaaatgatgtgagatattctttttgtctataaattgactgactgaaaattgtggggcagttatgtttcagaaatatgtaggattgggtattatattgtctttttattctaattttgatgaaatgtcaaccaatggctgtcctccaaagagttatagttgtatagttaattcttctggattaaagaaattcttcgtatacttatggtaattaattctagcaacatggaatatcagtaggcttgccttcttatgtctggagtttagactttttttgtgtgtgttttgtattacacattttttgttgttcttcacttggctttctatcatgactgctggaaggcagagggttgtaggtaggatgggagcaagaagcagtggaagtgtttgtgcagtcattttttgtaacagctccatggcatgaaaactactctcagcaactggtgtgaacacaaagggaaccggctagtcgcagccatctccatattcattggccttttaggttttggggcctagaatgaggggagaatttcactgtgaatgcaggatgttgaaatgcaaaattggcttttaacaaaattatgagggaagagatatttatctttgtgttccttttacctctgcctcactattctgaatccctgtacctgatgcctctgtgttaggttctggttggatcatgggccacactttagcatcttgcttagacttgttctctctaacagccattgttcctttgacctttctctttttgtgataaaatttcttgttcctatttatatttgataaattattctatatgaatatctgtggttacttacggcttaaaatatgctataccttccaagtagcaactacattttaagaggggtcctgggacaatgctttaacctagagttactctaatggtagggacagtacttatcatagttggggtccacaggtcttccctaatattttaaaaataatattgatagcatacacatgtgaaagacatttaacaaatacagaagaaaatgtcttcatttataaaggctgaggtaatagtgagtaaaagtagatataccaggcagaagtcatttgtagaagcttgactgaagtagatgagttatttttgaggatagtgatagaaatggggtgaagtgggataaggagaaattgcagattttcactgaaatgactttgagggcagggaccatgcctttatatttatgtcctccataggacctggaagaatgatctgtatatagtgtgtagtaatggttagtttaaatgaatgagcaaatccatgtggggaactattgattttaaatttttttaaataattaatttatttttttgagacagggttacccaggctgaagtgcaatggcgtgatcatggctcactctagcctccacttcctgggctcaagtgatcctcccatctcagcctcctgagtatctgagactatacgtgcatgccacatgctcagctaatttttaaatttttttgtagagacaaggtctcactatatttctgaggctgatctcgaactcctgggctcaagtgatcctcccacctcagcctttcaaagtgctgggatcacaagcatgagtcaccatgcctggttgatttttttttaaagaaaccttctgcatgtttatttttcccttaagaatatcctaaacccagatcgaatttagaaaggaaaaggaaacttttgatggatttagcacacacacacacacacacacacacacacacacacacacacacacgtaatcatttaaaaaggttggtggagatatgaaacgacttaggcaaaaatgaaaacccatttattcatcaatgaactccaggttgaagaaagttctatgactcataacaagttgtgctgacgagggagtctttaagttgtccattcatccctttgtgagatgtgagttttttttgtgtgtgttttatttggctttttaaatgttgacaagtctcaggtgtatgttaatagaaattctgtgatcataggtccattagaacagcatctgggaaggaaaactgatgctaagaaatcagcagtaagagggaataaaaatgcaaccaaaaccctttcgttgatatgcagcacaagctggttggaagcaaagggagtgatgcgatgatggaaatcctcattaaaattaaaagccatagaaagcggggaatagtatcaaaagcaatgcaacataaatcattatctacagggataaataaaatacaaaagaattagtgtttccagtttatgctttatgttgaaaataaaaatttgtttcttagaggtatctttgacatgtaacctaacaatggcaaactgccattgagagtccaggccttgttttaatgagtacctcataactgtacagaactagaagctacagagctctccagagtattagtaaatccagttttatgctatgaaaatagaaagtgaaagcacgttcactgtacctattcaaaagtaggaacaatattaatattctatttcattacagaatttcagttaacctaggttttagatatgatatgcaaaccacagagcaattttctatattgctatttttaattttttttcaactttttttttttagattaaggggatacatgtgcagatttgttacatgagtaaattgtgtgatgttgagatttgggtaaagaatgatcctgtcaccaagatactgagcatagtacccaatagtttttcaacacttgccccattccctctgccttctagtagtccccagtgtctattgctgccatcttgatatccatgcgtactcattggttagcttccaattataagtgagaacaagtggcatttggttttctgttcctgcattaatttgtttaggataatggctccagctccacccatattgctgcaaaggacatgatttcattattttttatggctgcatgatatcccgtggtgtatatgtatcacattttctttgtccagtccaccattgatgggcacttaggttgattccatgtttttgctattgtgcatagtgctgcaatgaacatgtgaattcatgtgtctttttggtagaaaaatttgttttcttttgcatatatacccagtaatgggttattagtaaataacccattatttattagtaaatccagttttatgctatgaaaatatttagatatgatatgcaaaccatggagcaattttctttttttttattatactttaagttttagggtacatgtgcacaacgtgcaggtttgttacatatgtatacatgtgccacgttggtgtgctgcacccattaactcgtcatttacattaggtatatctcctaatgctatcctccccctccccctaccccacaacaggcccccgtgtgtgatgttccccttcctgtgtccatgtgtttccattgttcaattcccacctattagtgagaacatgtggtgtttggttttttgtccttgcgatagtttgctatattgctatttttaatttttcttcaacttttgttttagattcagggggtacatgtgcaggtttgttacatgtgtaaattgtgtgatgttgagatttgggtaaagaatgatcctgtcacacagatcaccatttgacctaggtcaaatggcagttctcttttaacttctttgagaaatctccaaactgttttccacagtggctgaactaatttgcattcctaccagtagtatgtaagggttcccttttctctgcagcatcaccagcatctgttgttttttgactttttaaaatcactattctatggctattattaagccacattatgaaaaagttaagaaacaacaggttgcagagaaaacagaatgcttatacactgttggtgagaatgcaaattagttcagccattgtggaaagcagtgtggcaattctgcaaagaacttaaaacagaattaccatctgacccagcaaatacattattgggtagatccctaaaagaatataaatcattctaccataaagatacatgtgtccatatgtttgttacagcactatttataatagcaaagacatgtaatcaacctaaatacccaccaacagtagattggataaagaaaatgtggtagggatttcctggcaagatggccaaataggaacagctccggtctgcagctcccagtgagattgacacagagacgggtgatttctgcatttccaactgaggtaccccattcatctcattgggactggttggacagtggttgcagcccatggagggtgagccgaagcagggtgaggcgttgcctcacctaggaagtgcaagaggttggggaattttctcccctacccaagggaagccgtgagggactgagcctgaggaactctggcccagatactgcactcataccatggtattcacaacccgcaaaccaggagattccctctggtgcccaccccaccagggccctgggtttcaagcacaaaactggttgaccatttgggcagacaccaaagtagctgcaggagttctttttctccataccccaatggcacctggaacaccagtgagacagaatcaattactcccctggaaaagggtgctgaagccagggagccaagtggtctgactcggcgggtcccaccctcacggagcccagcaaactaagatccactggcttgaaattctcactgccagcacagcagcagtctgagatcgacccaggacattcgagcttgttcgggggaggggagtccgccattgctgaggcttgagtaggcagtattacgctcacagtgtaaacaaagccactgggaagtttgaactgggcagagcccactgcagctcagcaatgctgctgtggccagactgccagatttctctactctgggcaggcatctctgaaaaaaaggcagcagccccagtcagggacttatagataaaattcccatctccctgggacagagcacctggggaaaggggcagttgtgggcgaagcttcagcagacttaaatgcccctgcctgacagctctaaagagagcagtggacctcccagcacagtgttcaagctctgataagggtcagactacctcctcaagtggatccctgaaccgcatgtatcatgactggaagacacctcccagatggggcagacagacacctcatacaggagagctctggctgacatctggcaggtgaccctctgggaggaagcttccagaggaaagatcaggcagcaatctttgctgttctgcagcctccactggtgatacccaggaaaacaggattgggagtggacctccagcaaactccagcagaccggcagcagaggggtctgtcagaaggaaaactaacagaaaggaatagcacgtccactcaaagaccccatcttaaggtcaccaacatcaaagaccaaaggtagataaatccacaaagatggggagaaaccagtgcaaaatggctgaaaattccaaaaaccagaacgcctcttctcctccaaaggatcacaactcctcaccagcaagagaacaaaactggacagagaatgagtttgatgaattgacagaagtaggcttcagaagatgggtaataacaaacttctccaagctaaaggagcatgttctaacccaatgcaaggaagttaagaaccttgaaaaaaggttagaggaatggctaactagaataaccagtgtagagaataacacaaatgacctgatggagctgaaaaacacagcaagagaacttcgtgaaacatacacaagcttcaatagctgattcgatcaagcggaagaaaggatatcagtgattgaagatcaacctaatgaaataaagagaaaagacaaggttagagaaaaaagaatgaaaaggaatgagcaaagcatccaaataaatatgggactatgtgaaaagaccaaatctacatatgattggtatacctggaagtgatgaggagaatggaatgaagttggaaaatactcttcaggatactatccaggagaacttccccaacctagcaagacagaccaacattcaaattcaggatatacagagaacaccacaaagatactccttgagaagagcaaccccaagacacataatcatcagattcaccaaggttgaaatgagggaaagaatgttaagggcagccagagagaaaggtctggttacccacaaagggaagcccatcagactaacagcagattgctctgcagaaaccctacaagccagaagagagtgggggccaatattcaacattcttaaagaaaataaatttcaacccagaatttcatatgcagccaaactgagcttcataaatgaaggagaaataaagtccgttacagacaagcaaatgctgagagatttcatcaccaccaggcctgccttacaagagctcctgaaggaagcactaaacatggaaaagaacaaccagtaccagccactgcaaaaacataccaaattgtaaagaccatcaacactatgaagaaactgcatcaactaatggtcaaaacaaccagctagtatcataattacaggatcaaattcacacataaccatatttaccataaatgtaaatgggctaagtgctccagttaaaagacacagactggcatattggataaagagtcaagacccatcagtgtgctgtattcagaagacccatctcatgtgcaaagacacacataggctcaaaataaagggatggaggaatatttactgaggaaatgcatagcaaaaaaaaaaaaaaaaaaaaaagcaggagctgcaatcctagtctctgataaaacagactttaaacctacaaagatcaaaagagacaaagaaggccattacataatggtaaagggatcaatgcagcaaaataactaactatcctatatatacatgcacctaatacaggagcacccagattcatgaagcaagttcttagagaattacaaagagacttagacccacacaataataatgggagtctttaacaccccactgtcaatattagacagatcaaagagacagaaaattaacaaggatatacaggacttgaactcagctctggaccaagcagacctaatagacatctacagaactctccaccccaaatcaacagaatatacattcttctcagcaccacatcacacttattcaaaaactgactgcataattggaagtaaaacactcctaagcaaatgtaaaagaacagaaatcataacaaagtgtctctcagaccacagtgcaatcaaattagaactcaagattaagaaactcactcaaaaccacacaactatatgaaaactgaacaacgtgctcctgaatgactactgggtaaataatgaaatgaagggagaaataaagatgttctgtgagacaaatgagaacaaagacacaatgtaccagaatctctgggacacatttaaagaagtgtgtagagagaaatttatggcactaaatgtccacaagagaaatcaggaaagatctaaaattgacaccctaaaatcacaattaaaagaactagagaagcaagaacaaacaaattcaaaagctagcagaagacaagaaataactaagatcagagtggaactgaaggagatatagacatgaaaaacccttcaaaacatccatgaatccaggagctggttctgtgaaaagatcaacaaaatagatagactgctagccagactaataaagaagaaaagagagaagaatcaaatagatgcaataaagagtgatataggggatatcaccaatgttcccacagaaatgcaaactaccattagagaatactataaacacctctatgcaaataaaatagaaaatctagaagaaatggataaattcctggacacatacacccttccaaatctaaaccaggaagaagtcaaatccctgaatagatgaataacaaattctgaaattgaggcagcaattaatagcctaccaaccaaaaaaagcccaggaccagatggattcacagccaaattctaccagaggtacaaaaggaagctgataccattccttctgaaactattccaatcaatagaaaaagagggagtcctccctaactcatttgatgaggccagcatcatcctgataccaaaacctggcagagacaacaataaaaaaagaaaatttcaggccaatatccctgatgaacatcgatgtgaaaatcctcaataaaatactggcaaaccaaatccagcagcacatcaaaaagcttatccaacatgttcaagtgggcttcattcctgggatgcaagtctggttcaacatatgcaaatcaataaacataatccatcacataaatagaaccaatgacaaaaccacatgattatatcaatagatgcagaaaaggccttcaacaaaattcaacaccccttcatgctaaaaactctcaataaatgaggtatcagtggaacatatcacaaaataataagagctatttatgacaaacccacagccaataccatactgaatgggcaaaaagtggaagcattccctttgaaaaccagcacaagacaaggatgccctctctcaccactcttattcaacatagtactggaagttctggccagggcaatcaggcaagagaaagaaataaaagtattcaaataggaagggaggaattcaaattgtctctgtttacagatgacatgattgtatatttagaaaaccccatcgtctcagcccaaaatctccttaagctgataagcaacttcagcaaagtctcaggatacaaaaatcacaagtattcctatacaccgataacagagagtcacatcatgagtgaactcccattcacaattcctacaaagagaataaaatacctaggaatccaacttacaagggatgtgaaggacctctttaaggagaactacaaaccactgctcaatgaaataaaagaggaaacaaacaaatggaaaaacattccatactcattgctacccccatcaagctaccactgactttcttaatagaattggaaaaaaactactttaaatttcatatggaaccaaaaaagagcccgcatagccaagacaatcctgggcaagaagaataaagttggaggcatcactctacctgacttcaaactatactacaaagctaccataatcaaaacagcatggtgctggtaccaaaacagacctatagaccaatggaacagaacagaggcctcgggaacaacaccacacatctacaaccatctgatctttgacaaacctgacacaaaccagcaatggggaaaatattccctatttaataaatggtgttgggaaaactggctagccagacacagaaaactgaaactggaccccttccttacaccttatgcaaaaatcaactcaagatgggttaaagacttaaatgtaagaaccaggaccataaaaatcctcgaagaaaacctgggcagtaccattcaggacataggcatgcacaaagacttcatgtctaaaacaccaaaagtaatggcaacaaaagccaaaattgacgtgggatctgattaaattaaagagcttctgcacagcaaaataaattgtcattagagtgaataggcaacctagagaatgggagcaaaattttgcaatctatacatctgaaaaacgctaatatccagaatctacaaagaatttaaacaaatttacaagaataaaacaaccccatcaaaaagtcggcaaagaatatgaacatacacttctctaaagaagacatttatgcagccaacaaacatacgaaaaaatgctcatcatcactggtcatcagagaaatgcaaatcaaaaccacagtgagataccatctcacgccagttaggcaatcatcaaaaagtcaggaaaaaaaagatgctggagaggatgtggagaaatagggatgcttttacactgttggtgggagtgtaaattagttcaaccattgtggaagacagtgtggaaattcctcaaggatctagaactagaaataccatttgacccagcaatcccattactgggtatacacccaaacgattataaatcatgctagtatacagacacatgcacacgtatgtttattgtggcacagttcacaatagcaaagacttgtaaccaacccaaatgtccatcaatgatagactggataaagaaaatgtggcacatatacaccatggaatactatgcagccataaaaaaggatgagttcatgtcctttgcagggacattgatgaagcagaaaaccatcattctcagcaaactatcgcaaggacagaaaaccaaacaccacatgttttcactcgtaagtgggagttgaacaatgagaacacatggacacgtggaggggaacatcacacactgggccagtcagggggtggggggctgtgggagggatagcattagcagaaatacctaatgtaagtcatgggttgatggttgcagcaaaccaccatggcatgtctatacctatgtaacaaaactgcacgttgtgtctgcttggtccagagctgagttcaagtcctggaatcccttgttaactttctgtctcgttgatctgtctaatgttgacaatggggtgttaaagtttcccattattattgtgtgggagtctaagtctctttgtagttctctaagaacttactttatgaatctgggtgctcctgtattgggtgcatatatatttaggatagttagctcttgttgttgaattgatccctttaccattatgtaatgaacttctttgtctcttttgatctttgttgttttaaagtctgtttttttagagactaggattgcaacccctgcttttttttttttttttttttttgctttccatttacttggtagatcttccctccatccctttattttgagcctgtgtgtatctttgcacatgagatgggtctcctgaatacagcacactgatgggtcttgactctttatccaatttgccagtctgtgtctttcaattggggcatttagcccatttacatttaaggttgatattgttatgtgtgtgaatttggtcctgtcattatgatgctagctggttgttttgcctgttagttgatgcagtttcttcattgcatctatggtctttacaatttggcatgtttttgcagtggctggtaccggttgttcctttccatgtttagtgcttccttcaggagctcttgtaaggcaggcctggtggtgatgaaatctctcagcatttgcttgtctgtaacggattttatttctccttcacttatgaagcttagtttggctggatatgaaattctaggttgaaaattctttcctttaagaatgttgaatattggcccccactctcttctggcttgcagggtttctgcagagtgatctgctgttagtctgatgggcttccctttgtgggtaactcgacctttctctctggctgcccttaacatttttttccttcatttcaaccttggtgaatctgatgattatgtgtcttggggttgctcttcttgaggagaacgtttgtggtgttctctgtatatcctgaatttgaatgttggtctgtcttgctaggttgggaaagttctagataatatcttgaagagtgttttctaactggttccattctcctcatcacttccaggtacaccaatcaaatgtagatttggtctcttcacatagtcccatattttttggatgctttgctcattgcttttcattcttttttctccaaccttgtcttctctctttatttcattaagttgatcttcaattactgatatccttttttccgcttgatcgaatcagcttttgaagcttgtacatgcttcacgaagttctcatgctgtgtttttcagccccatcaggtcatttgtgttattctctacactggttattctagttagccattcctctaaccttttttcaaggttttagcttccttgccatgggttagaacatgctcctttagcttggagaagtttgttattacccaccttctgaagcctacttctgtcaactcatcaaactcattctccgtccagttttgttcccttgctggagaggagttgtgatcctttggaggagaagaggcattctgttttttggaattttcagccattttgtgctggtttctccccatctttgtggatttatctacctttggtgtttgatgttggtgacctacggatggagttttgttgtggatgtcctttgtgttgatgttgattttattcatttttgtttgttagttttctttcttttttcttttttttaggtattgatgggacgtatctcaaaataataagagctatctatgacaaacccacagccaatatcatactgaatgggcaaaaactggaagcattccctttgaaaatgggcacaagaccgggatgccctctctcaccactcctattcaacatagtgttggaagttctggccagggtaatcaggcaggagaaggaaataaagggtattcaattaggagaagaggaagtcaaattgtccctgtttgcagatgacatgattgtatatctagaaaaccccattgtctcagcccaaaatctccttaagctgataagcaacttcagcaaagtctcaggatacaaaatcaatgtgcaaaaatcacaagcattcttatacactaataataggcagacagccaaatcatgagtgaactcctattcacaattgcttcaaagagaataaaatacttaggaatccaacttacaaaggatgtgaaggacctcttgaaggagaactacaaaccactgctcaatgaaataaaagaggacacaaacaaatggaagaacattccatgctcatgggcaggaagaatcaatatcttgaaaatggccatactgcccaaggtaatttatagattcaatgcgatccccatcaagctaccaatgactttcttcacagaattggagaaaactactttaaatttcatatggaaccaaaaaagagcccgcatcgccaagtcaatcctaagccaaaagaacaaagatggaggcatcacgctacctaacttcaaactatactacaagactacagttttctttctaacaggcccctcagcagcaggtctgttggagtttgctggaggtccactccagaccctgtttgcctcagtatcaccaatggaggctgtagaacagcaaatattgctgcctgatccttcctctggaagctttgtcctagaggggcaccttccagatgccagccagagctctcctgtatggggtgtctgtcagtccctactgggaggtatctctaagtcagggtatacggggttcaggcacccacttgaggaggcagtctgtccattatcagagcttgaacactatgctgggagaaacattgctctcttcagagctgtcaggctgggatgtttaagtcttcagaagctgtgcccacagagcaccttcccccaggtgctctgtcccagggagatgagggttttgtctacaagtccctgattggggctgctgccttttgttcagatatgcccttcccacagaggtggactctagaggcagttggccttgctgagctgtggtgggctcttccctgcttgaacttcctggcagctttctttacactgcaagcataaaaccgcctactcaagcctcagcagtggtggacgcccctcccgtctccaagctccagcatcccaggttgatttcagactgctgcactagcagcaagaatttcaagccgggcacggtggctcacacctgtaatctcagcactttgggaggctgaggcggacagatcacaaggtcaggagatccagaccatcctggctaacacggtgaaaccccgtctctactaaaaatacaaaaaattagccaggcatgatggcaggcgcctgtagtcccagctaatcgggaggctgaggcaggagaatggcgtgaacccaggaggtggagcttgcagtgagccaagatcgcgccactgcactccagcctgggcgacagagcgagactccatctcaaaaaaaaaaaaaaaaaaaaaaaaagaatttcaagccaatggatcttagcttgctggggttcatgggcatgggacccattgagccaggcaccagagggaatctcctgggatgcagaccattttaaaatgtttcttggccacttgtatgtcttatgagaaggatcttttcatgtctttgcccagtttttaatgaggttgtttgttttttgattgttcatttgtttaagttgcttatagattctggatattgaaccttcattgggtgtatagtttacaaatattttctcccaataggtaggtcgtctgtttattctgttgataggttcttgctgtgcagaagctgtttagtttaattcagtcccacttgtcaatttttgtttttgtcgaaattgcttttgaggacttagtcataaattctttcccaaagccaatgtccagagtggtgttgcctaggttttctttcaggattcctataatctcaggtcttatatttcaatctttaatctaaagttaatttttgtatatgatgaaagataggggtccagtttcattcttctgcatatggatagccacttatcccagcacaatttattgaatagggagtcctttccccattgtttatttttgttcactttgtcaaagatcagatttggtgcgcagccttatttctacgttctgtattctgttccattggtttatgggtctgtttttgtaccagtaccatgctgttttggttgctatagccttatagtacagtttgaagccaggtcatgtgatgcctccagctttctttttgtttaggattgctttgggtagtcaatctcttttttgtttccatttgaatttttgaatagtttttttttctagttctgtgaaaaatgacattggtagtttgataggaatagcattgaatctgtagattgctttaggcagtatggctattttaatgatattgattcttccaatcaatgagcatggaatggttttccatttgtttgtatctataatttatttcatcggtgttttatagctgtcctagagatctttctcctccatggttagctgtattcactggtattttaattttttttgtggctactgtaaatgagattaccttcttgatttgtctctcagcttgaatgatatttgtgtatagaaatgctacttatttttgtatattaatttagtcttctgaaattttactgaagtcatctatcagttccacgaatattttgacagagtctttagggttttctaggtatagaattatatcatccatgaagggaaatagtttgacaccttcttttccaagctggatgtcttttatatctttctcttgtctgattgatatggctaggactataatgaatgggagaggtaagagtgggcatctgtgtcttattccagttgtcaaggggaatgcttccagtttttgtcctttcagtataatgttggctgtgggtttgtcataggtggctcttattattttgaggtatgttcctttggtgcctagttattgagggtttttaacatcatgagtagatgttgaattttattgaaaactttttctgtgtttattgagatgatcatatggtttttgtttttaattctgtttatctggtgaattatgtttattgatttgcatatgttgaaccaaccttccatcccaggaatgaagcctacttgatcatggtgaattaacttattgatgtgctgttggatttggtttgctagtatgttgttgaggatatttgagtcaaagttcatcagggatacttgtctgtagttttttgttgttgttgttgtgcctttgccagattttgggatcagaatgatgctggctttgtagaatgagttatgggggattcctccctcctctatgttttggaaccatttcagtagaatttgtatccaccgtgatttgtatgcctggcagaatttggatgtaaatccatcaggtccagggcatgtttttttttttttttttttttggttggtaggtttttattttgattactaactcaatttcagaactcgctattggtctgttcagagtttcaatttcttcctgattcaatcttgggagagtgtgtgtttccaggaatttatcagttttctctagattttctagtttgtgtgcatagaggtttttcataatagcctctaattatcttttatatttttatgggttggttgtaattttacctttgttgtttctgattttgcttatttggaccttctctcttttttcctttgctaatctagctagcaggctattgatcttgtttatcctttcaaagaaacagacttttggttttgttgattcttcatatggatttttacatctcaatttccttcagttcgtctctggttttacttattttctgctagctttggcggtaatttgttattgtttttctagttcctctgggtatgatgttagatcattaatttgagttctttctaactttttgaggtaggtgtcttctatgtaattatgtggttttatgagatcttcttgatattaatttccatttgtatttcattgtattccaagagtatgattttattttttgaagttattgagacttgctttatggccaagcatgtggtcaatcttggagtatgttctgagtgcatatgagaagaatgtatattctgaggttgatgggtggaatattctgtagatgcctatgaggtccaactgatcaaatgttgagttcaagtccaggatttctttgttagttttctgccttgatgatctgtctagtggtgtcagtggggtgttgaagttccacactattattgtgtggctaagtcttttgtaggtttagaagtacttgttttatgaatttgggtgctctaatgttgggtgtgtacatatttaggatattttagtcttcttgttgaattgaaccctttatcaatactgttgttggtttaaattctgttttatctgacataagaatcatgacccctgctcttttttggtttccatttgtctgatagatctttctctaatcctttatgggtgtcattacatttatatgtgagatgggtctcttaagacagcaatggatttctctcattttttaatccacttaccactctgggccttttagatggggcatttaggccatttgcattcaagattaatattgatataggaggttttgatcatatcatgaagtttttagctggttgttttgtagtttgtattgtgtggttgctttatagggtctgtgggctatgtactcaagtgtgtctttgtcgtagtaggtatcattcttttgtttccatgtttagaaatcccttaaggatctcttttaagactggtctagtggtaaaaaaatttcccttagcacttacttgtctggaaaatattttaattttaattttaagttctgaggtacatgtacaggatgtgtaggtttgttacataggtaaacatgtgccatggtgttttgctgcacctatcaacccatcacctaggtattaagcctagcatgcattagctatttttcctaatactctccctcccccaaccccaccccccaacaggccccagtgtgtgttgttcccctctctgtgtccacgtgttctcattgttcagctcccacttataagtgagaacatgaagtgtttagttttctgttcctgaattagtttgctgacagtaatggcttccagctccatccatgtccctgcagaggacatgatctcattccttttgatggctgcatattattccatggtgtacattaccacattttctttatccagtctatcattgatgtgcatttaggttgattccatgtatttgctattgtgaatagtgctgcaatgaacaattgtgtgcatatatctttgtaatagaatgatttatattcctttgggtatatacccagtaataagactgctgggtcaaatggtatttctggttctagatctttgagaaatcaccacaccatcttccacaatggttgaattaatttacattcccacaaatggcataaaagtgttcttatttctctgcaacctcaccagcatctgttgtttcttgactttttaatgatcaccattctgagtggcatgggatggtatctcattgtggttttgatttgcatttctctaatgatcagtgatgttgagctttttttcatatgtttgttggccacatgaatgtcttcttttgagaaatgtctgttcaggtcctttgcctacttttaatggggttgcttttttaaaaaaatttgtttaagttccttgtagattctggatactagacctttgtcaaatggatagattgcaaaaattttctccgctctgtatgttccctgttcactctgatgatagttgtttttctgttgttgttttgttttgttttgtttttgctgtgcagaatctctttagtttaattatgaaactgcctttgcaacattatgatggagacagtgaaatagatctaacttaatcaactccatgttgcttctaacctccaagctgtccttgttcattcatgggtataggctgaattaactttgggagaagcttacttcatagtttatagtttaatatgaagacaataacagccctttcccaaagcagacctccttcatgcctgggaattagattgcctttgtaggactaacattagccacaagattagaaattatggtttgaaagtcatgcggctggaggctacaagtttctgacccttcctaaactgctcctaagatcagtgcttgaaatattttgcagaccctgcacttgatggatcagctggcactacccaggttgataagttgtctcatctaatcatctaatcttgtggcccccacccaggtactgactcagtacaggaagatagcttcgactccctgtgatttcatttctgaccaatcaatgcttctggctcactggcttccctcaaaccaccaagttgtccttaaaaactctcctccctgaatgctcggagacactgatttgagtaataaaactctggtgtcccgcacagccggctctgcgtgaattaccctttccctattgcagttcccctgtcttgagaaatcagctatgtctagtcggtgggaaaggtgaacccattgggtggatataattagatacaatttgtcaaattttgtttttgttgcaattacttttggtgatttcatcatgaaatctttgcctatgccaatgtcctgaatggtattgcctagattcccttctagggtttttatagtttggggttttacatttaagtctttaatccatcttgagttaacttgaagcttaggttggtgggatatgaaattcttggttggaatttcttttctttaagaatgttgaaaataggcccagaatctctcttggcttttaaggcttctgctgagaagtctgttgttagcctgatggggttccctttgcaagtgacctgtctcttctctagccatctttaagattttttctttagcattgactttggatagtctggtgactgcatgccttggtgatgtttcttttgtatagaatcttccaggtgttctttggatttcttctatctggatgtctatctctagcacgattagggaaattttcttgaattattccctcaaatatgttttccaggctgtttactttttcttccctctcaggaatgccaataatttgtaagttacatcactttagataatcccatattccttgaagactttgttcttgtatttattttatttttgtctgggttagtttgaaagaccatcttcaagctctgaaattttttattctgcttggttcaatctgttgataaagatttcagttatattctgaagttccttaactgagtttttcaatttcagaagctctgattgatttctttttaaaatgtttatctcttccttcatttcctggattgatttagaagtgtcttcgtgttgattttcaaccttgtcttgggtctcagtgagcttccttacaatccattctttgacttctttatctgtcatttctgagtttccactttggttagggaccatttctggagagctagtgtgatcctttgatcatgtcactacattcagattttttatggtgccagaattcttgcactgtttctgtctcatctggagacactggcacttctaattttttaattattttcatgcaggtaggatttcttcttattttttccctgtaatattattgtttttcttttcctttcccttccctgcagggggtacaactgtagagaatgctgggtaggatattttggcttcactttcatagccctatgcacttttggggggcaggttttatattgggctgtgtagtttgacctataaggtagttgatggtacttacaggtaagagctggctgtggccaatgcagtggggtatgtacttgatccttgttcactggcacaggctctctgttgcctcaggcaatgggttgactcatggaatgcacagtggtctgagctccctgctcaggccggggacagggaagcccaatgggtggggccagaccaggcaggtccacttacaggttctctgatggcaggcataagcactgagggtgaatctagtgggtggccaccagacacccagaggtgtgcctacgtatggagctgagaaacctccttagccccaggttctttgcacagggatggtgggtagctcatgctcctattccagaggaatgggtgctccagatacctggagatctacctgagtgtggagcagagggacccctgcaccaatatttctgcaaaggaggggtgggggtgactcaggctgctaaaccaggaatgcaggtgctctaaatgcctggagctctgcctgggtgtgtagcagagagggcccttctgtaccaggttctctgcacaggaagtgtgtggtgactcaggctgctgatccaagcaagctggttctctgaatgcctggagttctgcctggacatggagtgcagggggccttgctataccaggatctatgcccatgaagggtcaggaagctcaggctgttggtccaggcaagtgggtggtccaaatgtctggatttctgcttaggggtataccagagagtgcccttgagtgatacaccatctcaagggggaaagctggagcacccagcaatggcacacacagactggtttccagtcatcaagctggccttggctgcaagtgtcactgtccaggagaaactgcagctgtagcagctctcctcctgcctgaggcttgcaatggaggagagcagaattccagtgcctacttctgaaaccctttccacagttctggctgtggatgtccttatcccagtccagggcaggcactctagaggtctggtctgagacggcaatgcctgtgtggtcatgctgccaggttgccacagaatggctgactttgtatgtgcccagattaaaaatgatatcctgctctcagtcccacatctgggaaaatgcctgcaacttttcctggtgtctttcccttgcagagtctctaagcctctcctcaacttacctccaggtcttgggagaaacaaagtgttctcccttggtcttggttgctcagattcccagtggaaaggtaagtcacagagggaggctctctgcttctctcacatgctggagcttcactcacttaatagctaaatgctgtcacgggggctgtttgccagtgttctccacaggaccagggatatctttcatgattctagtggattcccattttcctccttgaattaaactgcacagagtttatatttatgcactgtcttgctacttccgagtggctgaggcatgctaaaagcccctaatccaccatcttggaaaatgaaactgtattgctactgaagacgtgggatgtccaatatggcattgcaaataagcatatatctatagaccaacatttatgtatataatactgtgttaaatactacagggaaaatattaaaaaataagcaaagatagacattgaagaaatatttacaagcatgctgagtgttatcatggagaagtacaggtgcaatggaaatgttaaagtgagggatcttgtcaactctgcaaatcagaggaaacgctctggaggaattgtctacttaaatgagacttaatagatgagaatgttaaccaggtgaggaagtactagcattctagggagagaggaagcatgtatggggccctggagatgagagagaaaatggcatattctaggaaccttaaaaagcgcagtatggctgaagagtaggaaaccattaggagtttggctggaagtaagattggagagtaagttagaagtcacattgtgagggacaatgggaaactataaaaggttttaagaacagaaaatgaccggtgagaagtgcattaaaagatgtggtgtaattgggcacagtgtacactgctcaggtaacaggtgcaccaaaatctcagacacccccactatagaacttctccatgtaaccaaaaaccacctgttcccccaaaactattgaaatacaatttttttttttttaaagagatggtggctgggcgtggtggctcacgcctgtaatcccagcactttgggaggccgaggcgggcggatcacagggtcaggagatcgagaccatcctggctgacatggtgaaaacccgtctctactaaaaaatacaaaagattagcggggcatggtggcgggtgcctgtagtcccagctactcgggaggctgaggcaggagaatggtgtgagcctgggaggcagagcttgcagtgagccgagttcgcaccactgcattccagcctgggtgacagagcgagagtctgtctcaaaaaaaaaaaaaaaaaaaaaaaaaaaaaaagagatggtatactcttgggtgaggccatcttggaagacagtaataggtagttggttattttttgttagtcagtttagtacccatacttggctcttggactgtgcttattagaccttgatatggagtagtccatttgtgttccatgaaacttttgaaaccagctgattgtcaaatgtcaagcatctcaagagattctgcctgggttggctttatggttccatttatatgtatgttctatataatatataaattctataatttatataataatataatatataaattctataatttatataataatataatataataacatatacattctataattctagtacctactgctgacatgtaatattatatagatataactgctgatctgtaatatatataattcctgacatgtattatatattacaatgtaatatatattagatgtaacatatattacatctcataatgtatacctctcatacattatatatatattacaaggtctaattagagaagtctaactagagaaatcacatcaaggtctaattagagaagtatgtacatctcagcagttatatatatatataatattacatctagaattatattacaatagaatatacatatatatgtgtgcatatatataatattacatctcagcagtaggcattaaaattctgctctcccccattgcaagcctggggtaggaggagagctggcatccaggaccagcttggtgacctgcatccagtctgtgtgccattgctgggtgctgcagcctgctcccctgagaaagtggtgcagcagggtgctctctctgccgtacccccagggtgctctctctgccatacccccaagcagaaatccaggcatttggagcacccacttgcctagaccagcagcctgagctgccccacccattatggacataggtcctggtacaacagggccctctccactccacacccagactgaggccgatctccagtttatatatgtattaggagatgttggtaatgatttggagtggttattagccaatcaggagacaaattgataatttttttctcccaaaatagaagaaagacaggagagaaatgaagagagaggaaaggtagagctatataacccagtagcaagatggactatgaacagtactcagtagctttctcatatgctgtcaatggatggagtgtggttcaggaggtttggattcagttatattattttcatatgacttaccattttaacttccttagggaatcacttaaattagtcatgccttagttcttttcatgtaaagacattctggctcagaaccaaccattgtgcagtttcacttgatgaaatcatgtcatttagagcatcttgaactccagagagaggtatctcatgcgagaagtttttattacaattgttatcttctgcttgtttgcacctcagttccttagaaaagaaacacattttgaagaaattcctttaataaggacttggcaatgtaggcagactgccttgtgatattcacacttttctaactgcaatattgagtgtgtgtctttgatgggtctcttatggcaggtgtactgactttttttcccctcctggtgtcggtgtaatatttttacagaacggcagagggtatatgaatagatcctgatgtaaggtgtgaacaaggaagaaagatgtttgctctggctttggcttatcttctagcaaagttgcctagaatgtggttgtaaatgactgtcatgtagtaaactctgcctaccttccctgtctcttctctaagctaaaataactagcactgttttgttcatttatgcaaacttgtgctttttttttttaatatgtagagagatgatgctaagtcatcagcagcattgtggctctgacttgtttttactagtagatgggttgcatctgagcttttcacttgccttacttcactgaggaccaatatagtgtctctgggggacaatggtcaaggtgaggcttttcgtctgtggctgtgatatagagtgagtctcattggcttacacaggatataactgcaattttgacctcagtgctatgctcaatttagttgagtgaggttgcttatggggtaccaatgaatcccagagggcagaactcactctcaaaaatgtaacttgtctattagtcagtggacaaacatataactgaagagtatgcagatgtttcccattgaaatgagaaaataaattttaataacttttttttgtatcttttaaggaagagcctggaattctccattcagttgccacccatagtgtgtctcattgttttctgttattgtaggtttctaggtcagatgctgatcacgaaattatttgtcataaccttctgtttgaaactgaagcatttttttttaaaaaaagttttgtctcataatgtctagaaactgcctttacattataaagttgcttgtatttatccacagcctggaataatctattgatggtattttacttctaaacagtaagaaagatatgctgtaatctgttgggaagactgtattctttgtacttatctaggttaaaggaaacagtagtagcttgacctctagatatttggcttcatatgccttggctgcttggtagaagtcatcccatattgaatatacattgtttccaaaggacatttctgcttctggagtagctccaaacacacactgctatgcttataaaacagggctgagggaagtagtttgctggaaccagtttgctcttgctagttaagagtcgattgtgtacatttcttttcaacactgtgttgaatgacataacattggtagattgaaacaggtcatgatgggagtattcacaccacaggaataggcaaaggctacccatcaggggtccctctccccttggagagtcagttgttgaatacttaacaacacaccactggttggaggttgttatcccagccattgaggcctaccccagagtagacttgacatattccattttattcctggaattgggactgactcaggcctccccaggttttgggggaactattctaaaggaataagccaattcaaatccacacttttgaaactgggtgagaaagagccaagtcatctgaaggatgaaggtccagaatggggctgaattaccattcagtttatcgcattcagagcaatgttgtctaacagactgattccaggtgctagccatttactgtaaataagaaatatgaactattttgtcactggaacaatttaccaaacaagtaccttcctgtcaattcatggtaaagtaatgagagaaacaagagaagtcctcaacttgagtatactttgtaagtggtttagcttcctggcaggcactgatgtatttcatgtgtatccatctcatccctgcagattctcttagcttaatgattgtcaaaacactgtaaatagtcggtgatattgaagatggcaatttccataaactatttattctttctttttgacaaaaaatgacttcctatttttttaagaatgcctcaaacacctgggttttggtgctttcatttttagaatgaacattcctcctacttggcagttaatattttcgactttcagaacacttttggaatacggcttgactttaaaacttttaccattaaaatatttacaacgcatgtaataggtatagggatactttcattacaaatcattaaaaaaaatctgaacacctgaatgaaaacttggacaaaagatatgagcaaagctatctacagaaaaaaggaaatacaagtagtcaataaatatatgaaaagatgatctatctaattcatattgaaaatgtaaatgcaaatgaaaacaccatatcaatgttggttgagaatatgaagtaaataagccatctcatatactattggtgggagtatacattggtattaggtttattggagaaaataaggcaatattttcaaaaggtaagatgcatttagttttgggcccactgtccttacttccagaatttatcttacaaaaatatttgtgtatgaacattacatatacatatacatacacatggctattcattataaaattgttttaatagcataaaaactgagaagtatccatcattagggatgatctaactaattagttaaattaatatggaaacaccaggcagtggtgtactttgtattcactagaaagtatgaggtagatctacttacactagcatagaaagatgttcactaaatatagatggcacttggtgaaaaaaatattgtccaataatatgtcttgtattacctcactttcatttaaaaattatatatcactcttcactatatatacttctgtagaattgaatatttgaaaataagcaggcattactcttgtgtttaaaatctattggaaaatacttttgtttttatactgttctgtaagcttgttctcctctattaacaacatactttgaacttatccctccctcactcttcccaactgacgtgcaacatcataccccatggataagccatcctccatccatccatgcatccatccacatattcatctatccacatacctgtgcaccaaattatttcttacttacttatttaaacaatttctttttccagttatagaagcaatgcttacccttggccaaaacaaaacaaaaaatgaacaagcaaaaacaataacaaaatggtacagttagagaagggtacataaaaaaatacagcttggactcattctccagaggcaaccactttaagagtttttgttctagtggttacttttttgccattaaataatgtacttattataataatgtaagtatttatatcaacattatattataatattagtaatatgcttatatctccatttgttgtcttctttttcttcttctcttctctgctctcttctcctttccttgtctatctgtgtcaggctcagaagaaagccataatcaggatatctctaaccctggcatagttcatgccttgggatatttgaccaagatgggaagaaccagagaggaaaatggatataatcatagaggggtggaccagtaaagaaatgtggcccctcgtctgtgccagttccttacctgaaaccagagaaggctagattgcagttggtgttttagctgtggataaaactttaacccagagttcctgggactcttaatggtatgacgaaatggagaaaaacatggcttttgagtccaaaagactggattttgaatccccactctaccactttctagctgtataatcttcaggcaacttgtttaactcctttgggctctagcatccttatctgtaaactgacagtattttactcaatattatactgtggaagttagatgatgataataactagcatttgcttattactatgcatcagatatgattctaagtgctagattgggtctctgattacaatgtatatctccttctcatgcttactataattatgattaaataatttattgtttaatgtgtgtctctcccaatgaatgttagtttcatgagggcaaggatcatgtctgtcttcctcacagtactgtatttttagtacctgctaagtatatatattgattctcagtatttattgactaaattaagagatatctgggttgtgactgtctcatgcgtgtgtgtgtgtgcgtgtgtgtgtgtgtgtgtttgtgcgtgtcagacttttatgaccctgaggcataattcggtatttgacttcaaagtgagatgaccagatggtttgttttttattttaccaatgtcctaacagtcctttggtagccccaaataaatatgaaatatagagttgaaaatatttgggattaataattccttataaaaataattctgcattgatggtcaccaagtagtaatacatgcccagaacttggctgttttattaaagtttatttaaggaatagggaaatttggtaggaaatacagatcagtgtgctcaataaaaaatcctgccaacttttctatctgtaaagtgtatctttaggctataactcataaaaaaaaaagtaatgttttaattgcagatgacatatcagtttctaccagtttgttgttatataggtaatgcaattgattaagctcaattggaccagatcattcttttactgaatctttgttccaattgtagtgttttgtagataacttttttttttttttgagacagagtctcactctgtctcccaggctggagtgcagtggtacaatctcagttctgtagcctctgcctcccaggttcaagcagttctcctgcctcagcctcctgagtagctgagactacaggcacgcaccaacacacccggttaatttttgtatttttagtagagacgtggtttcaccattttggccaggatggtctccatctcctgacctcatgatccgcccgcctcggccttctaaagtgctgggattacaggcatgagccaccaggatatctttgctcaactgggttggacagtcgagaactgattttaattttattgagggaagcattggcttgaatttgtctctttaaaacatcaatctcattgttcaattcccacctatgagtaagaacatgcagtgtttggttttttgtccttgcgatagtttgctgagaatgatgatttccacatggacacaggaagggtaatatcacactccggggcctgttgtggggtggggggaggggggagggaaagcattaggagatatacctaatgtaaatgacgagttaatgggtgcagcacaccaacatggcacatgtatacatatgtaacaaacctgcacattgtgcacatgtaccctaaaacttaaagtataataataataaaataaatcaatctatgtttctattttaacaccaaataattatgttaacaaagaccacagacagcagttgcttttgcttatccttaatcacttccctaagtataaagattttggtaattcaactttaaggctatctattcctattgtgaaaaaggaccccctccccacatattcccatgtgtcaatgagggaacataaggctgatgtggtaaagactatgatgacctggtacatttcaagatgttttatggtacttaaaaccaaagggatctgaaaagggagcctggtgatagaggaggtttaaaccaaaaagactctgggttgaacgtgaccagtaattgctcaacctgcctggtatgtctaaaaggaataacacacttggtatataatctagaactgtgattttgatgtgtgaacatatcattgaaaagaaaaaaaaatctatcaactgatctattatgatgttaaattacttatttgaccaattttaaataacgttaagatgaaatttacatatacttcaatgatttaaaggatagaactaaataattttatatttatttacttttcatgatacataatatttttacatatgtatggggtacatgtgatattttgttacatgcatagaatatgtaatgatcaagtcaggatatttagggtatccatccctcaaacattcatcatttctctgtgttgggaacatttcaagttctcctttctggctattttgaaatatataatatattgttgttaattatagtcaccctactctgctatagaatattataactcattttttcatctagctatatatctgttcccattaaccaacctctctctgttccccctcccctaacacccacccttcctagcctctggtatctatcattctactccctacctcagtaagatgaacttttttaacttccacatatgagtgaggacatgcaatgtttgtatttctgtgcctggcttatttaacttaatgacctcacattccatccatgttgctgcaaataacattattttattctttttttatggctgaatagtattccattgagtatatataacactttttctttgggaataaagctgcaataaatatggaggtccaggtatctatttagtgtactgattccttttcctgtggataaacacccagtagtggatggctggattgtatggtagttttatttttagatatttgagaaatctccatactgttttccacagtggctgtagtaatttatgttcccaccaagggtataagagttctgttttctctgcgtcctcaccaggaattctttttgtatgaatctatactacagcaatccaaatggttatgcataaaaatatgtgcacatacaaggatagccaatgcagtatgcgttgtgatggtgaaaatctggtaacagactaaatacattttcatgggtggtggtggtacattcatactatggaatactatacaaccattaaagagatggagatagacgggtatggatagaaatgggtagatctacaagatatatgaaaaacagatatgattccacatataatggaaaaatctatctatgcatgcataagaatgtgtgtatatctgtatggaaatctatagaaaaaggtttggaatttttaacattactataactcttaggaggggagtggttaaagtctatggttgaagggtaaatttcacttttgtcattttaataataaccattctgactggagtaagatgatatctcattgtggttttgatttgcatttccatgatgattaatggtgttgagcagtttttttcatatacctgttggctatttgtatgtcttcttttgagaaatgtctatttagagcttttgcctatttttaatgagattgtttctttctttgtgaggttgaattgtttgagctccttgtgtattctgtatattagtctcttgttagggaatagtttgtaaatattttctcccatttgacgggttgtcctttcactctgtttcttgtttcctttgctgtccagaagctttttagtttataatggtttcatttgtctatttttgtttttgttgcttatacttttgaggtcttagccataaattattttcctaggccaatgtcttgaagtgtttcctctgttttattccagtagttttattgtttgggattttacatttaagtctttaatccattttgagttgatctttatatatggtgagagatagggatccagtttcattcttctgcatatggttatccaattttcccagcaccatatattgaagagtgtcctttccccaatgtgtgttcttagagcctttattgacaataagttgactgtaaatatatgaatttacttctgggttctgtattctatttcattggtctatgtgtctgtttttataccaataacgtgctattttggttactatagtgttgtaatatattttgaaatcaggtagtgtgatgcctcaagccttgttcttttttttgtttgtttgtttttgagatggaatctcgctctgtcacccaggctggagtgcagtggtgtgatctcggctcactgcaacctccacctccctggttcaagcaattcccctgcctcagcctccatagtagctgggattacaggtgcatgccaccacacctggataatttttttttttttttgagacgtagtctcactctgtcaccagggctggagtacagtggcgcgatctcggctcactgcaatctccgcctcctgggttcaagcgattctcctgcctcagccccctgagtagctgagattacaggcgcccaccactatgcccagctaattttttgtatttttagtagagacggactttcaccatgttggtcaagctgctctcgaactcctgacctaatgattaacctgcctcggcctcccaaagtgctgggattataggtgtgggccactgcgcccggcaggctgatttttttgtattttttttttttttcagtagagatggggtttcaccatgttggccagactggtctcgaacttctgacctcaggcaatccacctgccttggcctcccaaagtactgggattacaggcctgagccactgtgcctggccactttgttctttttatttaagattgctgtggctattcaggccattttttggtttcatgcaaattgtaggattgtgttttctatttcagtaaaaatgacattggtattttgataggcactgcatcaaatctgtagattgctttgggtactgtggtcattttaacaatgttaattattcctatgcatgagcatagaatattgtttcatttgtttgtctcattcattagtgttttttttttcaagcttcttttttttattatactttaagttttagggtacatgggcacaacgtgcaggttagttacatatgtatacatgtgccatgttggtgtgctggacccagtaactcgtcatttaacattaggtatatctcctaatgctatcctacccccctcccacaccccacaacaggccccagtgtgtgatgttcccctacctgtgtccatgtgttctcattcttcaattcccacctatgagtgagaatatgcggtgtttggttttttgtccttgtgatagtttgctgagaatgatggtttccagtttcatccatgtccctagaaagaacatgaactcatccttttttatggctgcatagtattccatggtgtatatgtgccacattttcttgatccagtctatcattgttggacatttggctttgttcccagtctttcctattgtgaatagtaccaaaataaacatatgtgtgcatgtgtctttatagaagcatgatttataatcctttgggtatatacccagtaatgggatggctgggtcaaatgatatttctagttctagatacctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttacatttctctgatggccagtgatgatgagcattttttcatgtgtcttttggctgtataaatgtcttcttctgcgaagtgtctgctcatatcctttgcccatttgttgatggggttgtttgtttttttcttgtaaatttgtttgagttcattgtagattctggatattctgaccctttgtcagatgagtagattgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcatgaattaatttttgtataaggtgtaaggaagggatccagtttcagctttctacatatggctagccagttttcccagcaccatttattaaataggggattgtttccccatttcttgtttttgtcaggtttgtcaaagatcagatggttgtagatatgtggcattatttctgagggctctgttctgttccattggtctatatctctgttttggtaccagtaccatgctgttttgcttaccatagccttgtagtatagtttgaagtcaggtagctcgatgcctccagctttgttcttttggcttaggattgacttggcgatgcgggctcttttttggttccatatgaactttaaagtagttttttccaattctgcgaagaaagtcattggtagcttgatggggatggcattgaatctataaattaccttggacagtgtggccattttcacgatattgattcttcctacccatgagcatggaatgttcttccatttatttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcctatcagcttaaggagattttgggctgagacgatggggttttctagatatacaatcatgtcatctgcaaacagggaatttgacttcctcttttcctatttgaataccctttatttccttctcctgcctgattgccctggccagaacttccaacactatgttgaataggagtgttgagagagggcatccctgtcttgtgcccgttttcaaagggaatgcttccagtttttgcccattcggtatgatattggctgtgggtttgtcatagatagttcttattattttgagatacgtcccatcaatacctaatttattgagagtttttagcatgaagggttgttgaattttgtcaaaggccttttctgcatctagtgagataatcgtatggtttttgtctttggttctgtttatatgctggattatgtttattgttttgcatatgttgaaccagccttgcatcccagggatgaagtccacttgatcatggtggataagctttttgatatgctgctggattcggtttgccagtattttattgaggatttttgcatcgatgttcatcagggatattggtctaaaattctctttttttgttgtctctctgccaggctttggtatcaggatgatactggcctcataaaatgagttagggaggattccctctttttctattgattggaatagtttcagaaggaatggtaccagctcctccttgtccctctggtagaattcagctgtgaatccatcaggtcctggactttttttggttggtaagctgttaattattgcctcaatttcagagcctgttatttgtctgttcagagattcagcttcttcctggtttagtcttgggagggtatatgtgtcaaggaatttatctatttcttctagattttctagtttatttgcatagaggtgtttatagtattctctgatggtagcttgtatttctgtgggatcggtggtgatatcccctttatcattttttattgcgtctatttgattcttctctcttttcttctttattagtcttgctagcggtctatcaattgtgttgatagtttcaaaaaaccagcccctggattcattgatttttttgaagggtttttttgtgtctctatttccttcagttctgctctggtcttagttatttcttgccttctgctagcttttgaatgtgtttgctcttgcttttctagttcttttaattgtgatgttagggtgtcaattttgggtctttcctgctttctcttttgggcatttagtgctataaatttccctctacacactgctttgaatgtgtcccagagattctggtatgttgtgtctttgttctcgttggtttcaaagaacatctttattactgccttcatttcgttatgtagccagtagtcattcaggagcaggttgttcagtttccatgtagttgagcagttttgagtgagtttcttaatcctgagttctagtttgattgcactgtggtctgagagacagtttgttataatttctgttcttttacatttgctgaggagtggtttacttccaactgtgtggtccattttggaataagtgcggtgtggtgctgaaaagaatgtatattctgttgatttggggtggagagttctgtagatgtctattaggtccacttggtgcagagctgagttcaattcctggatatccttgttaactttctgtctctttgatctgtctaatgttgacagtggggtattaaagtctcccattattattgtgtgggaatctatgtctctttgtaggtctctaaggacttgttttatgaatctgggtgctcctgtgctgggtgcatatatatttaggatagttagctcttcttgttgaattgatccctttaccattatggaatggccttctttgtctcttttgatctttgttggtttaaagtttgttttatcagagcctgggattgcaacccctgcctttttttgttttccatttgcttggtagatattcctccatccctttattttgagcctatgtgtgtctctgcacatgagatggatttcctaaatacagcccactgatgggtcttgactctatccaatttgccagtctgtgtcttttaattggagcattcagcccatttacatttaaggttaatattattatttgtgaatttgatcctgtcattatgatgttagctggttattttgcttgttagttgatgcagttccttcctagccttgatggtctttacaatttggcatgtttttgcagtggctggtactgactgttcctttccatgtttagtgctttcttcaggagctcttttagggcaggcctggtggtgacaaaatctctcagcatttgcttgtctgtaaaggattttatttctccttcacttatgaagcttaatttggctggatatgaaattctgggttgaaaattcttttctttaagaatgttgaatattggcccccactctcttctggcttatagagtttctgctgagagatccactgttagtctgatgggcttccctttgtgggcaacccgacctttctctctggctgcccttaaccttttttccttcatttcaactttggtgaatctgacaattttgtgtcttggagttgctcttctcgaggagtatctttgtggcgttctctgtatttcctgaatctgaacgttggcctgccttgctagattggggaagttctcctggataatatcctgcagagtgttttccaacttggttccattctccctgtcactttcaggtacgccaatcagacgtagatttaatcttttcacatagtcccatgtttcttggaggctttgtttgtttctttttattcttttttctctaaacttctcttgtcacttcatttcattcatttgatcttccatcactgataccctttcttccagttgatcgcatcggctactgaggcttgtgcatttgtcatgtagttctcgttccgtggttttcagctccatcagctcctttaaggacttctctgcattggttattctagttagctgttcatctaagtttttttcaaggtttttaacttctttgccatgggttcgaacttcctcctttagctcggagtagtttgatcgtctgaagccttcttctctcaactcgtcaaagtcattctccgtccagctttgttccattgctggtgaggagctgcattcctttggaggaggagaggcactctgatttttagagtttccagtttttctgctctgttttttccccatctttgtgtttttatctacctttggtctttgatgatggtgatgtacagatggggttttggtgtggatatcctttctgtttgttagttttccttctaacagtcaggaccctcagctgcaagtctgttggaattttctggaggtccactccagaccctgtttgcctgggtatcagcagcggaggctgcagaacagtggatattggtgaacagcaaatgttgctgcctggtcgttcctctggaagttttgtctcagaggagtacccgggcatgtgaggtgtcagtctgcccctactggagggtgcctcccagttaggctactcaggggtcagggacccacttgaggaggcagtctgtccattcttagatctccagctgcgtgctgggagaaccactactctcttcaaagctgccagacagggacatttaagtctgcagaggtttctgctgcattttgttttgcagtgccctgcccccagaggtggagtctacagatgcaggcaggtctccttgagctgcggtggactccacccagttcaagcttcctggccactttgtttgcctactcaagccttggcaatggcgggcacccctcccccagccttgctgccaccttgcagtttgatttcagactggtgttctagcagtgagtgaggcttcgtgggcgtaggaccctccaagccatgcatgggatataatctcctggtgtgccgtttgctaagaccattggaaaagcacagtattagggtggtagtgacccgattttccaggtaccgtctgtcacccctttctttgactaggaaagggaattcactgaccccttgtgcttcccaggtgaggcgatgcctcgccctgctttggctcatgctcagtgtgctgcacccactgtcctgcacccactttctgacactccctagtgagatgaacccggtacctcagttggaaatgcagaaatctcccctcttctgcgtcgctcactctgggagctgtagactggagctcttcctattcggccatcttggctccacccatctcattagtgttttatagttttccttgtagcaatcctccacctcataggttaaatttgttcctaggtagtttgggattttttttttttttgtagctattgtaagtggaactaacatttttgtttctttcttggctggatcatgattggtgtatagaaacattgctgatttttgtacactgattttgtattctgcaactttactgaatttatttatcagatctgatagttttttggtagagtctttagttttttctagatcatggcatcagaaaagagggactatttgacttcctctgttccaatttggatgcatttttatttctttctcttacctgactgttctggctagtacttccagtaccatcttgaataggagtggtgaaagtgggcatccttgttccagttcccagaggaagactttcagtttttccccattcaatataatgttagctgtgaacttttgatatatagcctttattatgttgaggtatgtttcttctgtacctggtttgttgagagttttttttttttatcatgaagggatgttgaattttatcaaatgctttgtctgcatctattgagatgattgtatgtttttttcgttcatgtgctatatcacccttattgatttgtgtatgctgaaccatccttgcaaccctggaataaatctcacttgacgatgatgtattatcttcttgatgtgttattggattccatttactagcatttcgttgaggacttctgcatctatgttcctcagggatattggcctgtagtttttgtgtatgtgtgtgtgtgtgtgtgtgtgtctgtgtgtgtgtgtgtgtgtgtctgtgtgtctgtgtgtgtgattatatggttttggtatcagagtaatgctggccttgtggaatgagttagggagtattccttcctctttaattttgttggaatcatttcaggataattggtggttttctttagaagtttggtagaacttggcagtaaagccatctggtcttggatgtttcttttttgggagactttttattactgattcaatctcattacccattattggtctattctcattttctgtttcttcctgattcaatcttggtaagttgcatgtgtccaggaacttatccattttctccaggttttccagtttgttaacatataggtattcttaatagtctctgatcatcttttgtatttctgtagtatcagttgaaatgtttttttttcatttctgattttattcattgggtgttctatcttttttgttggttagtccagctagtggcttattaattttatcttttcaaaaaagccaacttttcattctattggtcctgtatccttggtattattcttttagtctctatttcatttagttctgctctgatctttatttttttctgctgattttgagtttggtttgtactttcttttctagttacttgaggtgcactattaaattatttatttgaaagctttctactttttcagtgtaggcatttattactataaacttcttagcattacatttgctgtatcccacaagttttaggatgatgtgtttccattttcatttatttcaagacattttttgatttacatcttaatttcttcatctacccaataatcattcaggagcatgtggtttaatatccatgtatttgtatagtttccaaagttcttgtttgtattgatttctggttttattccattgtgttctgagaaagatacttgatataatttcacttttaaaaacaatatgttgagatttgttttgtggcctaacatatggtctattctggagaatgtttcatgtactatggaaaagaatatgtattctgaagttgctggacagaatgttctgtaaatgtatattaggtcaatttggtccaaagtccagtttaaatataatgtttctctggtttttctgtttagctgttaggtctaatgctgagaatgggatgttgaagtcccccactcttcattgcagtctatctttctttttagatttagtaatatttgctttatgaatctgggtaccccaatgttaggtctatacatgttcataatagttatattttcttgctagattgatacctttgtcattatataatgaacttttttgtcttttttttaactacttttgatttcaagtctgtttgatataagtatggctactcctgccagcagtggactgggtgggtgggttcttaggcccctgaatagcaggcatgacataagttatgtcagtagtacatggctttttatttccatttttgtggaatgtctttttccattcctttactttcagtctatgtgcatctttactggtaaggtgagtttcttgtaggaagcatatagttggattatttaaaaagcccatttaactattctatatcatttaactggaaagcttcattcttttatattcaagattattattgatctgtgaggcttttctcctgtcacattgttaattgttttcaggttgttttatatattctttgttcttttatttttctgttattttttggcattgtggtttggtagatttctgtagttgtaccatttgcatcctttcttttcattctttgtgtgattgctttaccagtgagttttatactttcatgtgtcttcatgatggtaaaagtccttttgttcccgggtttaggactcccttaagtatttcttgtgggtttcatctaatggtaatgaatttacccagaatttacttgtctgggagagactttatttctccttcatttatgaaggatacttttgctggacatgttattctttgctggcagtttttttctttcagcactttgaatatgtcatcccattcgctaaatctgctcttagtctaatgggggaattttcttataaatgactagatgcttttattttgttgtttttagaattctccccttttctttgagttttggcagtttcactataatgtgctatggagaagacctttttgaattgtatctgacgggatggctgagcttcctgtatctgaatgtctaaatcccttcctagacttgggaagttttcagctattattttgttacataggttttctatctttcttttttttcaccttttgggaacactgaaaattcaaacatttggttgctttgttgtatcccatatgtcatgtaggctgtgttcattcttttaaattactttttctttatttttatctgactgggctatttcaaaacacctgtattcaacttctgaaattctttctgctgcttgacctagtctattattgaagctttcaaatgtatttttttatttcatgtgttgaattcttcagttccagaatttctgactggttcctttttatgatatgtatctctttggtaaagttctcattcatatcctgaattggtttttggatttctttgtattgtgtatctgagttgtattgtacctcactaagcttctttaatatcattatttaaaattatttttccatgatttcataaatttctttttcattggaatctgttgctggagaataattatgtttctttgtaggtgtcatatttccttgcttttttgtgttccttttgtccttatgttgatgtatgtacatctggtataatagtcacttcttccaattctttttgaatttgctttcataggggagtactttttcctgaagatgtatctatgatgctggttggggaggactctttggctttgatctgagttcatgcagtagtgtagtaatctccatatgatttcttctgctatatagcatcgttaatgcctgtgatttccttagtagcttagggtatgattgttaatggagactgtggtgaagttgtgctggggactgagatgacaaatgggccagtcttcaggccctggtggtggcagtggcaggccaagtatgcctgtccttgggccccatggctgtgtatgctggcatctgtgttgacaatttctggcaggtcagttcttgggccttcaggtggcttgctcagatgccagctgtgtcagcagtgactgggtaggtgggttcttaggcccctgagccacagacaaggcatgggtaatgtcagtagcagtgatgtgatgattctttgtctcccaagaggtgtacattgatgttggtagtggctgtggtgggctgggttggttacgcttcaggcctgcaggtggcacttgcaggtagatgccagctgaggtggtagtggctaggagtttaggcccaatattatgcctttgggaggagtgctcaggtgcccacggtggtagactgggttgggtaatccccaggatcccaggctacgtactctgccttggggttgggaatggcaaaactagtctgggtaagctgctgcttaggccccctaatggtgagagatggtaccacctgtggtgagtagaggtgtagtgatcctcagtccccaggtggagtgctcaggtgagggatgatagcggctgtgccgagtccctgccactggagagggtgggactgtctttagtggctataacctgggctggtgggtgaagaatgtgtattccttttatattctggtcccactggggcttggctcccagacttgccagtagtagcctatgtctagatcatgcccccaccccagatgcaggagtccccactcagctggcaaccaagtcccagtggaaactgatgccttacccacatcccattctttatcccagcagtgctcacttcccaagaccggcagctgcagcccacacctgcatgccttattagtcctggttgtggaatgctcccagcttgctcctcagtcacagcactgacagcctgatagcccaagtttccataatgccccagttccagtgctgttgggctccaggactgtgttcattctgccaaaaactatgcttgaaaatgatgcctttttgtagctgcttaggtctcagaaatggtgtggcacccagcacagactcactccctggaacacttccctcccgtggtctcctggcagctccatatgttagtttcagggtttggcagggggtcaaggggttctcccatagccaagattgcatgattccacagtgtggatatgggtcactggaagtctctcatttaccctttccctcaattggaaagtcgctcccagctgccactcaatcctggccaggcagcctacttctctccctctcctttctccacttttgatgtttcttgtcacttctctgttgaattccagtattctctcttggataatgtattttaagtgtgactgtccatacactattttcgttcttctaagtggaggaagaggacatgaaatacttctaatcagccatcttgaagctcctcccttaattgttaatgatggtgtaatattccaccatatgggtatgccataatttatttaacaatctattattggacatttacattattttcaactttggtagtgtaagtattgttgagatggacataatagtgcataaatctttagttacatttgggattcttttctttttttttttgacggagttttactcttgttgcccaggctggagtccaatggcacgatctcggctcactgcaacctccacctcccaggtccaagcaacttttctgcctcagcctcctgagtagctggagttacaggcacccgccaccacacccagctaattttttgtattttttagtagagacagggtttcactatgttggccaggctggcctcaaactcctgatcttgtggtctgccaacctcggcctcccaaagtgctgggattacaggcatgagccaccacacctggctggattattttcttaagatatactgggtaaaaaggtttgaattttgtttttgcctgaaattttgcattaagatagaatcatgcttcatcatagagacacactgtacctgacataacccttgctgtattttcgggtatcttttagttttgttattaggaatgttagaataacatccgtgtacatgagtctgactgtattttctgagataggtaatttttaaaggttattatataaacttaacagctaatttgttctccagaaaaatgaatgacaatttatattctcattgccagtatatgagagtgttttgctgcaggctttctaacattgagttaggttgttacttttaaaccattgctagtttgatagatgctaccaatgttgatcagcaaaagggggatcaaaaaataggatatcagttgggagaaagaggtaaattttttgaaggctttaagaaacaattagtatgatcccagggtgtagttacatatttgcacggacttttatgcctgtattgaaaagatatgtgaacaccagtgatctggaaataagatatccaggctagtaatcgttacgattatggctattattataaaaagacctactgttcatttattgagttaatccctagaagactaaattaaaatacatatcactgaggattagttttttaactttctcccattggttcattttcaaaaacaattatgtgtggtgaaccagttgctacctggggccttaaagaggttaaaacagaagttttaaaggggaaaatatcatttttttcacaaagaagtgaagtaggagtgcccaattgaaggaggcagcagattcctggtttcctgatttgtgctgaatatgagttgtagggcagcaggataaattttactcaattctgaaaatggagggaggggagagagatacttgcacttttcttttgcctaagtgtaacttcagagtattatggttattgatcagtgaggagaaaatattaaatcattaatattaatgatccctaataggaaagaaactttataaaatgtgaattaattgatttgcctccaattgattccttgctgtagtaaaattacttagctcactaagcctccgtttctctgtattttacacaagggtaatgaggttggtccacttcttaaaatactataaaacctcaattagctggagtgtggaaaagggaaagtgtaaggattaaaggggttagaaaagttttttggcatggtggtaaacagagaagatgccctttcagctattgccacgcaattcttgttgaaaacattttttttaaagtttattttattattgttatactttaagttttagggtacatgtgcacaatatgcaggttagttacatatgtatacatattaaagtcatagaaaaaatgcaaataaagaatattagatgtatttaatgactcaattggaaacaaagcaaaaacaaaaacttggcctccagaaatttgaatcagtgaacttaacattcaatgctaaaaaaatcctagaatgaactacttaactattgagaagatatatgcctcctcaaacctccaactcttccttttctacagataaacttgccagctgtttcacagaaaatgtagaagccacaagatggcaactccccaccataaaacacttacctgcaccatcatctgtaatttctgccttcctcccattttcaattgaagatcagaaaatcctcccgtgtatgtcaaattcttccacttgagctccagaaacctttttttaatctgttttttttaagtgtccttactccatacaataaccttgtgttttctttcttttcgaccattcccccttttctggcttctttccctaatcatttagagcttgttcaagtccctcctattcactaaagaaaaaaaagtctgatggtattcccccaaaccagtaaattcagtctaatcatgaggcaaacatcaattaaaaaattattctctaaccttctgccatatgcttaccctatctctctctttcctatcacagctaatctttgtgaatattgtctccactcagtgttctacttccttaccttcagtttactcttcaatctatacagtctgattctaaccccgctacaccactgatctgtttctgacaatcttcttttggttaacagcctttttacttggctaaatataaaggacacttttgagcctctgactcacttgatcacccagcgtttaacatagttgtcattcttgaaatatgctattcccttggtgttcctcctggttttctttgtacctttcttgttacctttttctcagtctcttttgtaggctactctgaaccttcccaactcaaatgttggtgtttctcagtactttatccttcgctaccttcttattttgcctctatcttttggtagttcatctactcctgtgacatgaagtaccatctctgagcttaagactacaaaatatttataccaattctgtttccttaacttctattagtatcctcaatttttcactaacatctattcttagatgtactataggcaactcaatctgtacatgatcttaacccctgatcacctcaccagtgtcaactgtctctattcctcctatctattaataacactctgtgattctgccatattgaactcattctacttcaatgaacattccatgccctctcagctccaggcctatgtccaggctattacctctttttagaacgatctttcctatcgcactctaggtttcaacttagaagtcactttctccagacacctttgtctttctcataaacatgagtttgatttcttctctctttcctttcaaaacactccatatttctcctcttattacatttaaaatacttcattgttgttgtctgtggttttttcttttctactagactgtgatcacacaaaaagtagatacaatacctatcatgttcccattgtattcctatcataggcatacattaagtttattgaataaataaattaatggatcttaggagcaaatcagactaaacaaagttattattttcctttggtaaaactgttagaatgatatatcactatgaaagcctagtctatcacatgcatgatctctcatgacaagatgtgccaatatggtctagttaaatggattttagtatagttaaatgattcataccaaattggtcaaccagattaatggattaatgctgacatgtagagagatctatggtggtaggccacagatctctgttatatgtcatatcttattcagaattttaaaaattattgacttgattgaaggcagagaaagcaagcttatgaaatattcagatgacacaaaagtaggtgggagagttaataaaatgaataaaagccttatgctttgaaatggtcttcatgatttggaataatagaataaaactaacataatgacatttcatagggattaatataaatctataggtttaggataaacattttaaaatccatttaatattcaagaagaatggattgcatacctactgtgttctagtcaatggtgctggggatgcaaaaaaaaaaaaaaagcatagcctctgcccttgaaatagttaaattttgacgatgatattgaatctagatcatggtacataataggctcattgcactttgtattttctacatagagaatgttgtatgctgttgtaggtatcatattaattttacaatatatgcagaaagtatactatttagtttaaaatttaaacatttcaatggtatcagtcggaataatttagattatgctattgtaataatccccaactcttggtggtttgtaaaaacaaagttttatttttcacttatgtaatgtgttggctagaagctctgctctgtgactcttcattctgtggcccagggtgatggagcaaccaccatcataaatattaccagtcactgtggcagaaggaaagatagctgtggaaggcgtcacattgacaaataaatgctctggcctggaagtgacatgcaactgtgagcaatgacttctggtcacaaataattggccagaaccagatgcatcactccatcaatcacaatggggccaggaagtgcggtcatatcatgtgaccgaaggcaaagaggtgttaagtattttgagaacagagttaatgatcaccattactatattgagtaaaaagtgaaaattacccttcaaccttagactttatccactcccctcctaaggattatagtagtgtcaaaaattccaaactttttttttttaagagatctgaagtgattttacctttatttccttcactttaagccagtgatgaaatttcacagtgatttctgggataggggcagaaggaaggtggtgttaagaatcatcagggctgtggcctagtcagcctgcagaggtgcaggcagggtgggcccccactgggacagctggaggaggcaggtaggtgatgttctcagagctgagagctggtatgtgatgtcctctgcagcttccagcacgctcagctcgatcaggccgtcccctgcggtggccagtgagttggggatcagcttggcttccatggagtcaccctcagcagagatgatggctgctattttctgctgctcagccttttccaccacaaatctggccctctctgcttcctgctgatccacctctttggcttccactgcttctgtgaactccttcccgaaggtgggatgtgtcaaggacacatcgtccaggatgagcccaaaggtggctgctcactccgtaagattgtcactcacctgcctggagagcagctctctctgggtgattagttctccagcatcaaagtgagacaccaccgacttgaggatcttggtagtgatggatggcagcacacgctcatcatagtcctctctgatgctggtgaagatgcaaggaagctggctagcgacaggccaggagaggatgtgcagtgtgatgttgacattctgtaagtctttgctaccagtgatgactggtacattaagtggtcgagaatggcagtcaaagataattggtttctgtacccatgggataggaaagtgagtcccttcccctaccacaatgtcctgtactccacagaatcggtcaaagatgacagctctgtgaccagcatccacattatataaggcagagttcagcatgcttcctacaacagctaaggccaggccaaacttgccaatggacacaaacactttggcagccatgttttcttctgctggaccctctcacacctgcttccactctgacctccacatgaattccccagccacacatccaaacctcttcctacagatttccatacacatacacacacattctcaggcatgcatacatacatagatttttccattatatgtggaatcatatctatttttcatatatcttgtagatctacccatgtctatccatacctctttatctcagtctctttaatggttgtatagtattccatttatgaatgtatcacccctacccatgacaaggtatttagtctgttatcagattttcaccatcacaatgcatactgcattgaccatccttgtatgtgcatatatttttatgcataatcatttggattgctgtagtatagattcatacaaaagcaattcttgagcactttaatttttgccaaatactaacaaattgccttgtaaaatgctgtcctaatttataatgtcataaacagaatatgaatgtgtacattaaattttgagaagactattgacaaacacttttattgatggaagaaaatgttagatgatgagggatttagacaccacatcaaaaattgagtaagactcattgatcaatgagtgtgattgaagactttttgtctaaactgcttgtaacaccttatacctactacttctaggtttcctggctggagaaaccctgaaaaagactagtccctgtaacacataacacttttgattttatcttaatggtcagaactcaagattatatcttaatgatcagaactcaatacctttccatatccagctgctagggaggctgtgaaatgaaattttcatttttgtggactatgtatggagcccaaagctggggactatgatcactacagaaatcaaaaagaaaccctatagttacttatgccagtttttttctttatacttgcttctccttgcattctctcctgagatagtcccttctgctgtctctcaatgtttcatcactcactattcctcttatctattccccttttttgctatgtcaactttttgagtctccacttctaattttttctctctctgcttcttcatgttttttctctttctcctctacgatttttttccctccctttctgtgtcctatccacctgactctatcttttgctatctctgttttcttacttgtgtgcctttggctatgttggtttcagtctctgtgtctctttatttctacctctgattctaatggttagggctaacaacagacttggctgccactttatgcagttattttcaaatgacagaagtgcttgagaataggctagatataggaatgctgtaaaaaggatttcttgattggttgaaagttggactaggtaactattgaggtcctttccaaatttgagtttgagagccatatttccctccatagtagatagaatctagttaacattattgcatctctgttttctgattgaatagctaataggacctcagggccatctctatgtgaataccagacttcattgcaaattactatagaattataaaatgtaagagatagagataaatgtgtgttgactaaagaactgtctttctctgtatatatgtatgtacgtgtctgattttatacatatatatacatatatgaaaaccttgtgaagatatcaaaattttctttgattgcaaaaatgtaacaagaaatgattataattgtgtgctatttgaaactagctgatattttagattgggtctattaactgtgtccaaatgtatccataagttaaatgtgttttggtttctagagtcaagagtttgccatataggtactgttaaaaattagcatgaaccagaaacctgacatatctggtactttaagggaggaagggaataaagtgaaaaaggtaatttgcaaactatacttgaaagtcattgaagcataacatcattacaattatctgtcaaaagatttagttcaattacagttttaaagctctctcttcaatatggcattactcatatcaggatttgatactccaatgagaggaatactaatgccttcattagccattgtcttagcagcttcattctttagaattcattacgtggccttttgggatttttatatactaaccctagggaatcagtaaacacaaatctctcaggggaatatgaacttcagaaataagaaccattgcatatttatagccatggcaggggggaagactctttttaggaaaaaaagtaattttgaaataattgaataacagtataattgccatgatagtaggtattatacatgctcctgtacactttcttcacacagcagtaagttggttgtaaaatcaccaacaggaaaaagttataatgtaataaacctaaatttcagtgtaaggtttccaggagtaactcgagctgcttctgaaacttttactattgaaacagatgtgtgggaaccatatgttgggagcccagtggtcactgttgtaagacattccttgatcaatgatgatatttcaggccgactgatgctgtagatgaacactgctactagattgattacactggcctttctctttgactatttgaattgaggcagtttgacagattttccctttcaatgggaaatctgaatcacctactgaacatgctaaaaaaaaccacttattttactaggtattcccttagcacttaacaaatataggttgctcttcattgtcctgcacttgactaagtactctactatgcatgtatcgccacagtgaggttatagttccttgaagaaaagaagctacattttataatcttagacttggtttatgactcccatagcatctaacttctagggcaaaaatcgttcagtagtggttaagagattggggtttgttgtcacacagacctacattcaaatcctttttccataatttattaatgtcatgaacttgggtaagtcacaaatgtcagtttcctgaaaagtaaaatggagattatagtaactcataagattgttgagaggataaaatgacatataacagtttagcacaatgtctggcccacacaaagtgctcaataaattattatcatcataaagtataatcattgttcagcaaaatttgttgaattaattgactcttctgtggaaatgggattggtaaatatatggacttaaaaactttatatgctcactttttctaattctgactgattttaactgacaggaaaagtagcatatgaaataattctgtagttaaattgtacagttccaatgattatttccctattcacagtcaaacattaactattttatttcacaaagaatagggaggggtgaattaaatagggaagtagaaatatttctgcatcagttattttccacataaaatatctctgaatatcagttataaaatctagttcatgtttttggtgaatatgatcacataatgtccacttggcaaacagagtttttaaagggctttctcaaatcaactttttttgccaccatttataaaatatcagaattataaaaatgatatttgattttagcaagttatggtccctacacactgtcagctttcagacagaaatcgtgaaggtacaatcatagatagaataggtttgcggtaaggagagcttggcagactcctaaaatctaaccagtatggttgagttggtaactaagtgaatatatatagcaggaagagctatagcagagatgagccaatgttcttaacaaagtcactggcgttatataagttctaaattggggggtaagacagaggagctagaatgggcacgttgttcaagaaaattttgaatcataagccttcctttgaaagttcagagcctacataatcatctggagatctggcagataaggtctatggaaaacaaagaatcctgtggagtacttaatggtcttttcagtcttggtttggggtctccaaaaagcagaactctaaggatttgaatgtaggtagtttatttgggaggtgatcccaggaagtactgcaaggaagtggcaaagtcagactggaagggaggtaaagcaaataagcaggttgccactcaatattactggaacataccaaagggtgagggagctagggtatttattcatgaactttcacaattgattgagaatcatttagtgaatattaacaacctggcacttctagtcatctcctatactggccaagctgcttttgcagttaaagaagcccctctggcagagaaacataggaagacttctgcagatgacttttagaatgggtcaaagaagacatgggcagggcaccaacagtgtttatgacagcaggaaatatggtacctctcagatctggataatcccatgttagacaagagatgttctatttcaaacaaatgagtaacttgaaaaaacactaaaagtttccactcatttgcattatttaaacatttgataagatgttatctacatagattttgttcttttattcattaaaaatatttattaattagttatgtgtcaggctctatgctaggtgatgagaataaaacagttagtgaccaagtggctgccctcatgaagtttacattctagtgggcaaggagtaggcaaagacaaccaagctaataaatttaaccgattcattaagtgtttcaactcattggagtataaacttgaaatggtattatttttccactaattgctatttactgtgttctgttgtatttaccctcttccactgagagattaggacaatgataaacatttcaatctgattgtataactttttagctgctttcagatattaggagagtctcatgctgattttaaagctttggcttgcttactccaagcccctatctgatgaaaatgcttctcttcctttttcttcaaacagatgggacatatggctctagcggctaggagtttggggacatgtatggtagcctttcatacatctcttcttatttcttccctttcccctgtgcctgttttgttattgctttgggaggagagttgctggggaaaagggagaggaaaaagacagatgcttgtgactgtgtgtgtcttctccttggttggtcacaattgctcttctagctgtctatgggcactatataaacaggtagttataacagcctgctgatgggaggcttctccaagcatctcctctggacattggaaatcccttgcaagattattacatcttctgttagaccttcagctggtgccatcagatcactttattttcacatgcattcatcttgccccatgttgcaaagcctctggcaagaattatgcagttacctagtccagcttggacctttgggcatatgccaaattcattttccatgtctcttgggacccatatatggctgtgtgttgggagtaggtgagaattagtctcggtcctcttgtcatctggaaatctccaatatcccacctctcccgagggttctttatcctagctccagtggtgcagggaaagttcagcatgtctaatggtaagtatatggttaactgggaaagaaaaagcctgttttccttgtcaaaacgtagccttctcctcctttccaggttcctttgtttattgatggagttggggtgaggtgatatggaactagctgcattggttcattgtgctggtggcttcagacatcaaactggaagttttctgaatttaggatatcaggtagatctttgaggtcaattctgggaaaagaggatcctaccaagcacttgatatcaccctgttactcttatattctgggtaaggctctatacctttaggtacgaactaattatttttaaaaatctttacatagaatactggacctttacatgtcatccagaggctattgcctttccaggttttcttccattcattatttcagtgattgctgtagtttcaccctcatacctcccattgccatttttgtatcttgaatttatcatgagcccaaagtacttcagtggtacttatattccgattattttaaaggaccctagctgaaccaccatataggtaaccaatttactgatttttttaactcaatagggacaaaaacttaaagataatttcccccccacccccaatgtctactggtggcactttacaaactcctttccctgttattggatgtggagatttaataacagcttggttcaattccttacccttttcagttatttttgattttggaagagtttcattctaagtgcttgagactcaatactgttcatttaaaaatgaactcaaagtagtgtaaaaactcttcctatcacataaacaactgtaaatgctgatcagtcttatgaataaaacaaacaaagaggtgagctagagattgacagagttcagattgggtagttgagaaaggcctttttgtgggactcagacatgtaggatgttaagaaactgagtgaacagtggagagtatctcaggaggaagacaaagtgcaaacaccgtggggaaaaaaaaatgccttggcacattccaggaacagaaaaaatgaccatcatggctggagcataggcagcaaggaggagagctttgtgaaataagatcaaagaggcacctgggggctccacctataggcctttgaaagtctaatgatttgaaattaggtacagtggtacctccagctttgttctttttgcttaggattgtcttggcaatgtgggctcttttttagttccatatgaattttaaagtagttttttccaattccgtgaagaaagtcattggtaggttgatgaggatggcattgaatctataaattaccttgggcagtatggccattttcacgatattgattcttcctatccatgaggacaggatgttcttcttccatttgtttgtgccctcttttaattcgttgagcagtggtttgtagttcttgaagagatccctcacatcccttgtaagttggattcctaggtattttattctctttgtagcaattttgaatgggagtccactcatgatttggctctctgtttgtctgttattggtgtataggaatgtttgtgatttttgtacattgattttgtgtcctgagactttgctgaagttgcttatcagcttaaggagattttgggctgagatgatggggttttctaaatgtacaatcatgtcatctgcaaacagggacaatttgacttcctcttttcctaattgaataccctttatttctttctcctgcctgattgccctggccagaatttccaacgctatgtcgaataggagtggtgagagagggcatccctgttgtgccagttttcaaagggaatgcttccagtttttgcccattcagtatgatattggctgtgggtttgtcataaatggctcttattattttgagatatattccatcaatacctagtttattgagagtttttagcatgaaggggtgttcaattttgttgaaggcctcttctgcatctattgagataaacatgtggtttttgtcattggttctgtttatgtgatggattacatttattgatttgcatattttgaaccagccttgcatcccagggatgaagcccacttgatcatggtggataagtttttgatgtgctgttggattcagtttgccagtattttattgaggatttccacattaatgttcatcagggatattggtctaaaattctcttttttttgttgtgtctctgccaggctttggtatcaggatgatgctggcctcataaaatgagttagggaggattccctctttttctattgctaggaacagtttccaaaggaatggtaccagctcctctttgtacctctggtagaatttggctgtgaatccatcaggtcctggactttttttggttggtaggctattaattattgcctcaatttcagagcctgttgttggtctattcagagattcagcttcttcctggtttagtctttggagggtgtatgtgtcgaggaatttatccatttcttctagattttctagttaatttgcgtagaggtgtttatagtattctctgatggtagtttgtatttctgtgggatcggtggtgacattccctttatcatatttttattgcatctatttgattcttctctattttcttctttattaatcttgctagtggtctatcaatttttttgatcttttcaaaaaaccaacccctggattcattgattttattgaagggtttttcctgtctctatctcctttagttcttctctgttcttagttatttcttgtcttttgctagcttttgaatttgtttgttcttgcttctccagttcttttaattgtgatgttagggtgtcaattttagatctttcctgctttctcttgtgggcatttagtgctataaatttccctctacacactgctttaaatgtgtcccagagattctggtacattgtatctttgttctcactggtttcaaagaacatctttatttctgccttcatttcgttatttacccagtaatcattcaggagcatgttgttcagtttccatgtagttctgcagttttgagttagtttcttaatcctgagttctaatttgattgcactgtggtctgagagactttttgttgtgatttctgttcttttatatttgctgaggagtgctttacttccaactatgtggtcggttttggaataagtgcaatgtggtgcagataagaatgtatattctgttgatttggggtgtagagttctttagatttctattaggtccacttggtgcagagctgagttcaaatcctgaatattcttgttaattttttgtctcattgatctgtctaatattgacagtggggtgttaaagtctcccattattattgcatggcagtctacgtctctttgtaggtctctaaggacttgttttatgaatctgggtgctcctgtattgggtgcatatatatttaggatggttagctcttcttgttgaattgatccctttaccattacgtaatggccttctttgtctcttttgatctttgtaggtttaaagtctgttttatcagagactaggattgcaacccctgctttttttttgttttccatttgcttggtagatcttcctccatccctttattttgagcctatgtgcatctttgaatgtgagatgggtctcctgaatacagcacactgattggtcttgactctttatccaatttgccagttggtgtcttttaattggagcatttagtccatttacatttaaggttaatattgttatttgtgaatttgatcctgtcattatgatgttacaaggctatagtaacaaaagcagcatggtactggtacgaaaacagagatatagatcaatggaacagaacagaggcctcagaaataacaccacacatctacaaccatctgatctttgacaaacctgacaaaaacaagaaatggggaaaggattacctatttaataaatagtgctgggaaaactggctagccatatgtagaaagttgaaactggatcccttctttacaacttatacacaaattaatttaagatggattaaagacttaaatgttagacctaaaaccataaaaaccctagaagaaaccctaggcaataccattcagaacacaggcatgggcaaggacttcatgactaaaatgccaaaagcaatggcaacaaagccaaaattgacaaaggggatctaattaaactaaagagcttctgcacagcaaaagaaactaccatcagagtgaacaggcaacctacagaataggagaaaatttttgtaatctacctgtttaacaaagggctaatgtccagaatctacaaagagctcaaacaaatttacaagaaaaaaaaacccatcaaaaagtggacaaaggatatgaacagagacttctcaaaataagacatttatgcagccaacagacatatgaaaaaatgctcatcatcactggtcatcagagaaatgcaaatcaaaaccacaatgagataccatctcacaccagttagaatggcattcattaaaaagttaggaaacaacagatgctggagaggatgtggagaaataggaaagcttttacaccattggtgggagtgtaaactagttcaaccattgtggaagacagtgtggcgattcctcaaggatctagaactagaaatagaatttgacccagcaatcccattactgggtatataaccaaaggattataaatcatgctactataaagacacatgcacacgtatgtttatcatggcactgttcacaatagcagacttggaaccaacccaaatgtctgtcaatgataggctggattaagaatatttggcacatatacaccatggaatactgtgcagccatataaaaggatgagtttatgtcctttgtagggacatggatgaagctggaaaccatcattctgagcaaactatcacaaggacagaaaaccaaataatgcatgttctcactcatagttgggaattgaacaatgagaacacttggacacagggcagggatcatcacaaaccagggcttctggtggggtgggaggcagggggaggaatagaattaggagaaaaaacttctataaatgacaagttaatggatgcagcaaaccaacatggcacatgtatacctatgtgacaaacctgcacgttgtgcacatgtacactagaacttaaagtataataaaaaaatacaaaaaaattgaaaaagaaagtctaatggaaggagttcagatttcactctaaatccagtgggaagccactgaaaagttttaagcagggaacctgacatggtttaactgtgaactttcatgttttcttctatttgcaaaaaataaagccagaagaccccagattgtcattgtttctctaatggagttttgaaaaatgtaaaattataggtgtggttttgttgaggccaagatctgtggttcaaactttatatccttttttttgacttttcagctgtcaagaaaagtgaaggatgaagccaccatttcttttggcccttgtggtctgttctgtagtcagcacaaatctgaagatggtgtcaaagagaaattctggtaagttgctggcaacttgccactatttggtcaaaaatgtacagttttgtgagcacccagagggcacctgtgcctttaactatgaatgtctttaaatagaagcactcgtattccagttatgttggaaagtagccaaaataaaaatgatgtttaatcctaccactgagaaattgttgggaaatcagtggaattttgttaaacttcaatgaccagtatactctcagtggacaatgaaatgttaagggcctacttagagttggttacatttgctagtgaataaatacctgggagcaaacatttacaaatgagaaggtaagaaacctttaaaaatatacatcctttgcctcctaattgagtgtgtagcattgcaatttaaagactttgataaatatctgagttttagttccttatagttgtacccagttgctaacaggcaggggtctacagcctccaagttcagaattattagctaattgcccgaagaggaatttctcgagaagaaaaatctattcctagaacatgttggtctggcaggcagccatgactgtactaagagattagctgtagccagtacatagtccagtcaaagcttaatcattgtttaataatacttggatatatatgtctttcagttttgattatacattctagctgtaattacaaactttgcatgagattttaagaattgattttctgtctgtaatcattccagtaagacattgaggaatgtgttattatatggaaacaaaagattgtgttgagactttctactggcttctaattcatttatttctgagaattaaatgtatttgctttactttctcattaagtatcaaatctagtcaatgaaatgcatgcttacttttcaaagcaaaaaatgcggattggggggaggtgcttggagtttggctaatgtttgtttcctgagataagaatacttactaattgaaatacctaacaaatagttttgtcttcaattgatagcatattaataaatgtttccaaaagtgagagatttatcacagactataaaatagagtaacactgctgaagtccaaaggatcctggagtgataaagatagggcaatatattgtctttttctcttcttatagattcaggtctatatttaaattacttttgtatgttgtgactctctttcagctgaatttgtgtttaatattttacctattatctctccagctcagcatatcattcatggctgcctttccttgctttacctttgaagtcccattttactttcaatcttggttcaaattgatagttgctgaaataaaatatttagagagattgcttaacagcaaacataacctgttgaaccagattgcattttccttactcggtcatgtcataatgtctggagcagatccgaaaggaaaaaaagaaacgagggtttaaaaagtcatctgtattatggtagcttaattgaagtaaaatccaaactgaaaaaaaataagttgctgtcaatgtattctgtcttataccttggtttgcttattatataagagaagagaggctgttaaaatatatatatattttatatatatttatatatataaaatatataaatatatatatacacacaaatatatatgtgtatgtatagacacacacacacacacacacatacacatatagctgggctattacaggtggctcacacctgtaatcccagcatttgggaggccaaggtgggtggattgcttgtgctaaggagtttgagaccagcctgggtaacatggtgaaaccctatttctacaaaaatgtaaaaattagctgacattgtggtgcacacctgtagtcctagctaatcaggaggctgaggtgagagtatggcttcagcctgtgaagcagaggttggtgagccgagatcatgccactgcactccagcctgggtgacagaaccagaccctgtctatatatatatatatatacacacacacacacacacatacacacacacatatagaaggttatcattaatgcacagatgtcattaaaagatcaacttttcaatgctttgcctctttatttttgcttgttaagcgtgaggctatttgtggcttactagggtttcttagctttgttttcttagtgtggacaaatggtatcatatctgcagtcagcttcattgaagaaacattacccaaaaagatatttcacttacagtcaaagtgttagaatggtttcagtctctgcttctccttccctttatgctgcactccccctccatccctgccaggacaatagcaattgtaatattggaacaaaacttcttacaggtctgtgcagttgaaatcatttgaatgcacagctggttcttttattttatgccttactgcttctgtttatggtgtatacggagtaggcagaaaagactaataggttagtgttggtttgtgcttgtctctgtgtgttttttgtttgtatgtttgtttattgtttcataatgcaaaaaagatagggcatgggatgaataaaagacatcttaagttgctgatgaaaacgaggatactttggagcagttcttttcaactctacctttctgtttagccacccccatcataaccccctctccagccctatacctctgttaatattattattttatgtagaaaatataattatttgcactttcattatcatagtgctatttgagttaccttatcttttgaagaacattaaaaatgctttggcaaatctgcagtacaaatttttgcttcatgtagcttgtgaagtcctttgctcattgccaatcaaagagatccaggtttaagctcgcatggatgttcatcatggaatcactaacggaactcgtaacttttatttttttcccctcttcccttccctcaagtcaagaaatgaaaaacgattgcaccctttattcattaacatttatgactgtttagtgtctgatgtgaagatagttataatgatttctatgcagttcattgtagacacaaatccctttcactgagatccctacaactgctgttgctaatggccacccttatgcacaagacagagagaggaccaagggtggaagttttttcttctgtacttgtcaaacatggaaaagaacttagtaacagatgtgagttaggtttttggttttggaggttggtttgtttgttttaatctactctgggcacatattggagcaaacctgcttttgggtggtgtacaatttttagaggtgatagcacaggctatgtttccatgtaatgcccattcacactgggcaagtccaacaatcaaccctggcttgggaaacagcaaagatggctctgagactgcatctagggcctgattgctttagaacatattaaaatgcacagcatttaattttaaggactatagctgattattcaagtgtaagtttttggtcttcttcacataacactccttcagtattcactttttataaatttaggactggatagataaaagtcatttggaaagcctactctatcaaaaacaagtttacttaaaggtgtcattctttatgtcaggaaattggctaatatcttgatgatcaatagcagaaatggccatttctttttcctgtagaggacacaggtacctaaaactaatttttaatagggtgggtgggagaaattactcttcctcaagaagtcactcaagaccttctatttagctattttttaacctgaaaaacgtcctcagaatatacatgaactttattatttgggacattaaatcatccccttaactttcttttggcttttgctgctgctgctcctgcatgaaaatgtgagccatgttatgcagttgttggcattcagttcttccagcatggacctctgtatcagagaaagcatcagtctgatgagtgggtatgttaatattcaacccaaattgggtcatcttacagtcagttcatctggaggatgatctagcacaaaaacttctcagtgttgggaggaaaattgcagagctacctgcatatctcaatcagctagaaaatgtagtccccagtggtaagaagaatgtgaagacttgctggcacacagtgggtatttaaagatatattttggatggacttgaaagaaccactcagttccacgtaatgagagaatggctttatttggggctttggtttataaaattatgatattttctgattgttgatgaggaaataacagcttgttttcactaaaatacatttgttttagaatttccagttagataactgaggacgaccataaaggcaaaagtagaggttatatgagcttacatttctggccaaagctagaaagggactcttataccacttccaagtaaaaagaaaataacttcttttgtgaaatttattgttatataattaaaaataaaaggaaccatgctttgaaccctcaaaggaaacaataaaatgttttatttaaaaatgctggttagaagtaatgttgctctgtggatattcacactgtgcttttagctgtagagtgtaagaacactagaagttagaaaatcaacaatgtgatattgagatctcatctcctaaatgtattctaatgagctaagatcaaggaggaaaatacttccctatgatttgttctttaattgaaagggacaatctgagacatggtacttttatctctttaattagggtgacttctctggaggaaaatggatctttgaaggaagggaaagtggtactagaagaattggttaggtcattggaagtgatataggacaatgtttggagtataagacaaagtttacagcaactagataataggcagggatgagagatatcggtcagaaagaatgtgtggccagaattgagctgagtgaaacacagttattgaataagttgaaggggaaataattttacagttcttatcattgaatttgatatggccaaaggcatacttgttgaactgttactgtatgtgcaatattccactagtcctgaggtggggctgacggggagggaaaataaatcaaaactcccttgtttaaaatacttaatatcattgagatcaatgaatggctaagcaaataatggttttagggttagggagggtggagtgtaggtcctgttctctggaatgttccattctctaaaggtagaacatttctggagttttagctggatgcccagatgttaacaagatattccctagcactgctaatcctttaatatcttcttccattatcaactctgtagtggtcgttccgcaatgataagcctttggcagtcttttccagggcatgttcagtccagttctcaatcagggatccatagaggacctccacatagatctcatgggctcccctctgggaagctctctccttttactgggagttccagccattttaaatgccttgaactctgatctctgtagctccagctcaataatactactgggctctgttaggactctaactcaccaagccatagttggggaattgtccccagtcggagagctgggttgattgtggggctcacaccattagtcctccttttctccgagatcacagcttaacacttcctgaatattattgctttacacatttcttccacttttgttgttgcttactgtgggagagttagtctagtttcagttacttcctgttaccttcgataccccatcattctttgggtgctttctgtcataaagaagttgtgctagggttaccttgatactgattctttttagtggaaaatgaatttagaaaccttctttttcttttaaattgttatttcattgagatacttccaattcaaatccagcatcacagggctcttccttacctttctccattccatatttgtatttcctttttccacagtgagaaccctcattctcatcaacatcaatatatttacttgttttgtcctataagttatacaaaatagttttagaatgtctacaccaaaaccactacaagcaacaaacttactaaagtacaagatattttataattctttttgtctttagaattcatcccactaaagttgtacagtcagagtgatatgttcaaaagttgcttgaattaatttctttttctctgtggtcatgttattaattcaatatataaataagttaatttgtgtttctatgcaatttgcttttttatccttttggattaaattttatttttgaatacataaaatttttacatcattggaaattcaaaattatagaaaaaataataaatccaagaagtctcactcccatgcctatcccttctacctggtctcacacatgtcctagttgtaactaattcctttagtttctgatatttcctttctttttcttttttgcacaaatcaatgtgtatatttttagttccacttgtttcatagtagcaaaaaataattatccatttaattttttggttcttgattttttcactaatgtatcttggaagtcaagcattttggattctgttaatatttttttcttattacaattgtgtatcatgcttaatgaaatttaaaataatattaaaatagaaaactctcttgtttatatccctagagttaactcatgattgaattttttatagattcttccagatagtttctttggatatatatgtatatagatgatttatgtatcctaaatcatatgcatttttcaaacttggaatcatactgtacgtactattctccaacctgatgttacttcacatgatatttatatctgtaacttctaattcttgacactatataactaaatcatatttttaaatactgtgaaatattccattgtgtggacttataataaaattaaaaccagtgctctgtttatggaaattagagttttatccctaggttttgctattgcaaaacaatgctgcgaggagtgccctattacatagatcttagtacactagaagagtaaacatttttgtaggctagattcctagaagtggaaatgttggataaagtttttatttaaattttgaaatgatactgacaaattgcccaccaatgtcactgtgccaattttgccaatctaaatccaaatgaaaaacatttcattgtttactaaaatccccaggttggctactatgagtatgttctttggattcaaataaccttaaaagtgtgtgtgtgtgtgtgtgtgtgtctgagacatagagagagagagagatcagcagcaaaacaatccatacagtgaaaatctctgcctattccattaagtttggcaacaaagaatggcagagaagagaatgtgagttaacaactaagttcattattattttggttgttctacaacatcaacatctgatatgattgaaatattaaagttccttatgacactggttctctttaaatgaaaaggtgtggataattaagctaattatttaatgaaagctggaaagtccgaaaacaattccatgggggatttcatccagctctgtagcatcttccaaatacagaagtcaccgagcttggtatcatgttggatttgttactgtccataaggttaaaggatgagagagaaggaagaataattgagccttctattaattttgatattgggatttatcccatccataagtacagccaagaactgcagtgaatgagctcctttctactctgttgttttggaatgaaaagatattttatctgccagagtggagacatgctttgaatgtctgttatttctgccaggtgagtttctatcataacccaactcatgtaggcacatcagtctaaagtgcatcccttgtggctttgctgacttctacaggtgtaatttgccctaaacgaagtatgtgctctgcaaaagcacacccttaatgcctactgtagtttggtccctggagaaagctagcacccagagatttcttagaatatgcatgactttcctagtctatgagaaggacactgaatatgcagttttaaacttccattcatattcctattcttgcctcatatttgcttccatatatttatttgagactgtcatagagaagcatgatattttgtgaggcttgcaccaggactattttctaaaagaaatgctttgacattcaatgaccttcccccaggctaagaagagtcaggccctgcctctctctgtgggtgtgagttatgagagctgtattgtaagtgtgctctccctaaatggttacagacaagaaacacatggttttaagaggcacccattaaacccttaagatgaatggcatgtatttggcatctctactttgtggagaaacaagacagtggtttcctgaaatcaaattctgccaaggattgtcttagaaatagggcatttattaattcaccaaacatgcaagcaaactaaatgcaagcaagcaaaataaaatgtcttatgatgggtccctctcagtgattcagaaattgaccagacatgcttttagccccccaagaaacaagtaaatcatagggggaagggagaaactaacatgcatcgagtgctcctatatgccaggcactttacatacattgtctcctaatacaaagacactgaggtaggtaggtccaactcttgttctccatatagggaaactgaggcttagagtagctaaataatttgaccactctcttacatagctagtaattggcaaagccaggatttaaacccagatttgtctgaccccagagtcctgctcttaatcactcgtccatgttgtgcctttgtgtggacatcattagcctcattttaaagatgagaaaactgaagctcagggagggtgagtttatctgaggtccccaaccattaagtggaaaatttaggtttcagatgatcgactgattccaaagtttatgctctttccacaacaccatggatatgtcttatttacaactcttataaaaggcataatataataagagtcatataagaggcatggatatagttcatatcaaggagatattattttcagctgggtgtgagggtgattagggaaggcttcatgggacaggcatcatttgacattgactgtgaagactggattgggcagactggattgggaatagtgacgggggatggtattctgagcagaggttaaaataagagcaaatatgtggatgcataaagtgcaggatatttttgaatatcaagtggcctaaattgactggaggatagtataagattcaggtagttaggaaacatatttgttgagaaacaagtagctagacagatggtgttttgaatacctccacaattttaaaattataggatatatattgaatccagaaaggaaatgttggttaaggcgctttagattggaaggcagggggcaaggttgctgagacattctagctctgtgctagtgtttcttttttatttttatttttatttttttattattattatactttaatttttagggtacatgtgcacaatgtgcaggttagttacatatgtatacatgtgccatgctggtgtgctgcacccattaactcgtcatttagcattaggtatatctcctaatgctatccctcccccctccccccaccgcacaacagtccccagagtgtgatgctcgtgtttctgttcacatgctttacatttgctataataggaaggttcaatcaaagctttgttttcaattatgaaaatgttttgaatttaaaaaaaactgagtaaggcattaaccttaattaaaaatcagaataaagcttatttgtatcttcagcttcagggaattaatgatttttttttttttacagtaaaggaacttgtttctggtcttaacattaccagcgggtggcactgtaatacattccttctgcatctctgaagtagcgttttaccatctcatggctgtcttcagagtctgaaattagaaggaataacagctttatagtcaccatagtgtgattggtctaatctttgaacacatttactaagcaccacccccacaaccacgattcttcagtttttgagagctattctgcttaggttctcaccaaactacctctgaatcttttcatttttttcccaagaaggtgactgtgaggcatagctctcgttacttttcaagtagttcttcaaagttaggtattcaaaagccaaaggcaggagaagttatgagactggcaaattttacctttggcactccccctggctactttgcttttaatatctttgcttgtttcttgtgcatttcgccctccccaaggctaaagagaattcaaatgattcacaattttcttgacctttactcagaactttcctattctttgataggtgacagctagtttaatctttaaaccaatccagactgatacactgaaacactactgagcattcggtgttattggacacacctcttcctttttgacactctcttcttctgctctagtgacatcattttatcttggtcctatctgtatctttctggccattttttcccggtctccatcattatctcattttcctctctgtctcttaaaagtcgcttttctccagcattttctccttgttactcttttaacaaaccactccatacgtttccaaagtttctactcccttggtattaactatctaccctcttggtgcttctcagcagtgtctgcatattggaaccacccagggagcttttaaaccatattcctgtgcaagtaccactcccagagttactgatttatttgggctggggcctcggaatctgttggttttttgttcatctatttgttttaactacaaggtgattctaatgtacagccagggatgagaacccctgacctattgaggtttctagcaatccagtctttatgtctcctctgagttacatgcattattttccttctagacatcttcccttggctgtcccacaggcactttgaacttcaaaactcaatttttaatctatttaaattccacccttcttgtgtaccccatcttagttaaaattacattatcattctatttgggccagaatatatggtgtgactctcaaatctactgcaagtttccatattcagtaatcaccaagttctgcagtttgaattctcaaatatcttctaaactacctgtattagtcagagttttccagagggaaagaactaataggatagatgtatatatgaaagggagtctattaaggagaattgactcacacgatcacaaagtgaagtcccacgataggccatctgcaagctgaggaggaagtcagtagtggctcagtccaagtccaaaagcctcaaaagcaagaaagccaacagtgcggccttcagtctgtggctgaaggcctgagagcctccagcaaatcactggtgtaagtccaagagtgcaaagtccaaagaacctggagtctgacgtccaagagtgggaagcatccagcaagggaaaaagatgaaagccagaagactcagcaagccagcttattccaccttcttccacctgctttgttctagttctgctggcagttgattggatggtgcccacccatactgagggtggatctgcctgtcaagtccactgactcaaatgttatctcctctggcaacaccctcaaagacacacccagaaacaagtactttaccagccatctggcgtccttcaatccaacaagttgatacctaatattaaccatcacaccactccagtcatgttttttttaaacaaattttgacttttattttagattcgggggtatacacgtgcaggtttgttacctaggtgtattgtgtgatgctaaggtttgtggtatatatggtcctgtcacccaggtagtgagcgtagtacctaataggtagtcaccccacacttcttcatcctatctgttgctgacctagttcagcctttcataatttcttccagcccttctacattactgcccattttccataatacttgcaaatggtgtttttacttgtttgcttgtttttagttatagatgtacagcaatttcaagcatttattccattgtctaatgaacatttgtagatcaactgctagatgcaagacctctacttatgaaataaaactcctttgactccctattgcatacaggataaaggtaaaatgccttgtagcatataatatatggcatacaagacccttaatttattccttagttcacttattcattcaatacttaaatattcaatggcctgtaataggtactatgctaatttttatataaatataaaaacacgtgtgctattatatatgtatgtataggtatatacatatgcatgtgtatacacacacacacacacgcacacacacaaacacacaattcatttaggctccaggcttctcagtcctatttttgtgcccctcagtcctatttttgtaccccttgccacacacctcttcacacaagagccatcctgagttatttatcattctgaaaaaagaactgttcatattcccagctctgagcattttatcttatgcttttcttcacatgtgaatcacttcccaccttctctgacttttgatactattcatctttgaagaaccatttcaaatgtcattttctctgtgtacctttcgttggattgcccccatcgacccacctcttccaggcagaattaattgtccttcctctgtgctcctgtagcattttgtttagacttctatactggaactggtcatattgtgatttagttatttgtacgtctgtcttttccaccatacctgggagctttttgaaggcaaaaattgtttcctcgattctctatacctggtagactgccttgtacataatagttgatctacgaatgtttattagataattgaatagatgcttgtggattactggcaccctagcagtctttaggagcagaacacatgtgattgaaagtcattaaacaaccttgaaaaactgagtatgccacctatcacagtttggaattgtggccagagcacagcctgcctactctcaggttttgctgttttgacaaggaggatttatcagtgcaatcagggcctttgaaactctatcctcatctgcagagcccacattcacatagactttatagtttataatgagattttaatgtctgaacaccacccacctcagtggtcagtgacttggcttatttaggattcatgtggtatgaactagctaagaacagagagcatggtgggctgggaaagggcaggccaattgctttctttcttttttttttatactttaagttttagggtacatgtgcacattgtgcaggttagttacatgttacatatgtatacatgtgacatgctggtgcactgcacccactaactcgtcatctagcgttaggtataactcccaatgctatccctcccccacccataacagtccccagagtgtgatattccccttcctgtgtccatgtgatctcattgttcagttcccacctatgagtgagaatatgcggtgtttggttttttgttcttgtgatagtttactgagaatgatgttttccaatttcatccatgtccataaaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttccagttctagatgcctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatgaccagtgatgacgagcattttttcatgtgtcttttggctgcataaatgtcttcttttgagaagtgtctgttcatgtccttcgcccactttttgataggattgtttgtttttttcttgtaaatttgtttgagttcattgtagattctggatattagccctttgtcagatgagtaggttgcaaaaattttctcccattttgtaggttgcctgttcactctgatggtcatttcttttgctgtgcagaagctctttagcttaattagatcccatttgtcaattttggcttttgttgacattgcttttggtgttttagacatgaagtccttgcccatgcctatgtcctgaatggtaatgcctaggttttcttctagggtttttatggttttaggtctaacgtttaagtctttaatccatgttgaactgatttttgtataaggtgtaatgaagggatccagtttcagctttgtacatatggctagccagttttcccagcaccatttattaaatagggaatcctttccccattgcttgtttttctcagttttgtcaaagatcagatagttgtagatatgcggcgttatttctgagggctctgttctgttctattgatctatatctctgttttggtacaagtaccatgctgttttggttactgtagccttgtagtatagtttgaagtcaggtagtgtgatgcctccagctttgttcttttggcttaggattgatttggcgatgtgggctcttttttggttccatatgaactttaaagtagttttttccaattctgtgaagaaaggctttggtagcttgatggggatggtattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaggcaattgtgaatgggagttcactcatgatttggctctctgtttgtctgttattggtgtataagaatgcttgtgatttttgtacattgattttgtatcctgagagtttgctgaagttgcttatcagcttaaggagattttgggctgagacagtggggttttctagatatacaatcatgtcatctgcaaacagggacaatttgacttcctcttttcctaattaaataccctttatttctttctcctgcctaattgccctggccagaacttccaacactatgttgaagaggagtgttgagagagggcatccctgtcttgtgccagttttcaaagggaatgcttccagtttttgcccattcagtatgatatcggctgtgggtttgtcatagatagctcttattattttgaaatacgtcccatcattacctaatttcttgagagtttttagcatgaagggttgttgaattttgtcaaaggctttttctgcatctattgagataatcatgtggtttttgtctttggctctgtttatatgctagattatttattgatttgcgtatattgaaccagccttgcatcccagggatgaagcccacttgatcatggtggataagctttttgatgtgcttctggattcgttttgccagtattttattgaggatttttgcttcaatattcatcaaggatattggtctaaaattctctttttttattgtgtctctgcctggctttggtatcagaattatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagatcctgttattggtctattcagagattcaacttcttcctggtttagttttgggagagtgtatgtgtcaaggaatttatccatttcttcatagattttctagtttatttgcgtagaggtgtttgtagtattctctgatggtagtttgtatttctgtgggatcggtggtgatatcccctttataattttttattgcgtctatttgattcttctctcttttcttctttattagtcttgctagcggtctatcaattttgttgatcctttcaaaaaaccagctcctggattcattaattttttgaagggttttttgtgtctctatttccttcagttctgctctgttcttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttaaatgcgtcccagagattctggtatgttgtgtctttgttctcattggtttcaaagaacatctttatttctgccttcatttcgttatgtacccagtggtcattcaggagcaggttgttcagtttccatgtagttgagcggttttgattgagattcttaatcctgagttctagtttgattgcactgtggtctgagagatagtttgttataatttctgttcttttacatttgctgaggagagctttacttccaagtatgtggtcaattttggtataggtgtggtgtggtgctgaaaaaaatgtatattctgtttatttggggtggagagttctgtagatgtctattaggtccacttggtgcagagctgagttcaattcctgggtatccttgttgactttctgtctctttgatctgtctaatgttgacagtggggtgttaaagtctcccattattattgtgtgggagtctaagtctctttgtaggtcactcaggacttgctttatgaatcttggtgctcctgtattgggtgcatatatatgtaggatagttagctcttcttgttgaattgatccctttaccattatgtaatggccttctttgtctctttcgatctctgttggtttaaagtctgttttatcagagactaggattgcaacccctgcctttttttgttttccatttgcttggtagatcttcctccatccttttattttgagtctatgtgtgtctctgcacgtgagatgggtttcctgaattcagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtctggatgatctttacattttggcatgattttgcagtggctggtaccagttgttcctttccatgtttagtgcttccttcaggagctcttttagggcagggctggtggtgacaaaatctctcagcctttgcttgtctgtaaaggattttatttctccttcacttatgaagcttagtttggctggatatgaaattctgggttgaaaattcttttctttaagaatgttgaatattggcccccactctcttctggcttatagagtttctgctgagagatccactgttagtctgatgggcttccctttgtgggcaacccgacctttctctctggctgcccttaacattttttccttcatttcaactttggtgaatctgacaattatgtgtcttggagtttatcttctcgaggagtatctttgtagcgttttctgtatttcctgaatctgaacattggcctgccttgctagattggggaagttctcctggataatatcctgcagagtgttttccaacttggttccattctccccgtcactttcagatacaccaatcagacgtagatttggtcttttcacatagtcccatatttcttggaggctttgctcatttctttttattcttttttctctaaacttctcttctctcttcatttcattcattttatcttccatcgctgataccctttcttccagttgatcacatcggctcttgaggcttctgcattcttcacgtagttctcgagccttggttttcagctccatcagctcctttaagcacttctctgtattggttattctagttatatattcaaaatttttttcaaagttttcaacttctttgcctttggtttgaatgtcctcccatagctcggagaaatttgatcatctgaagccttcttctctcagctcgtcaaagtcattctctgtccagctttgttccgttgctggtgaggaattgcgttcctttggaggaggagaggtgctctgctttttagagttcccagttttcctgttctgttttttccccatctttgtggttttatatacttttgatctttgatgatggtgatgtacagatgggtttttggtgtggatgtcctttctgtttgttagttttccttctaacagaccggaccctcagctgcaggtctgttggaataccctgccgtgtgaggtgtcactgtgcccctgctggggggtgcctcccagttagggtgctcagggttcaggggtcagggacccacttgaggaggcagtctgccggttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgtgctgtggtgggctctgcccagttcgagcttcatggctgctttgtttacctaatcaagcctaggcaatggcgggcgcccctcccccagcctcgctgccgccttgcagtttgatctcagactgctgtgccagcagtcagcgagactccgtggggtaggaccctccatgccagttgtgggatttaatctcgtggtgcgccgttttttaagctcgtcggaaaagcgcggtattcgggtgggagtgacccgattttccaggtgccctccgtcacccctttctttgactcggaaagggaactccctgaccccttgcgcttccccagtgaggcaatgcctcaccctgcttcggctcgcgcatggtgcgcgcacccactgacctgcgcccactgtctggcactccctagtgagatgaacccggtacctcagatggaaatgcagaaatcaccatcttctgcgttgctcacgctgacagctgtagaccagagctgttcctattcggccatcttggctcctccccccaaaattgctttctttttattaagagaaaatatcatctatacagcatggaattacaaaaagccttaagaaaatgctgtgtaaatgaacagccaaagtaccttcctgcaatctagaccgtgggatcccatatttaaacttatgcctgtgcaacaaaatattagacaaaacaataccagagggagaatggtggtgaacagtttttaaacctatgtagagtaaatatttgtggtagtgttttcctttacacagcatatgcagtagaatgacaatataaaggaagtagaaccccatttgtcaggggagtaggaaggcctgatttttatcagcatgcttctattggctacgtctaagttagcctttttatagagccactgcatctcatccttcctttttacttttgttcaaagtcgagtctcccagctctttgagctcttcctcagtcactctaatttctgctttgatagtagatcctagacttcttttacctctttccattttattcagtccctaagtgtcattcgcacatcctctgtgcttcacctaactacaacttggccaaagctgttgctactaatttcagtttacttagaattagttcaattgttcaattcccacttatgagtgagaacacatggacacaaggagaacaaggagaaaacatggacacagggaggggaacatcacccatggggcctgttgggggatgaggggcgagaggagggataacattaggtgaaacacctaatgtagatgacaggtcgatgggtgcagcaaaccaccatggcacgtgtatacctatgtaacaaacctgcatgttctgcacatgtatgtcagaacttaaagtttaataataaaaaaagaattcaattttcttaaagagctgatcaatttgtgcggagatgtataaaatctgattttgaactaaagaaacttaccttacatcctgattagatctttaatgtcataaaaatgtaaactgtacagtgaaggggcccttagcacacaattgtttaaaatccactacccgttgtgtacttttgtcccttccttttctagttgttccttcaagatatggactggagcccatgaatgacactaaaatgtggctcacctactcatcctgctgattaaaaaaataaacaggaaacacatcacttctggtgaatgtcatgaccaggatgttagataaaaacacccttaggggccttaacaatttgtggccagaatgacctttgtttttgcagttgtttttcagtctgcaaggggcctttccatttcctcttagaaggtatgaacactgaccacagcattttgaggcccaggctgtgcggcttaactctcttgcatacaagaacaaggaagagaataaacagttccgtttcctgggtaatcttaccttcctctttcctaatgttgttttaggatttttatctttgcacttttattccttgaattttatgatggggattgtcatattctctgacttttcatggattttattagaaatcacttgtatcatcaggcttcttggatctaccactttggatttggtgccctttttgctgctcttggtaagagctttgtctgccattttcacattcttgattatttatgctgctttgaatgtccgtttgagaaagtaatcagatttttttccctctgagaaagcaggggaatgatcttttgcatcactttgcataaaattaacatgttgattttctataaacccataggttcaggttaatttacataaacctggcattcaggaagctcaacctttacattgtcaaggaaaatgaaataaatcaggacagctgaaattaagtatattcaagccatcagaaaatggggtgggcaaagaggcgctatggggtagaaaatttcatagttccttatagttacactcacaaaatcttaatgtgttaagggaccagacaggtttttcaatccagccttttcccagtgtaggaatcccattgagagcacaccatgcaagtgatggtccagctgacagttacacttgcaaaacaaagtgcctagtaaagcagactctttactttggaatgcctttaattgttaggaaactaaaatctgttcttttgtgaactcctattaatgggtcttagctctgcctcctggaatcaatctaatccagtggttcttaatttggaatccctggacaaggcttaaatgagtccacaacccccctgaaactgtatgcaaaattgtatgtgtgggcatgtgtgagtgtatgcatgtatcgatagctttcataaaattttcaaagggacatatgatcctcaatcagggataactttataagcatacaatttgtgcagctgcactaagccccacacttaaaaggaatttgtacttggattaatgcttttctgttgccatcctgaaattcttaataatttttaaacatagagcccgaattttcattttgctctgggccctgcagattataggggaactacccccaaagacatgaagttattaaaaaaaaacactaaaatttctataaaatgaatcattggatagttctactttcaggaggcctgtaccatccttctgtttaccttctgaccttcttgtgtttccaaacattatcttcttgatttagaatgaaatgagggcagtctacttcctctttaaattctttccaatttcttccctgccctatatgaaagattcttaacttggaatattaacttggattcataacttggaatccatgcccattattttattttacaacttatctaatttatctatatagtatttcaaactttgaaaccaatttaacacaacaactgtattgtgtctgaagaaaattaaccatttttattaacactgggacagttcttatctttttatccttgggtatctgaaattagagcacagcgagttctgtcagagcaaaaaatatacttttaaagcaaatcattcagatgtatccaattcaattttactaacttctgtcttgcttcatatgaaagcttttaaattgatctctttctttgattgatcagggtctttccccctcacatataatactctcaataaatttaatacactgaaatgtatattctcataccaaataattcacttaatttataacatcaaatacagaaaaacttaatttaaaattttaattgcatattttatgtcagcatgttattaaaacgaagttcataacacattagtaattttattggagaagtacaagttcccctgagggtcaataggtaaatgtgttattactctttggtgaccttggactctgctgtgggaagaatgcaaatcatagccactctgaacaacgtgagaaagagaaagaaaataagctctaggacgaaagtttaaaagtactgcaattatttttccttggaataaagaagtctaaggataacctgaaacaaatgaggtatttttgatgaagaagagttgtcttctatattcaagagaaatagatgatttgagatttaggttgacatttgaagaaattttcttttaaactaatagaatcatgtcctgtgtaggttagagacttacttacctaaggcaaaggcttcagccagatgatatcttgaggttccttcaaattctaagtttccacccttgggcttaaaattccacttctgtgatacaccaaggctggcatggactcttttgctgatttgcctttcatcttggactcttcattttcattcttaattatgtgttgaacacatgtccctcctggggaagaatgagtttggaagtaatgaagttaatttgttgaatggctagaatgaccacccataaatatctaagtgaggattgtctctttcaccttcatcatctgggaggccaaaactgaaatatagttatttcaattttgttgtcattactcaaatgtttttgcatctattatttgagaactcccttcagaacccatggcataatctgggtaactccagtttggacctaacctttgagtgtgatttgcttctttaagatagccaacaacaacaaaataaccaacatacatttgcacccatatcttactaagtaggtcagtgtggtaatatattttctgtgaaaatcatgttataactgtaaggtaatagagggtttctttggcttgcaaacaaattggatatgaaggcacaattaggacagaaatttcaaaaaattacaatagatcctaaaactgtgctagttggtagactatatggctggtgactaacataggtgactgctttgttaactaaaggaaaatattcatcccaaatttaaaaatcaaaatagtctcattatatcatacatatacagccaatcaacagaatagaatcagagaataatggaatattagcttttgaaatctcttggagatcattttgtctaatgtcttcacctccacctctgtgattctcacattcgtgtttcagctgaagtttcattctgggaagactgtcagtggactcccaagaatagcttagattccttagtgcctgagtcagggcctaataaataatagctactcaataaatattcattgaatgaatgagtatatgaacatatttagaggtttggaagaagctagaagaagctggaagttacagtgtcttgaagttattatcataaatgttaataattattcaaaacagctaggggagaagaagtaatccggttgtatgagcattctgattgttgcaattctagttaaatgagatttttctataaacatatatgtaaagattgtcctatctcctcagatattaaaaagggttttatttttttaaggctatgtttggaatttgaaccaaattcgaatgtgactgcttcttgctcttataactgctaattgccaagcactgtatagaatcgtttggcctgacattgcttctgaaaggagctaaccatgctctggtaagaagggaccggatctatggaaaagaaatgctctgctgtatacctagctttcacctgatatacacttcacttcttgggatgtacacttgctgtatactgccctactgcacaatcttcctcacttttctccctgcctggcatagttgtacccatagaacagagacctgatctacttcagccacatgtaaagaatccatatggatcaagtgctggatgaagattctgtacaccttgattctagtcctgggaatatcactctatctatagcactgtggttaagtactttctgagccttagcattctcatgaaaaaaataatgaggggtttgggcttcatccaaattgttctcaaattgtcttctgtgcattcctaggggttcattggaggcacttctggggctaatacagaggtcagagaaagaagcagaatgacggggactttgggctcacccactccacttcaaccacagcagcttcacttttgtttgatatgcttctgtgaaatattttgtttgaaaaccatatgcactgacatggtgagagtgcataatagatataatttagtcattcaggtaggtgaaatgattccaccgactgtttcatgatccaatattatggctttttgtgttgctgattgaactgaatgatcatgcaacaatctgatcaattgctgtaagcagctatcttcttggccacctggctgcatctattcatgtcaactcagcagtagctttagattaaagatgtgaaaattatgagcccaggaatagaagagtctggctttccttctcatggagattgaggtgggggtatgtgaatagttctgggcaggactatatggagttctattaatagaccctccacctcacctacttttccttccctagacctggagctggactttctataaatgattgcctgcttatatactaaaagctaaattgatccaagtaagagtcacacccagggtacattttatcattttattatctctcatcctttcaaactcaatcgattgtttactataagaagcacgattagtgctcctaataggctgacaggaagacataaagtaccctagagatggaccagaaaagggggaaatacatttggtctgaaatatgagttttattttcaggtatccactgatctgtggttcaaagtgtgatgatttctcaatgggaatgacctgatttttttcttggattttgttactatttagcattgattgtgtgtagcattttccatttacctaatggctagaggtcatgcaaccagtcaccactctcattccagcgtcacagatgaggagccagaaacccaaggagaaactagtaagttggctctagctcatatgctaaattgatgcagaggtgcagggaaccaacatcaattttctaaaacccctaatgtacatctccttactggttccaatctcctcctgcagggacaccatacagtacaaataaacccttccactaagctagttggaggccttgattataaaatgtcagagtggggcttgtgccttgccctgatctttagggtcatctgaagagcttgcgctgtggcttgaccttatgggaataaagcagcaaatgctttaggcttcttgttgaaaacctgcaggagaagatgattggcagtacaattgttgtgacattgttcatttatgaagcatcagaagtgggtgtgtaggcatggcagagacactcaccaaaaattatttggttttgctggaataaagtgcatcttggattgcttataggaggattgtattcagggttcgtttgacaatctaacttccacactctgatttgcccaaaaagctgtggcagcactgtgtttggagttatggattatcagttttgtcagccaagatagcttctgttttcctcttcaactcaagggtcagcattctttgctcaaaaatatttaaatccattttaaagtgagcagaatgagggagcagaaggaaggcaaattgagacagagacaggaagggagtgggtagattatacgtagagttaatagttgctatgtgaaattcaagcttctaggtttatttgttcaataaatataaattaaacactcacttgtttgccagatgcatgcaagaggtaaaagattattaccttttgattctcttaactgacagaaacagtaaccttgaaagtccactcaggcattacccctatcctcttctttcaagacttccatgactaattgagcagtaggaaattgttcctgttccatttcaacttaattgtgaaaatttgttctcttcttgctgtaagatatgcttttatctatttgcacctgctcaatatacatgcattatttctgtgtaatgtgggtacctgttcggccaagttagataactaagaaagaggtaattgagggggccttgctctggagctgtacctacttagatttaaatctgatatatgcaataggtgactacctatgaaaccctgagcacattgctgaatcatcagtacttcttctctacagtgaagttatctactgggcaagagtcactgtaagaactagagaaaacatgtagaaagaataacctggggtgggggaagggggaagggaaagcattaggagatatacctaatgtaaatgacgagctagtgggtgcagcacaccaacatggcacatgtatacatatgtaacaaacctgcacgttgtgcacatgtaccctagaacttcaagtgtaataaaaaaaaattagccaggcgtggtggtgggcgcttgtagtaccagctactcgggaggctgaggcaggagaatggcgggaactcgagaggtggagcttgcagtgagctaagattgcgccactgcactccagcctgggcaacagagtgagactctgtctcaaaataaataaataataaataaataaataaataaataataaaaacttaaaaaaaaagaacatccacataggccttgctatatgacataatgctcaatagatggcagttgttttgttgttgtcatattctttagatcaacatttccttagttaccgtaaacaaaatcagaatgtgagagtagtcccaaagaggggtctttagttctgcttttctggtcagagagaacattttgtgtatttaagtttaaagggtaccaccagacagtaggttttattatttctcttatttcacttttccacttttccataactagcagtcatctgtagttttctttagtgcttaaggtgttatgaaatattcatatcattttatgaaaggctatttacacagaggaaccagatgtaaccgagtgtacatacaaatactggccttatttttcacgcttggtaagtagcgcataacttgaaagctaagagaagatactttttgttttggcaccaataattccagaagaagggcatcctattaaaaaaatctattgatctaagagggactagaaatttggctgaatattttagaaattgtttgtttgccctgagcttcaaaaactcatggcttagagtttcctgggaagggtagaatcactgaatagatagggtccagctagctaagtttcctggtcagcccctgaagaaagtttcattgcataaaaagcgtagatttgtcttcaaagttttccccaacactttatctctgaggttttctctattcatcttgagaataaagccctgttggtgaacataaatacactcccagagttgcttatcaggcaagacagaattgagcagttgggcctgaactctcccaccgtttaaaccaacgttctcaaggagttgttagagcaatttatgcttcccacatctgttcctagatgttatgacttgtttatggaagcaatgtaaataccaattctaacaacagctacaactaatactcaatgtttactccatgccagatcctgtgctgagcacttgacatgtaagacttccttcagtgcttgcaacaaccgtacaataggtgctacacgaaacagaagattctatggtcaaaaaaagctctagagcagtgggtagaaaaagttgaaggtgtttctctactataggatttaccaaggacttggagtgtgcagcttttccaagtgtattggagcatggaggcattttttctcctgtcttagtccatttgtatggctataaaggaataactgaggctgggtaatttataaagaaaaagaagtttatttggctcagggttctggagggcgttcaggaagcatggtgccaacatctgcttctggtgaggacatcaggcagcttccagtcatggcagaaggtgaatgggagttggcacgtgcacatcacacagccagagaggagaaaggagtggggggaggtgccaggctcttttttaacaatcagttcttgtgggaactaatagagtgagaactcactgattacctcaaggatggcaccaagccatttacgaggaatctgccctcatgatctaaacacctcccaccaggccccacctttgacactggagatcaaatttcaacatgagatttggtggggacaaatatccaaactatatcattccccaagggccatctggagagatggaacaccatttgggacatgctatcctatgagtttcttatggaacccatgcttattaactttggaaattggatcaaatttcaaaaatttctgtctttgccctggccttatcttgtccttaaataacccatactacctaatcttaaaacaacttataagtttatatatgtgtcctggagaactggatctatgttgcttatctaccaagtccaagccaccatcatccctcagctagactattacagtcacctcatactcattttcctgcttccattcttatcttcttgtaaactcctatctatgctgcagccaggttcgttctaaataacaaagaaacaacaaaaaaccaaaactgtgccacactactattttgcggcaaacctttgaagacttaccatcacattcaggatttgaacactgtaccatcacctacacaactatgcatgacctgaaccatgcccatctctccccgccaggctcctgctgctgtagccaaactgtcagttcttctagtgtttcagactaattcctgctcgaggcatattctaattccctctgtctgaaatattctgtcacccgtctttctattcctactcgtcctttgtttctttgcttaaatgctgttttctcagagaggttgtcactaaccacccccaaaattaggtgtacccagtttttgtgttcaataaagttaaagggattttttttacagtaggacttatcagggcctttgatatgttaacatgtattatgaatttcaagagggacatggagtatcctgcttttttttccttcagatcacttatcacaatgtttatttgtttaatggctatctccccactagactctgggttctatgagggcagaaatcatgcctctctactgatcctacacccccaacgcttaatgcagtacctggcacatggtaggggataagtgtatgtttgttgaatgaatgaggaaatgaatgtgattcttcctgctgctggactgcctttttacagtggggctgccatggaatgatttaatatttttcatataacctcttcctactaagattttcacctctcttgtttaacccaagtcacttttggaggaaaaactagaattatattcagcactgattggtaacagttgaggattaatgagagcaatacctggctcttatatttttaaatattaatcttttaaaattattgaatattttattaactattttaacttttttaatatttaaaatgatttccaattaatggaattctttaaaacagctttttaaattttaaaagttctagttcagagcaaaataacaaagtaagataatgcattacaactgttgtttcccaattagccatatctatgggaagcaatccttaggccatgaagtctaagcccaatgtgcgcctagtaccatctgaccttcaaagttggtccagagaccctgagagaaggaaatgcctttatgagtgctgagtctgcaaatccaaaaaccaacgtataagtacacgctaaatatgtgttggtagatttttatgtaagaccttggtggtgttatatatattctttcatctgatctttcttgttacttatgtaacacattttcattgctaccaagcaggattacaagttcaattgtgacctatggaacaaaatgactgactagaccttgtgatattttaaaccatgacgtggggtgcattaactgggtcctgcaaccaaatgaggcacatgcttacctaattttcagggtcctctgggccactttgagagggctagtgcaggtagagccagcaggataacagaacagtgtacagcccagaaggtcactttctggtagttggaaagggcaagctgtccagtgttagttctttgacaagagctgcccctaggtcagtgtacacacacataaaatgtgtgtgaaaagatgtagacaaaaggaattctctgggaggttattagtgtcagttacttgtcagttacatccaagggccacagcactgctggtatagcttccgttgagtttctgtgccatattttggttttacgggcaagcagccttcaccaggatatgctaaagagtcatcaatggattagtatcactaacaaaaggaagattcaacttaatgagagaaagtgtgcctcattaatggttgggaaattaagcagtcagtttctaatcaatgctaagtgatagaacttcagtggaggctaaagctcattagtagaatacacatagatggtaatgacctcaaaggtatttaaaatataggtgaaaagaactacattaataaggcaaatctattccacctgtccatgacttggctcactgttcccctgtgttatctgtatgtcatttggtacatttatttatgagaataaatttgcatttgtgtggcgcaattggttggtatgcttggctccaactctggagaataaatttgcctgataaaatatatggttttcaaatttctacatagataatggattatgagcaacacaataatttgctttcatgaaaaaagtctataggaagaattgacttataataagggctttgtttattcagtaactcatttattcaagaataattgccttgagggaaaaatggatagcaaacctaatgcaataaatgtttatttggaattgtatttaactatttcttccttttcttccttgtgaaatgctttctcaaatgtgatctgttaataaattatgccaatatcgccaagggccttgctgaagatgttcatattgaaatgttccaaaaatatgccttagtttccctggcagaaagccaatggtgacatcagagatggcatgactatacttcaaacaggacaatgcatatgacagccaacttactagctctattcttatcccacgcttgccaagctactgcaaaagcctcaagtggtaatgcataggtaatttgtaagtcttgtatctcctttctttcacctggccaatctgtcctccttaagaggcaacttgaagactacaacgaggagttttaataaaatcgtactctcctatcttctcttcctcttgcctatcctttaaaatttccttttcttgttcattcttctcagaaatcctcagttggttctggcatctttagtgaaaacagccagatgaggtgtttatcaattcctagggctccttttgttttcatttagataagaaactccccaagggtaagacctttatttcttgtttggcgaagtgcaacatttgttcacagctctctatccccgataaatggaattaggaaatatgtcttgaagtagagccaagcactgatacaaaggcatccagcctgctttccataccctttgcttaggagagtggtgctgtgacaataaatggcccctggtcatttgtaattggttaatgtccaggggtagagcaatttaaaagtctagagagcaaagtgtaagaatgattttggctcttttgaatatttccccaaccaagatcatcggtagattgtaagatctgcaatcagtagaggttccagatatttgcaggcttttaattaataaggctaaagaatggaatcaaccattttaggagctctgcaatggttaccatgtgtatcacattgcttaaagcagatgctgcctcttgtcacgtcagggcctagcttctccctgaagccttcttcccctcatcctgtctctgttagtttttcttctctgtcatcctctaccactttcatacttaccaggctctgggatttctttaaaggtctaccatgttggatgctcactgtcacctcagttgtgaaaacagactcatttatacctcaggacatatggctgttttggttaaactccaagggccttggtctatttatttgttggaatctttctagtttgttattaaatgacagacaagacaaatgaataccacctctgggtaaatttacaaattttaatgacatttctctccattaagttttgaccttaataagacagcagggaccttcatataataaagtagttcatgcattttgtttagctttatagacagaggaacaccagaagcattttctcttgaaaccaaaatgagctgtaagcaactgtactgagtctctagaaaggaattagttttgccagcgagagttgaaacaaggacgctactgctatgttctgagaccctgaattctgttccaaaatagataagactggatcttggcatctgactttttgttttttcagtggtagtctgttttgagtcacctatatctgtatggtaacgatagagtgaggagccataagtattcatccagacagaacaaggacctgaacagtcaggtcttctcaagcaccagatggctctattttacagaaaaggaaaacaatgcctagttaggtaaaacagccagaccagagtcactctgcaagttagaagtggaatcttgctctcttgcttgtgtgttactggttagcacatcactatcctgaagaacaattaataatatctcatttcttgccttaggagaagtcttttaaattactggtgcctcagtttcccttttatatagatgggacaaatgacatcatagtttattcactaatccattcagcaaaaatagtctaggtactacaaagacagccatatatcaaatgtagtccatatctggatatatgcactttttctatcaaaaagctacacacaaaaattacaatacaccttattttgcactgctatagagtttaggacaatgtactgtaagaggattatatatatatatatttattattattaaagttttagggtacatgtgcacaacatgcaggtttgtcacatatgtatacatgtgccatgttggtgtgctgcacccattaactcgtcatttagcattaggtatatctcctaatgctatccctcccccttccccccaccccacgacaggccctggtgtgtgatgttccccttcctgtgtccatgtgttctcagtgttcaattcccacctatgagtgagaatatgcgggtttctgtccttgcaatagtttgctgagaatgatggtttccagcttcctccatgtccctacaaaggacatgaactcatcattttttatggctgcacagtattccatggtgtatatgtgccacattttcttaatccaatctatcatcgttggacacttggcttggttccaagtctttgctattgtgaatagtgccgctataaacatacgtgtgcatgtgtctttatagcagcatgatttataatcctttgggtatatacccagtaatgggatggctgggtcaaatggtatttctagttctagatctctgaggaattgccacaccaacttccacaatggttgaactagtttacagtcccaccaacagtgtaaaagtgttcctatttctccacatcctctccagcacctgttgttttctgactttttaatgatcgccattctaactggtgtgattatatttttaacagtagaagcagactttgctggactctttcgagcccatgaaagaaaaatgtagggtgtacatgcacaggtataccctaaaactttttgaaaattgtgtataaacatacagtgttttcatctctttttcgtcatcatcccctgtcaagcatgcatcatgttcataccattgtacatgtgttaggaaaaaactggaccattcaaagattggcaagattggctggacccttcatcccattcttctatctttacctttcttcattctgtcactcctccttagaaccctctaccctgtctatccatatcagctttgtttttcaaggatccacttgagggaccaataggtttgtatttaggttatctgtagaggatcttaaatgcacataggacattacattttaaagttagctaactcttattttaaaggcacttgtcaagcactggccagtactcaggggtttgctgcatgatgggtcaccttcattgaggagcatttgcagaaacggactgccacacggtgataacttggctggactaaagcacacagatgtttgagctgttctttaatcatagatttaaatttcctattttcagagaattcactttggttataagaagaaccttgtagcaggaatggaccccagtcatccttttattggggaaaattttatgttttgaaaatgttaactaagccataaaacattcagccatccagtttttaggactgaaatatgggaatcatttctggatttagctctgcctttgtaattcagctcccccaatattagagcagcctccatatgtcccaattaagtggccaaagcttggcttctgtggattgattccataatgcagaccgtaatagctcataatgactctgaaagaactgtctagccaatcttgccaaaactaaaattgcctttcatttttaatatccccaactgttctcaccctgttggggatagcaaatatatttgcatttggggggaacctcatatgcagctctgtggaaaacatggcacttctcgctgtgattttatgagctatatgtagccaagccatgcatatcgtgaacatatctgcacacagacttgccaggacctgtgattcttgcaagccttttcattgttcctcagaatttgtcagtaggaagttggtgaaatacatctgcccaccctcctccttatttgggagcagaattcataccaggcatttggtttcttcagactgtaattaacaactatggacttagaactatatcccccaccctagctggtagtataaacaggacacgtggacaatagcctgaccattcactagtcctgttatctagtgctgctaagactggttaaatgttctgacctgaaatataagtattttgccattctctattgttctgtaccatttattctagttgatgtcacttctgttcgtaacctatagaactctttgtagatgggagagagattttgactatctagaaatgagaggggtaattaatgcagtaaagacctttagaaggtgaaggggaatggggtccagagcccaggagggcgggctaaaaaaatagagacagttctttgattctaaaagtagggaaggaaaaaaagttgaggatacacgcaagataggtttgggtgacagtcaaggtgacttccattttgtaaactaagttagaggtaaggttgatcaactgagggggaaagggggagtgtaagagtaaaacttgagaaagtggctagaatttggatagatcctgcttttccccaaactaattgtctctatcagcaaggactgggccagctaccctgaaatgattctgccacgcagtgaccatattaaaaatcttgaaagcttcatcagtaaactgctttaatgagtagggctctgcagcactgatcccacaatatgagttggtcccattacaaactgataatgtccagcctcagctgggctctcactgtcactcaacaatccattgatgtgtcttggtctgctacttctgccattacacactaccttcactcccaataaatacattaggtggtaatacttgggctagaaaattttcagtgagatgattcctttgccatggcagggacctagcttgtgtgactatcacctaatctttagtgctaattgtgaaaaggcatgagtctttctggacttctgagggaagaaagtcttctattcttttcagttaaatcaactaggatgcaaagcagaatataatttctctctaaagtccagattcctttgccttttgtggggcagcaggagagagagagaaagagagagagagagagagagagcgagcacgagagcacatgacattcctatgagtgacattagtagaagagctagaatcttctaccataacaggaatatgtttatgtatggctaatggtttatatgaaatgaatgtgcatatgactaagggaagactttgagatgaaaaagtgagaaactttgggatgagtgaacttgtgatgaatctaatgggtggcctagcatcagaaccataacatgagtagtagccaggtgggccaggtagatatagcaggtcagatgaaatccacttttcagaatacgggactaatattgagctgaggtatttgaagaacaggcatccagatataatataatattagggattactgtgtttcaggcactgttctcagtaccttatctgtacagtattaactcatttaatcctcacaacagccctgtgaagtaggtactgcggttttcgttttgtttcgttttgagatggcgtctcactctgtcacccaagctggagtacaatggcctgatctcagattactgcaaccactgtctcccgggttcaaatgattctcctgcttcagcctcctgagtagctgggattacaggcgcccgccaccacacccggctaatttttgtatttttagtagagacggggtttcaccatgttggccagcatggtctcgaactcctgacctcaagtgatccgcccttctcagcctcccaaagtgctgggattacaggcatgagccactgcgcccagcaaagtaggtactgcttttatccactgaggagtggggagtgtaagtaaattgcccagagttacagggctaattaacagtagaactacatttcaagcccatgcatttaattgggaagactgtgaagaagctatcacctgtttttaaaagagaggggtaaagcaaattacacaaggttaaacagctaatggaactaacttgttcaggaacccaggtgttctgtgtgtaaggtattgttttgttactgcacccttagtactcaaagtatcagcagcattggcatcacttaggagcttattagaaatgcaggctctcagtacacttctcacacctgctgaatgcaagtgtgcatacagttatttgtgtgcatattaaagtttgaaaaacactgagctattacttcattggcactagtttgcgggacagatatttacaaatactgttagccaaaggcagaaactacatcccaattatccatctaagacagggaaagtatgaaatttggcagggtttgggggtggagttcacatagtaggaaacacagggatttgaatagttgaccagccagtattggagaggttagagttcagaggtaaataaaatgggattctacaggaaatgaagttctatgcagtaacttcatcacataagagttcctgactaagtgaggtatgtaggcaagcagtaccagaagctagccctcctagagctcctgttatttatttgtcaaagggcagagctggttttgaagtgaatctgacttttgcagtggttgcagcagggagggtcaaaggatagatttggcacaccgtctagttgatttttcagcttccctgtcctgggggaatcacagatttctctgctttaagtaaacttgatatgtgaatatctggatttataaaacagtaaaaattataggtgtggcaatctcagtttatagactttgtaactaaattattcattttattagagagcacatgatatgttgctttttaataatgagctcccctaacacatttaagacagaattcaattttcagccctgttaaaaattcaacctagtaaaaacatatacaatataagtaagctgcccttgcatgagccgggataatttgcctaagcaactgtgtaaaatggtctgaatgtttcctgaattcaggacaaataggattttggtatatgtcaccctttgaaagacaaaagaggtgctttctggagaacacactgctcttgactttaagcctccttcagttctgtttcacagtttttattcttcatggtctgttgaactgaacttgtgacttcaagtggttcactgaactgagatttattgcagtttgaggaaggaaacagtaaaataagaaggcagttttgctatttttgtacaagacctcctaagcaacatttcacaaaacacatggtttcaattacctctgtggcatccacccacccacccactcatccattcagccaatattgtccagtgtcactatgttagggctgggaatgcagcagtggacaagatacatacagtttctgctctttggagcttatagtctagggtgagatgcagccaggttaaccaggcagtttccagtagagtgtgattaacagctaggatgattgaactctgggctgtcatgagaacataaaaaagatgtctatgacccaaaccagctgcaatgaatagacagaaattatattagctatctgtggctgcataagaaattacccccaaaattagtgttttaaacaatatgtatttgttattccacagatttccatgagtcagacacctggtcatggtttaacttagtcgtctgcttcagtgtttctcattggttgcaatctagggattgaccagggctatagtcatctcaaagtttaactggggaatgatcaattctaagctcacttgcatgatggttggcaggattcagtttcttgtgggttgttggactgtgggcaccagttccttgacggctgttggctagaggctagcctcaattatttgccatggggccctttccatagggcagctgacaacatggcagctgggttcatcgaagtgggaaagtgagggagaaagaaaattccagcaagacagaaatcagtattttgtaaatgaatctaagaagtgacatctcatcagtttcgtcatatactgctccttagaaacaagtcactaggtccaactgtactcaaaggcaacagcccaacacccaaagaaaagagaaaaggtttatataaggatgtgactgtcaggaggcaggaaacattgagagccattttagaagctggctaccacagaaatgtcctcctgtacagagatgtaagttgtagctccttaatggctctgttgaactattcttagtctcattcttactcaaactcaaagtttgtcaccaggctaccctgcctccggttcatagtatattgtcatagtgttacctcgattggcatgaaaaatagttatcaactcccttatttcttcgatcatttcaatcataatggttgggagggtcaggaaaatgccttcggaaagcaaggatattggaacaagtacaaatttaatgccggctttcatgatatctgtctaagatttctggtaggccttttctctgagacacctgtttttaattagattattttgatttctatggcttattcaaggtgcctttagtaatggataatgtagaacaagtatatttgtccattgggatctggaaaaagcttgaaaaccagctctcaggaagagaggtatattagttagggtgagggctatacttctataagagactacaaaatagaatgacttaagtgagatgacaatctctctcttattctcactctgtagtccctctccctcctcatccccttccctgccttgctctcttctctctctcattacattatagctggtataggctggtagggaagttgtgctccatgcagtagttcaaagctccagataccttccattgttgttctgccatcatctagaccagcggtccccaaccttttttaccagggactggttttgtggaagacaatttttctgtggacttggtggggggatggtgtaggcatgattcaagtgcattacatttatcatgtactttatttctattattatttcattataatatgtaatgaaataattgaacaactcaccataatgtagaatcagtgggagccctgagcttgttttcctgcaactacatggtcccatctgggggtgatggagatagtaacacatcatcaggtattagattctcctaaggagcccacaacctagatccctcacatgcatgcacagttcacaatagggctcgcactcctatgagaatctaatcccgcccctgatctgacaggaggcggagttcaggcagtaataccagcaatgggaagcagctgtaaatgcagatgaagcttcgctcgcttgcccgccactcacctcctactgtgtggcttaggtcctaacaggccactgactggtactggttcacggcctggggcttgaggacccctgatttagaccacagattgatagattatggctggcagatcaaatctggcctgctgcctgcttttgtaaataaagtcgaattggaacacaaccagccccattcatttatatattatctatgtctactttagcactacaacaccagaactgagtagcttttgacagagaccttaccatctggccctttatagaacaagtttgccagcccctactctaggacatggtccttgtgtgcatgttttcattccagattgtgggaagagggatgggcaagagttcagagtaaataactatattttaagaaattgttgaggaagttgtatatatgacttttgctcagaagccattgatgagaactagtcatgtggccacatctggctgtaagggtgaaaggaaaacgcagtccctgattgggtggctttatattcagacagtactcatgacaagaggataatgtatactgatataccaatattattgacatttttcaattaaacaatctaatgtacagataagcaaatttactttcttaacgacacaggggtagtaagaagtactttctgacatcagcagaaaatataatagagttgagctgctagaaaaacaaaaacagttaaagaattgggctacatagagattgaagctagaatactattcagaatccagggcagcttcagagacctgaatatcgggataggtgattttcagaggacctactttctttctctcctcctgaaaactggctttctaattttgtacttggtatagcttttctctgtatccccttttcttcttactcttgtattttctccttatttttctcttgaccataatttcctcatgactctagttttacggcatggcatttcttgattgatcttttcagtctcacttctcaaggtcctctttgttcattgccttgttttcacattattaccctgttcacatttctaaaaggcagagtgaattctgtccagattgttgtcttcagagtttctggccacttttgcaatggcttcctgagggttaagaattacgcttgtttgtggcattggtgactacagagggtggggtcatttggtataaaagattataaaagatggctttcaagggctttcccttgaacaagggaatggatatgggcagttgacaggtttactataataccatagtcataagagctacagcctctcttaaacacttaatactgcccagggccgttatgtgtatctttttatttgtcataactaaagcttgtcagtctgctcttatttgtgaataagccaaatatcaccaattcttggcattatgtatttgtaaaaaacaattctttgaagtttgaggattcccctagtgtagatagctgctggcagttacaatttgttaatgaacatgaacctcttggtaggtttagctgtaatagagggactgagtaaaaactcaaacttcttagatgtttgagaaagttggatttataacttcacattttattgtgttcatcttatcacttcccacagcagcaattttcacctcaaaattctcttgcattgtaggaatgaaggcttagtgtgtggaaggcactgtgttgaatgctctacaatacatttatttaattttcacacaaatgttgcaaagtaggtaccaatattatccccattttacagttgaggaaactgaggtacagaaaggtcgagtgactttcctcaaagtcacagagctagtaagtggcaaagccagaattcaagctcgggtggtttgaattcagaggcaagtacttcacccccatagttcataaagcacttgagtatcccgtaccccaaattttctagtgacacagattgtaatctgttttggatcccttttctcctcataaactactttcaggaatgctctaagagctctgtgtttaccagctactgatgtctctagaaaaaccatcagagtccatcaagtaaactatgcatgttaaaaaatatttagtgatatgtattcatgatggatgctaaatcttccaacggagccatgaaggtccattggctaaatgaatgtgcttctagatttgtctaagtacttactgtctagcataaatagttcacattatcttggtaaatgcagagggttgattttcttagtacaggttatttatacagccacaaatagtcccagttggtaatgacttttgggtgagtaatatgggttttaagtcttttacaaatatatgaaattttatggtaagtatgcagtgttacattaatatacaactaatgtcagaatggcctttgctgggatagtaatgctgataaaaattttttttgaaaacattcaggctgcaaatataacagttggtctgcaaaatttgaatgtactccttatccctatttactctcatcttattctgtctataaattatgctctacccttcctttaacacctggtacaaaatgcacgtccaggaatccagtcccaattaacttcacctaatgcatcactccctccctatgtgctcttagcacctctagatacagttcatagagacatttgcttttgttttcatgttttttgtaagtggtcttaagtcacttcatgtatgtttgttttgtcacattatataaattgaattgtcttcatgatgtcaggaagagccgttgcaaacagaaggtgaacagtaaataatgttgactgactgcccttaaagaatagaaacatctgtttgcttcaggtcaagactcttagaatactcattgaatatggatttccttaatcacaaggacatgccaggaagaaggaaaggaaagcacttatagtttttacaacaaaaaacataaaaaaagaataaaacaaaatccctctctgtttgattttcttcatgcccactctgattgcttcagactgactgattaaggctgtccaacagtattttgtaaataagggataaagtcctcctacacattaatttcttgaaaagaatatatggagatttgggtgtttcattcctccttaaagttgccataatgctttgtagaatgtgctagtgcaccatcttgcttctgtggtcaggtgaagaagtgaacagggaggtggtggtggtgtatgtgtgtgtgtgtatagagtcttctgtcataatattgacccccttctgctgagatttgtgtgatccctgatttatcatcagaaattgatcacaagagtttatctgtataggagaaaaagcaaagccttggaattgaagcaaggaaattaagagctcagttttgcttgaactcataaattataaattatgaagggaagttgacaggcctgaatttggtatgatggagaagtattttagaaaagatcaatgaaattcataggtatttaatagagaagcatatggacaagcatggctccaaatccagaagctttggagggaaatgtcctggtgatcatagttctcctataccatccctggtcccgagctgtgtccaaagaattggctcaattattttctagctctaaggatgctggtctagcctaggaatgacctaaggagtcaactctgctggcttatttttgctctcttaagactagtttaagttaggatatccagtgccgtccttcaaacatgaaggcagaccaattaatctgccatccataggacacgggtttgtgtagttgatcaactataaaggactgggcattcttgatcttctactctttctcactaggtctcctttatgaccagtacaaccttatgcttggtcctgtgctcacagctctttgtgtgtttccactatcacagaatgtgttccattttacttggtaaaataattttttatgcaactagtaaatatagttagctatttatatgactgtttccttcatcagactgtcagctaaggacagggtcatgtcttattctcctctgtatcaccagcacctagtaaaaagcctgttcataaatgttctataaatggatgagcccaagctgtggcctaggtgaagttagttgcagtaatgaaaatagtaacagataactgatatttagcacttactaataccaggccttgcactgagcactgaaatgaactatatcacttaatcctcacaaactactctgtgtggagttatcatctacattcataagtgaaaacacagaggccgagagatgttaagtcatttgcccaaagacacacagctattaagtattagagtgaaaattcaaaccaagggatgtcagattccaaaccttcaacattacactgcctgctaggatgtcaatctcatgagaagaaaataagcttggcccatttggtggagagctcagagtgacttcaggtttctgaacccaatctagtttcatattagaacagactttaatccaaattatcccagaaatctggggacttactagtgaaatcagatttttttccagaagaggtagactactcctaatttggggataaggatgctagtgctagaagagacttatgtggcatggtggcatttggtttaaatagtttctttataattctccctcatcagactgcgtgttttctctgttatattttcctaatgtcagggattggacctctaagaataggtgaaaagtgtccctggcagaaggaatataacttatgatggtcttgaagtgaaaaggagcttggcataatcaagcagcacaaaagtggccagtgtggctggaacacagggactgagtggcagaaacgctagatgagcctgggggcaggagggttgtggtagtggtgaactaattcagagcctccacagtacttggggtgagtttagtgggacagtgttacgaatgaataaataataataggtggagattctcccttactctcagtgaagtaaatcccttgaatatattggacatggcctctttgttgaattatctgctataatggactgtgttctaaggaaatccagagtgcagtcaggccctgaattatactcagaatatcttcttaaagaacgtagtctctatgaaaaattcaggagtagagactttgggccaagattatacagttatatctacagagagatataaatatacagataatttaatgaaatgaaattatttaaactcaatatactctaatagatttattaggtatgttgaaacctttagtcgctaattacaacttaatgaaataacaacttaattcccgttcctactcccttctttttcaatctacagttcacatagcaaattattcatctaatggttaatcatctgactcctctattagactctgatgagatagcctgaggtttgaagaaaatgattcttgaaagacacaaggatttatgaaacccagggggctccaggcatctgagcttccttacttttctattgggaagatgggaaggtggggaggtcccacattttgtacttttctccacagaagcattggagggggaggagaaggtatgctgggaggtgacctggcaataaagggaatagaactaacaattactgaatgcataccatgagtcagccatcttacattcattatgccatttaactggcacaacaaccatttgatacaggtaccatttgttatcattttacacatgaggagatggagactcagaaaggctaagtgacttgcccaagctcatacagctagttaggttgtggagcatggaatctaataacgtgcaactgtgggtgcctgcaaagtttgctcttccaacttactctgtgcctgcttctcatttttcctaatacctgaattctccttgcctctcagattttcatcaggaggtggcttctcaatctggaaatcagggcccatgagggaggaaagctgtagtaaatatgctttggtgagcaactagcttttctatttccaggatatgaacatctcatcagctgaataaacttaaggttatttctgcccacccacccacctacactgtcactattgctacctgacacttcatgataacatcacccttcaggattctccaactgcacgaaatggaaccccagagataatttgaggctgagctcagaatttatgtaccatgtatcaaaaatgaaacgttttagtcaggtttcctgagacccgatagccccagctaaactggaggcgagagggaaatctttttgagtatggttggttagggaaagttcaagcctctgtagaacatgatggtgaaggacctttgacagcctaaggccagaataaaggcaatgggtgcttggagtcactaggattaatagttctttaaaggcggggaccaagttttgtttttcgtttctagcacctagtacagtgacttgcattaagtaggtgctcaacagatgtttattaaacattcaagtgtaaaattctataaaatattaatacttgaagataagtacctatttgttaataggcatcttttaaagtaattcaagctataagaacaaagtcaagaaagtatagtggtcctttgggggaatagctatgattaagagatagggaccctgacaatgatgttgcagagccctagatttttgccccaactctgccattaactggctgtgtgcccatggacaagtcacttgactactctatgccccatttgtcttatctgtaaaaatagagggtaaaatgttcctacaagtgttttattcatatgttcattattttatgcacataataaaaatacccaatattcatttagctcctcgcagattacagactcatgtatatcacctcgttgaagccttccacaatgtggtgaggtaaatattatctcagttttacagataaagaaactaaggttccggttatagaagtaattgtagaagactactgctaagtaagtcttttgcctcaaatccagtcctctttccaggtaccacagctcttttcacatagtaattagctgtatgtaaataatgcttcccaagtgcttgaaaaatcatttgttcccttaagtcttcaaacatctctcctccaattgtgtttgattgttaatttactcagcaaattcatttccaaatttcaagccagctgaagttgacttactaggaatttcacattctctaggtcataattaacaaggcttgcctttatttttctgcaataagccttggttttttggtgaaggaaatgcacatgccctgctggaagcttaggcagattatgaggggccgtactttttagcttagctagaaatggaatctatgtgggaattgaactacctctatttcagctaacagcagaaagtacacctgcctttgcttgtatgcagattcatatatattggtgcagatatgacattattaacaaacctgtacatgtacccttttagaatattttgtcttccattaatggaaaattaatatatccaatgacaaaatatcaaatctactactggatattttaacatatattatgacaaatcagattcccttaccactttgtactgttgggaatgagtcctcaaatgtaccctctttccctagggcatgacacactggctacattttcataatttaacaaagtataaagggactttggcagatatcaccgaatctgtcagatttaactgcttgtaaattcaattagtcgggggaaaaacagctctggagaatatatcaaaattcaattagtcagcaaatcgaggtttttagcctactcttttgggtaatctatcaaaagggaaagggtacttcacacttatgatcaactaattaaatgcattaggccctgatgggatagtttttaatattcaccaccctttcaagtctatttggccagaaaacctagtatgaaagagttccaacagtaggcgttatctaaacaagtgtatagaatgtctaattaaggtacaggctgaaggtgtttccttgccttcttcttttaattgattgaaagagcctggctctaaattttcaataccttttaataaccaatttaagtgttactgggatgataattttattgtacaccaaatactgctttcttttgaaaatcttatcactaatgaaggtgtttatagctattaactgattatagtagtgctccttcaaaaaatgggtttctagtgagctaatgatatatcttaagtgttttgaatgatgtttagaggaattacaatgtggagtgactaaaccagaggctgcaaacattgtatgggggtgttctttcaaagtaaatatgtcatttctgtgactcataacttaactttgagtagatttatcataggcttgctgtaattgaattgtttcaaggctgtattttcttttgtttgaaattcatcccacagtagtgcaaatgttaacaatattgttttgcttctttataatcacttgtcaccctccccactatttgggcaaacatttactgggaagctttactccctcatccctgaaaggagaggagtgtggcaggtcttgtcattctaagacagcagttaagaataacaacccatgaggaatggtctggattaatgtttttgccacttgcagctctgcaaatatccctgcttgctctctgactttggtgaagttacagcttctttcaattttggcttcctcatccatgaactcccaatctcatccagtttaacatttccattcctttttatctgttggcattcatatcatcacacagttgttcttacctttctttagtcttttgctttctatctgactgtctttgggtaaccttggtcttgtagtccttttcaccttgaaactggctcaccttatttttatctcctcatgccttctatttattaatgcaggacagcagagccacctgctttctaatatttgcgctaggcccttttttgatgacattgctttccagcctttctctctgtaatggggagacctttttatctgtcaagtgtcactaccctacaggggaataaatgaattgaaggcaacacagaaatataaattaaactaatttatacttatctgatttttaattagagcaggacacatcaaagtttgatctgtgggtggcaaatacatttatttactagatattgcatcaatttgttccctgcataacacatccagttgaactgtggtgtgactgagaggtggaatgatataggaagcaaggaaaatattatagaacacaggaattaagggattgttatcatctgagcagggaattggggaacattgaccttaaagttgttataatcagcctcaattatcaactctatctagggcagatctttcaaatccaagttagtttctctctggcttctagaacactcctgggctgcttttctgattggtaggtgcttggggaatacaaactaattttaatactagcctgccaaatttaattgagaaggaatatctgctactgaaaattaaaaatttgtaagatagatgattggttttggataatctgccctttcagattaaatgtatgcaatgaatttaacatgttataaggaagatctatatagcgcagtgcttaagaatgtatctctggattcaaataagttgaatttaaaccacaggtacactttggctctttgaccataggtaagctacctgtcactctaaacactgctgtagcagctcagacagtggtttttttttttccatagtgggctgttgagcctgtcccattcagagaagacactctgaaattttaagaataaaaagcctggataatggcaaacccactaactgatgtttcacagatgactgtaccaagaggtgctgaggcttcaaaagtaatttctataagtaaaaagcagagaatggggaaaagtagcctaacacctttgaaccagctcaacttctctcttttttcacacctcgcttgaatggtcatactgacgagtactttctatatgttacctctctcctgtccctttttctgtcacttgcactttgtcttctccgccattctcttcttacccatccctcttctgtgtgtattgcctttcccctactccccatattcctatctctgtgtctcctctatcattcatgactcttctctttttggcatgtgtaatattgaattcgagtttagttaaaatatttgttaacatcatcaaaacaaaacacttttatgtataaccgtgatcaagaaagtgaaaagataatgtacagaatgggaaaaatatttataaattatattgctaatcagatattagtatccagaatatataaagaactcttacaactcaacaatgaaaagataagggacacagctttaaaaaacagcaatggtcattgtttcaaagaagatacgtaaattgcaaacaatcctgtaaaaagatgctcaacatcattaatcatggaaatggaaattaaaaaaagcagtgaggtaccatttcacatctatttgtatagctataataataaaaaaaagaaacaaacagcaaagttgtggggaaattagaacactcctgcattgctggtggggatgttaattggttcagttactgtggaaagcagtttggcagtttctcaaaaggttaaacagagaattgccatatgacccagcaaatctgctcttagatatatatgtgaaagaactgaaaacagagactccaacaaatacatgtacagccatgtttgtagcagcactacttaaaattgccaaaaggtgcaaatgggccaaaagtttatcagtggataaatgggtaaacaaattatggtacatacatacaatggaatattatttagccgtaaaaggtaacgtacaatgtggacaaaccctgaaaacatgttatattaaagaagtcagatgcagatgtagaaggctacatattgtgtaatccacttatatgaaaatccagaataagcaaatccatagagacagaaagcagattagtagtttcaagggctaaggtgaggcagagatgataaagaaaatgcttaatggctatggggttttgcttagggattagtgaaaatgttgtgggactagactgagatgttctgggactagccttgtgaacgtactgaatgccactgaattgttcactttaaaatgtttgttatatgaatttcacttcaatacattttatgtacagatgtacatatactcatttgctgcgtaacatgggtcaatgatgaattacatataggatgatggtctcataaaattataatggatctgaaaaactcctatcatctagaaaagtcatagccataatagcacaatgcattcctcacctgcttgtgataatgctggtgtaaacaaacctactgcatcgccagtcatataaaagtatagcacatacaattatgtacagtacttaatgcttgatagtgattataaatgtctatgttactggtttatgtatttactatactctttatcattgttttagagtgtgctccttctacctataaaaaaaagtcaactgtaaaacagcctcaggtgggtccttcaggagatatgccagaaggcattgttatcataggagacaacagctctctgcgtgttattgtccactgtacctttcctatgttcaggtctgtttagatacacaaatactgacctttgtgttacaattgcctacaatattcagtacagtaacatgctgtatacatgtgtagcctaggagcaataggctgtaccatatgacctatctgtagtaggctataatctaggtttgtgtaagtacactctgtgaatacatgactgtatgcatgttctgagatatacacacacccattaaagctattgatcttgtgttttacctttatgtgacactttacctttaaagttctctttgtgtgcatgtgtacaggggttgggaagaagcagttcagtatcatttaataagggggagaaacccaaccccaagatacttgatgaaatctaaggaatacagtctaagtaacacctacctgctcctcccaccaatataagaagagctaaaatcattaatgcatgtatgtataggaaaataatgaaagacaaatatggcaaaatgaggtcagttcaaaggatttatctgtgtgctaagagatgagatagaggctagtggcatgagaaaagcaaaaatggaaataagaggaaaatgaataggtagaactgagggcaatgacctggctcattggaaaaaaaaaagattttttggtaaatattctgtattccaaccatgtctaatagggatttatgaagtgggggaggagacactggaagagagagagagtaaatatgaatgtatttgtattaaaatctctagaataaatgtagtcatataaatctctggaatacaaattttcacttcagtacttcactgtgcaaaatagtttctgaggcaatgaaggaacataccagggctattagagaaagctatgggattggcaaatcagtgagggaggacttgccagctttgaatgcctagtaagtttatttacagtatacccctgcttggtccatgaactgtagtcttaccacagaaatagctggaattttgagaaaaactgtttttgaagttataaatgatcagctgctgtaatactggcttataagaccagatagtgtggccacaagtgaaaagagaataacctaggaagttcccctcttctccatgagttgtcattaactgtttgattgttcccagcagtattataactctcccttttccctggagcagtctgccatttttgcaaagtgaggaccaatttaatggggtttacttaatggattgataaggctgaggggcaaaggtttgccacagggaataaattgatggttaatgtatttttgcctccaaggccagaaaggagacataatgaaaagagtgaagtgaaaagataagactagggtttaaacgacagcttgtggtcctctgcagatgattcatttctgctgcttggcatgtgctttagacctatatgtttacaaggacaaaaatgggaaaattactccctgatcctctatatatgtacaatatatataaggacctattcctaaggtccttgtaaatccctagcccttaaataaatatacatttgagagaaaatatcacaatatagatttaacattgtatggagtagggagtagaccagtaattttttttctcactgaacgaacatttaaaacattaatatcctcttgcatcactaagagcagtaagactgcaccatcccctggttattagtgttcatagcaagctgtgtgaatcttgttggcaaaactttactagcctttgtagcagcccctgacccaggggcatctctacaaatcccctttgacagctgttttcatatgcactgagaatagacaagaagaggtagattttgactgaaacaggaggcattttggtgagagttatttcaaggaattttattgggaggaactttttttcagattgataataaaaacaggtccataggcaaaagctttataacagtattttaatggcaaattaggtgtgtttgcatcagttctgtaagctttcaatgctggtgttttaggagacaaatgtcctactttcctacagaattgtccctggtgttactattggagagcaaattatgtactgcatgggccctgggatatctttaattagtcagtgacgaaagctgggaaatctttcaccaatattctttaactttcaggtttaggatggctctaacctggcctgggtaaagaataatggacttggtgaccctccaaggccacttccatttcagtgattctattacctacttctgtcaatatttctccacttcctcctcccctgcagaaatgagagaaatacaaagcaatttgtgatcagcttccctaacaagccccctacacagaccacgaatatgagctcaaagcacattacttgaaattgtttaaaatgtaatcccttccaccttactcttgttttcactcaggacagagaacttgtttttgaaattcagactcttatttctatactcagaggcatgcaaccacaatcaagatggggtttggttgaattcaagttttttaaacctattcttcatgtataacatcacatctttttatgtgtatatatatatatatgtagaattatatgtgtaataaattacttcagttaagttgtgtgaggctagggtaggctgcagtaataatcaacactcacatttcagtggtttaacccaatagaagtttacttcttctgagagtccaggttgctttccagggaacccgtttccatatagtgactcaggggcttagactgctttgatctgatagtttcagcctcatctctgaaatgacatatgttcacttcccctcatgggccattggtcagaattaattacctggctttgcctaaatttaagggggcagagagaagccgagaaataagtcttccatgtttccagaaggagaggagaatttttgatataggtgaataatagggatatatacaagtttagtgaatgagtctgcttaagaaaattttgagactatggggtttttttagatataggatcatgacatctgcaaatagggatagtttgacttcctctctttctatttgggtgctctttatttctttctcttgcctgactgccctggccagaacttccaatactatgttgaatacgagtggtgagagagggcatcctggtttcatgccagttttcaaggggaatgcttccagcttttgcccattcagtatgatgttggctgtggatttgttatatacatggctctcattattttgagttatgttccttgatgtggtttggctctgtgtccccacacaaatctcactttgaattgtaataattcccacctgtcaagggtgggaccaggtggaaaaaattgaatcatgggggcagtttcccctatgctgttctcatggtaatgagtgagttctcaggagatctgatggttttataatgggcttccctcttccttcggctctcattccatctcctgccaccctgttaagtggtgccttttgctgtgattgtaagtttcttgaggtctccctagccatgcagaactgtgaatcaattcaacctcttttctttataaagtattctgtcttgcgtatttcttcatagcagtgtgagaatggactaataccttcctttaatgcctagtttattgaaagtttttaacatgaatagatgttgaattttctgaaagtctttgctgcatctactgagataatcgtgtggtttttgtctttagctctctttatgtgatgactgacatttgttgatttgcatatgttgaacaaagcttgcatcccagagataaagcctacttgatcatagtgaataagctttttgatgtgctgctggattcaatttgccagcattttgttgagaatttttgcattgatattcatcaagaatgttggcctgaagttttcttttgttgtagtatctctgcaaggttttggtaacagaatgatgctgacatcatgcaatgagttgggtaggagtcccttttcctcattttttgggaatattttcagtaagaatggtaccagctcttctttgcacatctggtagaattcagctgtgaatctatctggtcctgggctttttctcattggtaggctatttactactaattaagttttggagctcattattggtctgttcagtaaatcaatcttttcctggttcagtcttgggagggtatatgtatatgggaatttatccatttatacccagttttcttgtttgtgtgcatagagatgttcatactattctctgatggttgttggtatttctgtgggggtctgtaataatatccccttgtcatttctgattgtgtttttttgaatcttctcttttttcttcattactctagctagtagtctattttattttctattttttcaaaaaaaaaaaaaaaaaccagatcctggattagttgatcttttgaacggtttttgtgtctctatctccttcagttgagctctgactttgattatttcttgtcttctgatagtttgtcttagcccaaactcttcttaagctgataaacaacttcacaaagtctcaggatacaaaatcattgtgcaaaaatcactaatattcctatacaccaacaacagccaagccacgaaccaaatcaggaatgagcttctattcacaattgctaaaaaaaaaaaataataaaataaaatgcccaggaatacagctaactagggaggtgaaagagctctacaaggagaactataacccactactcaaagaaatcagagatgatacaaacaaatggaaaaacattccatgcctattgataggaagaatcaatattgttaaaatggccatactacccaaagcaatttatagattcaatgctatgcctattaaacaaccactgacattctttaccgaactagtgaaaactattttaaaattcatatggaatcaaaaaacagcctgaatagccaaggtaatcctaagaaaaaagagcaaagctagaagcatcacactagccgacttcaaactatactacaaggctacactaacaaaacatcatggtactagtataaaaacagacacatagtccaatggaagagaatagagaacccagaaataagaccacacacaactatctgatcttcgacaaacttaacacaaacaagcaatggggaaaagatttcctattcaataaatgttgctgggataaatgactaacgatatgcagaagattaaaactagatcccttccttacaccacatacaaagattaactaagatggattaaagacttaaatgtaaaatccagaactaaaaaacctggaagacaaaataggtaataccattcagaacatagatacggacaaggatttcatgattgaagacaccaaaagcaattgcaacaaaagcaaaaattgacaaattggatctaattaaactaaagagcttctgcacagcagaagaaactatcaacagagtaaacagataatctatggaatgaaaatatttgaaaactatgcatctgactaaggcctaatatctagaatctataaggggcttaaatcaacaagcaaaacacaaacaatcccgttaaaaaataggcaaagaacattagcagacacttctcaaaagaagacatacatccacccaacaagcatatgaaaaaaagcccaacatcactgattattagagaaatgcaaattaaaaccacaatgagataccatctcacaccagccaaaatggttattattaaaaagtcaaaaaataacagatgctggcaagtttgtggcaaaaaaggaacacttatacactattggtgggaatgtaaattagttcaaccattgtatgtgacagtgtgacacttcctcaaagacctaaaacagaaataccattagacccagcaatcccattactgggtatatacctgaaggaatagaaatcattctgttataaagacacacgcacatgtatgttcatttcatcactattcacaatagcaaagacatggaatcaacctaaatgctgacgaatgatagactggataaagaaaatgtggtacatatgccatggaatactatgcagccataaaaaacaagatcatttcctttgcaggggcatggatgcagctgaaggccattatccttagcaaactaatgcaagaacagaaaaccaaatattgcatgttttcacttatgattgggagctaaattatgagaacacatggacacatagaggggaacaagacacattggggcctatcagagggtggaggttgaaaggagggagaggatcaggaaaaataaataatgggtactaggtttaatacctgagtgatgaaataatctgtatagcaaaccctgtattacttcattgacagaacccccatgacagaagtttatctatgtaacaaacctgcacatgtacccctgaacttaaaagttaaaaaaaaaaaaaaaaaagaacattttgattccttcttttatggtctttatccaagggttcatacaaaaatgggaaggtaggcctatttatttgtaagttttcaaaactgaattgagctgagttgcctgaggagggggggcagacactcaatcaacaaacacattcttttttttaattattatactttaagttttagggtacatgtgtacaacgtgcaggtttgttacatatgtatacatgtgccatgttggtgtgctgcacccattaactcgtcatttagcgttaggtatctctcctaatgctatctcccccccccaccccacaacagtccccggtgtgtgatgttccccttcctgtgtccatgtgttctcattgttcaattcccacctatgagtgagaacatgtggtgtttggttttttgtcattgcgatagtttgctgcgaatgatggtttccagcttcatccatgtccctacaaaggacgtgaactcatcattgttatggctgcatagtattccatggtgtatatgtgccacattttcttaatccagtctatcattgttggacatttgggttggttccaagtctttgttattgtgaatagtgccacaataaacatatgtgtgcatgtgtctttatagcagcatgatttataatcctttgggtatatacccaataatgggatggctgggtcaaatggaatttctagttctagatccctgaggaatcgccacactgacttccacaatggttgaactagtttacagtcccaccaacagtgtaaaagtgttcctatttctccacatcctctccagcacctgttgtttcctgactttttaatgaccgccattctaactggtgtgagatagtatctcattgtggttttgatttacatttctctgatggccagtgatgatgagcatttttcttagtacctgatatggtttggctctgtgtccccacccatatgtcgacttgtcttccccatgtgtcaagggagggacctggtgggaagtgatgggatcatgaggatggatttccccccatgttgttctcatgatagtgagggagttctcacaagatctgctggttttaaaagtggcagtttcccctgtgtactctctctctcctgcagccatgtaagacgtggcttgtttccccttcaccttccaccgtgattgtaagtttcctgaggcctctccagccatgtggaactgtgagtcaattaaacctcttttgtttataaattatgcaatctcaggtagttctttatagcagtgtgaaaacggactaatacagtacccatggtatatgcagcctcaatttttgaaaaatgatttactgcaggattcttttaagttaagagtcagcaaacatttttctgttaagggccagatagtacatatcttcagttttgtaggccatacagtctctgtgacaactatttaacttccattactgtgtgaaagtagccgttgacaataagtaaacgaataagcttagctatgttccaaacaaagtttgtttacaaaaacacatagtgggttgtagtttctgactcctgctttaaatagagagactcccttgtgaataagaaagtttaaagatacctgtttaccaaaaggtgagcaagagcagagaaattttaaaactaagtcagtgacagttcattagaaacaaagacaaaactactgtgaaataagccaatgtgaaaatagtttatcatttgtcacaagtgatttacattttgtatctaattatatgtgaacctgtaagttaagatgctcttgatcacaaggaatagaaaaaaattcaaactggcttatgcatataaatgtattggttcatgctatacaaaagttctgaaatagtctttatgtagtttcatcagagcctcaacatatttctctttcattatcttgactctgcctttttgctagcatcagctttgtcccctggctggccaacattaattggggctacttgctttcatagtcacatattggagaaagaatggatatctcttttttagccattgaacaaaagcactgtgctttctctgttttatgtgcccttaaaccaattaatgtagcaagggaatagcattactctgattgtctcataccaatctgggtattgggtgcattgctggagctagggttgaggtcaaacctatccagctgaaagactgaatgaatgtttaaaagcaactccattaccttccacaatgaccgcttcaccctgttgcaacttgtagcttcaccgtttcatcctgttgcaatttgttgtagcatatatgtgcagagaggtgggaaggccataggagaatttttattattagcaagaacctcaacccagagatctttgaatgtggataccatgttgtagcttttgctgaaagccatgtagacaccgcataatgtccctgatttgcctcagggaagatcagatttcttgctgggagtgatggtggtcacaaaggtcattggatatttctgtgtgctttctgcagatagtcatactggatataattaaggtatacaagaactgtggagaataaatatgttgttaggggaatgaacagctaatggtaagctgatatccagagtatcctgtactacatcaaaagatctcaatctgagtccattctaacagtattctatttctacattccattatgctatgcttatttttggttgccatatcttaaaacaatgcatcagagttgaagaatgtccagataaaattaccataggcatatctgtcacaaaatccagaatcagaagcaaatcgacattgttgggttttattagtgtcagtgatacaatggcatcgcaaattttccaatgtaattcagagagatccaagatgaacaaaaatattggggcttttcagtctggacaaataaatactgaaggaatatcattaaaacctataaaataagaaattaaacataaggtatacataaacatatttattaaattctaatatattaggacagatggacacatattttagctcaaaacaattttaaggcaaatgaaaagacatgcaccttcataaaatgagaaatcaggtcgtagaaataataagcacctccagcaattgctactagctgggcacatacccttgaaaaacaagttcatggtagttaaagactgatctgtctgtatcaaatgatgaagggcaatgaagatgttttgtagacatcctggaactttgagtttagcagcagtgagaacagctttgctgtaccttgaactatacccctttatggttcatgtagcaggactggtattttcttcttctaaatatctactttctttgcttgctgtacctgtttgtacctaaccttcaagctgttccattttaaaacactgtcagtccaactgcctgatgaactgagaagagcttaaaatggacaaagggcatgaacaggcactactcaaaagaagacattcatgtggccagcatatgaaaaaagtctcaacataactgatcattagagaagagcaaatcaaaaccacgatgagataccatctcataccagtcaggatggcaattattaaaaagtcaagaaacaacagatgctggtgaggttgcagagaaataggaacgcttttacactgttagtgggaatgtaagttagcttaaccactgtgggagacagtgtggcaattcctcaaagatctagaaccaggaatactatttgactgagcaatcccattactggacatatacccaaaggaatataaatcattctattacaaagatacatgcatgcgtatgttcattgcagcactattcacaatagcaaagacatggaatcagcccagatgcccatcaatgatagactggatgaagaaggcatggtgcatatacaccatggagtgctatgcagctataggagggagtgagatcatgttctttgcagggacacagatggagctggaagccattatccttagcaaaccaactcagaaacagaaaaccagacaccacatgttctcacttataagtgggaactgaagaatgagaacacatggacacagggaggggaacaacacacattggggcctcttggcagggcagagggagagagagcatcaggataaataaccaagggatgcggggtttaatacctaggtgatgagttaataggtacagcaaaccaccatgacatacgtttactgatgtaacaaacctgcacgtcctgcacatgaaacccagaacttaaaataaaaatttaaaaaaatgcatacaaatataattgaatagaatacctatacaaagatataaacatagaactgtgtaatttaacaaatacctttctttaagactcaaaaactcattctcaatatattattgaccataataatgctgcaattgtcaaagtctggattttcacacagataggtttgaaattcagccatgtattttgataagcgctattgtataggaattggagtgtactttcattcctgcttgcccttttgttctttctggacaatatccaaagcacagtatcttgctctaatagctattcttgactggatttctggcaacggcatttccttgcattgctcataggtgccttgtttagtgccctgcccatttttagtcctatctacttctaatcgtggtaaaagagggtgattgttcatagcagaggtaataaaacactatctgtaaagaggcaaatagtaaatacttcagggtcataggccatacagtctctattgcaattactcaactctgccattgtagcatgaaagcagccatgaatgatatataaatgaatgagctagctgtgtatcaataaaattttatttataaacaaaaatttgaattttatattattttcatttgtcatgaaatattctttaaaaaatttctaggtcattaaaaaatgtcaaaaatgtttttagctcatgggtcatatatagaaacatgggatgggctggatttggccagtaggagtagtttgtggaacacctagtttacagtgaggatattgagagggagacagggtctatgttttggctttgcttcaattcctttacttgtagtgctcttatattgtggaagtcagctttattttgtgttagctgtttcctcacttaaggtgataactctgtccatgtgttcaaaatgttaagtgagcctcaacttgaaagaactagaggaggtggtttctactttgtctctcatattgcttttccatagtatatgtttggaaactctgtaagaaagcagatcaaatattttctccatgcattgttttacagtaaaagcctgcatgtagcaccatgtgatgtacgagttgtctgcaaagattaaatcctaagtggacatacacaggacatgcatggaaaccagcagaatctgacgaatggatggtatagcaaggagcatatatgataatataatgcagagcatgcattctaatgaaatatattgttgccagtagcattattttgattacaaaaatataattaagtttaattgtaatggtaataataatgaaggagaaggtaagaaatagggaagccttcaagaacatagattccttctttgccatgctatggtaggatggtcatccccttatcagattgctattcacccagtatgaactggtgtaggcatttcagttatttgcagctgacatccattttgacagagccagtctccattgtgtttgaattggtacccatgatctattttgaaaatttaaatgtgtgttaatcaaaactgctagattgagtcttgcaatggagcataagaacaaagttgaagggtgaagtatcaccactgattgtagaaaatatttttaaaatgattaatttccaaaactgtggatgataaaatataaatatggtcagttttcagaaatattgcagatacatgtaacgtcctgttactaacccttggaaattctgataaaatgtaacacctcaggatgacacaaaaaattccaacttgccagaaaaaaagactgtaactgccaggggtggggtgcagtacagtcagactgtgtaaattaggaatgtgggttttcatgaccatgtaacaaaggaggtgaggtctcaggtgtttgtaaagtgaggttttggaattacagatccctaaggagagctggtacccttgaatttctaacctttaataaaagggtgaacaacaacaaaaaaatcctacccacagagaaatgacaaggaatttggctctttgcctgagatttggatggaaaaaaaaatctcctacagagatttgtaactataggcttacaattcgtttgtgtttggagtttcattttctatgatccccaaacttagaaggtagcaaaaaattggttctgagctagtgtctcccctgagtttcctggcagaagcagtcaaaagagcttttgaggaacatacagtacaggctacaaggtattgttgcagaaaaagtaaccctttataagacaaattcacaataaaatgttaccaacatgtgactaaacagttcaccctgatgaaagtcagtagacacaacaaacaatagaattatatccctaagaattagacatagcagaatagagatacaggagataattgaaaattaatgttcatcatagtgactgaaaagaagtcaaaatcctaagaattgaacaacaggctttgagaacaaaagatttacaacagaagaaaataaaagttttagaaaggaaaagtatgatttgatttgtgggctaattattggataatatggagctacagagattagtaaactgataaatagtctgaggcagtcactcacaatgcgacagagggatgaagggatggcaaaatatgagaggttaagagacacgcaaatgaaaagattcaacatatatctaaaaggggtgctaggatagcattaggagatatacctaatgttaaatgatgagttaatgggtgcagcacaccaacatggcacatgtatacatatgtaacaaacatgcacattgtgcacatgtaccctaaaacttaaagtataataaaaaaattagcatggtggaggagcaatattcaaagagataatggctaataattcttcaacactgatagaaaacccaatgcagatttaagaaactcagcaaacatcaagcatattacgtaaacaaaaggaatccacatgtgtaatgaaactggagagccccaaagaaaaatggataatgttaaaaaccaccaaaaaggcagatcatctataaaggagcagcaaatagagcaactatagacttcacaacaaaaataattgaggccattcttgttcatatggcaatgcaattttcccaacaccatttattgaatagggtgtctttttcccactgtatgtttttgttgactttgttgaagaccagttggctgtaagtatgtggcttcatttctgggttctctagtctattccattgatctatgtgtctattttttaaattatacttaaagttctgggatacatgtacagaatgtgcaggtttgctacataggtatacacgtgccatggtggtttgctgcacccatcaactcgtcaactacattaggtatttctcctaatgctatccctcccctagctccccaaccccgacaggccctggtgtgtgatgtttctctccctatgtccatgtgttctcattgttcagctaccacttatgagtgagaacatgtggtgtttggttttctgttcttgtgttagcttgctgggaatgatggtttccagctttatccatgtgcatgcaaaggacatgaactcatcctttttatggctgcatagtattccatggtgtatatgtgccacatttcctttatccagtctatcattgatggacagttgggtaggtttcaagtttttgctattgtgaatagtgccacaataaccatacgtgtacatgtgtctttatagttgaacgttttataatcctttgggtatatactcagtagtgggattgctgggccaaatggtatttctggttctagatccttgaggaatcaccacactgtcttccacaactggtgaactaatttacactcccaccaacagtgtaaaagcattcctatttctccacatcctctccaacatttgttgtttcctgactttttaaagattgccattctaactggtgtgagatggtatctcattgtggttttgatttgcatttctctaatgaccagtgatgatgagctatttttcatatgtttgttggctgcataaatgtcttctttttggaagtgtctgttcatatcctttgcccactttttgatggggttgtatgtttttttcttgtaaatgtatttaagttacttgtagattctggatattagccctttgtcaggtggatagatttcaaaaattttctcctattctctaggttgcctgttcactctgatgatagtttcttttgatgtgaagaagctctttagtttaattagattccatttgtcaattttgggttttgttgccattgcctttggtgttttaatcgtgaagtctttgtccatgcctatgtcctgaatggtattgcctaggttttcttctagggtttctatggttttaggtcttaggtttaagtctttaatccatcttgagtgaatttttgtaaaaggtgtcaggaagggatctggtttcagttttttacatatggctagccagttttcccaacaccatttataaaataaggaatcctttcccccatttcttgtttttgtcaggtttgtcaaagatcagagggtatgtggcaccatttctgaggcctctgttctgttccattggtctatatatctgttttggtaccagtaacatgctgttttggttactgtagccttgtagtatagattgaagtcaggtagcgtgatgcctctagctttgttctttttgcttaggattgtcttggctatatgggctcttttttagttccatgtgaaatttaaagtaattttttttctaattctgtgaagaaagtcagtgttagcttgatggggatagcattgaatctataaattactttgggcagtatggccattttcacaatattgattcttcctatccatgggcatggaatgtttttccatttgtaagtgtcctctcttatttccttgagttgtggtttttagttatccttaaagaggttcttcacatctcttgtaagttgtattcctaggtactttattctctctgtagcaattgtgaatgggagtttgctcatgatttggctctctgtttgtctattattggtgtataggaatgcttatgatttttgcacattgattttgtatcctgagactttgctgaagttgcttatcagcttaaggagatttttataccattaccatgctgttttggctgcgatagcctcatagtataatttgaagtcaagtaatgtgatgtttctacccttgttgtttttgctcaggactgttttggctattagggctcttttttgtctttatatggattttctatctctcatcatatacagaaaccaactcaaaatggattaaaaacttaaatgtaagacctgaaaattaaaaaaaaaaatcctagaataaaacctaggaaaaactcttctggacattggctttggcaaaaataattcatgactaagacctcaaaagtaaacccaataaaaataaaaatagacaaatgagatgtaattaaattaaaacgtttctgcacagaacaagaaataatcacagaatgaacagataacttgcaaaatgggagaaagcatctgacaaaggactaatatcaagcatttacaaggaactcaaatgtctcaataacaacaacaaaaacagccccattaaaaagtgggcaaaggatgtgaacagacattttaaaaacattcaaatggccaacaagcatatgaaaaaaataatcatcatcactaataatcagaaaatgccaattaaaactacaatgagataccattttatactagtcaaaatggatattattaaaaagtaaaaaataacggatcctggaaagattgcggagaacagggaatgcttatacaccactggtgagaatgtaaattaatacaacctttatggaaaacggtatgtagatttctttaagaactaaaaattgaactgccatttgatccagcaatcccactactaggtatctacccaaaggaaaataaatcatttgtataaaaagatgtttgtactcatatgttgattgcagtactattcacaacagcaaagatatgaaatcaacctaagtgtccatcaatggatgattggataaagaaaatttggtacatatgcaccatggaatactattcagccataaaaataaatcattttgcagcagaatgaattttgtttttggattttttttttttgcagcaacatggatggaacaggaggccattatcttaagtgaaataactcagaaagtaaaatactgcatgttctcacttataagtgtgagctaaataatgtgtatacatgggcatagcaagtggaataatagatattggagacttagaagggtgggaaggtagtgagggatgagaaattacttaatgggtagaatgttcactctttgggtgatggctacattaacagccctgacttcaccactacatagtatatccatgtaacaaaattgcacttgtagcccctaaatctataaaaataaagaaaaagaaaaagaatgagaccaaaagagaaaggaatattatcttcaagagctgaggaaaataacaatctagaacttctgtactgaatatcataaaagagtgtgagcaaaataaatgtaaatgtcactgaacactgaaataatttactactcatagacacttggtgaaagaactactaaaaatatatgtgctagtagaaagaaaattgaatccagaaagaagccagatgcatgaagcaatggtgaacagtgaaattggtaaatagaggtatatctaaataagaggtacatctaaataatgttgatgaaccacttacaggttacaagtatgatatggtttgaattatgtcccctcaaattcatatgtggaagtcctaagccccagtacctgtgtatttgaccttacatttggaaatatgtttgttgcagacataatgagttaagatgaggtaatctcatcttggatagggtgcgcacctaatacaacatgactgacgtccttataaaaaggggaactttggacacagagacattcacacatggaggatgtcatgtgaagattggagataagctgccacatacctgcaacaggaacaattagatgctaggggcagggcctagatatagatcttttcctaaagtctgcagagagagcacgggcctgttttcttaatcttagacttctagccttcagaactgtgagacaatacatttctgttgtttaagccactcagtttgtggtacattgttacagcagccctagcaaactaatataaaatacaaaatggatcaagacacttgaaaactgtaataggtaagtataatcagaattacattttctctaaggctcttgtattatagtctaggaggaggagtagagatgttgatcacctttagactttaagtcaagtatgcatgttaaaaatttaggagtaatcaacaaaattatttaaatagaatctgtatatccaaatcagtagaagaggacagaaggaaattgtaaaaacttcactcaatatgaagcaggaaggagaaaaaaagaagaaaataaaaagagtgataagtaagacatacaatggtagaaataaattcaagtataaaattaagttcaaaatgtaaaacaattaaattcatatgccaaaggtatagaagctcatatcaaaaattttttaacaaaattataaagctttagaaggctagtagggcttgatcatcgtcccaactattggttggagggttgttgagatttcacatgaatagttggaattttaacatgggagcaatattctaaccaaggggtgagcaaatgatagcccacagcccaaatagggcctgctgccttttttttttttttttttttttttgtacagcctgcaagctaagaatggattttacatatttttaactttgtattttagtttcatgggtacatatacaggtttgttatataggtaaagtcatgtcatgagggcatgttgtacagattattttgtcactcagctgctaagcatagtacccaatagtttttttttttatcttatccctcctcacactctgcaccttcaagtagaccccagtgtatgtttttccccaccatgtgtccatgtgttctcatcatttagctcccacttacaagtgagaacatgtggtatttggttttctgttcctgtgctagtttgctaaggataatggcctccagctccatcatgttcctgcaaaggacatggtctcgttcttttttatggttgcatagtatttcacggtgttcatattaaatttttaagattaactgtatgctcttgaccagggagaaatgtaaaacaacacagaataattgaaaataaatgaataaaagagatggatgagaaatatcaaccgaaagaaagccagcattacaatgatgatataaggaaaaaatatttaaagcaaaaagccttattagggacatggaaggtcactacttaatgataaaagacaaaactcactatgaagatatatattttaaacaagttagtctcaaatatataaagcaatatttgaaagaaatactaggaaacgttgaaatattcacactcatatttgaagactttttaaaaattaaactgaagtaatttattaaaataattttattatactttaagttttagggtacatgtgcacaatgtgcaggttagttacatatgtatacatgtgccatgctggtgtgctgcacccattaactcgtcatttagcattaggtgtatctcctaatgctatccctcccctcccccccaccccagaacagtccccagagtgtgatgttccccttcctgtgtccatgtgttctcattgttcaattcccatctatgagtgagaacatgtggtgtttggttttttgtccttgtgatagtttactgagaatgacgatttccaatttcatccatgtccctacaaaggacatgaactcatcattttttatggctgcatagtattccatggtgtatatgtgccacattttcttaatccagtctatcatcgttggacatttgggttggttccaagtctttgctattgtgaatagtgtcgcaataaacatacgtgtgcatgtgtctttatagcagcatgatttatagtcctttgggtatatacccagtaatgggatggctgggtcaaatggaatttctagttctagatccctgaggaatcgccacactgacttccacaatggttgaactagtttacagtcccaccaacagtgtaaaagtgttcctatttctccacatcctctccagcacctgttttttcctgactttttaatgatcaccattctaactggtgtgagatggtatctcattgtggttttgatttgcatttctctgatggccagtgatgatgagcattttttcatgtgtcttttggctgcataaatgtcttcttttgagaagtgtctgttcatatcctttgcccaatttttgatggggttgttttttcttgtaaatttgtttgagttcattgtagattctagatattagccctttgtcagatgagtaggttgcgaaaattttctcccattttgtaggttgtctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacatttaagtctttaatccatcttgaattaatttttgtataaggtgtaacagactttttttttgggatggagtctcactcctgtcatgcaggctggaatgcagtggcgcagtctctactcactgcagcctccacctcccaggttcaagtgattctcctttctcagcctcctgagtagatgggattacaggtgggcacaaccatgcccagctaatttttgtatttttagtagagacaggttttcaccatgttagccagtttggtctcgaactcctgacctcagtttatccacctgcctcggcctcccaaagtgctaggattaaaggtgtgggcctttaaaggcgcctggcctgtttgaagattttaacataactttcagtaatcaatatgcaaggagaaaaaaatcagtgcttatgttaaacagacttgatttaatggacataaatagaactctgggcccaataattacagaaaatattagagtaaaaataattaaagaaataattagagaaaatactttttcttttgagttacatgtgaaatatttctaaaaattgactgtgtactaggtgacaaatctcaaaaataccccaaagcctctataaacacctctttctctgaccacactgcaaagaaggtatgcatcagtttaaaaatagcaaaaagtccttgttaattttgaaattaaaaatactttgatgtaattcattggttaagaaaattttatgtgggaaattagaaaatatttagaattgaataatgatgacacagcatagcaaaacttgtgggatgctgccaatgtcagagttgaattttcagtgtagaatgtgtaagagaaggagaactaacagaagctgtgtccactttaagtagttagaaaaggaacaagatagttgattaaaaaagggaaggaaatagaagtagaaatgaatgaaatagaaaacaaagaaatgatagagaatcaacaaaaccagcatttggtctttgaaattattagtagacaagcataccaaaataaacttattgtaacactgattttacaaaaagacttgacaagtcatcagtattaagaatgaaaagggagatgctactgtagatacagtcaaatttaaaaacacagtaacaatatcttgaaaaactttgtacaataaataaatcatagaattgaacaaatggatactgtcatgcaaaaataaaatatattaaaagtgcctcaaggaagaataattaacctggataaatctagtacctacattaaagaaattgtatcaatagtcaaaaatctacatacaaaaaaatcaccaggcctagaggatttcacaaattagtttatcaaattttcaaagaacagataatctccattttatataacttcttcagagaattaaaaaagagggaaaattcccctgaactaattttcagagtctaatataatctttttacccaaacaagatagatacactttgagaaaaataaattacagattacctcacatacatggcagctaaatgtcataaatacaatatcagcaggttaaatccattaataagttttattaatgaaatactgcctcatgctgatctgaatttataccaaaaatatttaagaatggtttaactttttaaaaaattatttaatgtctttgataaccttaaagaaaaaagtaatataaccacctcaacagattaaaaaagcacttaatataattcaatataatttgattttaaaaactcctagcaaactcctagaaaactatacaaaaaacttttaaaattagataaatgttattgaccaaaaaccatttgagacaaagtaatcttgcctgctatcactacctctaagcaacaggaaataagaatagaaaaatgaaagttatgcgtattggaaagtaaacaacccaaaacttattgtgaaagaatgattgtcttgatataaatttaaaaataatattcaggaccgggcgcagtggcacacacctgtaatcccagcactttgcgaggccgaggtgggcggattgcctgaggttaggagttctagaccagcctggccaacatggtgaaaccccatctctactaaaaatatatgaaaacaacaacagcagcaacaacaaaaacaaaaaaccggggtagtggcatgcacctgtaatcccagctactcaggaggctgaggcaggggagttgcttaaactggtgaggtggaggttgcagtgagcagagatcataccactgcattccagcctgagtgacagcgagactctgtctcaaaataataataataataataataataatagtaataataataatcatgcaaactgttaaaactaaaaagagttcagcaacatttcttgataaaaaatagaaaatacaatactataaaacttctagaaaaacacataggaattcattttcatgacctaggattaagaaaagagttcatcataaaaattataaacttcttttctgggaaggacactgtgaagaggatgaaaaggcaagccacagactgggagaaatattggcaaatcacatatctaataaaggacttgaatccaaaatatataaagaattctcaaaactcaggaataaggaaaacaacagcctaatttaaaaatgggtaaaagatttaaacaaccacttcaccaaagtagacttatagttggcaaataaataaagtacatgaaaagatgctcaacattattagccaatagggaaatacaaattaaagccatgatgggatgtcactacatgcctatcaaaatggcaaaaataataattttaagaatacaattatcagtgctaggcagaatgcagagtagctgaaatttgcatacattttcagtaggaatgtaaaatggtacagctactctggaaaaacagtttggcagtttcttataaaactaaacatactacttccgtacaactgagcaattgcgcttttgggcatttatccaaaagaaatgaaaacttgtacacacaaacctgcatatgaatgtgtatagaagctttgtttctaataacccccaattggaaacaactcaaatttgcatcaacagatgaatggataaaacatattgtggtgtatctacatagtgggacactattcagcaataaaaaatgaacttttgattcatccatcaacttggatgaatcataaagacagtatgctaaatgaaagaagccagtctcaaaaggctgcatattgtatcattttgtttatatgacattctgaagaagataaaactacagtgacagagtggttgctagggtttaggagtagagggagagtgtgactacaaagggatggcatgaggtagtgttttggggtgatggaactgttctgtatcctgattctggtattggttacataaatctatacatatattaaaattcatagaactatataacaaaaagtcaattttactgtatattaatttaaaataaaatttaaaaatttaaaaattacttcataaaaaggaggatatgtacagtatcagaaggttgatcatacatcctagtgggcctcaaacaggcccactttatgcttttatcctggtgtaattattaatagtgtcaattgtagaattctgtttgaatggtaaattatatgcttatcctaaatatgaaactgtattcttactgtaaatatgaaaccattcattttaattttaaagtatacaagacaaaattaagaatgtattgcttttgattaccatttatatgtagtagcatggaaattgcatggaagagaaataaaatctttaggaagaaagggataacaaaagaatgggggcttcagctgacataaatatgacaaaattagaaataaaaaattcaaaaataaatataaggtggctctcaatggaaattccagaaaataagaaaatggtattttgattaacagcttatgtttatgttagaaccttgatcagttcttgaagcaaataggtgataaaaatggtggtcctcttggtttgctgaaaagtgaaatgatatgtgctgatgtcacatatcctctgactgttcctgatgaacctacctcattgtctgatgtccatgaatggcagttgctatagaagtctgtgcatggcagttatatgaacaataaccattgtgacaaagggaaccactattaccctaatggaaagagagaaattagagacacagtagccacacaaaactaaaatatattaaatattagtgttgtctacttctttaatggggaaaaagagcatatcattagtgtcaagcgcatcccacagtaggctctctttagaagaataactcagtgcaataatgtgaattgctttgtctttgattttgaacatgattaaattggcaggcagtgggtgggagtatgttgttcaggatagaagtttgcataactggtaactgtagcatttttctcagacactatcattgtgtcaaactatgatgcacaatgatacacaatgctgtgatacacaagctgtgatacacgatgttagttatcattgtgtcaagatctcatccttaacatctgcagtgatttgtgctctctgcactaagtcaaaccttcttagcctggcatctaaaaccctccatattatggcccaccctatctatctaagctctcataccaatgtttcccatcacacaccatttactgtagtcatctgtctccttcattattctagaagcacactgagttctttctcccctcctcacatgttgttttccttaagtggaatgccctaacttctcttccacactaatctaaaccctgcaacactcaatccaaacctctctggtccatgaagcctttcttggctagatcaaccttcactgatctcctttgaactatgacacttactattatgaatacagatttatagtaatgacattttccattgtttgttgttgtttcaaatgtattactattctcttcctcagaagattatataggctattggcaaggcagtgctcatatctcataagtctttttgactccttgtagcgcatgatagatgctcaataaacatttctgactgacttgaatgcccattccaaattatgtttcactgttttaaacatcacaaactgatcacttttattgtcagctactcccagaacttcttttctctcctgtgattttcactctttagttaatcattgagtgttttagagatataagaccaaaacagtatatccaccatgaagtcattttacagttctatgcttctatctgcatttcctggtgctgctttctatcttataagaacacaacactaccaaaagcaaacatgacttcttaaagcaattttaaaaagtagcctcttgtcctccaagggagcttaacctctgctgaagaacaagaaattaacttcagattctgaccaaatttttgacaagagcctaaagttccttggaggaatggtataataatcatgcttgtggttgtagtgattgcaatgttagcaatcctggcctgaaaatatttttactgtaggcatagaacatgaacttttcagtaagccaaaaatagtgaatggtgatcattgatggaggtgaggataaaaggttagaaccagaattaaagtctcagctgaactcagagatacatgcaaaagttggatcagtacagctaggcagtcaagatctaagcaatggtacaggcatagcagagatcataaaagttctcaaaagaacaagaattctttaagttgaatcaacgtcatccagaaccattttatttacttcccatttgggcatgagcccatctcagttcaagtcagctcaaggccatggaaaactaaagtatgtgtcttaatctgctttgattgggaagtgtggaaccacaggaaaaaaaaatcacacttgcattccagcaaaagagcattctaacaacaataagaacagaatggtacaagcaatatgtatgtacaggatttacttgaggtgtgccacaatatattgtaaattggaatgcagaactgctttgtagacgactcaatgactattgattttgatactgctgaaataagaagttattcatgcgtataggttctgtctgatacaattcacagcccaattgattagcctccaataaatctgaaaaaaaggaggatggcaagctctgctttaaataatgaagaatcattacagcttattaagatattctggcatgaggactgaatctgtcttagcatttcttccagcatagaaagtaggcaatttgagaactagaatcatggtagaagggatgaatagatgacagttactgcccatgttgctctgctggtaatgcctggcaaggtaaacattcaagacctgtcagtgacttggcctttcagtcagtgagatgactatcaactctcactagtaaaggtgagaagtattttattattcatagacaccaagcagagcctatgtgttcatgaatcttttggctttgctctttttcttgttcttcttccagcctcatttttgctcttctacagctatcattgctcatgctattcttcctttccactctaaatactctctcactgcctgcctaacaattcaaattttactcatccttcaaggctcagcacaagtctgactgtcacataaagcactatttggtaattcccgtggactagttatgcttgttctgatcttctagttttcttttgcagtaaaatatcagtcagcattcagtcattgtaattttgtttctttcattcaaattgaagttgaatattgaaactcacacatatatttatctaatgcttccacagtgcctggcaccaccatagctacacagctataccatattcacacaccacatttgtttcagaatagggtcattgtagaatttattgtccaaaccaggatacttttgagtgtaaaagaggatgcccattaataattatcctggacttcctttgaaatgcttctaaaaataggataagctaatagatgggtagagagaggattaatgaacagatgtgtgataaagtgcagtaatatgctaatggcagattttaggtggtggtcgctgtaaaatcattttcaccatttgtgtatttttgaaagatttcatgagaaaatattgaaaaaatataattatgctgagacaacacaggtaaactgaaatgttatggtcaacccttgctcagagctgctgttattgacctcagagagaaaagtatgagtaggtagacagaggaaaaggagtgaatagaaagcagtgtagctaagtgggtgggtatagtataaactaacacatgaatttaacacctagaattaggtatctggctttaacatcaagacagttccaggccagatgtggtggctgatgcctgtaatcccagtgctttgggaggctgaggtgggaggattgcttgaggccaggagttcaagaccagcctggtcaacgtggtgagaccctacctctacaaaaaattaaaaaattagccagatgtggtggcacatgcctgtagtcctagctacttaggaggctgagaacagaggaccgcttcagccctggagtttgaggctgcagcgagctattattgcaccactgcattccatcctgggtgacagagcaagaccctgtctcttaaaacaaacaagaaagagtgacagttccatttgtctgataccgagaatgatgtagtttggttgataaggagcttttggccattctatttcaaatgggttctaagagggagcaatgatataaccaagggaggagaaccagtgagtaggagtcattatatgaacctccaacctggcacttatgtagcaccagacctctgtgaagcatgtctttgggaagcagaccttttggtttgttgatttcagtagcagtagttggcatatcaggtggtaagcctagaaacattcattgaaaagccccaagaaatgttggttctcttatttgttagtttgctttgcatggcagatgtgtttctgaaaggaaaatgtggattttatttatttttaaaaaaacaggctgtattttcctaaggtctaacccagtggttctcaaacttggcttcacattgtaatcatctagatcgttttatgacatactggtacctggggccacccccattggttttgatttataataactgcgtaaggagtgtggtctgggcatcaggatttaaaaaatctccccaagtgattctaaagtttgagaaccactgatttcactcttaaagatgctgacatatcttctatttgaaggagctcttgaccatatggattgctccccagtgaggctgaaactgttatggagagaacagggttgagtccctctttgtaggagagaaaggcaagtaagaaagaatcgtgtgaagttttgctctgtggatcaaaatttaaactacagcactacttctaccaattttcatgtcttttgtcttacctcctgcaatccatagtcatatatttaataatcattttatcatgatactatacccctaatttttccatcttgtatatttggatatttatttattggattttctcagattgaggtccacctgttgttttagagcattatatatctaattaggtcatgtaatgcaaaacacctgtcacctgactactgtcatgactaatggtgaaacactgctagatggggatggtgaggaacattgtactatcctgtttcacctgtttgatggaggtgtcttaggaagtgggtaaaagtagtattttactagaaactatcagcaggaagtagatagtaaacagtctattttaggcacctacatttttttcctccctcgatcaataagaccagtcactacttacattatctgttgcctatctgtaattgcttgcaacagtgacatgaacatcctttttgcagagttctagtacatggtttcaggtcatcagaacttgagtggtttggtcacttgtcaggtaggaatgtcattgggtagacaatgtatttgatttgctggtgaggacactgattttaaaagtcattgcttatttaacataaaatatcaactggagttgcattatgattttaatctttttgggatatcaattattagaacacaaaattgttgtctgttatattagtgtccattttacattatttttaatatgcccagaaaactgttagatttatctcctctatgtacgttttcaaagtaataacctgagctttaatggaattgggattcatatttgagaaaatgaagtctgtgatattatgaaaacccatttattctatctacctttcctttttgtttttcttttctttttttcatagcttagtttataattattgctctaaacctagtccgttatttatcggggaaactcaactctacgtttgattggccttggctttattcaatctaactataataatttgattttttttatataaaatattcaatcatgctttaccatatgatgaacttcatttatacataaaagctacttgctgttctacctttggaaattgttaaagaatctcagtaagggttttctagccatctgcttccctttgaaaccttgtgttaatgtagatatctacagtggtgactctagggttattaaactgcagtgtccagttaaatgccgttgttcataattatctagaactccagtctacattaagaaatcacttctattgttttgatatcaatgtgtcttaaagtggactttctagttttactgcatggaggcatatacctatctcacatgcatctgtctttccagtggggtacctctctttaagagagccattgtaataagattcatacttaccaaacataatagttgtggtgcaactaatcacattattaaagtcgtcttcactttgttagaaataattctccatgatagttctttaaattggagtttctctagtacatttaagcatctgtttataaatctgtaattgacagaaaataaaggaggtgagaaaaataagcccaagtgctataaactactgccaaccggtccagaaattgaaataaataatctctaatactgtaatataaatcaatggggaaatgatgcaatttacaaaaactcaatttagacttgaattttgtaaaacacattttttgcccagggtgatgaatatttgtatttggattaatggtatcgtaaatttttttaaacaaaagactatgtcttttggttaacaatttaactattttatctaaaggaaaatgtgtagtgagatatgaagtgaacctattgtctctagcctccacattaatttgtaataacatctataaatttttgtttgtaatatttataaacatttcacattttgatggtaataaacttaaaaacatgtcaaccagagagcaaagaagcaaaatcaagaagaagtttgttgttgttgttgtttcagcactgaggatcagtgaaatgacttaacatccatgaaatgataagttattcagttatgaaagtaacctccaagtactgcagttagttaggagcatcaattttgacattcagtgcaagaaaaaagtcacttttctataatgaaataatattgcagtaaatagtgagattcctgtaaacctgtaattcatggcactttgcacagctatcttgatctactgagtgaatttgtaagaaacagtaagagataattttctcattttgtgcagagtgtttccattctttctatgactaaatacagatctctgaactaaattataagcacagagtaatattcagggtacatgaggagaaaaagcaatttagtgaccgttttgtcattaaaaactgaagcaaaactcccaagcctgaaaaccacaaaatctgtttattgccagcataatcttggcagtgatgagttatattcacgttattcaatgagacaaaagaagggtcaactactttttcaaaaacattttacttgctttataagcatttggaaggacttactcctgtttcctcagggctttcactgaccttatatgttggggtatattctgaaagtgagtaactttgggaagttttagcagcctaaaggaaagaaagggcaaggctgggacaatattttcactgcactaaaggttgagtgtgtttgtacacatacaactgaattatgtttctctggccaattgtaaatggctcaagggtgaggctctcagtctttgatttatttggaatttcacaataatacagggctagctcatagtaggcactcagtaaatgtttgtttaatgacactgagaaaatgtgtcacatggtgtctgtacagtgccaagtccatagaaagcactcacagttgatttttttaatagtaaatgaagtcattcagttcttggatattttggttgactgtacatattccaaaggcatggattcaggttaagtgctcaccacttcagaaggtgcagctgacattttaaccccaaattgttaatacttaactctttcttacccccaagggaagccctttgacccatggtgatagagcctttccagaaagaaggaaaaactccatttgatatggccacagaatctggcaggaggattcacttttagatttcaaagacaagtagagaatatggaagtaacatgagttgaatttcaaaacaaatcgtgacttcaggtttaatgcatttcaacaccaattctagtgtctcttctgaatacagctgacctgcttggcatcagtttatatacctgttattctgcttatatgttttgtagaaatatagactgacaaactactgccgacttagaattctgcttgagaccagctcaagaagttaagcagtagctggtatgcttcattagaggatttaattggccttaaaatgcaatgagttgtgtgtgtgtgtgtttactctctttactccgagtgcttcttttcaatgttcttaaatatacagtaatatatatttcaaagttattattgcacttatgttccctctttgaggccacttatttgcttcagaccttttttctgcctttttgattttggtttcaaactatttttttttttgcatttttattatccctctacaaaggtaattgaaattggtttggagagccttttaaagaccacttttttcaagctcagaatttacctccctgtgattgaaaaccacagtagagtaatggagggaaagtaaacaccttggcttatatagtaataattaccactgcaaaaatgtaaaaattattaattcaaaaaacttcaaatgctctctggtcacacagtgtaaaattttaggactgcaggagagttcctatggtcatttggtacttcctgagccttctggaaatttaatagcctctgagcttttctttagcctgaggtgcaaaaggatcctgctgcttgcttcattgggcttgaaaatagtgggcagaaaaaaatcttgtgcaaacacagtatgcatagtctttcatatacagattactttgcagacttcctttcagtagaaagtgttagataactttcagtggttggataacttacactgaatcaatggcaccgtcttgtttgctgtccctttagaccacatatttttaagatgggtgacaggttcagagatacaggctagactggagagctaagtgaagaaatccaagcctaagcaggaagcaagcagacagctttggtctcattaatgcctattttcaagcagaaaacaacctcacctaaccaaagggaaagtgcgtggttcctgggttagggggtgttctatattgataaccagaatgcaggatgctgaatgagtgaaagtgtttgctgtacacaaagggatgggtggctgggtggagatggtgtcaggaggtaggaaagggtcagacactggtaaatatggatggaaaaaatgtggactgaatgtattttgaacaaatttgatcattttggggggagaaaataataaggataaccgcacttcaggagggaagaatattatgaactgtggattttgaatgcatttaaatatttatgaaaatattttctttagactttttttcaatattctggatagcaaagaaatgttctcaaactttatttcatttatttttgcaaatttctgctggaaggatttggcaatacaggcagcactgtactaggcttctcaaaacatagtaggttaattctcctgtgtgactttcatcaagtaacttatctttttgtgttttcaaccatgaatgtacttattattcaggctagctgtgagattaaacagtatatgctatttattcatttgtttagtcacttattcactcaacaaatatttatagagaggctaacgtgtgccagacacttcatagcacaatttattaattcagtgaatgtttattaagcacctactctatactgttagagcagtgaatataaatatattatagaggtctctctttttcaaatttctcattctctctgtgtcttttaaaactttacttttgatttctttatctagattttattataattaatttaaaaatctccttgaaagtaggcaagttatcagttatatataaataaataagacaatatatgtggaatcaatttaaaaagtgtaaatcagtgtatatatgtggagtggtgttactattatttatagtcacttatcacccttgatggggcaatgataaacagctcatagagaagcatagaatgactagatccccaccccctcccatagaaagtggcatagcaatagctggatggatcagaaagaatgtgacaaatagaaaaaaaaaagtttttcttccctctagtctgtcattccattttaccaaagctggtgtactttgggatagtgtgattgttaagcctccctgtgggttgcaagtatgcttttaactgtgactattgatgctgctgctacagaccccctctgattttcctttacgtgctttatgctgtgaagaggttttttaaaaagaaagatccatctctagctctctcccctttaatagggtagatcagattggttttgtagggctgagttttcaccagtactatagttgtactggagtcacatgcctgcagggagcccctgctgaattgtaaatgtgccaatccccagagtgtagctcagtgtacctctgcaagcagtcagtagtttttcattaagcagtgatttgattagataaaaataaaagttgcttgagcattcatttttgcagcagtgcataacaaatttatgcaaattcctgtgtcagtaatctgcattcaaaatataaaagtgtgattaccaagccatgtgcacctgtattgaagtttaatcaggtacaaatattaatggaaagaataaagcgtttaacaaaagtcacagctgttcgaggtttgtaaaatattgcaatgagagcgttagtacattaatgataattttagcattttcagattaagcaaaattttattttaaaggaaatcccaaataaggcaattctttagtggcacttgggaaatgcagagaaataagattgggctaaatgactcagctgtttaatagtgaaggtgtgatcaaactgtttgaaatatatattagagaacaggtatttattaagaattttaatgtattctcaaggacaactagaatgattctaggaagtaaatggatattttacacctagcatggtgtctagcatgtaatagatgctcaatataaatgtttgtaaaactttttccttcattcatgctgattcattgcgtaaatcatttaagatattgtaaaaggagtaatgtatcgacttccaagtttgtaaatgaaaggctgtgttttatattttacaatggtaagaaaacaaaacaataatatttattgaatgctaggaactgtgccggacacattacatacattcttttagttcattctcttaacaacttatatagtaatagcttacttttagagatggaggaactgagcctgaaataaatcaaatccatggccacaaatcatagctagtctgactccaaggtcctggtttttcctctgtatcacagaatacatattatcccataattatctcagataatgcatggttacttctaggagagcactggtgtaacttttggctacttgtataaaattcatctgataacctaagaatctaaatcagaacgccacaaaacttaaagcatgaatttccaaatgtagcaaaaatactatggtgaaggattgacctctgcaaatgtgatttttaaaataatattaattttttctcatctttagaatagtgatctgagtgacactggacaagagagaggctaaattgtgattttctacgtctctgtctcttacaatttgtagttgtatgggatgagtcagaactttttttctgaatattgttctttaaaattgaacataatcccatcttcattcatagcaggactaaaaactaaaaggtataatttaatgcttcaagttttccatcctgttcgtttttgggaatgaaagccccattcctgtttattttcaggggaaggacagagtgagaaagggggtcatttctgggcttaagtcagatgtggctttcgtgccttgatagaaataattcattcaattggagaaaaagtgatagccccaggattaagttattctgtaggccatagtggttcacagaatttggaagacctatatcaatccttagctcagaaatacagttttccagtccttagatctaacattttatccaggcatgcaaagctcaaatgatctggcttcaatttaccccttcagggatatctctggttagtctttacaacaaactgacactagccagactagtgtacttatcctttactgaaactttccttcttttctcatgtcttttttctccttttctgtcatgttttccctctacttgtctccattcctcactccacccagatatgaatcttttctttcaaggtccaactcaaatctcatctgctccatggagactttcttgaaacttcagctcaaagcaatcttcctttatgtgtattcctgtaacattctctgtctgtttcattgcctatgccttttcccttcctccttccctcctcccttcccttgcttgctttcctctttccttcaacaattactgagacagtgtctgccaaccagaacatatttgcttctgggaatacaatggtgcctcaggaagatacaggccctactcttacggaggtcacacttaaatgaagcagacaaccactgatcaaagaaacaatcaattgcttcctggaagtaaaagaatatggttcgaggagagtggatgacaaaggggccatatagactaagaaaactgacttagggaagggggacaggaaatgcctcctgaggaagtaataattaagctgtggtctaaagtttgagtagtcgttaaccaggctatggggtagagcctgcaaagagcattggaggcatgggaatggcatatggaaaggccctgtggaaagaggatgagtgtacttacatgactctttttttgttgttcatgttctctctcctcaaacatactgtacaatgcttttggatgtgaacgatgtgttgtatttatttttaccaaattcttttgaaaggactttaattatcattgagtgcaaacttcagcaggccctgagaaaagttcagtggtttactgaaggtcacacacatagagacatgggtctcctgtacaccccctcctcatgcccagtgttctttcattgaaatgattctttataattttgtgtaaatttagccaacatacatctggaataagtctctgcatgtggaagatggttcatttacaattggtaactgtgcggtcatgtatagaatagaggagagcaggaaggtacagaatcaaaaggtgtttcattacatggaaagttttataggacaaagaggtacatgttagggaggaaatttacatttgtaaaggaccatgctaactaagctttggaatgcatagggtaaggattcaatctttgaagaaaatctgtgtgaaataagatatgaaaaacattatgatgattagaattcagagagccttggatttaatcctgttccaaatacatttcttgaaactgaaagaaaaaaatgataataatttggtagtgctatatttgtgtgacaattctaaaatttggcctacaattttttgacatttccaaccactgacaggtatgggcttatgtcccttccacttgaatctagttgaccaaatagaatacagtgaaagtgacactgccagtttctgaacctaggtttcaagaatatggaagcttccacttcttcttttaggaagcttgctcttacaccctagccaacatgctgtgaaaaagccaaacttcccatgggaaggcctatatggggaacaacaatggcctcttgcccacagccctgggtgggattccagaacctaattatattcaatgtgaatgaaccatcttcagagtagatcctataatctttagttgagccaccccagcttagaattcagagagcagagaaaagctgtttctgccaagacttgccaaaaattgcagatttgtgaataaagtaaatcattgttctttgaagcaactaagttgtggagtggcttattcagcagtgattgataattaatagatttggggagatcattcagatctgctgagcactggaaagttagaaagatctcagttcttatatagggcccttcaattttagaaggagaaggcaaattgaggaaatcaagaacaatctgataaatggaaacaacaccaaaataaattcatcaatcagagggagcaattatggagtcccagggaaatataacagtaaggattttatttagagtgtgtgggtagaagatatagagaaactagataccaatgttaggattccaggagaataaagttaggaaatgtatgagaaggcataatttatttaagaacttagggaaaataggatagggccaaagaccaggtcaccagcagagatataagtactgaggtccttgaatatctggctgcacctggtagtgtctcttcctcaacctgactctggcttgaagtttagcccctgcatgcctagcccatctgcttccctacagggtcttgacacatactatgccaagcaccttgggggcactgagggtttcagtttatagtccatgtatctaaatttgaaaattaatgagaagatggtgaatagagtcaatatatttcaaaattgcatgtcagatatggaaataaagtttgaacttgtagtttaattatacatgtaattatctttcatttacatgcaatgtcaatttttccatgacctacttataggatgaagatgaactcatgtaatttagagttagagttgaccataaaacaagtctggagaagaatattcttagcttagaaagggtggaatatatgttcctttgagcttttgggtgaaattgtcatgactgaaattataaattaggtaagaaattatgccatgtctggtaccaagtagttcctgcctttgatgagcctatttatttcaatgggtgaatatatgtaatagattaagacaattgagaaatggataatgtataaatgcgttactgtaaacaaaatggtttcatgtttgatggctactttcatgtttgattaagttgggccttgggacatacaaccatttcatttctcataggtttaggaaagtttagtgttagcctgataggcaaaatggctgactgactaggaaaaaggcaatggaagatataatttttgagagtattttggaagaattgattcttctgagaactggatgatatttatacttttctgaggcttgctcgctagtgcaagtgctattctaaatggagtgctttgcagattccagacatatgccacattcatgttgtctagatgatgaatgacttattgatagtccaggctttgtactatttgagatggtagttcttttaatagccatgatgtcattgagataaaacttagtgggatagatgttattaatggtcaccattcagccttttatttgcaatgaagccaaagggcagttggagggggatgaggtcagcctgaatcactgattcccttgaagtcttctgtgtgttcccattttgggatcctgtgaaaaaacagaagccaaattgaacaccaccacattttggatgagtttccatttgaggagctccaaaaactcccacaagtcagattcagaagagttttcaggagattgccaaagactgtgcagtattgctggcaggaatagaaacaacaagcagatgttttagcagagtggagcccattctgagagactattcccgggcattcaatgaaagagactggagaggaggttagttcagaacaaagatgagagagcctgacttgggcgtgcacttgcctaaaaatagacttacaaatttaagagttccaaagcccctaaagtaacttcagatggatatagttgctaattaatctcttgaacttcacatgaaaactccatctggcactgtaatcttgtgacaacttgctattgttgtggtattggtttaatttggtttggctttcttcttttttggaaacacacttctccctgtgcttatcacagtttttaaaaacccaaattaaaaaaaaacccaaatagttaaaaattcatagctgctttcatcaccagctggttgcatgacctttgataagtcgccagattcactttcttcatatataagaggaagaaagtaaactagatggtattttaggtctattccaactctacaatcagttaatttatttgaacacaagctacaagattatgagcccgtaaaaccaatatttataaattttctcttcatttctgaccactgatgaaaatgggaagaatatagaattcctctacaaatggcagattaatcactttaacagtaagacagagctctgagggtgaaatttgcatgtatatcataactcagagatgtatttgttcagcaaatatttattgggcacaaactatatgataggtgctgtgctaggtgctggaaattccacagtgagaaaaacatatggttcctgccctcagggagtttaaaatctagttcagaaaaaacaaatattaaatactgtaatcatataattataagtgggactaagtgctaaggaaatgaataatagtgaacctggcctagtagggaataggggttagaatgaggtcatggaagatttgtctgaagaacatattccaaagtattacagtacccagtaccaaagaagtccacatggcagacttcattattgaaccagttgtttttgctctgttctatgactctaactccaggcagcgaaatcaaaatcctcactattagtccaaaatggacttgggctagaacaagtagatggatcagggaaaaccactgtttatgaacagaaacaaaattcagagaccacattatgtcatagcattggagggaccttttgtatgccagggttaatatgaatgcatacttattttacattttccacaaggagcataagatatattataatcttatggatgcttgtgaactgaccccaggagttatgatctgtgttcaaatctcgttatttaacctttctggaaaatatgagaagtaaatgaggtaatccatgggaagggtttagcacagtgcctgaacctagtaaaactcaataaatttttctattgttgttcctgttagtatttaacaaaacagcaatcacccccatctctctctttctgagtaatacataagaaagttaccagtttccaaataaccattcttccttatacttcctatcctgaataatgtaagttagcttgatcaaggaaaaacaggggttgaagcttctagggcttcctggaaaatttctatgggatgggggcaattcttgctatggttttgtgcagaaagaggctgaaggtaattcagagggaggttataaactaactttaaaggcactggagttgcttaccatttaaaataatgttgttttggtggtggtggtaatgttggcgtgagagtgtgtgtgtgtgtgtgtgtgagagagagagaggctctaattgattttgaaaaattataaaatgtatattcaattatcatttcttggattttgaaaaattacaaaatatatatttgattataatttcttggagttcataataaatagggttcacttattgtgacaagggccccactatccttctttgaaattatggctataatttagtttcctagtacaagctttgctcatgttaccttctcagtatgtaatcactcatgatggcaatcatctatttgagtcatgtcacatggtttagtggtgattgttactgtctgagaaaatatttagcatttagctaagtatagttctttctaggtatactatgggcctttgttaggtatactatggagcaagtaaatgtaacttaattgagttttctccctcaaagcaggtgtgggtgcgttttcttggtgtaggctcatgatcaccttcgttatctgcagctttgctaccaaatacttctctttagttcttggttgaacatggttctgtattccattgtgaaacaggggatctttttttgtggggggaatgcttgtgttctagcccttcagaattgtgtttctcctgcacagaccccttgaccaggtcatggtcttttcacatggattatggttataactttgctcatgtgccctgtatacataaaatgatttcccacccaaactcttctagcctagatacattcatcctagatgcttttactctatcattcaagttcccttcctggccagagtccttatcaataattcttaggctatactgggcttgtctacttgagtgtaagtttctaaaaaggaggccccacaatatcttttttttttttttggagagcccccattctccagtcctagcacatagctgagctctaagaagatgctcaacaagtacttaatgacttaaatcctatcctctgagacatttcaacataactcaatgaaagatcagaagaaacaatctacacgaggatttgtatcataatctcttcacagttatatatatatttggggagaggaagaagagcacattatagatccttatcagccatatccagagaaagctgttactttcttctgatcaccaaaccaagtatgggacctcagacagagctgggtttgaggtactctaaggtaatggaatcagtgtaaacactatctaaaacatccgagtatttttctttggtcctcacacctcaggattcctgaataacttatgtactaaaaatcagaaggccagaaaaattgatttgaatttattgtccagtgaacttgctttttgttaatttaagggcagtagtttgaagggtaagttttcctgaagactctgcattccttgacctaaagtctccattaggaacataaacaatacgactgtatgtactgtgttttgaaaccactataaatggctctaatgtgtgaatcaggttatagtttaatttttctttgctggatcagaggcacttgagaataaaacatatgcagctgcaggatattgaaatatttcatatgcatatatatgcagcatattttctagggaattttaccccttagcaaatctagccaattctttttcaattctatgacttaacattaccttttctttttgtttttattagcgttcaggttttagactatttgtttccacaaattgtattttattttggcttaataaataaagaaattgagttacttcaaagtacgttgtggatgtcatttggtagcagtggataaatggaaagttaaatgacttgctcaaggtccaaaagaaagtcagcagcagggcagagacaaaatttctgtcctttttgccaattgcctgtcagattcactctgctaatgaaactttttgcaacagaacagtcttccaatgtttccaaggagccagttaattaaccaaataaagagaatgatcatagcgatttttaaaatgtccatctctctcacatttttcccccaaatttcattttgagtgtggatcaaggaggtggtttttacaatttaaatatgattggcaccattgctgttaaatgaaaatgtggctactgggtattgaaatatattttttaaaattggtaatcaaaaaccttgttagcatttgtgcccatctcatgagaagttcatagtgctttaaaattaacattgattaaataatgaactgactggagagagaccatttataaaattggagatagggattagaggcagttgtggcaatttctctgccaggctaggaacgctcattaatgagctaagagggctggagaattcatgaagggcagtatcacagatgattactcccattacgatgaaattggtaggccaatggatatgacaatatgatatttatgattatatctggttatattattgtagaagttaaatctttctgtatggaaacagtttagcacttataatgtgtttttaataaaatactcgtgtgcaatggcattttataggaattgtaaatgttaaccagtagactgaattggataagaaatgcaaaggcagattactttcaaataaaaaggggtagagtgtcaaatatgagtttcattagctaattggtaatataacatgcttgtttcccttgagcacctgaaggccagaccaagctgcagaaatgttgaggtttaaacaagcattgagcatactatgctttacagcctgagtgatcacaagggttaggaaaccaggacacaatctatagtctcaacaaatcatttaaagtatcattgcttaaaagctcacctaatgtttgatttttccttcccacaatttatgtgtttattccaaatctaaccaaatctctgaaatgatcaacaatatcatactcacggtatcttgtaatagatgcaatattctgggcagagagtatcacaataatctcttctatctggaattacaagggaaagttatggactgctttcccagaggttgcttttttcactgatcttgtggcaaccctatgatacaggcaagggctattatcaccattttgtaggctaggacactgaggctccaagaggtgggaagtaaatgacagagtcaaaatgtgaacctatcataaaaacaaaaaaaaatccccaaactcgtcaggtactatgcttagtacctgagtgacgagataatctgtacaccaaatccacgagtcctgagtttacctatataacaaacatgcacatgtacccctgaacctaaaattaagaagttaaagtttttgagaaatgtgaacctagatgctctgcccccaagttcagtgtccattctatgatccatgaatgacacaaataacagaattgtagttaaaattctcaagtgaaagttgtgtcagaacttcaatttagagtccttttagatttttgttttcaaatgtttgaaaaaggcacggtctgaaaaataatattggtccccctaagtccccccaaaactgccccagtaggactattataaggccagattactagactagaatttactgggattactttgtattaaacccagagcaggtagaacttgatttaagtaaatgcaatgtaacaaaacccaaatttacaacctagataatataccaaagatttgctttaagtgacaatttcacttgtatgttttaatcagtttacaaaaatggataatccatctctggggactttgagggaaacacacatgttatgtaaagcggaattaacctatactatgcaagagtcatgtgaaagtgacaggttgttgttcaaactaaatcttacctcctgcttgtgtgattttttttggtatatctagagtaatatagcactcttccctaatattcatccactggcatttggcatctagttaattacaaatgattgtagatttttattattgaaacagcatctaacagatttacttgtgtgtgtttgtattgggatgtacaaggaaatgtgttgtttcgaaggaatgtaatgtgaggtgtcaggtgacaaagatgctttctagggcttttcacccaacttgttccttgttcaagataacttttatttaacttgcctccaaatcaagccctgaatatcatgcaacacaacagagagatcttctcataaagtagttgtcttttagactcatcttgaagtgtatggagtcattttaatagccatagggagttgggcctagtcccagcaaatgcccagttgaaaattttatggaagatggagtaagtctttttttgttcattgtactaatatttactgagcactcatatcagacactgttctaggtattgggcacataaaagtttaaaagcttggaaaaaaaattctgccctcatgtcacttacattttagtggaagaaacagaccattaccaagataaatatgtagaatatataaaacctgtacagagtgggaatgatcaaaagaaaaaagtgaaggaaggagattgaagtgtatggataaagttttagttaaaggggccagggaagacttcactgaggaggactcacatgaaggaagtgaaggaactagccatgtggatatttgggggaagaatatttcaagcagtggaagcatcaagtgcaaaggccctgagacgagagcatgcctggggtattagaggagaagcaatgaggccagtgtattcagaggggaatgaatgtaaacaagaagaaaagatgaggtcagagaggtaatcgggtaactgggtaggtcctggtaaaaatcttggtcttctatccaagagaaagagagagagagagagtgaagctctgacttatgttttaacaagagcattcacattgcaatgattgcaatagactaaagaggacaagagaagaagcagagagaacagttaggaggctactgcagtaatgctagtgaaagaagatgatggttctagatggtaataatcagagtagagctcttaagattttctgacagactgaatgtgggatatgagagaacaaaaggaatcaaagttttggggctgaatgcctacaaggatggcatttatgtgttagtgaaatggggaaagctgcaggaggagatttgggatgtgacaaacatcagagctctgtttggagtatgtttggtttgagttgcctattaaacgtctaagagaattgttgtataggctttaaatgtatgagtctggattcaagggagacattctgggtggatatgtaaattggagacataatcacatagatggtatttaaagccataagattgggtgaattcacctagaaattactacatatagacaaaaggaagatgtctggtgacatgagaaaaagattttaaagtagtatgcatataatgttctcttttcttgggaaaaagtgcttatagaaagaagaatggaaatatgtttaccaaaatcatctctgggtactaggaatattggtgattttcattttattattttatgtttttccatatttcccatattttctttaatgaaaatggattgcctttataaccagaaagcagaataaaacaataaataccattaagaaaagaagatttttatctagagttgttctccaatgtctaaaataaaacatttgtttgtgtacagtcccttccacatgcttacatcctcagatacccacagtgaacatgctgaaaaaaaggttatttgaatcaaattacacatgacatgattgggacttgccatcaaggactgacaatacagatgtttctgtccttacatggagttgaattaatagaactagataaaatgtgcctggacggtaaagaatatgaagacctggggacagttaaacccaacaggactacatccagccagaatagattgggacccttggggctgagtcaaaaatcacatcctttgggaaaagagaattaattgaatgcttgttctactctcttgtgacattcttttccctgaaggccttttgccttctttttctagtagctcccattcagggaacagggtatctgctagttcagcaagctactcttaaatgttaataacttattcttggccaatttttcacacataggaaagtgtatcatcttatcatgttgagttttaaagatcatataatttttttcttttgaacatagaagctctaacacttctctttgcattctcttcatctccccatttgattataataaggattaccctcccccttctctggtggtgactcagacatagctaaagggggcttttctcaaacttcttttggaaaagagaaaaccgtcagtgtttggcttgaggacaaaccgagaatattttagctaagatgtaggacggttgatacagttatgagtgactgaaaagggaattgtagtggaaaagccatttgcgttttgagctatggcatttgctactgtgttagcactttgttaaaagtgtgtaaatgcatggtaagttttttaagcagaaacttggaaaattggtacagaaatttatttttgcatatgcttgcctttccattaagcagtaagtgtaatcctctccctgatgatctgatgatctactttactttttccttttcttcctaagaatgccgtgacccaattccaaatgttttgttgcacaaatgagctatgttactccctcttctggactccaaatgtcagaccaggctccctccaatattctatgaattttggcgatttttgaaatcaaagttagaacagtagatataatctatattcacccccagcctcctgctgagacatacataccacatacacacgtgtgtacacacagaacacatgttgaaagaaagaaacttctacctttgtcttctactcttaatagcaaagattgagtcctaagacggcccacacttatatatgaatttagatcaacaatgtaatcaaaggcatcaaattgtaaacattctgcctagaactggacttgagatcttacagaatgaatacaggtcttggagttctgagatctgagtgtaaatcttgcatctgctacttgctagcagagcaaccactgacaaactacttaagcatttatttaattctaaggccttacatacttgttctgatggcaaccagtatcatgggggttgaagttagacctgattcaaatctactacttggacaatttgggttaagtgatttattgctttagactctgtttcattgcctatggaattaggataatacctgctttttcagggcttttgtgaggattaaacaagaaaatgtatacaatatgtctaggagcagcatttgggacatatggtatattaaaaattctctcattattattgttgttgttatttctcttcttagtagcacaaatattttcttacctgtgaaaaccagaggctttcactaagtcaagccaatagcaggagaaaaaaggtagaatttctcatttttcaatttttgtggatacatagtagatgtatatatttatggaatacatgagatgttgtgatacaggcatgcagtgtgaaatactcaactcatggaaaatggggtatccatcctgccaagcatttttccattgagtaacaaacaattcagttacactctttattttaaaatgtacagttattgttattgactatagtaatactgttgtgctatcaaatagcaggtcttactcaatctttctaactttttttgtgcccattaaccatctccacctccctcctatcccccacaacacttccttgcttctggtaaccacctttctatgtccatgaggacaatggttttgatttttagatcccacaaataagtgagaacctgctaagtttgtctttctgtgcctgcttatttcatttaacataatgatctccggttccatccatgttgttgcaaatgatggaatctcattctttttatattccattgtgtatatgtgccatatattctttatccattcatctgttgatggatacagatcccttccaaatattagctattgtaaacagtgctgcaacaaacatggaggtgtagatacttcttggatatacttatttcatttcatgtaggtatatacccagcagtgggattgctggatcatatggtagctcaatttttagttttttgaggaatcttcaaactgttctccataatggttgtactaatttacattcccactaacagtgcagaagggttcccttttctccacatcttcaccagcatttgttattgcctgtcttttgggtataagccattttaactggggtgaggtgatatctcattgcagttttgatttgcatttctctgattatcagtaatgttgagcacatttttatgtccctacttgccatttgtacgtcttcttttgagaaatgtctattcaaatattttacccatcttttgattggatttttagatttttttcctatagcatagtttgaactccttctattttctggttattaattgcttgtcagatggatagtttgaaaatattttctctcatgatgcgggtcgtatctttgttgattgtatcctttgttgtgctgaagctttttactgcaatgtgatcccatttgtccctatttgatttggttgcctatgcttgtggggtattactccagaaatttttgcccataccaatgtcctggagagttttccctaagttttcttgtagtagtttcatcgtttgaaggcttagatttaagtctttaatccattttgatttgatttttgtatacagtgagagatggggtctactttcattcttctccatatggatatccagttttcccagcagaatttatcgaagagattgccttttccccagtatgtgttcttggcatctttgtcaaaaatgagtttgctgtaggtgtgtggatttgtttctgggtgtattagtctgttctcacactgctaataaagacatacctgagactaggtaatttataaaagaaagagatttgattgactcacatttccacagggctggggaggcctcaggaaacttacagtcatggtggaaggggaagcaaacatatccttcttcacatggtggcaggaaggagaagtgcaaagcaaagagggaaatgccccttacaaaaccatcagtctcagaagaactcattcactatcacaagaacagcagcatgggggtaacagcccccatgatttaattacctccccccaggtccctcccatgacacatggggattatgggagataaaattcaaggtgagatttgggtggggacagagccaaaccatatcattctcctccggcccctcccaaatctcatgtcctttcatttcaaaacacaatcatgcctgcccaacagtcccccaaagtcttaactcattccaggattaacccaaaagtccatgtccaaagtctcatctgacacaaggcaagtcccttccacctatgagcctgtaaaatcaaaggcaaagttaattacttcgtagatacaatgggggtacaggcgttagataaatatacccattccaaatgggagaaattttggccaaaatgaaaggggctataggccccatgcaagtccaaaatccagcagggcagtcaaatcatctccttctctttctcctccttctccttcttctccttctccttcttctccttctccttctccttctccttctccttctccttctccttctccttctccttctccttctccttctccttctccttcttcttcttcttcttcttcttcttcttcttcttcttcttcttcttcttcttcttcttcctcctcctcctcttcttcttcttctttttttgagacagagtctcactctgtcacccaggctggagtgcaatggtgcaatctcagctcactgcaacctctgcctcctgggttcaagcaattgtcctgcctgagcctcccaagtagctgggattacaggtgcccaccaccacgcctggccaattttttgtatttttagtggtgacagggttttgctgtgttggccaggctggtctcaaactcctgacctcaggtgatccacctgcctcggcctcccaaagtgctaggattacaggcatgagccatcacacctggccagggaggtcaaatcctaaagctccaaaatgatctcctttgattccatgtctcaccttcatgtcatgatgatgcaagaggtgggctcccatggccttggacagctcctgtggctttgcagggtacagcccctctcctggctgccttcatgggctggcattgagtgtctgtggcttttccagacctacggtgcaagctgtcagtggatctaccattctggtgcctggaggacagtggccctcttctcacagctccactaggcagtaccccagtgggaactctgtggcagctctgaccccacatttcccttctgcacttccctagcagaggttctctatgggggctccacccctgaagaaaacttctgtctggccatctaggcatttccatacatcctctgaaatttagccagaggttcccaaacccttcctgatttctggtcaagaaggtttgagacttgcaccctctgaagcaacagcctgagctctgcattggccccttttagtcttggtgggatgcaggacaccaagtcctgagactacacaaagcagcaaggccctgggcctagcccaggaaaccattttttcctcctaggcctctgggcctgtgatgggagcagctgccatgaagacctctaacatgccctggaggcatcttccccattgttttggcaattagcatttggcttcttgttacttatgcaaatttctgcatctggcttgaatttctccccagaaaattgggttttcttttctcctgcattatcaggcctgcagatcttccaaactattctctgtcaccttttgaatgcttttctgcttagagatttcttccaccagataccctaaatcatctctctcaagttcaaagttccacagatctctagggcaggggcaaaaagccaccagtctctttactaaagcatagcaagggctacttttgctccagttcccaataagttcctcatctccatgtgagaccacctcagcctggacttcaatgtccatatcactatcaacattttgttcgaaaccattcaacaagtctctaggaagttccaaactttcccacatctgttttctgagacctccaagtctctaggaagttcaaactttcccacatttttctgtcttcttcttagctcttcaaattgttccaacctctgcctgttacccagttctaaagtcgcttccacatttgagggtatctttacagcagcaccccactctctgcaataccaaattactgtattaatctgttcttgcattgctaataaagacatgtcccagattgggtaatttataaaagaggaggcctcaggcaacttacaaacatggtagaagaggaagcaaacatgctcttcttcacatggcagcaggaaggagaagtgccaagcaaagagggaaaagccacttataaaaccatcatatctcaggagaactcactcactatcataagaaaagcagcatgggggtaactgcccccatgattcaattacctccccctgggtccctcctcccatgacacgtggggattatgagaactacaattcaagatgagatttgagtggggacacagtcaaaccatatcactgggttctctcttctgttccattggtctatgtatgtatgtttatgccagtatcatgctgttttggttactattgctctgtagtataatttgaagtcaggtaatatgattcctccagttttgttctttttgcttagaatagctttggctattatgggtcttctctggttccatataaattttaggatttttttttctatttctgtgaagaatgtcattggtattttgatagggatggcattgaatctgtagattgctttgggctgtatggacattttgacactactgatttttccaatctatgaacatggaattttttttcattttttggtgtcttctgcaatttctttcattagtgttttataattttcattatagagattttttacttctttggttaatttctaggtatttaattttatgtgtggttattgtaaatgggactacatttttatttctttttcacattgttcactgttggcatacagaaatgctactgatttttgtatattgattttgtatcctgaaattttacttaatttgtttataagttctaataattttcttgtggagtctttaggtttttccaaatgtaagatgatatcatctgcaaacaaggataatttgacttcttcctttccaatttggatgccctttatatcttcctcttgtctgattgctctatcatggacttccagtactatgttgaataacagtggtgatagtgggcatccttgtcatgttccagatcttagaggaaaggctttcagctttttctcattcagtatgatactagctgtgggtctgtcatatataacttttattatgttgaggtatgttccttctatccccatttttttgggggtttttatcatgaagcaatgtttaattttatcaaatgcttttacatcatcaattgaaatgatcactaggtttttatccttcattctgtcgatatgttgtatcacattcattcatttgcatatgttgaaccatccttgcatcccagggataaatcccacttggtcaggatgattaatttttctaatgtattgttgaattcagtttgatagtattctgttgaggatttttgcataaatgttcatcagagatattggtctgtagtttttttatatgtttttgtctggttttggtatcagggtaataatggtctcatagaatgaatttggaagtattccctcttcctgtattttttgtaatagtttgagtagaattggtattagttctttaaatgtttgatagaatttagcagtgaagccatcaggtcctgagctttttttgttttgttttgttttttactgggagactttttattatggattcaatcttgttacttgttattggtgtgttgatgttttgggtttcttcctggttcaatcttggtaggttgtatgtatctagggatttgtccatttcttctagattttccaatttatccaaaaaacgtttgaatcttctatattggtctgaattttaaaagaaatatcctgctgagcttttgtctaaataagaattaatatgttagtatttctaaaatgttccactttgtgcttttcttggtatggattcaagtttatagtggtaaacacatataaataaaggctgctgcctcctactctcctttatagagccattgtgaatggttaataagggtgattaacccttaaagacacacacaatgccccagcattttaaaaataacttgtattttagatttatctctggtctttgtgggagaaccctatgactctctcatgaaatacattttgggagtgaccatttacttgcactagtgagaattagagaccatactttgttttgtggaccttttcagctgtagtcaaagtaaaatgactgcagtgtcttgagtagaactgaaaattgaaagtacctgcatcagtggtattgatcctggaggacttcattcctcatacttccctaaaatatttgtcctctgtttctgaatgacagtcagggataccccctgaaaaatgctgcccattgagcatgggatatcatcttgatgaattatttcaaaactctatcaaagtgttttccaaatatctagtgatctaatgaggccattcaggtcctgattttcatccaggccttgtttttagatattagctgggaaaagtacagagtgaagactgactgtctgcattggcacagtcagagggatcttgtggctcagcagttattggctacctaactggaaatcaaaccaatatagcactttatcaagtatatgtagtagtaaccacaaataagtcaacattttattaagaggaaaggggttggggaaacaattggctcaatttgccttactgagatatagaaagcctgtcatagaggacctcttctaaaatatcaaggattcaaagccatcacttcaaagcttaaaagatttaagggaaaagataaaaatcctatgacttcccattggaataattcctggctggcctgcctgcctgcctgcctgcctgcctgcctgcctgcctttcttccctccttccctccttcctccctccctctcttcttcctttccttcctatttatatcagatatagaaattttccttgcaggttctatcttcattgatttctgtacacttttcccatagtatgacaccatcatcatgattaacatcattggatacttattatgtcctagacactgttctaagtaatttgcacatattgactgacttattcttagaaacctaaggaaggtactattcttgtggaggcacagagacacaatgtgcccaaagcttcccagctagtaaatggtgtagccaagattcaaagataaggaatctggtttcagactctgtgatgataactactgtgctattaactaccaacctcaaaagtacacatgaaaagatgatgcaaataagccgttattgttaggccaaggttcgtttctatttttgctttgttttttagtagtgcactgaacaatcaacagtctctcagatggcatttagctgtcccagtttacacatttgcagggtggctggccagtgcttaaggtgtgacttggaactgatgtggctggatgtcaaatcagtgaccttggcagatatttggatggagaatatttgcttgtcaggtgtaccctgtttgcttttcctccacagggttcatgtagaagtttccatagtgtaagacacattctccacttttttcctgaaaacctagtacatttcaggaaattagaaccagtgagtttctgggggccatccatcaggtgcaatatcaggtgctgatttgtcactgactggcaggctctttcccaattcaaagcatgagaggactccaaacttctttttgtggttggagtgcccctggaagttgattcatgttctcattgcaatttattttacattgcatcttggcataatgactttgactaaaagggatattttctgatgtctctgctttaatttagaaataaccaaactgatttttccaacatatctccaaaactgaagacacatgtgcctaggaaaacaggggtttctaatgaaaatgctgacacaatctcatgaatgctgaggtttttaacagtctgccattcagtaaactagtatttttgtgtcctatgaaaataccaaacatctgcttgcaatgagcgtacttaacaccttttgggtttctttttagctaagctgaatgcacttgggaatgagtgaaacttcagataacaccggcaaaaagtttgaaataaggaatttttatttgaaaaccattttgtaagcataatggtacccatagtacaaattacaaacaccattcaaaacaacatggtagcaagatgttttcaaatggtgcaaagtccctgctcacaggtgtgaacgccagcaatgggcctgtcagctaaggctggttagtagaataagtggcaagaaggtaaaatataattgaaactaagaggcaaaactttatattccagggttcaaaataaaggacaggaatcagaagctaaagtgaatgtcaaagcctaggtagacacagtgggacagttggcaaaagaaaacttaaagtatgtattttttaattttaaaattctttatttttaattgacataaaattgtattttacatgtcaattaaacaattttatatgtcaattaaaagtaacacgtacaacatgatgttttgaaataggtatacatcatggaatgtctcaatttagctaattaatacatgcatcacctcacatattattttttgtggtgagaacacttaaaatccactcagtgattttcaagatacaatatattgttataaagtatacatacctggttgtacaatatatctcttgaatgctttcctcctatctaattgagaaaagcatgtgtgattattagagttgcctaactagtcttcctgcctcaaccctttcccccaccctaattattttctacattgctaccagaatctttcctgaagaacatatcaaatgatgcctctcccctatagtaatcacctggaaacattcagtgattccctatagtatactgaaaaaggtttaaacttctttaagggttttcatgattgggacccaaactattctttcagccttctcaaacactgtttatatccctggacatctgatacttatgctcagtggttctaaattgggactggtggcatttggaattccgttgaggtgttttgggttgccaaaacaggtgaagaataatatgggtatttagtgatctggagcaagggatgtcaagcatcttgtgttgagcaaaacagacccttaccattttagacttgcccgatcaaaatgacaatagcactcttgttgagaagctgcaagtttctagctaaactggattgttttcagatcttcagagatagtgcatgctttcctagtaatgtacctttgcttctgctcttccttctccttgctatgcttgcctctttattcattgttacctgttgcattcccatcgatcctcagggtctagctttcccgaggaattcattcttctttcctaccagagttgctgagcatactgtggtatagtagaaaaagtagtaacatgagaatcaagacacccaaatctttgccctggtactgccactcaccaattgtgtgacattggcaagtggtttttcttctctgagccttagtttattcatccataaaatgagcaggttaaaaaaattaggggattgaactagatattccctaacattccttccaggactagttttctatgggccccttatcacctatctcattttattttaatcacagtctaggatgtctttagatctctcaacatagcgtcttgtacattgtgtacctcaaatagttgacctgattggttcagagggctttatattccttgccttttgttgaagatgacactggccattgatgttgtaacattgttgtgctcaatccagtaaatatatatgtatgggctaaaagaatggcagggaccagttttctaaggtcacttaataagacaaggaagagccatgttgggtaattaatttgttgggaaattactaacattacctaacctctacagaaaagatcatacacatttaatgaatgtaaaagaatatagtaaattttaggtttttgttacatgtagaaaagtcttctctgacaaagtagcagtaattatgaaatatatatcatgtaggtttatattcctgtggcctgcaacaggctatttgtcttaaaattagaagttttgtaggcttcaaacgtgttcaactggcacttgccttgatataatagttcccttagagattggttggaatcacatttatgttgtccagttgtgtattcacaactgtgagtctgcattatgatgtatgggcacaatgctcagtacctagtttgcataatctttcccagatgcggggtttttcttaagccttcttaaagggctgtcactaaacctaagcatcatggcttggtttctatttgaatctgagaactgcctcagctgttaacttggtgaagccaatcatgttttcagctggtatttctctagtgttaccactttcacagaaaggtttggacacatgctgtgtcattaatgcccagttttttcctttctttttagtaagtcacataaatgtattacctgattgtcatgacatctaggatttttttttgtcctaggcctatctaccttgaagcaaaaaaggtgaattaggctttgatcacctcctcctccagcctaggtttaattagtgacctttgaattcacggggcccctgttttctccattgctgcctgctcccagaataatcttagcccttttttccacattccaagccatgttttagaaagttaataatagcacaacaaacatttccatagcatggtatgattctgtgtacaggttgctacatattatattcagtgaatgataagtgctaagtaagaataactcaaaagaatgagagatgtaagtcatcctatgttctagtttgcaacataaatccccaggaagcttgatgtaatgttcatcaccaccaccacaaccaccacccccatcatcatcatagcaactacaatttattaagtatttgctctttgtcaggcaacatctataatataatttaaatatcaaggcaactatattagttagattctattatgatctccattttatggatacggaaactgagatttagagaacttaactaatttgtctaaagtaatacaactagtaagtgtcagagccatgatttaaagcgagagtctgactccaaaacctgtgccttaactattatgctggactgcattctgttatagagaggaattcgttgaagagactcacttattttttaacttttatgttaagttcaggtgtatatgtgcaggtttgttgcataggtaaacttgtgtcatgggggtttcttgtacagattatttcatcacccaagtatgaagcctagtacccattagttatttttcctgatcttctccttcctcccaccttccaccttccaataggccccagtggagattcacttattttgatgaccatccaagggagtgaatacttctaaaatgcccagataactcattcaaagatggtctatttcccataaattccaaggaaaatgttctgaaaaggatcatgtgtattttgagcttctttttaaaacctagggagaaaatacaatatccccatgatccctgcttctttctactctgtctttaggttttttcatatcaaaaatgctgcaacctgaaggaactctgggctgtcggatctcctaaatttaacttttaaacctaagttgtaatcagcatagctttactcccacataccttctattttaccagccatatctcccctccagcagagtatcagcaccagggatgttgggcagaagcccagtagggggtggccccagtgttatttattgttttataggctgcagaataaagtatatgtgataattgatttactcttcgtcagcctttgaggctgataactcaattagcctgtcagatactgactgtgtatctttttcaaaaaaatcctcaaaggtgattttgtattttgtattagataaggtgtgagaggtattttttgcttatattgtattaaaagttcttattttctctgacgatcagcagcagaacaagcagtgttaccataatagttgggtttttttcttctttttaatctgtgtgcttcaagagagaatgatgatattttgaagcaggcacataaggaaataaaaatttaacaatctcaggtgaaataattttgatttccagtccccagctgagagagagagaatatgtattcagctgattggcagggctgcttgtgctcagtagcacaaattgctggattagagaaagggccagaagggtggtgagggaaagtctggtccatggctgagttatgattttaagacagtagattttgattgggcataatgatcagaaaaaaacttttgagtgcacaaacctctgcatacatattatgtacataataaaacacaaaaatgttatggacactaaatattttctttctatactctatggatgtccttttataaccacagggtacatatatccccattttgaagactactgacctaggagttatactttgtgtgaccctagaagagtctattagatggtctggacctcagtttcccatatataatataagagggatgggctaaaatacagtttcaagtttcattttatgcacgggtattcctatggactttagcctttctttcaggatgaggttttaactgctgttttggaggcattatgagccagattattactgaagaataaggataatattaattgttgcaattagtagccctcctattgcatttgtacattcacatttatatgcatgattatttcaatgtggcaaaaatacaatttactaagttaaggcagtatcacaatttgttttccctatgtgctttacgtatttccaccctatcttttaacaagtgatgttttgttaaaccactcagatatattcattgatacagtggttttaacaatggaaatttatttggctcagacctaaagcctttatataaaagttagtaccaaaattcaataaataaagctatcggttatttggttgtttattggatagagatcaatattgccttgttaaaggtaatctgagtgttagaccagtttgtatgatccatctttgctacaatttccacatgtttaaagcacagagatgtataattgttagtttgtctataaaatcctatgtatatattaaattgtctaaagtcatataaaatcataccctctagaccatagacaaatgggaaatcttctgtgtattttgatatttaagccaagttcattccacttgtgttattgggtaagttaatagatcatttcttattagagtttttgagttagggagacttaaccctgcctttcacacatccattatgaagacattgtaaaaatacttcagggtaccacaggaagtacaattttttctttttctttttttttgagacaaggtcttgctctgttgcccaggctggagttcagtggcacacacacagctcactgcagcctcaacttcctgggctccagtgatcctcccacctcagcctcccaagtagctggggctacaggtatgtgtcaccacacctggttgacttttaaatttttgtagagacagggtctcactgtgttgcccaggctaatcttgaactcttgggctcaagtagtccttctgcctcagcttcccaaagtgctgggattacaggcatgagtcaccacacctggctaaagtacaactttttagtctttgaaaagtaaaacatatttggatctatgaaatcaagaaaacaacttaatgtgtgtacctctccccttctatatctatataataatattgttatagtgtagttccattcagttattttagtttggaatcatgctttttattgaaattgttggtaattttatttgtatgtattaactgaacattgattattttgctacccagaatctattcacctttctttttgaaaccacacttttatttcctttgtagatcacccctccccacacccagcccacgtgcttaccataggcatatgaggtaggcctaagccaattagagccttacatttccataggcttcaatgattaatttaagggtgggcacattacccagttagagcaaaagagatacaatgaaacttcagtggacacacctgggaaagaagttcgtgctgttgtcaataaacttggagttatgtaaatataacttctggagttgctacagccatcatgtgaccatgaaagacaaatctgaaatggatgagagcagaggttaaattgaaagaatgagggatgagatctttagccatccaatcagacctatttaactggaatttttcattatgtgatccaataacttatcgttttgcttaagccacttaagggttctgttttctgtcacttggaactggaagaatccatttgatcatccctgtgcaatcttaggggaaggcatgggctttgtataactacccgtagtgccaaatctttcaacatggaaggagagaaagagacagagtgaacaaacatattcaggcgctttggcctgaattaacggaatgggtagaagtgaggcatattttttctctttaaatggtagtttatttcacgtttgtttagtgatgcattatgccacgctctgtgccagacacgacattcagaggtgaatgataattcaactctgaagttcacaatgaagtgggagattattccaatacaaggaacactttccagggtaacgggaacatatccaagagacatctaactaggatatgagacttgaactctgctctattgtgtcaatagtaggcagcgaagtggagaaggccattgcaggcaaaggaaataacatgagatatattctttaagagtccctgagttttgagtgccttatgtagctactggcaattgtagtagggatttatagtggaagaaagttttgtgcatgactaagtagtagtacttgggtcactgagacagcaattaaagggctgatactcctatttataaatgataccagtgcctagatctatgtctgaatgatagaatgtggatttagcttctccctagaatccaaaccatattatctgaatgcatgtttgtgcctcctgcagagtgccagtgcagcacaaatgatataccagagacgtgatctctatcctcaaggagggcaaaatctgaaatgcgccactttgataggaagcagaagagtggtgggatcgaggctgcaaaatttacatattcattgatatgtgactgggtatttacttcatttgcaaataataggtaagtgcattgtgcagaatagaaggcacatgaaattatgtaatttgaatgggaaatggggaaaatatctgtaaattactaagatgtgtggtgtagtaatcagctttctcttctgacaaaatatggcacatcaaccctctcatttattatgctctattacgttcttttaccagtcacgctacaagtttcacacactcccaccatgaaactgccagtcttcctactccatcactgcattgctagtgaaatgacttttaatgtgcaccgagtgtcagcagtcttctaggtgccctggaggaagaagacctctgcctgggcattcattctaaattaagcataaaagttagtgctcaattgtgaagatgtgcaaattataatttcaaaataccttaccatcttaaagctacgttccaacagctgggtattaatactacccagatacttgtttacttcagttatcttacaagctgtctacaatcagggtggatggtgttttagaatagaaaaagagcttatagctgtagatgatcaaataatcagtggccattaaaacacacaggggagttgcgttttggaattttaaaatgtttgaatcaaagggaacataaaaatagtaatagggaaatacagtctgttatggttcgcagactatagatgtgcctacattttgaaaaatcggccatttaaaatccaaatttaataaaacaaatggggtgattagttgcatttctgaagggttttgttgagggagatttgttaaaatatgtattgcatctgctgcttttaaatgttggctttaatagattatgaactctctggtgagatgaatagcaaggaaacaaaggtcaagtatttaatgtcaattgaaaaatgaagatgaaccatctctgcaattataatgtgttaatggggaaaaaattcaatttacaattagcaaagcactgcattcgaagaagcacttgtgttttgaaggccatacaagggaatcctggcatgtgtaatagcaaaaacataacatgtttaaacagctcatatagttagttaagccacgttttccaagacatgccataagtaaaagggtttatgaaaaaaaaaagagagggagagggtaagtggggtgggaaggcaagaagtggggagagataatgcttagaaaataatttggttgatcacagtaatgggtatatgagggaggattgggatcctgagagaagaggtattctaccatttgtctggctgtcatgtggacttgggagcaagagtcattcccagtggagtccattgatgtccctttcccttgacaacttactaatttatttattcttacatatacatattcccttattcatttgatggacacattttgtgagcaattatgatatataggaacataataactggggaacaaagaatgttgggggtaggcaaaatatcagggcacaaatttggaggatccttgcagtagtgcatagaaggagcaattgcatcttcactatttacagagatatagctaagcttgggccacattactgaagtcttgaagacatccaattgtacttgcgcatcatgaaagtctcattagggaaaaaatgcctttggatgctaagctggaaaatgaagacaatgttgctctcttggctttgacactaagttagatgtttgaccttggaccaacacttaagctttctgtgcctcagtctccttgtctaaaaaagaggataattctgtaatgctgcttgccatggcctcacatggatgaactcaggattaattagattaaagaagtgatcagtgaagcacatgaaagctcctcagaggtactaagtgagcaggacgaataacaattggaatgttagctatagagctgtaattggagtttgttttaaataggtcacttcctgaaaaccagggcaaatggtacttaaaaaaataaactttgttttacaatagttttagatttatagaacgattaagatagtacagagttcccatataccctacacccactttttcctgttgttaatatcttacataatatggtatatttgtagaatatattaatgaaccaatatttatgcattatcattgagcaaattctgcatatcatttagatttccttagtttttacctaacgctctttttctgttccaggattacatccaggataatacatttcatttaaccatcgtgtctatgtaggatcctcttgctgtgctgacttctcagacttttcttatttttttatgaccttgacattttaaagattatggtaaaatacacataacataaaatgtaccatcttaactgtttttaaggatacagttcattggcagtaagtacattcacactgttgtacaaccatcaccgccatccatctccagaactcttttaatcttgctaaactgaaactctatatccactaagcaataagtcactatccaccctccccctacccactggtagctaccattctactgtttctataaatatgactactctaggtacgtcatataagtgggatcatacaatatttatccttttgtgactaacttatttcacttaacaccatcaaggtttatcaatattgtaccaggtgtccaaatttcttcctttttaaagctaagtaatatttcgttgcatttatataccacattttgttcattcattcatctgtggatgaacacttgggttgcttccactccttggttattgtgaacagtactgctatgaatatgggtgtacaaatatctctttgagactctgctttcaattattattattattattattattattattattattattattattattattttgagacagagtctccctctgtcacccaggctggaatgcagtagtgtaatctcacctcactgcaacctcggcctccccggttcaagcaattcttgtgcctcagcctcctgagtagctgggattacaggctcccgccaccatgcccagctaattttttttttgtatttttagtagagacggcgtttcaccatgttggccaggctggcctcaaactcgtggcctcaagtgatccgtgtaccttggcctcccaacttactggtctgctttcaattcttttggagctataccaagaagtggagttgctgcatcatatggtaattctacttttaatattttgagaaaccaccatactattttctatagcagctgtaccattttacattcttaccaacaatgcacaaggttgtacatattgttgccaacacttgttttttttttatttttgatagtaactatcctaatgggtatgaggtattatatcactagcatttccctaatgattagtaatattaagcatcttttcatgtgcattttggccatttgtatatcttctttggagatatgtttatttaagttgtttgcccattttataatcaagttgtttgatttttgttgttgagttagatgagttctttacacattctaggtgttagcccctcggagatctttaattcagaaaagaatttctatgcaatgaaaagagagaaaagtaaagagtaagtaaatgaatgaattcatattggcttcccatcgagcagatctctgattcataagaattatctccaatatacttcctaaatatttaattttttcttttttaaaatataaaactttgcacacacctgtagtcccagctactagggaggttgaggcaggaggatcgcttgagtctgggatgtcaaggctgcagtgagctgtgatcctgccactgcattccagcctggatgacagagtgagactccgtctcaaataatatatatatatatatataaatatatatgttattgtgaacagtagtgctatgaatatgggtgtacagatatctctttgagactctgctttcaattattatttattattatttatatatataaaatttgagatatatagattattatttgagatatatatataatttttaccagccaattaaaatggatttttacttactaagcaggtagactggggctaccttggatttttacttactaagcaggtagactggggctacctttcctaaaaatcacttccttatccatgaactcaagtgaccagatgccttcaaaccaagtttcaaattgcccaaatgtcttctcaggagagaaaaatttgtccctgtgaagcaggcaggcagctcaggggacagatggatgccagggagtgtccctagagatgataattgtaacccatcctaacataacccttctcttcctttatgccctctctcaaaccacttatcttctaatttccattgacttcttctccctttttaaaggatgaaaccacccaactgatgcatctaaagtactagtggcagaactgggcttaggcatatagctcataacttgttattaggaagatataatagatagaaatgtgttttttgacagaatttgaagatgaggaagaaaattatagggaggctttaagtgttcctagctttcagcttcccttctaggaaccatctgatggtctgggttcatgtgcttggaagcactaagtgcagcatctccacactgagcaggctgatgtttgcatcgtcttccaggtacaaacagtctcctcaccactgaggggcactatcagatgtaattgggtctagcaggaataagacctaggaagaaagaacagatagaaaagaggtacacaagatgaaacatagcattctaccactaatggggattaggggtttgaatagtgcctagggcatcctgctttttcagaatatttacaaagaatggaatgtctagaataatgaagcctgacatagtgcttggtgctgtatacataatgtctcacttaatactctcaacccaatgaagtatgtactgttattatcatctccattttaaaaaggaaggaactaggcacaaggaagttacatagcttgtccaagataatacaggaaaaattagggaccaggtcacatttgtcttattccataactcttgcttctaacccaaccatttgtttggcttaatgagtggtgagttaaaaatgtgagcaatgatgtgaaggcagaaaaatgtggtctgcaacatgggaggtacaaagtgggggtggggaagtatagtaccagaaaaaaaaataactaaagttggttcagagagagaagagttagatggttattaaggaaacccctggaagaaaatatttggcccctgatgtctcagtaactcctatatcttcaatgtgaaagaagactaaatgaaattgataaaaatgattttttcatttcaaaatgagcataaaggtgttcttctccctctaattagtacagattaattagatgtaaactatagtccacaggccaagaaacaaattcaggtagggatatataggtggattaaaaaaacaccaaaatatgaatatcaaacaaatcctaagaaaaacagtacttacacattgcagaattgcttaccttatgttatttctggggatacctaagccatatctgtttattcagccactgatagcctctgaaaagtaaaagccacttttacaaatccggggtaacactggtgtctctgtaatcacaggacacagatcaagctagagtttgttactctgatatctctctgtcacagaaatatggccccatatgcaaggactgagtaagctagttgccagaatggctaggaagggggtgtcagtttcagccatggtattcttgtagtattatttaggctctgtgggctgccacgttccaacaggtctcactaggcagtggttgtgtatttttgttgcaggattacttgtaacaccatttcatttctaagacttgatgttctccctctctatttctatagagcattggaaattggcaaaaataaaaaataataatatagccaattcgatccaagctgacaacatgttcctatttttctccatctgccatgaattttatattctgacaagggcttgacctttggagaagcagacctctgttgggttacttctttggtacatttttatcttccaggtattttggaaactatttacctgtgctaataatttgccatccaaataggtcagtgcttcactgacttattattatttgtgtattctaaggaagcctatttggtatgaacagactcattcttacttttagagtttcttattctatcagaattcaaattaacagaacttctatatcatttgcaatgtgtcaaaatgaaatggagtcccttgagaagtttcccaaaaatggtatagtaggaaacctcaaagcaaagctttctactttacttagttttatttttttttttgttagtcagagagactcctatttactgctttaattgacttttttcatttttttaaacctcattgagccacaccttatagagctacaggtaacattattaaacacttaatgtgagacagacattgtattccagtgttttgcatgcactatctttataatatccctagtatatttttagctccactttacagatgaggaaattggggttcacggtacttaagaaactctcctgaaggcctgcagctagtgatatggaagctaagattcaaaacctgtccatctgactttgaagcagatgtttttaaacagttgactgatattagctagtgtattggctaagttactgtaacttggagaccccaaaatatagtggtttaaataatatagaaatttctttctctttgatttcacagtctgtatagagtagctctgatctatgagatcatttaggggcccagatgccttccatcttatgactccaccatgatttaggaatgcccctcatctgcatagttaaaactggatcactgttgcatctgcattccagcccatgggaaggaaagaagaaagagaggttatggaggtcaagtattttcatttctaagaatgtgaagcagaagatgctcacatcaattctgcttatatccttttggctagtcacatagtcacacctagctgcaagaaaagctggcaaatgtagtctctaaataggcaggcgtgtgtctagccagaatgctgtggtccaaatgttggttttcccccgaaattcacatgttggaacctaataccaaataagatagtattaagaagtgggggcatttgagaattgattaagtcatgagggctccaacctcacaagtgggattagtgcccttataaaagaggttcaagggagcacccttgccccttctgccatgtgaggatacagcaagaaggctccatctctgaagcggagagcaagccctcaccagacactgaatctgctggcaccttgatcttggatttctcagccttcagaactgtgagcaataaatttcgactgtgtatacattaccctgtctgtggtattttgttatggcagctcggatgaatgaagacacagaacttgggaggggcttctattactaaaaggaaggaggagagaacaaattttaaggggcaactggtagtccaccataccaccatagtgtctggtgttatttatcatcatccccttccagaatacaaaaagtcaagtagagggcatcagtaggagactatcttctgtagaaaagagaatgatctggtgtcagatactctggacattgcaggtaatgttataaaggttcagggatggaagctttaaatagcacctgtgttgacttaaatattcatgctaatattcacttagttttatatcccttcctgagaagttaggtttaggggacatttattattttagtatttatacagtagtcaaacttttgttctgtctacagccattttttcagttgttaccattataatattgataacctgaaccatcaagttaatccttttctttaggcttttattcttgtaaatattcatcagctcagcattttctttgctgagcaccttattcaactagaaaggagaatgttgccccctggaaatatcagcaatgatttagatgtgatcgttctcagatttcctcatgtctgtgtctcagtgtgcataaatatacaggctaactgttgctgaggcaaagggttggagatagattccatggtttatagcaaccctatttgagttgcaaatataaatgttgtatagatgctctcccatagtggtgttagagtctgtggatttacagaagagagttcttgacctcacaggagaatatgcggtaaagagtgttctaggagtagttagtagtagcttttctgggctttctttaggaaaatttaatgctgggatttgggcattaaaagttcctccacagtttggtgcaagtgcaaatacttctttaagggaatttttaaaagccacccaaagaattggattgtggaggaaatcaaagaatgttaacatagaagcagtagaaaatgtttctctatgtgagttctcatttgaatgtagatgtgagtgggtgggcaggtaggtactttatgtaatctgataggaggagaaatttagaggtggtagacttgacaagtatccctctggttctccagaactttaggatgacatgttagacattttcttgaaagttagtgagaggtgtttcctctgcaaacagatcgctgaaagtgaccagtttctagatgtagaaaccatcccagttgcccaggtttatctctataaaccagaatcaacaccaaccgactcttgtcttagcccaagggaacaagaaggtattctgcttacctgtttcccaccacaagaccaattttagaattcatttttatttatctcaatacagctgcctttttaattggcaatgatctctattgaatttctaacttatgctgaaacggtggctgctggtggctgtttgtatgaggtatttggtattttattttggcttaaatctgtttttattgctcaaatattgtcagcagatgcattatttctaccggaatttccactgctcagtgtacaggttatctccactttgacagctctgtatcttcaatgtcaggtacactgctcccaagtcatactagatttacacattctattatacttctattgaacagctcttaatctgctcagaagaaaacatgctacaaccagcaaattttatcctcttgcatttaatgggaacctttcttggcaaggatggacagttgtatttgaaccgttccaacaatatctggccagttttggaaagattttgaaggagttaaccctgtaacagccaaactctggttgatactttaatattgcctgaacacccaagttctaaccctgctctatttactgagttactccctcccccagctgccaataattcctaggaaccttgcctaatataatccctgttttagtcactataagttaggtttgatttacaatggaatttcatgctgaaattgggtggcaagatgcacatgtatttcttgggataactttactgcataatcttatattgattgtatttcaaaggaagtgttttcaattgtgctactcttagcttcatgcagcagtgggttgtgttataatggggttattccacatttattggctgagtttgtctctggagagatgtgtttgaaattaagaggaggtggggcagagttttcttctacagtttgcattctgaggtaggtaatatctgatattcaggccagttcatttttcttattgtttcttctctcctaagacactgtgaatataaagtaacaagagacaggacagaggctattgctagtctcctcatttgtatgatgggaataataatgcttaccttgcagagatgtgatgatgataaaatgaatataaagattgtaaacatgttcaatatatagttaatgctggtggaagcttctgagtagaaggtagactctaggattatccacacataacccttcatgtattttctgatctcctccactgagatctgtcctttgaatactatctctttaagtatgtatgctggggtattaagtctttttctttactgtagagttatctagtgtgtctttttatatcttctttgacatctttatctactgaaaaatctctaaacatctgtaactgtgctcagaaacctcttatccctgaagacccccagaagggctaagcggtaaccagagcagaggcaggagaagaagttgtaagaaagaggaagaggacaaaaaaaggaaactcaatgtttatgttgacaaatcagcttatttatcaagcatcttttttatgtccagcactatgctagaggtggaggaggtgctctggacttcaaggattatcgctctttcttttgtttttttgaaacagtctgactctgttgcccaggctggagtcagtggtgcaatcacagctcactgcaacctcaacctcccgggctcaagtgatcctcccacctcagcctcccaagtagctgggaccacaggcgtgcactaccacacctgggtaattaaaaaaaaaatttggtagagacacgggatttctctattttgcccagactggtctcaaactcctggactcaagcaatccttgtgccttggcctcccaaagtgctgggattataggcttgagttgccatgccgtgcctggcctctcttttttgaagtgttaagtattttagacttgaaaataatcagataatagccatcaagtaatataaaaacaagtcctaaggcaggccatttttgcttcaattataatttccaggtataacacccccatgttaatttagcctatgttggtgttttctctggtgtgggaaggttatttcaagtattgtaagatagttgggcactgtctatcttctccctccttattcagagtcttccttctgccctcagttttctgaccttgcatctgccttcagttttgcagtcctaactccttttttccccttatcaacccccactgctagcattttaaatgccattgactttataaggtgtcccttcctatagctcagcagttctaccttgttgcagctgctatatagcactgacctcttatctctttcaaaaggaaagatgaatctaagaagcgactgtggcaaagcaaactattcagaaactggcttgatgctatctctgagagaggtttgcttagtttgcagaagcaaatgtcgtgcatgcttccatgttgcttagtgtgatttgtcacttgggattctcaagcatttgatatgaggccctgactggcttagctcctcatcagaatgcactacaatttgttcacttcaaacccaccaggaatagagggcattcactttgacatctgctcttcagaagcagcccattaatactgtacttgatgtgtcaggttcttaaagaaatacttttagttcttttatccacaatcagatgacctggttcaaggtcagtgccaaccctaagctgtttttctttttgcttttcccttttgacagtcattatatgcctttgcctgtttgtaatcctcagagcctctcagctcaggcactggtaagtgtggtgcaaagattgaggtgggaccaacattattggcatccccggattttggccactctcagaggtacctcagtaagctacccagtgatctcatatcctctcttccttcctcaatctgtatctgttccaaactgcttcattcccactgctgtacatggcttctaatatagaaattatcatatagttaaaacctatcatatgccaggtgctaagccaaatattgtgcatgtattatatgtacatatattatctcattgaattcctgtagaacctctgcgaggaaggtggaaactcaggctctgagagactaagcaacctgcccaaggtcatatagctgggcaatgtagaatgcagggctgctaatagcttaacaacttaaccccttctggactagtactctttataaagataatcacttgtttattattttcaggcaacaaacacttattgcacattattttgtgactgccactatgctaggcattttggatatattaatagattaaaaatacagtagctactctcataggtatcaaataagctaggggaacgagacaaacagacaaatgaaatgccataaaaatataagatttgaggtgctaaggaaaccagaggggaacttaacccagaccatgaaggttatgtaccctatgttgcctcgcaggatgagtaagaattccctctctcattctcattctcattcatattctctctctctctctctctctctctctctctctctctctctctctctctctctctctctctctcgtatccctatgttggataggtccttctccttcctttgtacttttttgtgtatctcagtaatagcacttatttattcttttcattcacttaacaatagtttgagtacccactttgtgccaggcaacgttttcagcactgggaacagagcagtgaacaaaacaaagttctgcccctcttggattttactttctagtatggagatagacaggaaactaatagataaatggatatggaataaaatgtcaggttgttaaaagtaacatgaaggaaaatagattgagaagctggagaatgacagaaggtgctatcttatagggaagacttctttgagaggtgacgcttcccatgcagtactgtgattatgtgtttacatttctggctcgcccttgatactccgtacctctggaggtaatgggctaagtctttactttgtagccccagacaagagaatgtaggagtttgggggtatcagccaaggcatagttgaaatgatgagtcagtgagtctacagatgtcaagaatgaagaacagatgatgggggaggtaagggagtgagggagctagaatgctgggagattattgtcagagaagaggagatttacatttcagatttaaaagattgaacaattcctgatgattctgtggtacacttacatgtgggaatgactgggtacagtaaggggaagcccactgagtcatgtagctcaagaacctgtgaggctagcacagttgttcttaaacttgggcatacattaaaatcaactagagagctttcaaaattgcagcatgagatcttgccttaggagattctgattcaggagctctgaataggtttcagaaaagggatatatatatatttttaaataagttccaaaggagttttagatgcacagagccaaggttcagaatcactggacaaggatgttagaagtttgattcatgtgggttttaaagccatgaaagattatgtcaggactgagtggaaaggaggcctataagccaggtgtaatggtcctcaatgcatcttggaactgaccagaaatcagtagatggctgtgacaaggagggagagagtgtggtggaacacaggggatgattttggaaaaagaagagttttacacaaggatggagaagtgattaaaggctttcaccaattcagggctatgtagaaatttagggcatcagtatgcagtttggggtactttgcatggaagaaaagttctggcattagtctgcttagcagatctgacatcataacagttaggcatgatctgctccacctagatgtgctgtcagccttgggcttaggagacaaagtcctcagctgcatttatgaatttcagagagacactggacaagtaacttgagcaaacttctctaaagtgggcctgcctttagggaagaatatataggtaaagcctagagcatttctctgagagtttttggaactagtactatacataacaactaactagaatcattggttcagcgtcaattatatgcaaagtattaatcaactatatgcaaagtactcatcaactatatgcaaagtactgagaaagaagttactttctcctgaaagcaggttgtggggcaaatagcggctatttgataataatactggttcattgggttctgaatatttgaagtttctgatatatcgaatcattttggttttgaagtaaagattaccaagagctttcactcagcctgtgattttccctaggcaggtgagacttccaatcttaatagggcttacttaaatgatgcaaaaggcatgcacatgaaccagtaatttttattaataacattatcatcattgtaattacttgcaatcttggaaagatcctggggttataatgtaagaaaagcctgtatttgatttctggctcttgattcttagtgttgtgccccattaggcagcatagggaatgcctctgagttctaatcccctcctctgttaaactgaaaataataataatagtttctttatgctattgtgagaagtaaattagataatatatgtaaatgcatgaagcatatattaagtggctcaataaaagccgcctttcttctcagcttttctttagacaccttttccaatctcactgtagcaagtaaaaattattaaaattggaaccacaaatctttttaaaaaatcatttcaacttttaagattcagggggtacatgtacaggtttgttacttggggcgtattgcatgatgctgaagtttggaatacaaatgatcccattaccattgtagtgagcatagtatccaatagttagtttttcaactcttgccctcatccctccctcttccttcaagtagtctccagtgtctattttgccatctttatgcccatgagcacccaatatttagttcccacttataaatgagaacatgaggtagttggttttctgtggaaatataaatctgactctgcttgatgtgtttagaaattgttatcccctgtcaatgggataagttagtctctagcttatacagtatatgcatttgttacttgcctgcagtggaatatatttgaaaatggatcaccaattgatagttagactgttgacttctggaatgaaatgtgagaaaatataaccactcaagctacattcttctattatttgctaaatatccaaattgttaccataagggagaaatatgcctcatgaattgccatgtgactttggcatatgactgtggtaatctcatttttaagaactgcatgtaaatttgaagtaagaaattctagtttcaattaaaaacaaactgagctgaaatatccaaaattcactggctatgagcttatctttaacagttactaatttatatggccaagaggggttgtatttgcaaggccatccccttaagagctgaggttaaacaagtgagtggcatgggctataaatgaattgaaaattgccttctgttccagcccagtgcaatggtttgtgttttgtaataagccctagttggtgaggtaactcatgtcaccaggaggagctgtccacagactgcttgatttgtcactgctgtctgaaggacacaacaggctggggaagctggcactctgcagaatttttatggtgctgcatgcatgcattggtctcccttatcaagctgtaattcaataataaatacaaaaaaatttttgtttaaataaatctagggttgtgacacaacctgaccaaagctaggagagttaatgctgatgctgggatattaacttagccagggagcagtttgggtgaggggaagaaaaagatggatgctgggagagagtctctatttgtgatagagtattcatctgcatggctgtttttctggaatgctttggtctgtgccattggctcaatgtagtcatttttcaacttggtgtctttttgttcttcacgccctcaccctcctttttaaagagagaccaaagagcatgaagggtgacgagaaccactacaagaattttgttgcgataagcagaagccagccttatagagtgggttctgccattttctcccagaatggtgaatggttacaagaaaattactgggacaggtaatttggggaatggatggatttgtgaaacatttttttttttcacaaagaaaactgctttttattttttgttattataaaagtaatatgtgttcactcaaaaaaaaccttcaagcagtacagaaaagtataaagaaaccataaaaatcacctattataattttccccctcatatcagagataacatctgttaacattttggtatatctccttttgtctcttcctgttacctttttcacagtggtttattaggagaaatttctagaaatgtaattcacattttaggaacttgtgattcctatataaaagtgatcctccacaagacagtgctgatttccactccagcaccactgtgtgaaagtacagaaggaagcccatggtcacaatttattgcataatgaccacgtgccagtcactgctctaagtactttgtaaatattaactcatatcatcctcataacaaccctatgagatgggtactactagcattcccattttacagtcagggaaactgaggtttagaaaggctacacagctagtcatgagactgaaccagaaggttgatcaggctttggtataggagaaagaaatagcttctctctctctccctctgccttgcctgccctgccttgccctgcccttcccttccctgcccttcccttccctctccctcctctctccacccccacccctcccccatctgtttacctcaaggcccagggagaaacaaccaatgaaggaagaagtagcagcctagtggataagcagagagccagaggagtcccaagcagctgtgaatctttaaatttaggagttctgggcaaagatgtccttgcattattttcgttcctaaatgagcagaacagaacttcctctccagtgctgggctttgtgagctgaatttgaaccaacaatgagagggaaaatagcaacagatatagatacacttatgtttgtgtgcaaacacacacatatacccatggcaaggagtgtccctctgtggctctgatttctactcagaatcagaacaccaggagaaatgatgatctttgtcaaatgaggtgctcccttagtttcccagcattaaactagagtgggtatagataaatgttcataaatgcagtgatggagagagaattgaaagtctcttattatattccagaataattttgtatgaagtagcagaacatgtgaataactttctgtgtgaccttaggctactcccttcctcttactgaacctcagtttcctcccctctaaaagagaccatagaactaatgtatttgagtgttaagaaccctatctctactttaaacagttcctaactgatttgactttgggttttcttctcctggaccactcttattttttatttttttatgccttttcggggctacttgatctgttattggtctgctgttgctagaaattgttctgtggatgctaagaaggtgagttgcttcatatagtctatcaagtgagaacaattaggaaggcccctatggtcctagaagacagcttatcatagtatctttgagattttactcaaacctttactttagaactattgcctcttttagaggggaggaaactgaggttcagaaagaggaagggactagcctaacagaaagttattcacatgctctgctacttcataagtagcagatcttactctagtaagatgattcaagtgtctcatttttataaaaatgattggggcacaacgatattatgtgatttttccccaaagtaacatatctaattagtagcaagggcaggatagaccccagatcgcttcactgtctagtaaggtttcccaaagtgtattccacttaacacaagtccctcaatatactctgggtggagatcggggcatgaggaagaggattctgaggtcaaataagtttgggaaatgccgccctgtctaaggaagccacaatgtgcattgaagactctgagaaatatagagtaagggaacatatcactaatattgttatagcatttatggctttcagagcactttcatagccatttttagttgtgtactagaagagacaaagcaaaaatgcatataaagtagatcatgggattgaaaaggggataagtgtagccatataaacaaagggtggctgacagttgtggaggttcagcaaagagtcctgcagttattagaataaaactgatgattttgggcctggtcacagtaatcagattgctgaatcttcattttatttgaatttatttaaaggataactccaaaatcctgcaaagagaaaggaaaaaaaattcttaagatatttatagtattaggggcttttaaaatggatttccatccattgataaagaaataaatacccaaaagaagcaagaccagaaagtaactattactaagctgtcttgtattatttctcttggtcaaaatttattaaaagtttgaaagctcattgtcccattaaatgttggtgttaagacttcagttctttattcagaatgattggaggttatattttacacttaacattttccagctggggaactgaggtcacgacaagaatggccactcaagaattctgttggtccagcagttaaggtcatatatgggcttcttttgtggctcaggcagtagactgccattgttttcatatttcaatttgattttcttgttcataattcaagttgggagtgaactaagtggtatattttctccataagcccattgagaggctgagaatctgcttttctgcctctagattctaagttaagaagaacaagggcagggtgcatgtcattcctcttcaccattatatcaccagtggatagcatgggacctggaacaccatatatgtttaggatataattattgaataaataagtgttctgtagagaaaggaaagtggatcaaggtggaaatcatgtacctatttgtagtctactcaaagtatacaagcaatgtttgttgttgatgatgtgtttttctcatgataattgggttgtatttgcaagacctcacttatggaagcaaattaattgctatttaggttctctgactgctatttgggtaggtggcacagttggatgatagaaattatagtttttctaaccagaatctcttagtgacaacgtatattagatcagtgggtttctagtgaattggagtagaggtaaagtaatatcctatatttggattttcgaaacaacacctattaattatcctcctgcaccatcaccattataaagatgtggaaactcagtgtcagtaacttaccatgagcaccttactggttaatggtaccaccgtaactctgaggtaaatctactgttttacagtttggtgttcttggccacccctcctgctaccactaatcaacaacatggggatttgtcttggagctgctacttggtttcagtactgaaaaatatttcagggactctgtaaaattcttgatgggtcatcagccattgactaactcacctgaattccaactgtgtctggtaaagttctaccaaggatgaatgtattaacttctttacaagctcaaaaagtattagaggaggaatatgatattaccaagtgtttactgcccacttctcatgtagcataggggatatgtgaaagcatacagaaacattctgtacttttcaggagtttgcagctctgtacaggaggtcacatggaagtgcctggtatcttcagagaataacgcactatgatacagacatgttgcaagtatggcaagcatttaagtggtgctggaggtcggaggagggagggatcaagaagtaaacttcttgtgatgacaagatagtggcttttgggagcagacttcagtattctctttttgctctaactctccctttctgattcattttttttttctaccagtttggtggttaattagataagcagtgcccctacatctaccactaactcactttgttgatttcctattccacagtgactcctcagggaggaagataggtggtggagttcataataatggtaaatatgtagatgcctacaccttggggatacagattttggtacatgatattatggaaataggtgaacttagttggagaacagttttcaaaagaacaagctatgttttgatacgtgtggagggatttatgctgtccttgatatcaaaattttatgtttccataaatatgtgcctatttgtaagtagtatttcatgagggaattaggtggatggaagcgttgatagtacaaaagattttcccagtagtaacagttaatgcatgctttcccttatagcttaaaacaggtgaagggacttgaagtgagatgcttttacttgcattagagtagtttctctgtaaccatgttccccttcctctttattcaggttttcagcatatacaatatgtgtattaattattaggctttgctgtggggccattttttatgaacctccaaatgttgctgagtgtggaatagctctggggcttgataaaaacatggcctttattttcccaccagtctttccaaataaacctacctcataggaaagtataaagtggtttacagaagaagatttggaagccaagttcccatctttggagtcaaatggttcagcattctggcctggagaatggtgggtagaggggaaaatatgctcctttgtgcctttatgccttctcagactggctaacatcagagctgcatagcacatattctgagctgatggaattgggtaaaagcaggtttaatttgatctcagcactagatttaggagcaagtcaactctgaggaaagattcagtttcagcagagtggagctgagaagaaaccatttgttttcatgaaggaaaaataatctttgaagcaagacttctatccctctctcccttccttttttttttttaacttcagcttcattttcttgatctgcaaatctcaattcctcaaaatctcaagctatttttatgtgtctttttttcctttcataatgtataaacattagcaataaaaagtgatggatcaagttgttagaaaagggggcaactgtagctttttaggaccccaccttgaggaaatattctgttatttgaatccctcctggagtgtaaattccctccttaggtgatgaggtatgtataagtttgccgtaaaattatttttgttacactggggactcagatacacttctactcctactgctgggacttggtctgcatgaataatttgtgtgaacaagttgctcctgtctgtaaggaaactgttaaatccttgactttccagacacaaggatgtcatcttcaggatcctcactgacttatatggacaaatagtattgaaacagatgacaatctgaagttcctacagtaggttcaaaatccaggcagatatccccaacaaaagactaatgaaaaagtctactccgtatgagaaccatgccagggaaggtctttgaattcctacttctctctgttatgctaagctcagctatagatctcacttccatgagaacaaggctagtccttgtggcatttgcaaggaattaggctgggaatttgtggactatggttctaatttcatccctgacattaactgactaaccttgagaaacttgtttcacttttttgttttattttctctgtctataaaatgagggtgtaactacatctgccctagctgtttcacagagatattgtaagaatgcaacataaaaatggggtgttttaaaacctgttgaaagatgtaaacaaaagagacatacaaactaaaggtattgtcaggtatcattattgttaaatatttttggagctcttcaggagcaagttctttggcattgtctccctaaggagacaatggatatgagacgctatgaggaaaaagtaggtaataatacaaaacaggagggttggcggtggtagagagactctggacctttctggaagggctcaagtggctgaagggaaaacaaacattcatgggctggcccaaagggtaaagaaagttcctgcacccctaatctatgcattgtgcggtgatggggaaaatggtactcccattctttcagtaaaaatggttgatatctgaacccagctttggtgactcctttgccagtcctaagctagcactgctatgcaaaaagagacaacaaggggaagaagtcctcacaaagaaattcctgggttagggtaaagccaggaatgcaaaagcctaagggaaaagagtgttttttggttctttttttgtttgtttgtttgtttgttttgagatggagtttcgctcttgttgcccaggctagagtgcaatggcatgatctcagctcactgcaacctccacctcccaggttcaagtgattctcctacctcagccccctgagtagctgagagtacaggcacctgccaccacccccagctaaattttgtattttttgtaaagatggggtttcaccattttggtcaagttggtcttgaactcctgacctcaggtgatcccgcccgcctcggcctcccaaagtgctgggattaataggtgtgagccaccacgtctggcattgttcttcccatttcttctctcccctacagataacttaaaatcctttatctctccaaaagaccaagtaccatttagcaaatcctgctacctaagttgtaatgatctcttcagccccccccccccccccgcaaagtaatgtttgctatgacagaattacagtatgtctggaagagtttgtacttctctgtgatttggtacgaggcaatttaatctacgtgacaaagggagatatctgatttgtgggagcgctgcctcttttgatttccctctgtgctactgaaagaatggttggaatgataagaacagtatttttaaagtgtgttctgggcaatactaatctctaggtgttttttgtttgttttcagaaaagggcttctatggtcaaataaattgggaaatgattcatgctatgattccctctaggaaatgtgttgtgcatgttaggataccaaaagctttgagcagtttaacagtaaaggaatctgtttaactttgtttaatctagcatttcataaacttatttccttttggaagcccccttttcatataataccaatcactattaccctttaaggcctttaagaggtagattcattctcaaatacctgcatagttcagattgctatgccagacaacaaagcctcaagttagagaattcagtattgctggttagccttctccaaaattaaaattgctgtgctaagacaaagatagaatcagggcggtgatgttttctgtccaaaaaactattaaaatgttacagtgattcaacaacatcttcattatgagataggcaaacaatgaaagcggtccacacttattgcacgctcagtatgggccagccactgtgctaagcgctttctcttgttacttctaggcataaaaatgacccagcaagatagattgaatgagtcttcattttagagcccagggaactgagagctagagattatgtaaatcacccaaggccgcagacctagtaagaggcagatctgggatatgaatttcggtctgttcaactccagagtcgatgatttagatttaaaatatttaaagtcagactctgttttctaagtggaaaatggcatttcaagaaatctcaaaattctgtatctgaataatgtatcagctaagactctaaggcattcaggaggctgtcttttggttaaggggggctccacctgcatcgccagagtcagtctaagtataattataggtatcagcaacctagagaacagctggttcaatttaaagtgccctaaggatcacaagcatggtcctgtttacatttacaagctgataggccagttgctgtggctcatgcctgtaatcccagcactttgggaggccgaggcgggcggatcacaaggtcaggagatggagaccatcctggctaacacagtgaaaccctgtctctactaaaaataaaaaaaaaaaaaaaattagccaggcgtggtggcaggtgcctgtagtcccagctactcgggaggctgaggcaggagaatggtgtgaacccgggaggcggagcttgcagtgagccgagatcgtgccactgcactccagcctgggtgacagagagagactccgtctcaaaaaaaaatttacaagctcatttttttgcccacttactaagtttcaagcccatttccatcttctttcactgctgttccttgaggccacctctttaagccacttgcttgggtgcttataaatacaatgtccctcagatgggtacctttaattgtccctcctaatatcactaggtccctatccattcctttttcattgctctggaggggtggcttaaagccttattttgtggacataatgaaaacatgtccacatgcctctagactaagctgtctacaactgaagaaatatgacatccaactaattataacttaattttatcatacatttattattatatatatgttctaagtattttacatggatcaacttatttaatcctcatggcaactctatgaaggaggtactgttgttatcctcattttacagatgagagaactgaggttcggagaagttaagttactcgcctaagattacacagctagcaagctaagtctcaaacccaggtctatatgacctggtttgatgaataattaatggtattatgtgctattacttattttattatactagtcttgctgcgcctggattagccttcctccaaccagaatcttgcctttattgttagtatgctcattgcctcctcccggctctgccactttggtaaatagctgtctagtttgatggttctccaatgagcatcaatgtgtatcagaattacctggaggccttgtgaaaacctggattgctgggacccatccctagaacttctgacttaggaggttatggagcttggcagggggaggagcagtgaatttgtattcctgacaaattcccaggtgatggtccagagaccacatttcgagaaccattgatctcctgttaccactcaattaaccaactcttcttagaaactggttttctcttgagcaactcactgtttattaaaacagaactaaatgtttccattttgacttatttaaaacatcacctaaacatgtatatctccaagtgatttttaaattatttttaattgacaataattgtgtatatttatggggtacaatgtgatgttttgatctatctatacactgaagaaagattcagtcaagctaattaacatatccatcacctcaccaacttatcattttttcagggcaaggatgttaaaaatctattctttcagctatttggaaatatatattattattaactgtggtcaccatgaagtgcaatagatcacttaacttatccaagtgattttttaagagcagtttcactgtactgtgtcttgatcgtattcttgaacctaagtagtttggcatgcaaatgtgatttcagggatttacctccaattaattcccccaatggcttatagccacccccaccaccattcacatcatacctgaaagactttatgtgctatttaacttgattaaggaaatggtaaattgaagcttatttactacaagaatacttagtgacaggcaatatggcttggggattaagtacagggacattgtaattagacttgggtttgaatctcaactttgcctaataactagctgtgtaactgtgctcaagtgaagtaacttctctgagctctatttcttgtacagtgggagatgataatgaaatcaccctcatgaggctataaataagattatatatgtatagcataccctatcatgccaggtatttaaaaaaaaaactaaagaaatagctggtttatgttagtgattgcaaacctctaatcttcaggcctgtgatattccaaaaattgttgcaagagatcagtgacactgtgtgcataccaaaataaaatctcaaagatagaattaataagaagtagcatgtatagatgtacaattcatttccaatctaatctatgtagatgctgatttaattagtaaaatacaaattcacttagaggtatgactaatgatatgataactttctgtcattatgtagtacattttcatcaacagatattaaaagaccaacttttttgatatttaagaaaaatcttcacactttaaaaagttgtgaagcactggtttatctgaatagtctgttaatgcactatcccccagcagagagcaggcctctgaaagaggggaggccaggtcagctttgatgagcaaaggagacagaggacattctagagcatggggtgttgcttaaggagagcatgatgtggagggctggctgctgtagtgggggcaatctgagaaacccagggccagtgggaggatattagtcagggaagagcaggggcaataatgccaagatgtccagggaatctaccaaccagctaatctgttcctaggtgactaaggatttcaagtgaacaaccagccacaccaatagtgtatctagctttagagaaggactatgcgaattcattaggatagcagagtgtgtcttcctgaaggacttgggtgcctaaagtggaaaaatgcattgttgctttattctaattgcattattcagtcaaatcccttcaaaatgatcagcaaacagcccctgaaataggaaagtattggtggcaggagtgaaatttagagttgttttgatagaataattttcttcaggggtttgggctctgattgctacttagactgagtaaaagtattgctgaataaggtgctgagtaaatgcaagttgtcattaagaggaccgtggctagtctcttaaattatatccactattcagataaatgttgcatgccttcctaatagtctgcttccttatcgacttgagcatttagttgttgttgttttttttttgtttgttttgcttttttatttgtatttatgtaagagaaaaagggcaagtggtactcataacatcttgccagagcttcatagatgacatgagtatttgtaaatagggttggagttatatatattttcctagtctagaagtgcaagcttaagtttgcattcattatttgacacagtttggttatggtaatagtatatggtttggtagcagtttaggcttgatttagatgagaaaggaacaattgtgtttcatgtttttatttctaggaatagctgaattcagtttcatgtaattggtactcagaacacagctatccaagcctttctttatagtttctcttccatgtttccatttttatttccacccactcctatatagggcattaaaaaatgtatctctataaccatttaaaaacatgtctgtaaattttccacccagtagattttacaacaaatattttttctcaaaatagcttcgccctgcaacccaaaacactcctgaattattttgcactcatatctacccttcctaccatcccttaataagggctcagagaatgcagactcattaacatcagcctaaggaaaacagcatcacaaaaatcagtccaaggccaggcgcggtggttcacccctgtaatcccagcactttgggaggctgaggcaggcggatcacctgaggtcaggagttcgagaccagcctggccaacttggtgaaaccctgtctctactaaaaatacaaaatttagccgggcatggtagcacatgactgtaatctcagctactcaggaagctgaggcaggagaattgcttgaacctaggaggcagaggttgcagtgagctgagattgcgccactgcactccagcctgggtgacagaacaagactacatttcaaaaaaaaaaaaaaacaaaacaaataaaaaaaaaagaagaaagaaaatcagtccactttcaaagaaaagttaaaatatgcattgtaaaactggatagaactgatttgtacgctttttttgtagttaatacttctatgaaataatatatttaataaattttatatgactatcaccatttcacataattgttttcattggtgtgacggcccgcacaattttaaatcatttcagccgctgtatgcacagttttgtattttgctttttcaactaacacagcagtatttttctatgtttgttcatagtacaattttctaatttttaatgtttgatattccatcttgtttattcagcataagttacttagccattcccattatctgttgtattttaataatttgtgaggttattcatttattttctattaaagcagctaggcaaaagtttgactttacagtcactgtcctctagaatatcaatccctaagtgtttctgcttgactgttctaactctcccatttctacctgggtcaatctgaattctgccacgtaaaacatggttacccagtgaaagatctttacacacagtatattaggttgctaggggaaacttacagtagcaagctttctgtttgcttatttcacatacattctctcattaattcttctcaatgtgtctataagaaggtattgaattatttacaaacacttgggataaagaaggaggataggaagagttgcctgctgttggggaggaagaaaggaaagaataatcgaggtgatggattcattaagttcataacaagctgtccttgcaggaggtaagtctgttaggatatcttcttttcctttcctaccctaactctaaaatttcgtctggaccaactcttctgcctgaactataaacctccaccctgtgaacaatgtattaattttcaaatatttcttgtgtaggtgaatacaaccaccttcatatccacacatgtctgtgctcagtttggcaatgaatcaccttctaaacatccagaacaatcagtcagataaggatcacctttgattaagatcttctctgccaggctctattggaataggtgccagcttctcactacttagagcttacgattgtgcacaatgacagctaagatttgtctgggcaggaacatatttttcccactcttaaagtcaacatttgaggtgtttctaagtggaagaaattccctttgctcattctgacttttcattcagttcaagctctccatcttttgtaagaaatgttgttctccatcgtgctgaagcattaggttgctgtttccccaggccaatcagtctgaagataactttatgatgctgctagagcatgacaccatagtttatccattcttccgatttcatcagggtgcctgacgcttgttagacaactttggggatgcagactgtttggtccagccttgttgcaatcagcagtttttagcaaggattacctagacttatctttgagatccttgataatttaatcagtaaaaacacgacatggccttttgtaggctgcagtgagtgcagatagagtgccacaaaggcctctggcacgctgcaagagtaaaaggtggcagggcactacctgcccactcccaaatgctacatgcttcccctctaccacatgcaaatctttgcacttaatcatgtcattgccaagtcccgcttctggtactttgtatctcagctaaagaagatgaagaagtctttgggggaaattgtcttgtgtgggtaggtatttgagcaattctgcctgcaggtgaagaacttcagcttgtggctgcaccacaactcatgcagtggcacccacaacatgtaccaggaatacctggactcagccactgggggtgctgtcacccagtactacagagaaatgggtgcccagcaatgtggttgggcccactggatccagattgtgaaggtagaagggatcttggccagcaggtgccagcaatcaaacagttccacaactccaagatcaagtttgtgctgtcccaccgcatcctgcattgtcaacacaagccacacttcaccaccaagatgcccagcccaacaccttcttttaggtgcagggccctctcactcctggtctgcccaaataagcccaaaaactcccaggcgctaaagaaaatgcccaggacatggtgttgaaatatgcaaagagttgataccatgtgggacatctgataacgttagtataccacaatagtctttattgttgtggacacagagaaggaactcaaagactctttttgatgatcctgacataatcaggaggagacagtgaacaaactttatttcacaggaggctctgatgatgagtggtaaatttaggatatgttcaagattattctgctttcctccctttacaataagtcaagtattcattaagcaaccactctatttaagaccttgtgcaaagcactgtgggagacatgatgatctattaaattgggttttcttctttcaaacttaaattctagttggagtgacaagatctgaaaaattaggtaacacaggagataaatagttcaaggcaataatagaagaggtgtcatgagacaaaacattattatttgacaaatgaatggcacagacaagtgttctagaggttgcaagaagatagagctgagaggcatgctaatatagtgcctttttctcctgctgttttctctgcctaaaacgtccagtgtatacatccctctccacctgtaaaattcctatttctcttttgagatacagtcattgcctattcagtgcaatcgtcatcagcccacccagagttaatcacattacctctcataagcccatagaatcttagactcactgagagtataaaagcacatgttaatgcctagtgttccattattggaacgctaagcatgtgggaattatttatatcctactgctcaaggtcatcaccacggtctgattgaaaaattaaattgcaacctcaggtataaatgggtttattattcactgtaattattcacttacacattggattcctctaccagactgagaccttcaagggtaggggcaatttgatagtaatttatctttctgtcccaagaacctaccttagaattggacacatagtgttcagtacatttattgaaatgaaatgagtgtagtggaaagagtactggacttggaatcagaattaaaactgtcctgggcttggtaaatgtttgtttttctgaaatgtgtgtcatgtcacctctctgcactgaataaaatgatctctaaagttcttatagcactgaaaactgtgcaatcctagcctgggagtagttatcaaaggttttccataattgctgttgataataaataataatcacaacagttaacatttactgcatacttactatgtgctaggcatagaacatgaattatgtccttcaaccctcaaaataaccctatgtggtaggtactattacactcattttccagatgaagccaagactccaagaggttaatttactagaagtcacacagctagaaactgttgaaacagagactctagttcaaatctttttgaacctagaggcctttgctcttaatagccacactagtcattctcaaccctggctgcatatgagaatcaccagggagtttttaaaaaatagtgatagccaggcccaactctgcagagattctggttcaattgatctgggatgaggactaaacattggcagcttttaaaagctccccaggagattctaatatgccaccaggtttgagaactatttcattacatttttcagcctttgagagtacacctgggccttgtaaaagtttgcagtttagatggacaagagaaagaaggacattctgggtgggaattctgtttaagctttaaggtgatacacaactatctgaatgtgtcttatttctctgaagcaggtgccctttgttgtatcaaagctacttacagctgagtatatataggccagacttagttcctgatgcaattgcatttggaaacagtttcaagagtttcctcagttcagaaagggatggcttctgcactggctgctattaggtcatctgccactcttctgacagaggtcaacgggaaaaactacttccttgtgtagggacagcaggttggttctctttgccccatacagtagactgaaaacctgtcagtttctaagcaaccgtttaaatctggaattcatgaatcagattaccttactgagaaagctggaatgaagagaattttgaaaaagtcatggaatggcttccccctcctttgtggtacaacacttgccatggggctggctttacagcattcttgaagacattgttctctggtcactgcagtaaaagaagcagcttatttggggttttgttggctgctgctgctgaggttggggatagtttcctgagaatggtatacctgagaggatcgagaacagcaaagaagttggtagtaaaatgatattaccttctgcatgtggccattgagaggatttactgagataatccacgtaaaggggttagcatagtgcctggtccgggggtagtcctctgtaaatgctgttggctgcttgtatttctgtgtatttgtcaaaacaggatagtgataagatggcagaaagatgccaacagatacagtttgaggtgatgtttcttttatgacaaaggattagaaactagagggatggtatgaatagcagcagatagggcaccatgcttcctggtgaaagcatggtgctcaggtttctgcaaatttccttgggggtatgcagctgtgggtgacaccacttgcttgaaataaggattttgtcaggatctagaaggtccttttgccatttttactatattttattttaatcctttcctgttacttcccgactattttgcagactctgactacaaatctacctactcaccaaggtcaaataaatgaccacaactctttcacattcttaagtatttacgggaataataggtgaggggaagctcactttgcaggaaacatcatttagtgggataggcctgtttgaggtctacccctgcagggctctggtgatgctttggaatagggtttatctttatttggaagtagtaagaccttggcttcaaatgagaacaaaacatctcttaggagagttttttcctttgaaaatgctcaatatacaataatgcaaacttgtaaaaattttaattagtacagcaatgtataagaattaaaaatccatgttctattttccacaagcccaccatcagtctcaaccccccagacgatcacggttaactcttcatcatgcatccttccagatctttacccatccatctataaataaatatatgtacaaaaataggattccactatagtatatagtatccgttttccctctcacataacaatatgtcttggagattttttctatgttaatacattggtctctgtatctttttttttaaagcaactatgtaatataaatggacttttcattttgttccatttttttctttatgaacaaaacatttttaaataaaaacagcacttatgtgttaattcaattatctaacttcatacagccaataagtggggaagtcaagatttggaccaatgttggccgattccagaactcatggtattaactgctaggcattgctgtcatttccacaaattattttcactctagttttctaatgtaagcagtagttatgaggcaacaattaaatctcagagttgaaaggaacctttaagacaggttatttagtttaacatctcactctgcaagcaaattattagatgtttacttattaggaaaaatcattcctgaaactttattttggccaaataaaactccattaatttatttgcatttgcagtggtagaaactgtgggttgcttaaacaatagtttgtcttgcctcctttatattttatatcaccattttttcatattatcataaccctctgacataggtagagtaagctattattatgcccatttcataaatggggacactaaacatcagggaaattaagagacttagatttatacagtcagttgtggaaggccacttgaatggcaggcaaaggaccttagactttcccctgaagggagtgaggagttattgaagacttttgagcaggattgaggttatgggtttaggtggatggaggtcagtaggtggtaacatgacaactggaaaacattaggaataggagtcgcaagagccaagttagcaagccaagtcagccattcaagtgcaagtagataaggagcatgattaatcttgatagttatcaggcttgaaaggagaggatagatataagaaaaagtaagaagacaatcttgcgggagatgggggactggagagagaaaagaggtaaagatgattccagagatattggccagaagaaaatcaatgttggagggaagagtagtttggattagttgttgaacgctggcagttagatatttaagtagaaatgcgaagcaatctttggaaaatgtaggactgggacttgggtgagagcagttctgaggttcagcatcaagagtggtctaccttcacagagcttttcacacactcagcacattaagtctgaaaagggatcttaaaagtcgtgtacttgaggtccctcattttacagataagaccaatagatgatataaattgcctagggcttcacacagttcctgagaggtgatgataaatcagatcttttgagtcttagttgtttacttttacctgaaaacgagaagttgcaaactggtaatggaccactgatagttatgtttggccagtagggttatattactgttcacaaacacttgatgcctctctctgctccgccttccccttaacatcaaccttagccacatggcttactttggtcaatgaaatgtgagctgggtcaaatggtatttctagttctagatccctgaggaattgccacactgacttccacaagggttgaactagtttacagtcccaccaacagtgtaaaagtgttcctatttctccacatcctctccagcacctgttgtttcctgagtttttaatgattgccattctaactggtgtgagatggtatctcactgtggttttgatttgcatttctctgatggccagtgatggtgagcattttttcatgtgttttttggctgcataaatgtcttcttttgagaagtgtctgttcatgtccttcacccactttttgatggggttgtttgttttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttagttagatcccatttgtcaattttgtcttttgttgctattgcttttggtgttttagacgtgaagtccttgcccatgcctatgtcctgaatggtaatgcctaggttttcttctagggtttttatggcgattcctcagggatctagaactagaaataccatttgacccagccatcccattactgggtatatacccaaaggactataaatcatgctgctataaagacacatgcacacatatgtttattgcagcactattcacaatagcaaagacttggaaccaacacaaatgtccaacaatgatagactggattaagaaaatgtggcatatatacaccttggaatactatgcagccataaaaaatgatgagttcatgtcctttgtagggacatggatgaaattggaaatcatcattctcagtaaactatcacaagaacaaaaaaccaaacaccgcatattctcactcataggtgggaattgaacaatgagagcacatggacacaggaaggggaacatcacactctggggactgttgtggggtgaggggaagggggagggatagctttaggagacatacctaatgctaaatgacaagttaatgggtgcagcacaccagcatgtcacatgtatacatatgtaactaacctgcacattgtgcacatgtaccctaaaacttaaagtataataataataaaagaaaagaaaagaaatgtgagcagaaataatatgcattatttttgagatgagcattaaggcaaaatttaagtgtataatccaccagattttcttttccttctatcatgaggtcatcaatattctagatagaagtagctctgtcagcttgaacatgatatggaacagagacacaacttacctatgatgggagatgatatgcgtaacaaaaaaaacttgttgtaagctaagatctcagggtcatgtgtcaatgcagcataacctagcctgtcctaactgatacagcctacaacattctgaaaaactgaatcagtggctaacattaaaaaatttggagagttaacagaaaaatccagacttcgggtttctgatgagaaattggaagaggtggcaacatttagccaacttacatacacatggcatgatttgtctgaggctgcatagcagttcttcccttagaaatttgtgttgagtgtagttatacccagtatccactattcctaattgtatcttatacccacccattttttctttatttacatttacatatttacatattacatttatttacattatctgcctgggccttgcaagcatttgaatctgccactctggctttattatagctttccactcctcagggagaaaatgctagagacaaaaacaacagaggactggagacagaaatttagatagtacctacctgtaagtgtgagaaaaagaatcagtagagagacaaataataactgcctagaaaagtaacagaaaaaaaaccctgaattgcatagtgaccaaaacaaacaaaaaaacaaggaagagtcaggaaagaggggatgatcaacatcaggtaaaactacagagttcaagaataaagacagtgaaaaaaaagcaggtcacatgtaacccattaaggaataattgcagtgctttggtgattacggaagccagaggataagagattaaggggaaagtgctgctgagaggatggaggcattgagataatttcttttttaatgtttgctattgaatggaaggagaaaagtaattggtctctaaaatggcagcagaatcaagccaaagaggatttttccccctctttttttttctgtttttgaaagagggacaaatttttgcaaagcagagtaaggaggaaccaggtgattgagggagcaaagtgtgggagatgtctgggaggtgtggatggagaacacatctgatgcagttattttagaaataagggataatagactttcatctaagtctgctgacatagtgtatggggtcttagcgaatcatcagaagtgactcaaaagaagcagtgtctgggtcccacaatgggtattgggtaagggaagaatgatgaccttgtctagaagttcattgaaggtctgctgtctctggttacagttttgaatgaagagcagacaggcagtgaaggatctgatcactgagagactgaacgctgtttgtggcaggaacctgagccctgtgctcagatatattcttggtgctattctggccctcttttctgtcagttctgcaattgtactaataagaaatgtctcttgtctcccataggttaatgagtttggggaggaaaaatgcagagtttactatgatggcaggaagggcaatgcaaatggcctgctgagaaacttgaaatgcaccgcagggctttgaatttcatttcaaccgacaaacattctgctcatcaaacagcaccccctgaagaagcaatacagaattactaaatatactatcagtagtttccagcctgtgatcctagacccctggaaaccctgctgatggtctgcatacagagtcctacactattagtgcttacaatatgatagtgtctatatttctgtcaatgacataaaatggggacttactaatgctatattaccatctcatgattatgcttgggtttggaaaaaaatgcaactgacccatagaccttccctgtaatgcaacaaaaagagagccactctgtgtcatgatgtttatggagaccatgctgtcattcctactatgaccacaatgagagtattaccagggacttcctgatggggtcttagtgaagaatgaagacaagattgttctgtttttttttctgccttaacaagagcagcagcacttatctcactacatccagtaaagtctgttttgtggaggcatacaggtggagaggggacttggagatgaaagctggtaataggtggcccataggatcatttgcctatggaagggattgaagaatagaaacaaaattatagtcactatttaagtgttatggggtttgagttatgtgtccattctgtcagcagattcatttttctgagtgttgaatggggccacaatatagaagaggagggtagtgtggtggtgggaaatgtcctgcctcgggagggagggaaggatgtgtagagaaggaggggcctgatttttggactgtagagtaaaagcaaagagagaatgactggttttcaactgtgtttgactttattgttcttatgtcactggactatgctaggcacaaaaattaagaattagcaaaatgagcaaggcccatgttctcttcagcttattcactcaactataacagtgacacttggtgatattctattagcgaactagattacttctcagaatagcaactgttttccttgattacgtgaatgttgtaagtgacgtactgattcatacttttatggctggcctcatatgggagattgaaaaatcctttctgaggaagtggtatttatacagggacctcaaggatgagtaggagctagtcagcagtggtgggatggggagaagggattgctttaggaaacagtatgcatgtacaattgccttgggaagggaaagagcaaggaatgcctaaggatttcagagaagatcagtggagcatggtgaacaaataggagagtggtatcagatggggctgaaaaggtagacaaacaccagaagcataaagatttttttttgtgggactcagctttgagcattcattgaaagcaagtttatgaatattgttagatacattgtactagaaaatcttcatattctcgggcttgtgttgtatgtacagtcactcatttgatcattcattccaacaagcttatgttaaatatctgctatatgccgagttttttgtgccacagagttgtatacctcccagatctgtgtaaatttcagctgccaccaacaatgtggtcactttttcagtcctttccttaggatagcatcagactcagcttcttttcattattattatcttaggtataacattgctggtttgaagaacagggcccaatgccagtgacctctgctgccagctatccagaaaatgttttccaagactctcctggtaggcaagagcaggagagagaaaggaaactgcagctgtgtcttcatgccagtaaagcagcatttggggagttattaggcttagttcttacagctcttttcaactatgagctttgacaaagagtctgtaattgtcattttgaaggtcggtggatgtcacttccttcctccttggtctttctagtttttctttatttagactctgtttttttccctgctgcctttttaaatttgttccatctcttttattcagttatcctagccatctctctgagcatgggtaccaggggtaaggaccctgttctcagtaacagggaaagaggagctgtactcagataggctagcactgacccaggaatgcacctctgcagacatctttatcctccttcacaaatagtatttgtgctgaaggaatcaagtcaatggcaaagaaaaactggctttcttacctggatacctatttaagaagttttctccacttactctggccattactaatctgacctttctctgaactgtatcgtacatccccactgtgaataataaccatatgatttgcctcttgatgatttattgcattgaattagtttctgaatatttagtatttattgattttgtttccctaacaggatttgaaactcccttgggaaagggactataaccatacttatattttatcatcttagagatgagcaaaattgcaggcatgcagtttagccactcaatggatatttgactgatttaacgagacctgccaccttattgtacaaagcaatctaacatagaggaagacctttagattcccactaccatttctttgattattaaaagacagtagaatttttgacaatgattctattgtcaacctccctcagttgtctttctactggtagacctgtatggaggcatggatttagatgaaacatctatttctttgtgtcaaattctgctcctttgtgtggcagtctgcattatacaagaatgcgcttgccttatttctacatcaaagaaagtgagagccaagaaatgttcttaatgagttctttttggttcttatgccctctgaagcagcccaggaggaagagaggacaataataggggaggacagcaatataggaaagtaggaagatggtataaatgaaagggacagatgtcacttgaggcctcaaattaacttcatcagatctttgaattgctgcaaataaatggcaagtgcggagcaaggagcagtatgtgaagaagacattctttggtcttggcagcctgtgcttgtataacaaagatgagagatggagttgctagtattctctgttgaagatgtaggagttcaatagtggagaaaaaagaaaaatctaagaaagcaaataattgggatagggaaaggggattatgtttgtttcctattgctgctgtaacaaattacaacaatcttggtggttaacacaacacacatttattattttacagcactggaaaccaggagtccaaaatgggtatcactgagaaaaaaacaagatgtgggcagggctgcattcttttctggaaactctaggggagaattagtttctttgtctttttcaccttcttgagggtgcctgaattccttggactgtggtacccttccatcttcaaagaaccaactaactctggacaaactctggtgaagagtatgtagatgacataggagatacagggcaggaaacactgagtgaaagccaatgaccttctgaagatataaaataatttgtaaattttatgagagacaaatggcttgagagcctagtcatgctgctttaaaataattttatgttttttaatgcatatgaatacatttatacatgtaatgtgtgtctgttagagtgaaagttgatactgtttagttctgtgatttaagacatagtataagataaagtccatggacacaattttgtgaataatcttaaacttacccttcttttcccagagctaattgtttaatgctttcttcaccctctgctttatagccttctgtttcattctgggacacattccacccccctcatttttttttttttttttggttcctagccttttccctttgttcctctgctgacatcatacgtgtttttgataatttaataaaatacatagagtcaatcacagcatatgtacatttttggggcaaaaattctgtttaggaagacttctaaaatatttcattccatgctagttaaaatttaagtttaaagataatatttttacagtccctgtagccaattccctagaacctctttaatttatattctgtttctaattctacttctgatgcttcagtgctctgacatgtggcctgcttagaaaaaaaataactttgttgaggatactatatgacttgtgacttttccctaacttgctttggtcagagccatggatttaatttttatgtgggctacagtgtaattctaattcatgactatagtctgtactccttatcctgggttattttacaaaaggagtttagattaaccaccccaaagtgactagatatatgcaaggtttctatttctattattggagaaagaactcctgagtttctgccctactgatagtgagtcaatactccaataattgtacatagaggaaggcacgcagtgagcccttcagacaaaatgctttcatcagtctccttagtctttgattagtccttccttccttcctagaatgacctcatctctctcagaatgacttaaaaagaagcatggctttaaaaaatgagaataactgctaatgactttatgatcctgaggcaaagttttctttgcacaataaatgcttagttatgatttgatagtcaaatgtcgtgatggaaaaatgtatgataggcagtttgaatcagtgtagaaaactcagaaaagaggaggtatagcccaatggttaaatttgggggctctggaatcattaagagttggtttgggttctaagctcaacacttaatggctttatgaccctaaacagttacttaacctttctcaacttaactttcaatatgtgtagtattgcctatcttagagggttaattgcatcacagggagattttcattgaaggttgtttccctaagtaacttggtagctgctttgaagtttcactaagaaatcaacttgcaaaaggcagataataggagaaaagacatatacatttatttaacgtatgtacatgggatcctttagaatgaagaccaaaagatacagggggaactcttaatttttatgcttaggttcaacaaagtatggacagctatgtagaaacatgattggacaaaaagtgtatgatctaatgaataggttgagtggggaaacccagcaagtcctgtctgtctagattcttcttggcctctctgagcacacagttcttccttctgggcatggggcaggaccctctctggaatggaagggtcttatgagctacagccaaacaaggtaggccagataatttctttatggctggttttgccacagaaagtcagagggaaagttaaagtaatatttttaggttttatggctggcttgggggaacatgggttctggtttccatgacctgccttgaagaagggtgattctagtttctatggcaagcctcgagggagaatggaactgtgagaaaggaggatagcagaaggttaaagaaaaacttgtatctgaggctgatcctgaggccttaattttggggcattgttctctgagccccaacactgcccatccaagaaatttaagtgcagagacacactagaaatgaaacagaaataaggcagcctaatgtagttgctcagtggatgggctctggagctggattcaaccccatgctttaccatttagtagatgtatgacttcaggcaagttactttaccttctgtacttcaattttcttatctataaaatgggaacaataatagtgcctacctcaaagccttggtatgaagattaaatgaatacagataaaataataagcacagtgtctgacatttaattgatgtttaagaaagactatctcttcttattactgaaactaatgctgttagtactattaataaaaagatgatatatatagagatacaaggaaggatcaaggatgactcctatttttcaagcttgagcaactggtcctgtggtagtgccattcattgagatggggaaaagtgaaggaggaatagattcgggcgtgtgtttagtgaataacaagttttgttttttgacatgttgagtgtgagatgcctgtggaatatcagtatatagttagtcagttttggccgtgcgcggtggctcacagctgtaatcccagcactttgggaggccgaggcgggaggatcatgaggtcaggagatcgagaccacggtgaaaccccgtctctactaaaaatacaaaaaattagccgggcacagtggcgggtgcctatagtcccagctactcgggaggctgaggcaggagaatggagtgaacccgggaggcagagcttgcagtgagccaagatcgcgccactgcactccagcctgggcgacagagagagactccgtctcaaaaaaaaaaaaaaaaaaaaaggtcagtttttctgtgtctggagatcacagaattgtgatccaggaatgtaatcttgggagaagtaggtattctgatttttaagattatgatagtggatgacataaccaagaaacataatttagaaagagaagggaggagagcccaggatcaatctcggggccatagagggtgaggaatcagtaaagaaaatgaatagatatggaaagaaggtaggaaggaaatctacctttcatgacagttgagacagaagagtgtttcaagaagagagtaatcaactgtgtaaaatcaggacatagaaacatcaattgaatttgactcctttgagaagcttggttatgaagatgcatagaaaaattgaatggtggcctggatgagtcatcaaggaaggatctattttttataatatagaaagttatagtggatgtttatattgcaatagagacatacactagaaaaggagaaattaaagaagagaaaacaggagggaatgggatccagagtacaatagaggggcagggatacttcctatatttctatgagataaagtacatagcacaatgcctggcatatagtaagtgttcaatgaatagtatctgtcatgtttattgttgttgttgttactgtattaactcaagagcccaagctggcttgcatgtggaaaagacagttggagcatgcacagagccaatagccttcatggaatgaaaggccttggtgagcagatagcatttagagtgccgtatcctaaacaaaggcaaaaaaatgtggttccaacatacacagatgcttctcaatttacaataggattacgtccagataaaccaatcgtaaattgaaaatataaagtcaaaaatgtgtttaatactacaacacagcagatagttcccaacttatgatggttcaatttatgactttttcactttatgatggtgggaaagcaatacacattcagtagaagctgtaaccccatcctaagtcataaggagctccttgacttatgatgggtttacatcctaatatactcattgtaatgtcaaacaattgttaagacaaactatcctgaatcagaaactgtccggaaaagcatttggttaggttggcctatctaccctaaccaattttttttatatcatgggaggatgggaggtttctttgattatcatatggatgaaaagataaggtacttttattttagcaactgtacttcaaagaaatgactctaagaaatgggtagatctagttctgttgagattcactgatcagcacatccctggagaggtagccaacactctcctagtacacgttgtccctataacatgtgtgcttaaaggagaaatgaagtgtacccattgattatatttaccttagcaaaatgtgcttccatatgataacattatgcggtaaaaatgctttgtgatttacactgtttgtgtgatgttatgttctcaatacaatgagctgaaggcttttggctattattcctttagaaacaagcacctcttgttgagggctgattttgtccatattatcttgaaatgctttttgcctattcatctctaagtataaatatgagggtttttttttaatcctgcaaaatttcccataaacgtgtgtttttaaatctttcctaaagtggtctttatgcaaccaatagaaatcttaaatatatgatcagttttccaccctgtgttctctagataaagaaaagtttgactggtattagatatgaaaaatggaatgtgctttaaaattttcaatctgtcatttgagatcaatatcagagacagatacctattagactctttccacaactgtctcttatcgttgttaaagtttataagaagttacctggccaggaaatgggtttcactggttttaaacatccgttgttattggtatcatgtatctgctctcctgagtactgagcccagccatttggtttatgtgagtttctagactcctgtgtatttgccttactctctaggatttaggcttttttggttcccatattttgcttggtctagcctgtcacactttgttctttgtacctttagacctgtgtgtgcttgcttgatttaatttattatcttgtctcaactgctgattcagctttgccttctgactcttgagccctgggctaattctcatcctaaagcagcaggttttgagccttgcctccatgctacattgtgacctcagcaccagcattgagagctggtctaactcataggtctaactcagtacaacatttctgattttcatagcagttgcggtagaataaaaagaatactgtgcttaatgtttgaatctctgggtttaagctgtagcactgccagaaactcactaaatgcctatagacaaatatcttagcgtctctgaatttcagttttctcctttgtaagataggaataatattctccttactcatttttgtgattaaataagatatcttatgtaaaaatgcctaatgtgataactggcaaatgtttgtaaaatatttaatctcagttttggacactgtgatactctcatatgtttctttgtttccattattagcctgtttctttttataagcaattacttaatttatttccatgacaaataatcataagtaaaatgtatcagtccaaaagttttctggtaaaaaatcaaagtgaaattacaacacaaacttattttaacaaggtcccaagtttcccaattaacttgtctccaattcttatgtattctgttcaccaattgcattatatctcttctgaaaacaattaatatgacaacttgtaaatttctggcaaagaaactgagtatctagaactgagcagaaatatcacagtgattacaacaaattatttttgtctatttgcttgtaaatctgttttttttttaattttttattataccttaagttccgcgatacatgcgcagaacatgcaggtttgttacagaggtatacgtgtgccatggtggtttgctgaacccatcaacctgtcatctacgttaggtatttctcctaatgctgtccctccccttgccccccacctgttgacaggccctgatgtgtgatgtttccttccctgtgcccatatgttgtcattgttcaactcccacttatgagtgagaaaatgtggtgtttggttttctattcctgtgttagtttgttgagaatgatagtttccagcttcatccatgtctctgcaaaggacatgaactcattctttatcatgggtgaatagtattccatggtgtatatgtaccacattttctttatccggtctatcattgatgagcatttgggttggttccaagtctgtgctattgtgaatagtgttacaacaaaaatacatgtgcatgtgtctttgtagtagaatgatttacaatctttggttatatacccagtaatgggattgctgggtcaaatggtatttctagttctagatccttgaggaatcaccacactgtcttccacaatggttgaactaatttgcactcccaccaacagtgtaaaagcattcctatttctccacaccctctccagcatctgttgtttcctgactttttaatgatcaccattctatctcgcgtgagatggtatctcattgtggctttgatttgcatttctctaatgaccagtgatgatgagcttcttttcatatatttgttggacacttatatgtcttcttttaaaaagtgtttgttcatatcctttgcccagtttctgatggggtgtttttttgttgttgttgttgttgtaaatttaagttccttgtagattctggatattagccctttgtcagatggatagattgtaaaaattttctcccattctgtaggttgcctgttcactctgatgctagtttcttttgctgtgcagaagctctttagtttaattagatcccatttgtcaattttgacttttgttgcaattgcttttggtattttagtcatgaagtctttgcccatgcctatgtcctgaatggtattgcctaggttttcttctagggtttttatggttttaggtcttacagttaaatcttcaatccatcttgagttgatttttgtataaggtgtaaggaagggatccactttcagttttctgcatatggctagccagttttcccaacaccatttaataaatagggaatcctctccccattgcttgtttttgtcaggtttgtcaaagatcaggtggttgtagatgtgtggtgttatttctgaggactcagttctgtttcatttggtctatatatctgttttggtacaagtaccagtaccatgctgtttttgttaatgtagcctggtagtatagtttgaagtcagttagtgttatgcctccagctttgttctttttgcttagaattgtcttgtctatatgggatcttttttggttccatgtgaaatttaaagtcgtttttttcaaattttgtgcagaaagtcagtgttagcttgatggggatagcactgaatctataaattactttgggcagtatggccattttcacaatattgatttttcctatccatgagcatggaatgtttttccatttgtttgtgtcctctcttatttccttgagcagtggtttgcagttctccttgaagagttccatcacattccttgtaatttgtattcctaggtattttattctctttgtagcgattttgaatgggagttcattcatgatttcactctctgtttgtctattactggtgtatagggatgcttgtgatttttgcacattgattttttttttattatactttaagttttagggtacatgtgcacattgtgcaggttagttacatatgtatacatgtgccatgctggtgcactgcacccactaactcgtcatctagcattaggtatatctcccagtgctatcccttccccctcaacccaccccacaacagtccccagtgtgatattccccttcctgtgtccatgtgttctcattgttcagttcccacctatgagtgacaatatgcggtgtttggttttttgttcttgtgatagtttactgagaatgatgttttccaatttcatccatgtccatacaaaggacatgaactcatcattttttatggctgcatagtattccatggtgtatatgtgccacattttcttaatccagtctatcatcgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtataaaagtgttcctatttctccacgagactttgctgaagttgctagtcagcttaaggattttttgggctgagacaatggtgttttctaaatatacaatcatgtcatctgcaaacagggataatttgaattcctctcttcctatttgcataccgtttatttctttctcttgcctgattgccctagccagaacttccaatactatgttgaataggagtggtgagagaggtcatcctttccttgtgctatttttcaaagggaatgcttccagtttttgcccattcagtatgatattggcggtgggtttgtcataaatagctcttattattttgagatatgttccatcaatacctagtttattgatagtttttagcgggaagggatttgaattttatcaaaggccttttctgcatcaattgagataatcatgtggtttttgtcattgtttctgtttatgtgatggattacatttattgatttgcatatgttgaatcagccttgcatcccagggatgaagctgacttgattgtggtggataagctttttgatctgctgctggattcagtttgccagtattttactgaggatttttgcatcgatgttcatcagggatattggcctgaaattttgttttgttttgttgtgtctctgccaggttttggtaacaatatgatgctgacctcataaaatgagttaaggaggagtccctctttttcaattgtttggaatactttcaaggaatagtaccagctcctctttgtacctctggtagaattgggctctgaattagtctggtcctgggcttttttggttggtaggctattaattactgcctgaatttcagaacttgttattggtctattcagggttttgacttcttcctggtttagtcttgggagggtgtatgtttccaggaatttatccatttcttctagattttctagtttatttgcacagaggtgtttatagtattttctgatggtagtttatatttctgtggaatcagtggtgatctcccctttatacttttttattgtgtctatttgattcttctctcttttcttctttattagtctggctagtggtctattttgttaatattttcacaaaaccagctcctggattaatttattttttgaagggtttttcatatctctacctcattcagttctgctttgatcttagttatttctttttttcaaatcacactatttattgccatacagtttgtttctcttttcttttggttcacaatgcttaaatggggaggataatgaaaacaaatctcatagggaatataccctatagacgaaatacattaactacatagtgagttccgaaattattaaagtctagttgctcagttaggatggaagcaggcctctgtggaaagtatagtctaattaaagtttgaggtgtgccttataccaggggttctcaggggagatgatctgacctgacacagcagaggttcctagatgctaaagggttgttctggtgttggtgggcaaagctttgggggttagctcaaaggcaaataaggtatggccctgatagcatgagctctccctctttgagaggccgctaacagtgcagccctgctagggcctaagttctcaaactgtctgtgaaacttttaggattatatgtattttggattccagtagttgaggtcaatagctcagatatggggcctgataaggtatggcctaacattcttgaggggagagggcttatcacagcaaaacatgtcactcatttagcaaatcatataagtgcttggaattattttaaggctacaaaacaataacacaacatgaatttctccaagtgctctggaatatatcattgttagatgcaccataatttgatcataatttaagctgatcacataatgtttttaaatttagttggtcaaatgaaagtcattcaataaacataactggtgaagtggaggtcatattcgttagttttagtaatttcctattacaaaatatattatcagttgcagatatcagttgctccagtaatcctgcataacaaaccacctgaaacccaaaggcttaaaacaatgatcatttaatattgctcatgaaagtagagtttaggtaggtcattcttatggtcttggctaaactcatctgtctgcaatcaactgcaaattgaggaggctgctttgttgatcttgtctgagttctttgacatgtttatgcatgcttgagggttgaatggattttgtctaacctaaaatggtccttgactgaaacagctgggatgactgaaaataaggaagcctcaactctcctccatatctcttacagccttttatatattacccagttttagtttaatgaggaaaatgtctttggaatatttctgaggatactatttagaatttgtttttatgtttttttattagttatttcttgtcttctgctagcttttgaatttgtttgctcttgcttctctagttcttttgtgatgttagggtgtcgattttagatctttcctgctttctcctgtaggaatttagtgctatgaattttcctctaaacactactttagctatgtcccaaagattctggtacattgtgtctttgttctcattggtttcaaagaacttatttatttctgcctttatttcattatttacccggtagtcattcaggagcaggttgttcagtttccaactagttgtgtggtgttgagtgagttttttaatcctgagttctaatttgattgcactgtggtctcagagactgtttgttatgatttccattcttttgcatttgcgaggagtgttttacttctaattatatggtcaattttagaataagtgctatgtggtgctgagaagaatgtatattctgttgatttggggtggagagtactgtagatgtctattaggtcggcttggtccagagctgagttcaattcctgaatatccttgttaattttgtttcattgatctgtctaatattgacagtggggtgttaaattctcccactattattgtgtgggagtctaagtctctttgtaggtcttgaagaacttgctttatgaatttggctgctcctgtactgggtgcatatatatttaggatggttagctcttcttgttgcattgatccctttaccattatggaatgcctttctttgtcttttttgatctttgttggttgaaagtctgttttatcagagactagaattgcaacccctgctttttttttttttttttttttttgctttccatttgcttggtaaatcttcctccatccctttattttgagcctatgtgtgtctttgcacatgagatgggtctcctgagtacagcacaccgattggtcttgactctttatccaatttgccagtctttgacttttaattggggcatttagcctgtttccatttaaggttaatattgttatgtgtgaatttgatcctgtcattatgatgctagctgattatttcacccaatagttgatgcagtttcttcatagtactgatggtctttacattttggtttgttttgcagtggctggtagtgatttttcctttccatatttagtggttccttcaggagttcttctaaggcaggcctggtggtgacaaaatccctcagcaattgcttgtctgtaaaggagtttatttctccttcccttatgaagcttagtttggcttcatatgaaattcgtggttgaaaatacttttctttaagaatattaaatattgtcccccactctcttctggcttgtagcatttccacagagagatccactgttagtctgatggccttccctttgtgggtaaccatacctttctctctggctgctcttaacattttttccttcatttcgaccttggtgaatctgacaattatgtgtcttggagttgctcttctcgaggagtatctttgtggtgttctctgtatttcctgaatttgaatattggcctgtcttgttaggttggggaagttctccaggataatatcctgaagtgtgttttccaacttggttgcattctccctgtcactttcaagtataccaatcaaacgtaggtttggtcttttcacatagtcccttatttgttggaggctttgttcattccatttcattatttttcctctaatcttgtcttcaaactttatttcattaagttgatcttcaatctctggtaccttttttccacttgatcagtttggctattgatacttgtgtatgcttcacgaagttctcgtgctgtgtttttcagctccactgggtcatttatgttcttctctaaactgtttattctagttagcaattcctctaaccttttttcaaggttcttagctttcttgcattgggttagaacatgctcctttacctcagaggagtttgttattacccaccttctgaagcgtacttctgtcaatttgtcaaactaatttttcctccagttttgttcccttgctggcaaggagttgtgatcctttggaggacaagaggcattttggttttttgaattttcagcctttttgtgctggcttttcctcttcttcgtggatttatctacctttcatctttgctgttggtgaccttcggatggattttttgcatggttgtcttttttattaatattgatggtattgctttctgtttattagttttcttctaacagttaggctcctcttctgcaagtctgctggagtttgctgggggtccactccagaccctgtttgcctggatatcaccagcggaggctgcagaacagcaaaggttgctgcctcctccttcctctggaagctttgtcccagaggggcacctgccagatgtcaactagaactctcctgcatgaggtgtctgtcgacccctgttgggaagtgtctcaccatctggagacaaggggtcagggacccacttgaggaggcagtctgtcccttagcagagctcgagcgttgtgctgggagatctgctgttctcttcagagccagcaggcaggaatgtttaagtctgctgaagctgtgcccacagccgccccctcccccaggtgctctgtctcagggagatgggagttttatctataagcccctgactggggctgttgcctttctttcagagatgccctgcccagagaggaggaatctagagaggtagtctgactacagcggctttgcagcactgcagtgagctctgcctagtccgaacttcctggcggctttgtttaccctgttaggggagaacggcctactcaagtctcagtaatggcagacgcccctcccccaaccaagcttgagcatccagagtcaacttcagactgctgtgctggcagtgagaatttcaagccagtggatcttaccttgctgggctctgtggggttgggatctgctgagcaagaccacttggctccctggcttcagccccctttccaggggagtgaacgtttctgtcttgctgatgttccaggtgcaactggggtatgaaaaaaaaactcttgcagctagctcagtgtctgcccaaatggctgcccaattttgtgcttgaaacccagggctcttgtggtataggcacccaagggaatctcctgttctgtgggttgcaaagaccatgggaaaagcatagtatctgggctggatagcagcatccctcactgcagggtcacccacggcttcccttggctaggggagggagttccaccaccccttgcaaatcccagtttaggtgacaccccaccctgcttctgctcgctctccatgggctgcactcactgtctaaccagtcccaatgaaatgaactgggtactttagttggaaatgcagaaatcacccaccttctgtgttggtctcactgagagctgcagccagagctgttcgtattcggccatcttggtaaatctgtttttatccaagaaataatctgattcaacctttgtccatttataaaatgtgattgtttcttccattcaatggattcataagaacagcatcataacacgacgcgacgttttaatgtatagcattttggatatgcaatgggtgaagtcatgttcttgaaatacagctctatatgattaaaagtacctgttgtcacatggtctaatcataaagaagatgaaagagtgaatcagttcttattgacacttagtgcatggacaggtactctgtacatagcgttctgttaaatgcttaggacaacccagtgaggcaaacatagttattactgatttagagatggaaaaactgaacctcacacaggttaaggaatctgcctatagtcatgcagctggttaagagtagagctgggattcaaactctggtcttccttattctagctccctgtgctgtttttactacatgaagcaaactaggcctgtctcctgataacagaatgatagaggagatcctctacatttacaggctgttaaagtggtttatccaactcttggcagtaaacagatgtaaccaagtgtgaaaggacagggtaatcaggggacacagaacgggcaaagactgagtaggacatattcagaggtatgttttattcagctaattcatggctactgaatcttagacctgaaggtaggtacaactcaactctttttgccttcctcaaaaaagaggaagaaaaaagagaaagatcagtgttgaggaaatatatcactatggtatgtagaatggtatctgttaattattttggtgttgtgtcactcctgtcactatcttactaggtgacagcagcagtgtttttattcaagatatatgtgtgtaatattgttttcactggaaaataaataatggatgctatagtcttatgtccccaagaaaattttataagtttttaatgcatttatcatgcatccctacagataactttccccaggaaaattcagccatcagttttgtccatgttgttaatatatatgacatccataatgttacagtgtagagtcagaaagagttcatatttaagctcttccatttattatttaggtgaccatcgtcaatttacttaatctctctgaatttcaactccttctgtcaaatggatcctaagaatattttatgggtctataataaagaggaaattaggaaaaatacatgtacagattcttttatgtcctgttacagtgtcacatggcaattaataaaagctaattccattgctgataatgacaacactcctatagtaacttaagttacattagttctgcactgctcatatccagtttggcagggcagctattattgtgtatgcatgtgtgtattgttttcacatctagaatgtttatctcttgaggatgggaagtgtcagaaactgtttttgtatctctagggccttctcattgctttatttactagcatagttacttgtaatgactatcacaggaaagttatgtagcactttgaactaattttcaagataattattaaacaataactatgtttcttcttaggtattttgtctgtaagtagtgaaagctataggtaggagtgtttatttcattatgccatttggtttgattaatagcctttttctgcaagagtatttcttcaaagatttttttcaaatatgggactatttaaatcactaaatttaaagattttaaggaaatataatattttaaaactagctagcaaacatttactgagtgctaataatttgtcagattctattctaagtcctttggacatattaaataatttaatccttacaaacactgtatgaggtagaatatcattatgatttccattttacagataaagaaactaaagcacagggaggttaagtaacttgcccatggtcacacagctaacatgtagcagggcagggagtcacacatagttaatccaactctagaatctcctatgagtttcagcattatattgcctcttagtgtatgttggtgctaaatttttaagtaaaatgaactttggctacagctatcattattactgattcttaaatattatgcatttattctgataactgatctctttcacacaccctgattaggattttccaactgtgatttgtcctgcttctcttagttgggagtccatatagtttttaccaacttttcatcaaaagccattgcgggtagctttcttcatgtatcatctaattaaaatatcactctgagactgttcctacatttaaaaaacctttacttttatctctccacattttccgatctcttcttactattctgcttacatgtaactgaagcccgcaggagtctattagccttgtgtaagcataccgttggcttgtaattagatatgcagttgaaacaaagcagtttttaatttttttttcaagagtatctcttttcctttgtctgcctatgtaggaatccatctactctgttcagggttacttgaaatttctatatcatgcattagcaagtgaacctcagcttttatactcttggatacatactgctttagaaatgtttttgtcatactaatgtaaaaatcaacagatatgtattcctgccaggcaaaaaaggttttgaggataaatgtaaagtattttcgctacagccatttaatttttttgtttttgctttatttttattttattttttgataaataatcatatataattatggggcacacagtgattgtgatgtttcagaaatattattaaaagtagctaatatctgatatttcaaactccagttgttcattgtgggagatttcattctatctgctttcacattggttttccttacaaacttgaggctctgttcttgcctgtatctttctgagaaggaagattgaaaaaaaatggaagtatttcctgaggaggtggcataatttcttttgagaatatgatgtatagaatggacagctttcttctctctaccttagacagattttcatgaagcaaattgcttatttcccgggaataggttagaatttccgttccttaggtgttctgactatagtgcaacttcaaactggaacatttgagtttgaaattaattcttagggaagaatttcttcttgaggttcaccagaaaaaaggacagttttccctttcctttaaaaacatagaaacaatgcattttcttattacctcagtctaatttctgttttgctaatttggttctgctttggatttcattgctttaaaggtatatctatttatatacatgggctcaacatcagttgaaaaaaagttgattttggctcccctgacagtttcatcttactccgtttttgttcttttgaatttcataaatttacacttaggatattttaatatataaaatgaaaattataagaatgataatttgtgtagaaaatatacatcagatattctttatgagtagaagactacttctgcacatttttttctgtcatttctatgaattgttcatcgtcatctgcattaaaatacactcacttgcattttaatatacagtgtaagtgttgtttgtttgtttgtttgtttttgaaacagagtctcattctgctgcccagactggagtgcagtgatgtgatcacagctcattgcagcctcaatctcctgggctcaagtgatcctcccacctcagcctcccatgtaggtgggactagagtcatgcaccactctgcctggctaattttgacaatttttttgtagaaacggggtcttactatgttgccaaaggtattgctgtttatttttgaatgctgaaactaattttcagggagatcacaaagaaatcttttcatatttaaattataatcattttatgaaattgcttaactgtattaaatctgaatttgtctcgtgtaaagtcatttggttattttttttaaagcgagccttctgaatcatccactcagagccagactggctgggttaattagaagcagctggtgtgcatatggttctaccagaaacctgtaagaggtccacagaagaggtttgccctaggagactcatgagcagtggctagttgtgccaagagtgtagcaagaattggttgaggacaattcagggaagttattaaatagttggagcataaagacttctgttactaaaaaagattgtaagtcaggttttcacacactgggttttggcttatctactgaggataagtgactattgggagagccaaatcaatgtaaaaaggagaagaaatctatgaagttaagaatcaacattgctatgttttctttgaaatattttcctctttgttctttagactctttaatattatacaaatatattcattatgttttgttggttggttggttggttttggtaatccatttggttttctttattcataatctacaactctttttattggaatctcagtttgctaacccaaacaaaggaaccactaatcttttggtgacaacaactaaaccaaagtcactatctctggaactaaatagttcatttaaggcacagcctgaccactccctaatgctaatcccaactcctaagtaattactgaagtattgaaaagtgttctgattctatcttggtgtataaaaactttctattttcttctgcttatttgtgatgccactcctccttgttattcaatacattgctgaaacttacttctgtaaaatttttgtgatttgattgaatgaggactcccatgttactcagtcccttttctattctattcagactccttgtccacgccgcaccctttctggtcatttatctctgggacagttttaatattctattatctagcttgtcctttggctctttgtctacattattattggcttgataaagtcaatttgcattccctgaacacccactacaaaacttcagagaaaaatggtcccaaaactgtgtgggaaagacaagaggaaatcagttataaatattttacacacaaacaaatgattcacttgcagtcactgagagttgctattctcattcatagcctctgatataaacattcacaaagacttgttgatgaataaacatataaagaatgcaaagagttggtagaatttcttattgattattgatttccattttgctcttggatctacaacatggagggtaatgcaacctgtactcttcttgagcaccacgactatgtcactgtgcctagtcaggcattaaattaagtctgtgtagtcaagggtggttattgctgcaactcccttccctcacccaacaagaaaaagcaagctgcttctttgggtgtttcccctcactccttttgaaacatttatcctctggtccttttctcatcttttaattccatgaaaacttacctgtcttcagtctcattctgacaaggctctagtatttgctgttgaaaatgggaaattaagtcgaaaatcaatccctgtcaatgtttgccttctttgaaaacagaaaaaaaatgttgttagattgatcattgatcacattagctttatcttactcctactccttcattctataaatatacttttcctaaaccctaagaatcactttttaacaaatctattgttttcattactgaggcattgaattagagtatgactttgggctttgattgaatactgactctcaaaaacctgtgtaataacactaaattggagacacagagagggtcagtgattctctgtgttacctgttttatataacaactatgtttgagcattgtgattttctttgtaaaacatatctccaggctaactaaatggattttaaaaactgatactatcaggaaaaaaaaaaaacatttaactttggtgtttaagtctctacaacttggctccgccctatgtggccaagtttatgtcttcactatatgtcctacattggtcttattcattacttcctaattgcttgatgtatttttgtaatgacatttcatttagatttgaatttttttgactatgtgttacatttttcctaatactcccagttcctcaaaactttgtacagagctaagcatactaacaaaattaaataaaaagttcaatatcccccacttagatgtaatagaaatttatgccactaatactggcaccactgatacaaaggtattattaaaactgtttattttcttctctccctcacctgtcccagttgaagccttacctaaaatgttaacagtgcattagaaaaagttcttctgtgggtaaaattttagccacgttttcaaaacaaaataactttcttaagttccactgactttgatctcgtcttctacagccagacataacattgtagttgcagtcatgcttggcctgcttgtgatggtgattaaattggatctatgttactgtttatcaagatgtgacattaaagggtcagctgaaaggggctaatgggatgatccattctgtttgatagtgtttattatccacatcaagaaacaaccacattctacatgtgcacaatggagtgctattcagccataaaaataaagtaattctgtcatttgcaacaacatagatggaactggaggtcattacgttaagtgaaataagccaggcacagaaagacaaacacagcatgttctcactcatctgtgggagctaaaaattgaaacaattaaactcatggagacagagagtagaatgatggttaccagaggctgggtaggatagtggggggctgtggaggagatggggatgtttaatgggtaaaaaaaaacccagaaagagtgaataatatctagtatttgatagcataacagggtgactatagtcgataataatataattatacattttaaagtaacaaagaatataattggattgtttgaaacacaaaggataaatgcttgaggtgatggacaccccatttaccctgatgttattattacacattgtatgcctacatcaaaatatctcatgtaccccataaatatacatacctactatgtacccacaaaaattaaaaattaaaaaagaaaacaaccacattgacctatgggctatgtttaaacagaaataatgtatcctatatatgctggctatgaatattattgattctattattatttatatacaagtgaattaaaataactttttcaaatatacacaattctttattttttatttatttatttttttactttaagttctgggatacacgtgcaaagtgtgcaggtttgctacataggtatacgtgttccatggtgatttgctgcacatatcaacccatcatgtaggttttaagccccacatgcattaggtatttgtcctaatgctctccatcctcttaccccctatccctaataatggccccagtatgtgatgttcccctccctgtgtccatgtgttctaattgttcatctgccacttatgagtgagaacatgcggtgtttggttttctgttcctgtgggattatggcttccagtttcattcatgtccctgcaaaggacattatctcattcttttttatgggtgcatagtattccatggtgtatatgtaccacattttctttatccagtctatcattgatgggcatttgggttggtttcatgtctttgctattgtaaataatgctgcaataaacacatgtgtacatgtgactttatactagaatgatttatattcctttgggtacatagccagtaatgggatttctgggttgagtggtatttctggttctagatccttgaggaatcaccacactgtcttccacaatggttgaactaatttacactcccactagcagtgtaaaagcattcctatttttccacagcctcaccagcatctattgtttcctgatttttaatgatcaccattctgactggggtgagatggtatctcactgtggttttgatttgcatttctctaatgatcactgatgatgagctttcttcatatgtttgttggctgcataaatgtcttcttttgagaagtgtctgttcatatcctttgcccactttttgatggggttgtttgtttttttcttgtaaacttgtttaagtttcttatagattctggatattagacctttgtccaatgggtagattgcaaaaattttctcccattctgtaggttgcttgttcaccctgatgctagtttcttttgctgtgcagaagctctttagtttaattagatcccatttgtcaattttggcttttgttgccattgcttttggtgttttagttatgatgtctttgcccatacctatgtcctgaatggtattgcctaggttttcttctagggtttttatggttttgggttttacattcaagtccttaacccatcttgagttaatttttgtataaggtgtaaggaaggggtccagttttagttttctacatatggctaaccagttttcccaggaccatttattaaataggcagtcatttaaccattgcttgtttttgtcaggtttgttgaagaccagttggttgtaagtgtatcatgttatttctgaggtctctgttctgttccattggtctagatgtctgttttggtaccactacttgctgttttggttactgtagccttgtagtatagcttgaagtcaggtagtgtgatgcctccagctttgttctttttgcttagaattttcttggctatacaagctctttttttgttccatattaaatttaaagtagtttttcttattctgagaagaaagtcagtggtagtttgatgggaatagcattgaatctataaattactttgggcagtatggtcattttcacgatattgatttttcctatccatgagcatggaatgtttttccatttgtttgtgtcctcctttatttccttgagcagcagtttgtagttcttgatgaggtccttcatttcccttgtaagctgtatgcctatgtatttcattctctttgtaacaattgtgaatgggagttcattcatgatttggctctccacttgtttattgttggtgtgtaggaatgcttgtgatttttgcatattgattttgtatcctgagactttgctgaagttgcttatcagcttatggtgttttggggctgagacgatggggttttctaaatatacaatcatgtcatcagtaaacagagacaatttgatttcccctcttcctattcgcataccctttatttctttctgttgcttgattgtcctggccagaacttccaatactatgttgaataggagtagtgagagagggcatccttgtcttctgcctcttttctcttttcttttcttctttctttctttctttctttctttcttttttttttttttttttttgaggcagagtctctctctgtggcccaggctggagtgcagtggcgtgatcttgactcactgcaatctctgcctcctaggttcaagtgattctcctgcctctgcctcctgagtggctggaattacaggtgcccaccaccacacctggctcattttttatttttattagagatgggctttcatcatcttggccaggctaatctcgaactcctgatctcaggtgatccacctgcctcagcctcccaaagtgctgggattacaagcatgagccactgtgcccggccctcttgtgcctgaaagggaatgctactagattttgttcattcagtatgatattggctatggatttatcataaatagctcttattattttgagatatgttccatcaatacctagtttattgagagtttttagtatgaagggatttgaatttgaatggatttttattgaaggccttttctgcatctattgagataatcacgtgtttttgtcattggttctgtttatatgatggattacgtttattgatttgcgtatattgaaccagccttgcatcccagggatgaagttgacttgattgtggtggataagctttttgatatgctgctggactcagtttgccagtattttttattgaggatatttgcgtcaatgttcatcatggacatttgcctgaaattttctttttttgttgtgtctctgccaggttttggtatcaggatgatgctggcctcataaaatgagttagggaggagtccctctttttcaattgtttggagtagttttagaagaaatggcactagttcgtctttgtacgtctggtagaattcaactgtgaacctatctggtcctgggctttttttgtttcgtaggctactaattactacctcaatttccgaacttgttattggtctattcagggatttgacttcttcctggtttagttttgggagggtgtatgtgtctgggaatttatccatttcttctggattttctatagtattctctgatggtactttgtatttctgtgagatcagtggtgatatgtcctttatcattttttattgtgtctctttattcttctctcttttcttctttattagtctagctagcagtgtatctattttgttaattttttctaacaagcagctcctggattcgttgattttttggaatactttttgtgtctctgtccccttcacttctgctctaatgttagttattttttgttttctgctagcttttgaatttgtttgctcttgcttctctagttcttttaattgtgatgttatggtgttgatttgtgatcttttcaagtttctgatgtgggtatttagtgctataaatttccctcttaaaactgctttagctgtgtcccagagattctgctatattgtctctttgttctcattggtttcaaattacttcttgatttctgccttaattttgttatttacctcagagtcattcaggagcaggttgttcaatttccatgtagtcgtgtggttttgggtgagtttcttaatcctgtgttctaatttgattgcactgtggtctgagagactgtttgttatgatttcagttcttttgcatttgctgaggagtgttttacttccaataatgtggtcagttttacaataagtgccatgcaacactgagaagaatgtgtattctgtcaatttggggtggacagttgtgtagatgtctactaggcccacttgatccacacctgagttcaagtactgaatatccttgttgattatctgtctcattgatctaatattgacagtgggatgttaaagtctctcacttttttttttttttttgagacagagtttcactcttgttgcccaggctggagtgcaatggtgtgatcttggctcactgcaacctccacctcctgggttcaagcgattttcctgcctcagcctcccgagtagctgggattaccggcacatgctaccacacccagttattatttatttattttttttttgtatttttagtagagatagtgtttttccatgttggtcaggctggtcttgaactcctgacatctggtgatctgcccacctcagcctcccaaagtgctgggattacaggcatgagccaccacgcccagcctaaagtctcccactgttattgtgtgagagtctaagtctctttgtaggtctctaagaacttgttttatgaatctgggtgctccagtattgagtgcatatatatttaggatagttagctctttttgttgcattgatgcctttacaattatggaatgcccttctttgtcttttttgatctttgttggtttaaagtctgttttatcagagacggagattgcaacccctgcttctttttgctttccatttgcttggtaaatattcccccacccctttattttgagcctatgtgtgtctttgcacgtgagatgtgtctcctgaatacagaacactgatgggtcttgactctttatataatttgccagtctgtgtcttttaattggggcttttagcccatttacatttaaggttaatattgttatgtatgaatttgatcctgtcatcatgatgctagctggttattttgcacattagctgatgcagtttcttcgtagtgtcattggtctttatattttggtgtgtttttgcagtggctgttattggttttttcctgtccatatttagtgcttccttcaggagctcttgaaaggcaggcctggtggtgacaaaatccctcagcatttgcttgtctgtaaaggattttatttctccttcccttatgaagcttagtttggctggatgtgaaattctgggttgaaaattctgttatttaagtatgttgaatattgtcccccactctcttctggcttgtaggttttctgctgagagacccactgttagtctgatggacttgcctttgtgggtgacctgacctttctctctggctgcccttaacattttttccttcatttcaaacttggagaatctaatgattatgtgtcttgggcttgatcttctcatgagtatcttggtggtgttctctgtgtttcctgaatttgaatgttggcctgtcttgctaggttggggaaggtctcctggataatatcctgaagcatgttttccaacttgcttcaattcccccccttaatttcaggtacatctgtcaatcgcaggtttggttttttcacatagtcccatatttgttggaggctttgttcattccttttcattttttttctttaatcttgtctacatgccttatttcagcaaggtggtcttcaatctctgatatcttttcttctgcttgatcgattcagctattgatacctgtgtatgcttcacgaagttctcgtgctgtgttttacagcttcatcaggtcatttatgttcctctctaaactggttattctagttagtagttcctatcactttttatgaaggttcttagcttccttgcattgggttagaacatgctcctttagctcagaggagtttattattacccaccatctgaagcctacttctgtcaattcgtcaatctcattctccttccagttttgagctcttgcttgagaggtgttgcaatcatttggaggagaagcagcattctcgcttttggaattttcagcatttttgcactgtttttccctcatcttcgtggatttatctacatttgatcttgaggctgatgacctttggatgcggtatttgtgggagggtcttttcttttgatgtcgttgttgttgtcattgctttctgtttgtttttcttctaacagtcaggcccctcttctgtaggtctattgcagtgctggaggtccattccagacccttttcacctggatatcaccagtggaggctgtagaacagcaaagattgctgcctgctccttcccctggaagctccctcccagaggggcactggcctgatgccagctggagctctcctgtatgaggtgtctgtccacccctgttgggaggtctctcccagtcaggaggcacgggggtcaggtacacactcgaggaggcagtctgtcccttagcggagctggtgcactgtgctggtagaatctccttgtcaggatcagctgctgtcttcagtgctggcaggcagaaacaattaaatccactgaagctgccacagcagtcggccttccccctaggtgctctgtcccagggagatgagagttttatctataagcacctgactggggctgctgcatttcctatagagatgccctgcccagtgaggaggaatctagagaagcagtctggccacagctgctttgctgtgctatggtgaattctgcccagtccaaacctcccagtctccttagcactgtccggggaaaaccacttactaaagtctcagtaatggtggatgcccttcaccctaccaaactcaatcatcccaggtcgactccagacttctgcactggctgtgagaatttcaagccagtggttcttagcttgctgggctctgtgggagcgggacccactgagcaacactgcttggctccctggcttcagccccctttccaggggagtggatggttctcctgtctcgctggagttccaggtgccactggagtatgaaaaaactcctgtggctacctcggtgcctgctcaaacagccacccagttttgtgcttgaaacccagggccctggttgtatatgctcacaagggactctgctgatctgcagattgcaaaaatccatgggaaaagcgtagtactcagggctggcagcacagtccctcactgtttcccttgcctgggggagggaggtaccccagctccttgcgcttcctgggtgaagtgacaccccatcctgcttctgcttgctctccatgagttgcacccactgcctaaccagtcccattgagatgaactgggtacctcagttggaaatgtagaaattacctaccttctgtgttggttttgctgggagctgcagaccagagctgtttctattcggccatcttggctccttccaaacatacacaattcataaacatacttatgagttagagctccttctgatcttggtctatctgagagaatgtgtgagatttaatttctctgtttagatttcttaagctataatctggctttgaccatgtggaactgagcaacatttctgtatagcttttattcccactataaatgttcttgaggcttttaacttctgatgatctagtctttacaaagtttctgtagtgcccaagtgttgctgttttttttttaatgattaagatgaagtgattggcaaacttttataatccttcctatttcttcttaattcctttcttttctggaagttaaaccaatgtgctacacttttctgtccttctttaaacattaaaaatagaataattgcaccaagtggtacagatcaatgttcgtagtaccaagcagcaacctaggataatcaattaggtcaaccttttccaagtaagtaccatgggtcattagttctgagggaggttgggtaataggtgctgcatggaaaaagaggaagtagctatgattaaatgatatttgaaaactgatattttactgcatttttctcagagcctttaatatactgatgtttcatgtgaatttccaggaaagaaatatagtaggcagtatttacagggttatccaatttttttgcttccctggaccacattggaagaagaaggattatcttgggccacacatataagacactaataggaacaatagatcatgagctaaaacaaacaaacaaaaacagaaaacaaaaacacaaaaacatctcataatgttttaagagagtttatgaatttgtgatgagcttcattcataaccatcttgggctgcatgtggtccacgggtcgcaagttggacaaccttgatttaaaactttttccaaatgaaatgtctcagagagctagtgacaagtattccacatagcatattttgtgaaatgctacattagatgaatcctgcaccaagtgtgtggagacatgtgtcctgattcctcttctgccacagagtagttctgcgactttggagaagttgcctttatggcttttgcatttcctatttgtaaaaaaataggaagttgaattagaacagagctaggggtaggggatcacttctcagaaaaaactctgagactttttcagcccttccaacaaagttttgacataatcttctaatctcttcaaactttaaagctactgttgctttgggagcacagagtgtcccttatctgtgttgagatggagagtagaagttgagaaccactgggctgaaatcctctttgagctcacttccatctcatacttatcatgtgtattacagatagccagtcaaacccaaagtttgttttggctacctgaaaaaatgttaatgtttttgttgatgtgatatttcctcataacagtttgtcaaaaatattctgctacttagaagcagttataaccattccctttcatctgtttcaggaatacttatgtcatcagtggtatcaaactaaataacagagagagaggatctctaagaaaaaatgtttatttgggaatagaaattgcagtgggaatacaagtgccatagtaaactattcaggaaggtaaaagaagataaagatttttaaagaaaaaatgaggattacataaatattttgagataattatcttggctacaaggatcaataacaagggtggcacaatgtgtgaagttggacaggcagcttctgggcagattgtctcatggaaaattgaaatggtctttgtgtaaggttgtggctttcgcagtcttttgtgataattattgttattggggatttatgcctgagaaccctcccttcatggccttccttgactctatttgtcatggtttttagcacaaatgactccattttgattatgacaattttcacatttttcccttttgatgaagatatttttctgaaagacttactcattgattatcctatagttaggttttcattgtccctccatgccaagatggatctgtcctgatttcctctagtctggtctggtctccagtgtgaaggaagtgattgatgactaagagtcagtgtcaaaactcttttagccatatttgagcaacaagagagactggggtgagttgctcttgagctaaatctacctagagtccattattaagttcaaatttgtctgtttagtagatatttgttattatctcaaagtattgggccgatatcattttgttaggagttatacttttgtagaaatgtaacaactagctagctggtacaaagtttaaaaaggaaactatgaagtaaaattaatagtaatataataatcatagtttgtaggatagtttttttttaattatcctttaagttctagggtacatgtgcacaacacacaggtttgttacatatgtatacatgtgccatgttggtgtgccgcacccattaactcatcatttacattaggcatatctcctaatgctatccctcccccctctccccaccccacgacaggccccggtgtgtgatgttccccttcctgtgtccaggtgttttcattgttcaattcccacctatgagtgagaacatggggtgtttggttttttgtccttgtgctagtttgctgagaatgctggtttccagcttcatccatgtccctacaaaggacatgaactcatccttttttatggctgcatagtaatccatggtgtatatgtgccacattttcttaatccagtctatcattgatggacattcgggttggttccaagtctttgctattgtgaatggtgcctcagtaaacatacgtgtgcatgtgtctttatagaagcatgatttataatcctttgggtatatacccagtaatgggatggctgggtcaaatggtatttgtagttctggatccttgaggattcaccacactgtcttccacaatggttgaactagtttacagtcccaccaacagtgtaaaagtgttcctatttctccacaacctctccagcacctgttgtttcctgactttttaatagtcgccattctaactggtgtgagatggtatctcattgtgtttttgatttgcatttctctgatggccagtgatgatgagcgttttttcacatgtctgttggctgcataaatgtcttcttttgagaagtgtctgttcatatcctttgcccactttttgatggggttgtttttttcttgtaaatttgtttgagttctttgtagattctggatattagccttttgtcagatgagtatattgcaaaaattttctcccattctgtaggttgcctgttcactctgatgatagttccttttgctttgcagaagctctttagtttaattagatcccatttgttaattttggcttttgttgccattgcttttggtgttttaatcatgaagtccttgcccatgcctatgtcctgaatggtaatgcctaggttttctctagggtttttatggttttaggtctaacatttaagtctttaatccatcttgaattaatttttgtataaggtgtaaggaagggatccagtttcagctttctacatatggctagccagttttcccagcaccatttgttaaatagggaatcctttccccatttcttgtttttgtcaggtttgtcaaagatcagatggttgtagatgtgtggtattatttctgaggggtctgttctgttccactcgtctatatctctgttttggtaccagtaccatgctgttttggttactgtagccttgtagtatagcttgaagtcaggtagcttgacgcctccagctttattcttttggcttaggattgtcttggaaatgcgggttcttttttggtttcatatgaactttaaagtagttttttccaattctgtgaagaaagtcattggtagcttgatggggatggcattgaatctataaattagcttgggcagtattgccattttcacgatgttgattcttcctatccatgagcatggaatgttcttccatttgtttgtatcctcttttatttcattgagcattggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcttatcagcttaaggagattttgggctgaggcgatggggttttctaaatatacaatcatgtcatctgcaaacagggaccatttgacttcctcttttcctaattgaataccctttatttctttctcctgcctgattgccctggccagaacttccaacgctatgttgaatagtagttttaaaaataaattaatcctttataaaactgttaagaccgtcacagacatttacaatatgtttaaacttttagttttgtcctatatttaaaaaatagtcatcttattttaggacaaaaatttagcatataagttttttatacaaatttttaaaaagatttttatctgtatatatatatatatatatatatatatatatatatatatataacttaaacaatctctctttggtttctttaaatcttgtttttattgttctaaacctatatttaaaaacaaactttaaataacctgaatttagacaaaattactttctaaataaataacccattttcaatgcactttcaataattggttttgttagaaatacatcttttgtggttcactttgtatataaaattatacatattaattagaatttttaacttttagtaaccttaatttttagtgataatctaggaagaacttttgagctgtctatcatatatcagtattttatagatgagaactattttataatttttaaaaacatgttttctcctaacataattttatgtatattaatagatgtaaattatttagttttttaaataaaatttaagtattcaagaacaaacttatggttagtaatttatgttttagtattttatcttatttgaaaatgaaccagataattaatgagtgtttaatatttaagataactttagatttttcaattatatgaaaagtttatttataaatgttaatcccatttatatttaactgttttattatttatttatttgagacagggtctcagtctgttacccaggctggagtgcagtggcacaatcacagggaatttaactgagtaattgttttgaggtcagcctccatctcctgggctcaggtgatgctcccacctcagactcctgagtagctagaagtacaggttcccgccaccacacccagtcaatttttgtattttttgtagagatgggatttctctacatgttgcccaggctggccacgttgcccaggctggtctcaaactcccaggctcaagtgatctgcctgcctcagcctcccaaagtgctggtattacaggtgtgagccaccatgcttgaactatataatatatatatatggattacttacggaaactaagatattagacaaagctggttgtcattttgagttattttcttgttaaccactttttttccttatgaacttcatttgtaaattgttaatcatttttatagcctgtgaatatctgggtgtttacctaagtaatagccttaaatatatgagcgttttgtcaataacacagaaaagatagctgtttttactaaagtagcaatattaaattagtcttatcaatgagttttacaaacaaagattattatgtttttaggttggatttatagttttattacctcaaatcatctagtagagataagtataatcttgtctaaaaagtaaacccaaaaataatatgttgacaattttgaatatattttaatttttattttattaacaaatgtaaaactgattatttatcaaagatttacttaagtcatgtgaactaaaaagcatttgggttaattactatattttaacaatttttatgagtgctcatttacctaagccaatctaaacagaatttttaaaagggaattctggttaactctgccaggtttttccaactagatacaatacatgtacctacatgtaaatatacctagacatgtgtgtatatatacacaaaagatcctataggttttattttaaaattttaattatgaaacagtaaaacatgataatacaaacttaccagtttataaaatgatagttgcttttaaattatgtttttgacaaaatgggactagtttacatgggtaaattttatttgtcccagtaggtaatctaatgaaggctatagacctaaattttggataaagaatttttaatgtggtagttggattttttttttaaaaaaacctctttttatttttatttgttttaagtgagtttaagtatttaaatgttgacattttaactaggactggctgaattgtataaggaaaacaaaatttccagatgaccttgaattttagtaacaaatttattttttgttagtctggtttgactagttaacgtgggaagggaacattttagaaaatgttattatttcttttcagctctttttcatcccttttgggcacagaaagcaatttttatgtcagacagagatatattatggttttgaactgaagattttgatctatttgatctgagtctttcataaacatttatctaggttttaagactattaatcctttaattaactatttcattgccctttgtaattattagttaggcaaacctaagttcacattttaaaagttgtctaggttggttgttgccatggagctgttgtaatttgtagtatcattaatttgaaagtcctttgagactctttttaaaaaatcttggctgaaatctcataagaaatgagtatattttaatactagcagaaaagtcagcagatttaaagtgggtagaaaaaatagagagacaaagaacttagaaggctctccatgttaactctatagttggttgtagttttttttaataagcttagagagtttgaataattgccatttaagttctgagttttttatatggtttgcctaccagttgaaaaatgtgtatgagaatagactataaattttgaatgtatagttgtctagaattccagagggcttggcatgctttagaattttgagaatcctgttcttttttttcttgagaccagagaaaatcttatcagtactgtcagggaatgtcaggagtttggactggtattttcgatggcgtcgactaccctactagcttttaattggctgtcttgcactcaccatttagaatggttatttttgctcttggaagatgtttagaaacaaataaggtaaaaaagagccaaatcatttacagacacatgtaaccaaaccaaaatgacaccaaaatcagaatattcacaaaaatttttagccaggtttatacatcaaacaaaatattaaaacaggcacaaagaaacaaaagtgaatttaccagaaaataaatgtctcacagacagaatataaactagagttctcaaaccagaaggatccttgtctttatatcagaaagtgcttgtcaaaaaagacttatggtcccagaagggatgtaagattctttatttaaagtggtcttttaactaaatcagatctggaataaagtaaaaaaggactcaccaaagggagggagtctgagaatctgagagaagattcgccagggcagaaaaggaactcacgaaaatagagagtacaaaggactcagtcattgctgcattcaattccagaggtcaagatttgtctgaggtgagttcattttgaactcatttctaacactgtcttggtctgttgtgttgctgtaacagaatacctgagactgggtaatttacaagaaaacagacttatttagttcacagttctgcaggctggcttctgttgagagctttcatgttgtatcacaacatgacagagaaggtcaaacaggattctgatgcatgcaaagaaggaaccaaacaggaggaggaacctcactttatgacaacctgctctcatgggaattaatccagtcttttgagaatgaaaattctcttaatactccaagaatggcaccaaggtatttatgaggaatttgcccccatgacccaaacacctcccactaggccccactttccaacactgccacattggggatcaaatttcaacctgagttttggtggagaaaaatggaacacatccaaaccatagcaacaccattaaataacagaaagggagactctctaaaaagaaaaccaaataatgaactgggagactcttcaaaataaaatgatttcatatttaggaataggcattgtaatgggaataagtgggccatagtaaacaatatgcatattcaggaaggtgtaaaggaaggcaaaggttttaaaagacagaatgaggaggattacataattgtctttaagataattatctttggctacaaggatcaataacaaaggtggcaccagtctgaagttggacaggcagtttctgggcagatgtcctcacagaagtattttttgtgtatgtaaggtctttgtccgaggttttggtttttgcagtcttttgtaatagttctcattatcagatgtttttgcatgagaatcctccctttatagcctcctccagttctatttgtcatggtttttaacacaagcaactccattttgattctaacaactttcacaatagtgtttcctacaagctatgcctgagattaggatgcttgtgtaaatggtttattaagggagtgacctgaagaaaaacttgtaatgaagcaaaggaagcaggagaaggcaagataagaagctaagtaaggacatggcatcaggagaagcatagcctgatcccgtgggggccattaaaacacgaattacatcactgattgtcttgctcagtggtaaggaggatggacttttgtgctactgcatctgccatttattgatgaattgcttctgggatgagggacataaccttcctgacttatgaaggtgaggcagctcctatcagcttctgagaaggatgcagctgtgaatcattagaagccaaccctcagaaaacctggatgatgggtgcattggcccagaaaaaggggtatgagcagggtacaaacatcatctgctacaaccaacttacttgtgggaaatcaaaatcccctttggtttaaagtctgcctgtaagcatttaacagatacattcctaaagacagtagttaaatgtaatttaagtcaaatattaaagtgcctactgttagccaagctgcacaatgctaggtactgtggagaatattaagggaattgatcattatattcactcttgaaaagcttaacgtttggttggtgtgaagaataatatgtacataatattgtgaaatatcaacgataaggatgtaatcatatgttatagaaatggtacccaatggaatcagtggcagcatgcttaggtgatcagagatggacaactttgggctaggatacaaggatacaaagccctaggcaatctttaatattagtaaggatggtgagtctttatggtgggcaagtgtaaagaaaagcatcatggaggaaagtgggacttgagtttagccgataaggaatgatgaaggggaatgtgggaggtttatggtggagcaggaggttacaggatgaaaaacctgagtaaactttggagcattacacaatgcatgtgttgtgagggagcaatgaagagcatgacttagtttgtccagaggatttgtgttgcagggtagtggaaagagtatagccagtactgtaatcccagcactttgggaggccgaggcgggcggatcacgaggtcaggagatcgagaccatcctggctaacacggtgaaaccccgtctctactaaaaatacaaaacattagccaggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaagagtatagcagtataggatggtactggagtgtgtgaaaaaagtatagaaccaggcagaagaatatgaattcatgtcttagatagtgacaagctcctgaatgtttttgagcatgagaatgatctgatgaaatgatgctttaggaagggttgtctgggcaaaacaaagaagttgttggagctgtctttatgcacaacttttaaaatggattaattgactttaagatgtcagaaacttgtttatttaaatctttcatgttagtgacttgtatttggaatgcagttacttaactcaggtcttatgcttgactacattcagcttttcagaaacagctgtattaggtcatccagaaaccctgattttttttttaaaggtatcattaagtggtgagaaagaaaagactcattcaaaactttcaatttacctttcaaaccaaagcccagggataattattcataatcatttctaagtctgaaatgtgacattgttccatgagtcatcatctaggttttaaccacacatgcacaaaaaagcacaacataataccacacaggctatttgagaaagcattcagagaaatgttctgcctttttatgttgacttcctgtgtataaatctggaatcataaaagtccaaggacactcttcagtaggagtacattcagtaaacagcatgtgtggagcaacaactgtatgcagaactggagtagaagctggttacaagagaaagaatttttttttttttttgcctttggagatgctatagtagaaatagaatacaatgtttgaaaaatagaatgtttgaaaaatgtatgagaacatgtgtaaagcaatatctaaaaggggacacatgagatataaactgagaattaatgccaaagggctaggagaagtcacaaaagaggactcagacatgagggagtcacaaaactaattttctgacctgggccaatttttccttaaattggcgtggtttaccagaagaagagaacattgtgtttcccttcctggcaagtacttttggttgccgaagactatattatcagatggtgaaaatgttcattctattgatgtggttcctcagtggaaagtcatcacatctttctagaagagccaaaatcttttgtgaatgagctgtgttttatggcaagcttttataaatgattctagaattacagagtttctcatgccagaatatctatttgctctgggctagctagctaaaggactgacctctgccctggactatatagtaaatacctatcttcttaactcacaaatgaaggttcttagactaaagtttggacatgggtccagagaatatgacaggaatcaggattccagggcgatagatgaggcagcaaagtttggagctactgagtcagactcagctggagttggctactactaattcaaatgagctagggatcaagaacatggaatctaaaaggaaggaatggggtaagggaatggcaatctggaccagaatgggccagaagccaaggccaatatacagtgggaaaatggttattcaaactgggggaagctaggtcagtatagcaaaggtgaagccaaggctaaggacaacagtccagattcttcctagcaaagtgtctcacagaaatagagagcctgaatccttgagtatacaattaacagcacaggttttgaaatcagtctaaatacaaatctcaactctgccacctaccactatggtaccttgagtaaaagttccttaactgtgctaaggatctggatccgtttttttttttttttttactgtatctctctctgttgcccaggctagagtgcaatgacactgtagcctcgacctgctggacccaagcgatcctcctgcctcagccttccaaatagctggaactgcaggcatgcaccaccacacctggctaattttttatttttatttttagcacagaggacgtctcaccatgttgcccatgctgatctcaaactcctgggctcaagtgatcctcctgctttggcctcccaaagtgctgggattataggcatgagtaactgctgctggcctaagacctaattattgataatgaggacagtatagcatcttaccacataaatttgtggtgtgagttaaatgaggtaacacatgttaaatatctgatcaagtgccttccatgtagtaagcactcagcatggtaatgtaattagtgttagtattgctgctgcttctgttcctccaccacatcatcattcacacgattttggaatagcaaaacaacagtatgtggtattccaagaagactgaagcaaataatttgagaaatcttttttcttatggaaaagttctctaaggattgtgaaatatttgaaacagaaaatttcagttaccttgtattcaaatatttattatcttaaagcccaaagccttctaaatgctaaaactctactgtgtatcagatatgtcagcaagacaatattcacattaacaacaggaaaatgaatcgggacaaaatctgcagaagtgcacatgaaaaatggatgacagaaattagtttctaaccaaaagggaatggcttgatatgaaattggtaagaaattgttttccccatgaccttgaaaggtcatgaataattaaaatgccattaaaggtctacatttgttgtgaattcatgcatgtttagagcatatgtatacttaatcctggaacaatttcttatacctctttaactactcccactcctgccatacttagtaccagtgtcttatacataatgataatggacactcatacactgattgattcagcttatggagattggtagcttttattggcctttgcaaaacttaccttcaaaaactaaattaatatatgcattttgtagcttatcaagaataaaacattttaatagctttgattcatagataaaatttatagaggaaatgatttctgtaatatgcataaagacataatctgtgatttaatttattctaatcagaaagtgagatttcctaataaatctgcttttaactattctggttatttctaaacaattctgccaatttgttacctttgccctcaaactttactttctctgtttgaatgaagttggctgccttttatggtttacaaagcaattgaagacattcccacaatgccatattacttattagaatttttatgtgtgacaagccactctttcttcactttagcacttctcaaaacttacaggaataatattggttatcttatgggtcacagaacaaatacctattggactctggaggccagaacccctactttcaacttgactgctaagtatcttaatggtaagacaggcaggttgaggcttataggtttaggacataagatgttaaagctgcaggtggcagagtgttgagaaatgacattattctctttgtgtgtacatttatttgtcctttcttaatgctccaagggctgtagggtgaagcattgtaaagatgtaccagatcccagaaggttagcagttaaacatttttcagtttgcaaatgcaacaaaccatctcccatagtgtatttactatttcaaaaattgaccctctaaaaagaacatgcaatccctggaattcatggaaagactgggaccactttaatgagattcccataaagtgaaaactgtttattaaatgttgctaggatgttttcttgctggaaagtagtattgtgtgttcatattataaacattaaatttaagggccaagatggattgcctatggaagactcttgtagtctatcagcagtcctcaggtcacattttaagaactgagaataagtggagaatggctcacttgtacaacactattgcctgtgtagcacctctgaaagtcctcctactactcagattaatcagcgctgccatatggaatgtcattgccttcctttccctccaacctgttttttgtccctatagtacctgctgccaatagaatcatagattcatacatactaaaaaaaatcttcactttttaaagctaattgttagaatcctgcagttttaggggaaaatcaggtacactatatttagaataccctcaccttgatattgcaggaagcaaaattctcaattttttttcagtccgccagtactcagtcttccctcacttgggtcctaagactgaaagaggagaatctagattttaatacagttaataataatgataacaaggccatgtgttggtatgatgatgaaaatataaatcaaaatggtctttgatttaagtgataaatactacagtgtccaagatttgagattcctttgttccttgaagatagaaactattcattcttggtaccctaatatttagcagagagttttaaacatgatgactgctcagaggaagtttaaaaatgattgtaacttataggaattaaacattttatctacagtaaagagtttacaggattttcagaaatcagagaagggcttgacctcaaatgtaaacctgctattggtatgaacttcactaatttcctaattcagacccaaatgttaattttcttagagaatcataaaccacaccaaagttaaaaacaaacaaacttgtaaacaaattctaaacaaaatccaacttctttcattaaaactagtaattaaaggagaataaaattgatatgcatttactcaaagttttaggagcatttacctcttcaaaagaattcatggatcaactgaaacttaaacttttaaagattttaaaccactatctgtgtcacttgcttatctgtttggtcttggtttagtatgaaacatgtctctggtctgaaataaaagacgattgcatttcaaaaaagaccaatttataacaaaaaactcaaatcaggataatatgaatgaagtggtattacacataaagacaagagcagaagtcaagtttttccccaaaggatctgaaaatatcatcaagagtcaatgacctctcatttagcctttgaataagaagagtcattctttagctagacagctggctggaaataaataaaaatgggattgcaagtaagatcagatattaatctctttcccatattgctgagactctgaaacagtaatatggtactaaatttatacagataatggcttgattgacctaccctattcagctcttcttccattgaggttttgttcaaatagcttttaaatttatttctgatgaggctactagggtgtatgctatattgctaatatgttttttcaccaccttgaatactacatcaaccctaaagagttcattgttctagctgttctactcaaatatccatgggtctctctactcatggccatttatctacctatgaattttctgggtacaggaagaccaagagtaaaaggagacgatgaagatttttagtttgctgaaagggacataaaacaacctgaaaatgacacagaaacacctttaatagagtgctaaattgtgtgctaaagcaaggtcagagtggaacaacaaggtacagtgggaagagcaaaggctttgtaatcttaccgacttagttcacacccatgcccatcacataatgtctctgagtctcacagtctcctcatctgcagaaagcacttaatataatgagacttacctgacaggatttttgtgtatccaatgtgaaacatactaaagtacttagtacaatccctggatcccaattaatggtaggtgctatgattatcacagacagatatgagagaattggccatgaagctgtaatttagggaaaacataaattatttgatctgggtgagaaagtaattttttctaactggtataaatgtagccaccttttctataatgaacataatggacttcagaaaaccatatcctattacttgcctgtttggcacaacatatgtaatatagtttaatgactgtaacttcaggcatgaacctaaaactacttggaggtaatattgctttgcgttgcagtttcagtgaagtggacaggcagaatagagttcaattttacagtctgacctcttagtcattacttaaagccaccacagagccatttttaatctttgcattttcctctttgcaagtagtttctaagacagacagcgtgtcatactctaactaaatttcagattttaaaaaggcatttagctctgtaacttcagatgataaaaatccatttaatggagaatgttcttttgctgtctgcttggtcgataaattaaacagattaattaagtcaggctgtcaggaccaaggactgtcactaatgttagcctatggagctgacccatttatcagagactgaggctgaataaaggcagtctttgtcctgtaattctgtaatgaatacaaagaaatagcttatggagagaaaattctgtcacctgactgtatctcaaggcagagtagatgtggtgggaagaaaccctatcattgttattttcacttacttaattgatttgctttttccctatgtttctctgtatctacctttgtcctttgcatgtcataggaggctccttctcaatttgaaacataatcaataatgatttcctttgcttatctgaattggagctatgtgtgacacagtacacaccaaagatgtataaaacatcatccttaccttcgtagaacatgcacagaaataatacaggttaaagtatcccttatctgaagtgcttgaggtcagaagtgtagatttttttttattttggaatatttgtatatacataaccagttgagcatccctaattcaaaaatctaactccaaaatactccaatgagtatttccttttagactcatgtcagcactgaaaaaaatttttggaatttggagcattttagatttagaattttaggattagggatgctcaacttgtatatgactacgaaataaagaatcttggtggggaaccagaccagcaaagtggaaaaaagttaggttaaattggaatccaggattgtaataatgtgataccattaccaacttcatcaagcacttaagacttccaggtagtctttccagaggtcctgattcttggaccctagctatcttactccttttctttacccctcctttgactttgtccttggtgcatatgatctggcaaatatgaacttgacttctgcctagtattttccgccattactcccagagccttcctattaactgtattacctgaatttctaaatttagaaaaacttgctaaccactaccccttgatagaatgccaatgcagatcagatcagtggtctgtatgcccagcattctgactggaaaaggttccaaaaatgctttataaaaattgtttttgttgtcctttttagcatcagtctcataaggctaaggggtgaccctttaaaaagtctacttttctttaacaatccaattatttatctgcttactaacaaatgtttattaaatgcccactatgtggccaggcacatgcgagcactggggacattaaatatgtaaataaaatacattcagtgccctcaaagaactccctttatagtggaagacagacatactgaaaaataaaatatagactatcctcaacttatgagggttcaaattagtatttttcaactttatgatagtgtgaaagcaatacacgcctctacttatactcctctacttactatggagtcaagccataaccccattgtaaattgaggagtatctgtgtatatggtgtggtaggttctataaaacatatgtatagtcatcctttgatatccatgagggattgattgatttggtaccctcgagagtaccaaaatccaccgatgctcaggtcccttatgtaaaattgcatagtatttgcatataacccatgtatatctccctgtgtactttaagtcatcttgagattactttcaatacctaataaaatataaatgctatgtaaatggctgttatactgtgtttattcacgttttaaaattgttgtattgttattttttctaaatattttttatctgaggttgattgaatctgtggatgcagaatccacaaatacagagggtcaactgtaaaaggtaaagggtagtcagagaaaggttttaaaaagagaagtttgagctgggtctaaaggataaataggagtttgttaggcagacaaacggaagggggaggcattctaggcatagagcagcctacataaacacccagtagcatgaaatgacaaggtacaatttgaaagtagtttgatgaggctgaaaaggagtctaagaaggagaagtcttaggagaagtaaaagatgtccctgaaaaggctgacataggcttgaacatgggggtccttttatgtcacattaaagatctgaacttcattttgaagtatattgctgagctgcagtttatgagcttcttgccttaaataagtcattggttactgttatgtgctgaattgtgtcccatccccatcttcctccctcccctgccccccattcatatgttgaagtcctcatacccagtaactcagaatgtgactgtatttctagatcaagccttcaaagaagtgattaaggtaaaatgtggtcattagtgtgggccctaatctagttggcctggtgtccttataagaagagaagattaggacacaaacgcagaagaccatgtgaaaacataggaaaaagacttctaccaacaaaccaaaaaaagaagcccctagaagaaaccaatcctgtggacacactgatctcagatttctatcctccagagctatgagaaaataattttctgttgattaagccactcagttatcagtacttcgttatggtgaccctaacaaattagtacgattactaataatatagttccaaactttataaatgttaccttttaaaataaataaataaaaacattcaagtttattcctaaaataataacagggtgttcatttacttagagtttaatatgcttctttgagtataagagaaatcggtgatgccaccttaatattttggttaatgaagagacaagttcagatgtatgttaggaagattattctaggagcattgtggagggagtatcagaggacactgtgactagaaacaggaagaccagttaggaaagtgttgggggtctttatggggcttaataaatatcatagtgcccctcttctctgcctaagttctaaaccaattgagaaataaaacacaatgttggcagtttgagatggaaataacacctttaattctatgaaggctagacagttggaggatgtagctgagcatgaggaccaaatacacttattaattttctgtaccccagactggaacttggaacagcccagtcaagaaaaatttgaatctgagtatacttgctcagaccactgccatccactgggctgggtagagagggagaaagacactaaagcccagatccagccagttgataaatgtggatcatttaatcactcatacatttatgtaaaagcttttttctcttgtggcaggttggagagggatatagtcattcagatttattatagtaccccaaggtataacaaattccattatgttatatctgctatgtaacataagacctttcatatgaaaagctaaattaaaaagttgctactaccaatgccctttccctttttctccacctcagaagcttccaatgacagattatagaactaaattttgggaataagttaagaaccagggtaaattccttgcagacaacggtggccaagtgttctgtgaaattgtttcactgtctcaaacagctttgctgtagtcaaaagctcatggaacagctgttaattcctaaagtattcttctaagctgtaaagaatggttgacttttgccacctggcccagctaatcagaagctgatttcaaggactaagacatagcttctatcaccgtatttatgatgaaaatggtgtaagactaaatactatttcatgagctcctttggtccttcaatagtttaactcctcagttgaagagaagcacagttcatattttgagttgaatgatgatgtcacttcaattccaactctgaaatgtgaaatgattattgtcttcagccattttctcatcctgggaggcagagcttgtctaaatattgaaagccattgttcatgaatagtataagacttcctttagctttagggtccctaaaggctcccacacttgggggaagcttgttgtggaactgacactgagaactcttgtcataatacagagggcatgtgagccaaataaccaactttcttgaattctggatgttgccttgcaaactggcattcacttaacctataggctgtgttataaagagcccttggattcccacattgcatcttttcctttcaattttatagattgatcaacaaacttcagaggccaagcaaaaagtaaaagagcccctcaggctaaagatagtccttatttgggaacaattattaggtatcacattcattgtttctgagctctgaaaacttcaaggaaactcactatgtttctcgaacatatcctaagatagcaaggcaggaggaaagtggcagagaaactgtttaagttgggaaaagatacaaagtcaaaacattccaagtggcatatttgagcacttactcagagtacttctggactgtttactcagttggattcggaacatgtcgtgatggttaatattgagtgtcaacttgattggattgaaaactgcaaagtattgttcctgggtgtgtctgtgagggtgttgccaaaggagatttacatttgagttggtggactgggagaggcagatcctcccccaatctgggtgggcaccatctaaatcagttgccagcgtggctagaataaagcaggcagaagaaagtggaatgcaaagacttgctgagttttctggcatgcatctttctcccatccttccccaggaagacctctggccttttaccaggatagatgtgcagtggggaaaggagaatgatcagaccttttgtggactactggacactggctctgagctgacattgattccagagggacccagaatgtcactgtggtcctccagttaaagtaagggcttatggaggtcaggtaattaatttagctcaggtccgacttacagtgggcccaatggatgcctagactcatcctgtggtcatctccccagtgccagaatgcataattggcatagacatacttagcagcttaagacatacttacccccacattggctccctgactggtagggtgacagttattatggtgggaaaggccaaatagaagccattagagctgcctctacctagaaaaataggaaatcaaaaacaatatcgcatccctggagggactgcagaggttagtgccaccaacaaggacttgaaagatgcaagtcttgatacctttatcatatgacataagatttatttacttcagatcagcatttaagtgttattaactttatgtgatagcttttaggttaaagattagtgtgcttctggttgtgtgaaggatagctatattatgttaggcataattatgaccttattgttgttatttgaagattatgtatgattttgggagatgtgtatgggttcaagttgacaaggggtgaacttgggatggttaatattgagtgtcaacttaattggactaaaggatgcaaagtattgttcctgggtgtgtctgtgagggtgttgccaaaggagattaacatttgagtcagtggactggaagaagcagacacaccctcagtctgggtgggcaccatccaatcagctgccagcatggctggaataaagcaggcagaagaaaatggaatgagaagacttgctgagtgttccgcacttcatctttcttttgtgctggatgcttcctaccctcaaacatcaaactccaagttcttcagcttttggactcctggacttaacaccagtgatttgtcaggtgctctcaggccttcggccacagactgaaggctgcactgtcagcttccctactcttgaggttttgggactcagactggcttccttgctcctcttgcagatggcctattgtgggatttcaccttgtgatcctgtcagtcaattctcctaataaactccccttcatatatacatatatcctattagttctgtccctttagagaaccctgagtaatatacatgtactggcagttgctttccttctatagtgaccacacaatctgtctgttatttataatggtacctttccagtggctattgaatggattaattaattaagagatgagtattcaaatgctagttatgcaaatataaagtcacttctgacctatggttcagacaatgaataaaacagtgaaatccatgggaacactgttttgcaagttttgggtcacaactcatagtgtgttgtagagtcaattcagtaggttacaactagcatttaaaagagataggattgaaggaaatagaaagtattggagtacgttgctcatatgaaggataattttttctttgttaaattttaaaattctatacatgtaagtatatgctagatcaagagtaaagtactttttttatatgagccacagtcaaaatagtttgagattggcaaactctggcccacaagtcaaatttggcataccacctctttttgtaaataaagttttattgaaacatatttatgctcatttattcaagtattcctagggcttcttttgaaatacagtggcaaaggagagtagttgccacaggaccttacagtctggaaagcctaaaatattttctctctgacttttcatgggaaaagtttgtggatgccggtattagaaaatactggagacctttaggcatagagagactagttttggtgatttagaaacaaatgaaagtgaatataatcgatttctatgtagttgggagttcatcttatttcttttggctcatagcaagcattgttagggttttaacacttcaaaatgcatttgaattgagctaatgacagataatttaaaaattggggccaaaaatgaatgtgtgtttcttgaacacagtcatgttcttaagtagtgggttgaggctatctatcctagtatatagcaaagattcctcactttttgtaaactttgtaaacactacccaagaagattctagaagccaacatgactggcttaaaacctttatatatgctttcaaaattgtatagccatgcatcctggctaacatggtgaaaccccgtctttactaaaaatacaaaaaaaattagccgggcacagtggtgggcgcctgtagtcccagctactcgggaggctgaggcaggagaatggcatgaacccgggaggcggagcttgcagtgagccgagatagcaccactgcagtctggcctgggcaaaagagcaagtctctgtctcaaaaaaaaaaaaaaaaaaaaaaaattgtatagccatgtaacaacaacaacaaaaacaaagacaggattggggaactaaaaatggtatcacaaggcggtagatacgatgcaagctatgtacaagaaataaagcagaatgagtagcatctaattgcctcttctctttccctactaaatattggctgcttaagttacttaccagcaagaaggattgcttcttatactcatctgcattagtttaaaccatgcttattgagccatacatacaagaactgcgacggatgctgatgactgtaacaatccacatggctacagagggtatgtggatgtgacagtgaggggttgagtctggagatattggtaatgcccaaatactgtgtgagagggaccctctgaaccaagctaaagagaaactggcctttatcctgaaggaaatggggagccatgggaggtttttaaccagggaggtagataatcaactatgtgtttcagatacactctttgcagtatgactgatggattggagggagtagaaactggaggaaggaaaaccaggtagaagattattttagcaatccaattgagaaataatgagggcctgcagtgagtgcagtgacctgtggactgtttccatgggtatagatgtgaaatgtgtttaggaataagaagcacaaaatttgtggagaggaatgttaacagattaatctggaagttaagtagggacctcttaatggaaggccttttacaccatatcaagggattcagtctttattgtaaaggcactaggtagggggtactgatggaaaatcactttgctgcagtgtaaaaaatggattgaaaatagacaagctcagaggtagagagatctcttaggagactatttccagaagacttgcttggaaagtagttttaagtgagactatgagcatattaagttcctcctattgcctctcagacacaagtagaacaatggaacaatgcagtcacaaaagtatacaatttagctatattgcaagattgagaatatattcttgatatgctagtagcaagatattggactgctccctcatgcaaagctctgaagttctatatgtagacatgtgtttgtgagatattaactcttctgatgggataggttattctttagggccactctccctctttagggtattaaattacctgtatctgctctgaaaaataccgacgaaaacaacggacccattccttcgttttcatttttgtttgaaatccagtgccaaggatatttgcaacaacagtagatgactgcagaaaagaacttgataacttgtccccaatggggcgtctgacatcatgacatcatctcacatatgtaattgttatttatttgatccccaaagaaacataagtgctgcttctgtggcagtagaaatttgcataaatccaagatctcctgtgaagctgtacccttccaattaatctttgcaaggggaagggattatagtcttctgtgaattacactgctaattaatttctacacaaatcaattttattttgccaaatacacaagtcaaccttgcacagctctgaatactacatatatccatcgtcttaaaaagactccagtcaaatcatcattccattctttctcaggaaggaaagcaaacacactggattgagacattttcttcccctttcgtgttaactttgatgtttgaaggtgccttgaataatcgtttctttttttctgagcatatgttaatgtcaaatattcatttgttttaatatcaatgattctgccttgtaaaacactgttgcctgggatgaaaatgtcaacttttcttgggcctcggtataactttctggccaattcttgaagttcttttaatgcaagttttttgtttttgtaaggggaaaagtatcttgtgtatccttagtgttattcactcaaggctctgagaaactgctgtaaataccttttacttttattttttattttttattattttaatggacaaattatacttgtatacatttatagtatacaatgtgatgtttgatatatgtatacaatgtagaatgattaagtcaagctagtgataacatatccatcaccttacttatcattttttgtagtgaaatatttgacttactcccatagctattttgacatataaaatgtattattgttaactatagtcatcttcctgtcttaatatatattttaataaaaacttcttccttttaaaataattttttccccaaaattcatatgccacttcatggttccctgtataattctttttttgctttgtctcttcctagagtgggaaagactatttcttttttttcattattatactttaagttttagggcacatgtgcacaacgtgcaggtttgttacatatgtatgcatatgccatgttggtgtgctgtacccattaactcatcatttaacattaggtatatctcctatttctaacagaactatatccatgaacagttttatccagaaggagctatagccaagctgtattacaaaagctataagaatgtcagtcacatgcagatattcaaacatagaaaaggggagaggctgtgtttgtgaggcccagttcccactcttctgatttcatttcttctttaggatcttttcaccaccaccaccacgctggtgcacatttctggtaattgttggaaaaacatctgggtggatgtagtgtgactactattttttatttatctctgtttagatggaattattccaaaagatctcttatatgtatcccctggagaccccatgctaacacatgcctctgggatgttgtggtttttccactatcactacaataaaaatattaccattgcaaccattttacaatagcttatctgaagaacattacaaattaaatgagcttagagacagaagtcagtgctatgtataagaatagtagctatttatttagtgcttacagtgtgccaggttctgggctaagcaaaatctatgtattttctcattttatcctcacaacaactctatgaggagattactaagaaagcttgctgtgttgaaaaacataataagcttgtgattactcttgcttttgaagaaaagtggtagtagggtcactctattgctttgaaacatattcctatatttaactatgaatagcagtaatgactaacatgtattgagtgcttactatgtgccaggcactatactaagcactttatctggattgctccaaagtagatactaggaatttatggatgaggcaaccaagaatcagagatgttaagtaactggctcaaatccgcagcataaatcaggcaagtgggatctaattcaggttttgggtgactctgaagtttgtgttctcaactcatacctcctattactagttgtcctatttgtctccccaccataccctgcattctttgtaactttctcttacactattatggaaaattgtcagggtggcattatattttctatctccgtgatttttctcaggataccttgtcttactggctcttctggaactgttctattctgtcctcctaaaagaaaattgtcttcaggaaaacataagtttcttttattttgttttttgttatttctaaattgttagttgtgagtaagggagctatttgtatatcttatggaatgctttctgtctgtcacttatctcttattggtaagtgacaccagggtcctgagttctctgtgaaaatgttctaactgtaaaaattaccccaattatgtaaccagcttctttgtaaactttcccctgagactctgaaagcattttcagatctccccaaaagacaaacatataaagaaaaagtcaaattaaataacgacttatataagttcttaaatgtctataatggaaataaatatgattttttaaagttccagagtatgaaaagatcccctgaaaaagtatgtttctattcatataaatctcaccaaatcggactaattggtcaaaaagtcagtttgtttaaaaatattttatattcgagttgtctactaaaggaaattttcttttataataaagtttcctttacaactgttttaaaatgtagaaagaaacctgcagaaagcctttccattgttccaaatgacatatttttctattgtcacatgataatacaaatctgggacaccacagtagaaatatagaacaaggtgctgctattgaatctccctggtccttaatttattcatttatccaataaaggaattatcttgttgatgtttaagttcctttccaactctgacattgtttttttccttaccatgggttctgaattacctttccattgttctaaaattctaagaaatgatagttatcctgtattttttttctgaattcttttcataccttgtagtaatgtaatgtacctaattctaaaatcccctgggtaagagggacaggaagatcttggaaggattcaaatatgacacacaaaggggattagaatgcaaactgagatatcttcaatattaacaaaatattgatgtggatgattccttctctcctaattaatccccattatacatcaaaacttcctgaacacttatgaaaatcagcatcttgaaggaacactttcatacatttgattaaattattttaaaagtggaggttagatttataatctcaattaagttataagttccttaagtgcagagatcatggttttgtcttactatccacagtgcctagcatcctaaaggactcatggtagtcattcagatttattgttaaattgtatctgttgttgagaagccttgtatagtgttgtgtataaattctggccaagatgatggacaaagcagaagggaaatattataccacaacagatgcataaaatgctaaagaaaataaattttaacatgcatagccaagcctgaaagtatgaaaggggtatctccagatgttggaaatgaagaagaaaataatagctaaagtggcggataataattgaagctttacaaaatgtgaaggacctggactctaaacacaacttatcttaggtgatgaggatctaatgcctcgtatgttgggagcatgagcagtttcaacctttctgggacctgaaagtcatacaatttggaaagctctccttaaaaattatcttacttttcaatttcactaaaacccatgaacatgtgcacacatatgtagggccattccttgggccatgaagggagcccatggacatgaggccctgaaacctaagcttcattagctacatggtaaatctgcctctgacttttgtcaaggtcacaagcttggtaaaaaccaaggagcttgacttaggttacctatgtggaagccagaaccagaaaagcaatgcatcatgtttgaatagctaccagaaaacctctgctagctggcttagggtcttgtaggtaattcactgctggacccaggctttaggtcacctgagagtgactagaacctttgagttgtagaaactacagccaattaatagatataaaatctagtttgaatatggtgactcgtctaatattcaggcaaaggcatctgtgaaaccactccagaggaggccatcacaacccatgacctatttatatcttctacagaaaatattctcatatatccatggaagatgaacccataaataaaaagtataaaatacatgagaaaccttaacaccaagaaatatacttcacagaacctagagatgagagaattcacatccaagcaaccagagatagcagagcaataaaaggtgacttcaaattaagaaatttataattgcgtatgtgtatatagacacacacacatagaagtgcatatatgatttttaataaagtctcattcctttgtattagtcagtttgggctgctttaacaaagtaccatagatagggcagtttataaataacagaaatccaagatcagtgtactggcatagttgggttctggtgagggctctcttctgggttgcagaaaagtgcaagagagctctgtgaggtaactattattaatacaatggcatttatctcatttttgaggactccacattcgtcactgagttacctccaaaaaagccctaccacaaaatactgtcacattgggattagaatttcaacataagaatttttgagggacacaaacattcagtccattgtaatcttcaagtgtatatatcattttgcttcatgtaagttatattagctttggttaagttatgttgcagtaataaacaaccccatgatctcaccggcttaccaatagaaggttgatttctcacttttgttaggagttttctggaggttgactgcagctctgctccatgttttcttcactaacagggaagcctctatctgggaccttgacactttcaattcagaggaggaagagcaaggcggtaaatcactcgatggctcttaaaagttctaggaagcagcacatatcacttccacccatgttgcattggtcaaggcaagtcacatatccagacatgatgaaaaagaggtagaagtatataatcctcctgtaggaagggacagtgaatattttgaacaaaggatacaaaatttgatttgacaaataagaaatatttgatattagcaaatgagtccttctgatatgtatatagaggcttgaaaatcattattttatgtattaatagtttttccttgtaattctacaggctcttagcaattcttcattgatatgataaggattatcataatctgatattcattaaccttgctatgaatgccagaacaggttagttccaatggcaacactcatcttctacccacaaatcacgtccacttcttggactgatctttgatgctgccaggatacaggaaagtgaatagccgtgttaatcttgacactcatatgataaggattatcatcattatcatatcactttcaaattagctggatccaaatatacagacatgaatgtttttcccccaactctgcttctaaatcaaagttctttcccaatctttatcttgtctatttacagacctctaaagtatgatttgattatttttaactgtctgtattcctctctctctctctctctctctctctctctctctctctgaaacttaggatatgcatagataggatcatgggcagggtagatggggtggaacatgtttttctttcctcaccagggaaatttgatattcactaaccttgctatgaatggcagaagagattagttccaatggcaatgctcgtcctctacccacaatcaggtctacttcttggactgattattgatgctgccaggatacaggaaagtgaataaaaagaaaagccatgttaatttcaagctccatttagaaacacactagaaaaatcaatggctggtaagtagaaatcggcaaaattggcaggaagaatttttacattcaagcatagaaggggctggaatataaatctgcacactgaccagataataaccagataaaatgatgatgatactagaaaggcacttgacaaggctttttcctaatgttttagtgcactgaggaatgttcacctcttagattcactgaaccaagattctgtcatttaaaatttggggattaaagtttgtcattagttttctcaagccttactgatttcacagaactgaagtaggcagatactggctcctggaaggagtgattaaccagcaactttagtgctaaaggaatttaggaaatctggattttagtggggtatacttatgggaggccctcttcttcaggtttaaagatcattttctatggtgaatttaatctcactcagtgttacatctgaaaaatgggatattattctgagatcttcctcacttattataaaagaagaggttttctaactttgtgatgctgagagaattacttctctcatccccatgtttaccaattctcagcaccaacctgaagtacatttttctccatgaagcctgccctggcaattccagccttcacttctttttgtttcttcttgtgaacttctagggaaatgtatggcttagagacactacaatcctatggtcttcagtattgttccttaaattgactcatacttattggtttattgagtatctattctgttgggtattgtacttaacactgaggataccaaaaatagatatggcccctacctcaagatgcttacagtctagtgggaagaagagagagaagtaactgggataattaaaatacaatatgaaaaagaaaccatgtgaaaagcaccaagacataagcacagggtgctgtgggagtgctcagttgtgtatgttgttgttctatccaaccagagattaagtttctctaggacaagatccacatcttccacttttctcccattccccgtagtgcctgacttatactatccttggtctggaactcttttccccccacagatatatgcattccttgatcactgtattcttttaagtctttgctcaaagatcaacttctcagagacagttgagctatgttattcaaaattgtttctctctcccatccaccttacacacatacagtcacattctagaagcacatattttcttctttccttgctttatttttctacttagcacatatcaccatctgacataccatatcatctacctatttaattttgtttattatctatcttgcctgctagaatataagctctatgagaacagggattatatctgtcttgttactatttttttttttctctagagaggcctgtaacagtacataacagttacttacagtaactttaaagatattggcttaagttatggatgggtggtaacagtgcaagttggctcgcaattagtaattctttagtgggttgaatgatttctcttttaatcatttaatagagaaactaccactactgcctctactactacctctacttttaatttggcttgataatgaagggcctgttctgcaattcttagaccctgagaagttgctcttctggatacatgtcagatcccccataactatgtagcaacagtcacacttgctgccttaagcctctttcaccctctgaaggcatttagcacatggaccatgctttgagaattacagacacagttcatgaaatctctcttcttaaatttatatttaacagttaccatatgttcatgaccatgataattttgccccatacatttgtttttatttggggtcttgcatggtaggaagactttaagaagtcaaagattattttttcgtcttttcccacttaacaaaatcaaaatgtttcttaatgctgacgtagttactaaaacctatctatacaaaatagtttgctacttctaaggtaaagattgaaaaaatagtgtcaatttctgtttagaagatttctattattgttcctagtggaggtacaaaaactggttcacacacacaaccaaatcactgttatatagctttctttttttttttttttttcaagggacatgctgaattttattttatttttttctctgtaacaatttcttttattattattattattattattattatactttaagttttagggtacatgtgcacaatgtgcaggttagttacatatgtatacatgtgccatgctggtgcgctgcacccactaactcgtcatctagcattaggtatatctcccaatgctatccctccccgctccgcccaccccacaacagtccccagagtgtaatgttccccttcctgtgtccatgtgttctcattgttcaattcccaccgatgagtgagaacatccagtgtttggttttttgttcttgcgatagtttgctgagaatgatggtttccagtttcatacatgtccctacaaaggacatgaactcatcattttttatggctgcacagtattccatggtgtatatgtgccacattttcttaatccagtctatcattgttggacatttgggttggttccaagtctttgctattgtgaataatgctgcaataaacatacgggtgcatgtgtctttatagcagcatgatttacagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctaccattccttctgaaactattccaatcaatagaaaaagagggaatcctccctaactcattttatgaggccagcatcatcctgataccaaagccgggcagagacacaatcaaaaaagagaattttatatctttcttttgctttttatagcatctaacttcaggtaaagtttttgttaagatttttgcatgtcactttttggaaaacatttaaaatcagcattagtgtagaacttacacatgtaactattcaagagaatgcaagatgaatttaggaataatttctgagtcagatttacaatgcaaacatcaaacatgagcaatagagctattaaccttgaatcaattgagctgtctgtacatacagggcattttttttttcttgagacatacccaggggtaaaggagataacgtaaactcagtctgtgaataaacaatattgtttactggaagagatggcaaacaagctcatagagaagtaatggacatgcagaagatctggaaaaactgaagtaaggcttcaaataaatttgggaaagatttagtaaaaatctaagcctccacacagtagcacattattggctagtgttggagatggcttataggaatctttatggactaagattcttctggcttttattccacagatatctctctgccaagtggctttatacttcccttactgatacttcacatatctttgtgtacattgttagactgcatggactaagtgtggtaccttgcgtctgtaccatgataccagttagcatggaccccggcacattggatcattcagaaatgtagtttcaccacactctgtgccaggtcataatgatcttccctttgatctggctttccactaatattataccatccctgatgtgacaattcaatggttatctgaatttcttatatatgagtaaaataataataacaatgatgatttgtcaagcactttatatccagcaggcactgtgctctgtgctttatatattactgtctgttttaatcctcacaacaacccaataaggtatgtattcttattctacacatttcaaagatacagaaactgaggcacaggaaagttaaatagattgctcaacctcacttatgcatttgtctactctattagctttgctgtgatttccacaaaggtagatatcagaaggtgtgaattctcttttgaagttggttctaaacacagtgttatgtatatttagatggctaatcatagttaaacttataagtgtgtcaagtaattttagggcctcctgggaggtctctttgttctcccagatatctttcctactgaattgctgatgcctaaaatcttgcaattcagaaataccttatgttggcttgaagcttcttgttccctgtttaaagggcagatatttctggaaggataattctaaaaaatattactgggcattcatgtaagtatattttattagcttcctttttttttgaatgaacaaattttgatgggagcaagtttcgaaaacgtgaggacccaggatacctgaagttggcaagaaaaatatagtatcaagggaaatatggaagaggaagacattaaaggtacaaaaagttcaacttcatcttgatttccaaccgagccaacctcagttaataaacagttttcaatgactcttttggtaggaattattacaaagttatataaaatattttatcatagggaaagaatcggattctttgtaaatcaggctctggtttgattttagacttttatatttttattaatttgtgcatatttaatgtaaatgactaaataattatgtagcgatccattgctagttgaaatttagaatggggcattgccctaaggcaatatctccagatcagtgaaaattctccttagtcctaacctttctttttatgtttttaattgcaaaactaaaaagcaagcaaacaaacaaaaaacccaaacacgttaatttgtaaaagagaccaagcaaaactagtaaaaaaaaaaaaaaaaaaagagtgcagaaaacatagccttgctctatgaaattgacagcactttggtgtctgcattttcttgcaatattaatgagaaagtcaagcatcatgtttgtgccaaatggcaacttgtttgacacacaacagtttcattttcaagtgtaatatgttgattctttattggattatttcaggttttctttttgagtaaactttatatttcctttgctgtagtatatacaacattaaattcttgccctaaaccaattccttccagatatgtcaagctctccaagtctggtgcaaattatcacagtagtttctgctggaattttatgttgtattttgtaaatgtagcaaattgacttcatcctctacataggtatgaggttagctatcatgagttgtttcaggacaggatctcatattttctggttcacagtcatatgatttgtttgggtccttttcagtgagatgggaggaaagtggagacttacagtgagaagtactctaaattacaagagattatcaagacagactaagtctggactgaggattgattttcaggtagccaagtaggatggccaacttgacaattaattagggtaatgtgaaaagtgggggagtgtgtagagtgagttgattgcttggtaatcaaatgatagtacttctcattttctcctgctgagtacgctaaatctgttttgcaatttttttttatctgctactctttacttctcctttaagtaattgcagtaagtcacaattacgctagtcatctcctctgacaattatcaagtttcacctcaaagaatgcctggaacaaattatgaaggaaaaatcttagaattggggacatatggccttagcagagtaagctagtaaaattctcccatggcaaactactgagtaaagcttctataagacagccctgccagagattggcacccttcctaacccccaagatgttagtagaggatagtacttcttcagagaaaaagcgtacagtagtcccataagcatatagcctctgcagtggtctaccataccatagaccttccaggaatcagataacatttatttttccactaacttttcacaagaacatagaatacattttcttgtagaagatttagacaagtaaggctgtttcttacatccattattttccaggaggatggcctgtcccccagatccttacttgtttatttccatcatccaagttcatcacttagaaccctctcctaagcaaggacacagcttcatgattcattttgcatataataaactaattaacaagtacatcacaaaaatcaaaatttgctacagttcaaataggtctatgtgattcttatcacgcaaactgttcgaagtaatgcattttgatagaattgtagtatcttacaaattaaaatttctgtcacaaaactatacctttctgttttccaaaatcaaaggtgcaatagaataagcaatccttcaacacgccatcaacttttgagtcccatgattgatttttgtaggctattaatgatttatgtttcacagcattaggtgacatagattgattttgagtcctaaatgtttcaataacgacctcattttgcggagtggttattaatgtggtagtatagtttaacagcactacacccttttaaaagcagtttaatatttttttaagcaaaactaagattttacacaaggtcattctaggctctcaaactttattttacataacgtaaaatttttataaaaatgtaagattatcatctcattttaagatggcattttattaattaagagtgaaaatgttaattttgtagatatttttcatgcacctagagaatattttaaacacataaaaaatgagatatacctttctttacaattacgttctttgctagtgaacatgggagtcttcatttcccttcttacaaatattgctgaatttaattcagtaaaagtggtcatttttcatatttatctgtaaattgcactgaattttgttgtagtcacattaggaagtaatgatttatatgctttctaattatttatctgcttatataagcatagtctcattttagaaatgttattgaattaatgttgtaatacctggaacaaagaaaaataatttccatagactaagctctgcttttcagaaatctgatcttgttttgcatgctgtactctgtaatataggtaaatgcaggtgccaatcaggcaatttattataaaatttaaatagacgctgggaaaagtgcatagaaaatgcttatctactgaaaagtggctgttttcctgaatataaactctaagaggctgaaaccaaatagttaaagtatctgtcctattgcagaactagggacacaatacaacctgaggagttactggttgctctcttttattcccatgtgaggatattggaatgagaaggtgcatggcagttgtatgttctggaaagcttgtaatatagacaagagaaggtggtgagaattttttgagaacttttccctaagtcttctgttaaactgaagcttagagtaactcacaaataagtgaactaaaaaaaggagataaaataaatgtttagtttttaaaaatgctacttttatgaaaaatccaagcttaccactaaagaaaaaatattctaccatgttcaaagtcatatttggtcaacaggcatatatgcttctctttatggaatacttgtttcctgaaacaacatgaaaatctcattttataatagactggaaattattgtttacaacatgtaaatatgcttacagaaatgtgcagatatgatatacaaatgctgaaaaaacacggaagaataacaaaaagttggggcctggcttcaggtatatttttaaagccttttaagaagaattcaaatgatggaaggggcataagttggtgtggggactatgagcaaaagaaattcatgaggtgatatttttctttctaaataagtacccattttcaatgattaatgtagaaaattagttgccttgttggaagctgttatttattgctgaataacataccatcccaaagcctatgccttttaacaataactttcaacatccatggtaatgagaggtgaagccggctgggcttctgggtcgggtggggacttggagaacttttctgtctagctaaaggattgtaaacacaccaatcagtgctctgtctagctaaaggtttgtaaatgcaccaatcagcactctgtaaaatggaccaatcagcactctgtaaaagtggaccaatcagcactctgtaaaatggaccaatcagcaggacgtggatggggccaaataagggaataaaagctggccacccaagccagcagtggcaacctgcttgggtccccttccatgctgtagaagctttgttctttcgctcttctcagtaaatcttgctgctgctcactctttgggtccgcactacctttatgagctgtaacactcactgagaaggtctgtggcttcactcctgaagtcagcaagaccacaaacccactgggaggaacaaacaactccggacgccccacctttaaaagctgtaacacacactgcgaaggtctgcggcttcactcctggtcaagcgagatcaagaacccactggaaggaagaaactccagacacatctgaagatctgaaggaacaaactccggacacaccatctttaagaactgtaacactcactgtgagggtccgcggcttcattcttgaagtcagcgagaccaagaacccaccagaaggaaccaattccagacacattttggtgaccacaaagggactatcacctatcgccaagcggtgagtaccattggaccccttttgcttgctattctgtcctatttttccttagaattcgggagctaaatactgggcacctgtcggccagttaaaagcgactagtgcggccaccagactaaagacacgggtgtcaggctttctgggaaagggctctctaacaacccccgactcttcggagttgggagcgttggtttgcctggaacaagcttctgcttttcctgtacttctgggctgagtcaaggtcaacagagaggaaagccattcagctccagggtcccgacaacaagttggttgaccctgtgaccatgagcggaactctcgaagtcatgttgcccaagcgagactcgcccatctattctatctatcttgacccttgcctcttgggtcctaatgcctgccagacaaacttcctcttgcctcttctttgaggctagtcccacttctaaaaaccactccctatctctggtgcttttctagtttctcctataagaatgatttctagtgtaaactccaggactctgttaccttctttaggcacccaggctcaccaatcagaaagacataatttttacccaaagccccatcacaggggggactgcctggaattttaggatccctcctcagactagcaggcctaacaaaagctattcctgaagctaggatatggggaacctcagaaattgtatccttcctattcatataagtgaggacaaaaaacatcactcttccaactctggagatccctcccctccctcagggtatggccctccacttcatttttggggcataacatctttataggacaggggtaaagtcccaatactaataggagaatgcttaggactctaacagattttcgagaatgcatcagtaagggccgctaaatccgatttttctcagtcctctttgtggtctaggaggacaggcaagggtgcaggtttttgagaatgcattggtaagggccactaaatctgatttttctcggtcctctttgtggtctaggaggacaggcaagggtgcaagtttttgagaatgcatcagtaagggccactaaatcagaccttcctcagtcctccttgtggtctaggaggaaaactagtgtttctgctgctgcgttgatgagtgcaactattccaatcagcagggtccagggaccgttgcgggttcttgggcaagaggtgtttctgctgctgcgtcagtgagtgcaactattctgatcagcagggtccagggactgttgcaggttcttgggcaggggaagaaacaaacaaagcaaaaccatgggcaattttgtctttcagatggaaaacactcaggcatcaacaggctcacctttgaaatgcatcctaagccattgggaccaatttgacccgcaaaccctgaaaaagaggtggctcatttttttctgcactatggcctggccccaatattctctctctgatggggaaaaatggccacctaagggaagtataaattacaatactgtcctgcagcttgaccttttctgtaagagctaaggcaaatggagtgaaataccttatatccaagctttcttttcattgaaggagaatacacaactatgcaaagcttgcaatttacatcccacaggaggacatctcagcttacccccatatcctagcctccctatagctccccttcctattaatgataagcctcctctaatctcccctgcccagaaggaaataagcaaagaaatctccaaaggaccacaaaaacccccaggctatcggttatgtccccttcaagctgtagggggaatggaatttggcccaacccaagtagatgtccccttctccctctctgatttaaagcagatcaaggagacctggggaagttttcagatgatcctgataggtacatagatgtcctacagggtctagggcaaaccttcaacctcacttggagagatgtcatgctattgtaagatcaaaccctggcctttaatgaaaagaatgtagcttcagctgcagcctgagagtttggagatacctggtatcttagtcaagtaaatgatagaatgacagccgaagaaagggacaaattccctactggtcagcaagccatccccagtatggatccccactgggaccttgactcagatcatggggactggagtcgtaaacatctattgacctgtgttctagaaggactaagaagaattaggaaaaagcccatgaattattcaatgatgtccaccataactcagggaaaggaagaaaatccttctgccttcctcgagtggctatgggaggccttaagaaaatatactcccctgtcacccaactcactagagggtcaactgattctaaaagaaaagtttattacccaatcagccgcagatatcaggagaaagctccaaaagcaagccctgggtcctgaacaaaatctggaggcattattaaacctggcaacctcggtgttctataatagggaccaagaggaacaggcccaaaaggaaaaagctagatcagagaaaggccatagccttagtcatggccctcagacaaacaaaccttggtggctcagagaggacagaaaatggagcaggccaatcacctggtagggcttgttatcaatgtggtttataaggacactttaaaaaagattgtccaatgagaaacaagccaccctctcatccatgtctgctatgctgaggcaatcactggaaggtgcactgccccagagtgcaatggttctctgggctggaagcccccaaccagatgatccaacaacaggaccgagggtgcccgggcaagcgccagctcatgtcatcaccctcactgaggcctgggtatgtttaaccattgagggccaggaaattgacttcctcctggacactggcacagccttctcagtgttaatctcctgtcccagatgactgtcctcaaggtctgttaccatctgaataatgctgggacagcctgtaaccaggtatttctcccacctcctcagttgtaattgggagactttgctcttttcacatgccttttttgttatgcctgaaagtcccacacccttattagggagggatatattagccaaagctggagctattatctacgtgaatatggggaacaagttacccatttgttgtcccctacttgaggagggaatcaaacctgaagtctgggcattggaaggacaatttggaagggcaaaaaatgcctgcccagtccaaatcaggctaaaagaccccaccacttttccttatcaaaagaaatatcccttaaggcctgaagctgataaaggattacaggatattgttaaacatttaaaagccttaggcttagtaaggaaatgcagcagtccctgcaacaccccaattctaggagtacaaaaactaaatggtcagtggagactagtgcaagatcttagactcatcagtgaggcagtaattcctgtatatccagttgtacccaacccctatactctgctctctcaaataccagaggaagcagaatggttcactgttctggacctcaaggatgccttcttctgtattcccctgcactctgactcccagtttctctttgcctttgaggatcccacagaccacacatcccaacttatgtggacggtcttgccccaaaggtttagggatagccctcatccgtttggtcaggcactggcccaggatctaggccacttctcaagtccaggcactctggcccttcagtatgtggatgaattacttttggctaccagtttggaaacctcatgcaagcaggctactctagatctgctgaactttctagctaatcaagggtacaaggtgtctaggttgaaggcccagcttttcctacagcaggtcaaatatctaggcctaatcttagccagagagaccagggccctcagcaaggaatgaatacagccataatggcttatccttgccctaagacattaaaacagttgtgggggttccttggaatcaccggcttttgccaactatggatccccagatatagtgagatgactagaccactctacactctaatcaaggagacccagagggcaaatactcatctagtagaatgggaaccagggacagaaacagccttcaaaaccttaaagcaggccttagtacaagctccagctttaagccttcccacacggcaaaacttctctttatacgtcacagagagagcagagatagctcttggagtccttacttagactcgtgggacaaccccacaaccagtggcatacctaagtagggaaattgatgtagtagcaaaaagctggcctcactgtttaagagtagttgcagcagtggccatcttagtgtcagaggctatcaaaataatacaaggaaaggatctcactgtctggactactcatgacgtaaatggcatactaggtgccaaagaaagtttatggctatcagacaccacctacttagataccaggcactactccttgagggaccagtgcttcaaatacatacttgtgtggccctcaaccctgccacttttctcccagaggatggggaaccaatcgagcatgactgccacaaattatagtccagacttatgctgcccaaaatgatttcttcaaagtccccttagctaatcctgaccttaacctatataccgatggaagttcatttgtggagaatgggatattaagggcaggttatgccatagttagtgatgtaaccatacttgaaaataagcctcttcccccagggaccagcgcccagttagcagaactagtggcacttacccgagccttagaactgcgaaagggaaaaagaataaatgtgtatacaaatagcaagtatgcttatctaatcctacatgcccatgctgcaatatggaaataaagggagttcctaacctctaggagaaagcccattaaataccacaaggaaattatggagttattgcactcagtgaaaaaacccaaggaggtggcagtcttacaccgccaaagccatcaaaaaggggaagcagaagggagaacagcagcataagtggttggcagaggcaaggaaagaccagaagaaagaaaagagagaaagagacagaaagtcagagagagagagagagagagagaggaagagacagagacaaggaaggagagagagaggagaagagacagagacaaagagggagtcagagagagagagagagagagagaaagtcagagaaaggaagagacagacaaaaagggagtcagaaagagagagacgaagaagtcaaagagaaagaaagaccttctttctatcttccttctttctgacagcaatttactcctacctttaattcagcctggataaaatgatctcatcttccagagcaccagttttaccttcctatttactctttgcctatctatccttcctgcttccttggatacctcatacaatcacccctcaccttccactagctcctaattacctctacaagactctcaacctaacccacgctctgttaaaccagtccaatccttccctggcaaatgactgttggctttgtatctctctatcaacttctgcttacgttgccactcccattcctgcaaaaaaactgggtctttaccaacttaacctactaccctagttatgaaggaaaagaccctttccaacttctaaatatgcaatcattagccaaattccccatttctgataggaccaagaataccctaacaggacatgcaatccaacttttacattcttacatttcccacctcacctattacacaagcaatgaaaagcccatacacggcactgtaactatgaataccatcttaactttctaagttcctttatgcatccagtgcaacctgttatcaggcctgcctctggggcacctactaccccatcagcgtaattacaccccacaacttcaagccccaactgatcatagtaacttccgagtcacccaaacagctccattcagatggcttgtccgcttctcagggcccccaaaagtcatcatctcctccctacttaacaaacagtccaggttctgtaatggcaaacatactccctgcatgaccattcacccctggactccctgcagcagtgcccccaccactagtgaatgcctgctcatcccctctttcaaccactctctcaaaaggttcctagtcgatacaaaacggtgttttctccaatgggaaaatagaacacagggagccactcagtttgatcccaacacccttccacccgctcaccagagctaccttggcaagtagtctaggagtatgggaaaatgaaaacaacaaactcacacacctttttaacatacacaaacagttctgtctacccagccaaggtatattcttatgtggaacatcgacctatatctgcattcctactaactggacaggcacctgcaccttagtctttctaagtcccaacattaacattgccccaggaaatcagacattatcagtacccctcaaagttaagtctgtcagcacagagccatacaactaatacccctattaatagggttaggaatggctactgctacaggaaccggaatagccagtttatctacttcattatcctactaccacacactctcaaaggatttctcagacagtttgcaataaataatgaaatctatctttattttacaatcccaaatagacttttttttattgtactttaagttctagggtacatgtgcacaaagtgcaggtttgttacataggtatacatgtgtcatgttggtgtgctgcacctattaagtcgtcatttacattaggtgtatctcctaatgctatccctcccccctacccccaacccaagacaggtcctggtgtgtgatgttccccttcctgtgtccaagtgttctcaatgttcaattcccacctatgagtgagaacatgcagtgtttggttttttgtccttgcgatagtttgctgagaatgatggtttccagcttcatccatgtccctacaaaggacatgaactcatcttttttatggctgcatagtatactgtggtgtatatgtcccacattttcttaatccagtctatcattgttggacacttgggttggtccaagtttttgctatcgtgaatagtgccgcaataaacatacgtgtgcatgtatctttatagcagcatgatttatagtcctttgggtatatacccagtaatgggatggctgggtcaaatggtatttctagttctagctctttgaggaattgccacactgtcttccacaatgatagaactagtttacagtcccaccaacagtgtaaaagtgttcctatttctccacatcctctccagcacctgttgtttcctgactttttaatagttgccattctaactggtgtgagatggtatctcattgtggttttgatttgcatttctctgatggccagtgatgatgagcatgttttcatgggtctgttggatgcataaatgtcttcttttgagaaatatctgttcatatgctttgtctgctttttgatgggattgtctgtttttttcttgtaaatttgtttgagttctttgtaaattctggatattagccctttgtcagatgagtagattgcaaaaattttattccattctataggttgcctgttcactctgatggtagtttcttttgccgtgcagaagctctttagtttaattagatcccatttgtcaattttgtcttttgttgccattgcttctggtgttttagacatgaagtccttgcccatgcctatgtcctgaatggtattgcctaagttttcttctagggtttttatggttttaggtctaacatttaattctttactccctcttgaattaatttttgtataaggtgtaaggaagggatccagtttcagctttctacatatggctaaccagttttcccagcaccgtttgttaaatagggaatcctttccccatttcttgtttttgtcaggtttgtcaaagatcagatggttgtatatgtgtggtattatttctgagggctctgttctgttccacttctctatatctctgttttggtaccagtaccatgctgttttggttactgtagacttgcagtatagtttgaagtcaggcagcatgatgcctccagctttgttcttttggcttgggattgtcttggaaatgcgggttcttttttggttccatatgaactttaaagtagttttttccaattttgtgaagaaagtcattggtagtttgatggggatcgcattgaatctataaattaccttgggcagtattgccattttcacaatattgattcttcctatccatgagcatggaatgttcttccatttgtgtcctcttttatttcactgagcagtggtttgtagctctccttgaagaggtccttcacatcccttgtaaattggattcctaggtactttattctctttgaagcaattgtaaatgggagttaactcatgatttggctcctgtttgtccattattgatgtataagaatgcttgtgatttttgcacattgattttgtatcctgagactttgctgaagttgcttatcagcttatggagattttgggctgaaatgatggagttttctaaatatacaatcatatcatctgcaaacaagaacaacttgacttcctcttttcctaattgaataccctttatttctttctcctgcctgattgtcctggccagaacttccaacactatgttgaataggagtggtgagagagggcatccctgtcttgtgcccgttttcaaagggaatgcttccagtttttgcccattcagtatgatattggctgtgggtttgtcataaatagctcttattattttgagatatatcccatcaatacctaatttattgatagtctttagtatgaagggctgttgaattttgtgacaggccttttctgcatctattgagataatcatgtggttttcgtctttggttctgtttatatggtggactacatttattgatttgcatatgttgaaccagccttgcatcccagggatgaagcccacttgatcatggtggataagctttttgatgtgctgctggattcggtttgccagtattttattgaggatttttgcatcaatgttcatcaaggatattggtctaaaattctctttttttgttgtgtctctgtcaggctttggtatcaggatgatactggcctcataaaatgagttagggaagattccctctttttctattgattggaatcatttcagaaggaatggtaccagctcctccttgtacctctagtagaattcggctgtgaatctgtctgctcctggactttttttggttggtagtctattattacctcaatttcagagactgttattggtctattcagggattcaacttcttcctggtttagtctttggagggtgtatgtgcacaggaatttatccatttcttctagattttctagtttatttgtgttagaggtgtttatagtattctctgatggtagtttgtatttctgtgggatgggttgtgatatcccctttatcattttttattgcatctatctgattcttctcccttttcttctttattagtcttgctagcggtctatcagttttgttgatcttttcaaaaaaccagctcctggattcattgattttttgaagggttttttgtatctctatctccttcagttctgctcttatcttagttatttcttgccttctgctagcttttgaatgtgtttgctcttgcttctctagttctcttaattgtgatgttaggttgtcaattttagatcttttctgctttctcttgtgggcatttagtgctataaatttccctctacatactgctttaaatgtgtcccagagattctggtatgttgtgtcttttttctcattggtttcaaataactttatttctgcctccatttcgttacgtacccagtagtcattcaggagcaggttgttcagtttccatgtagttgagtggttttgagtgagtttcttaatcctgagttctagtttgattgcactgtggtctgagagacagtttgttataatttctgttcttttacattttgctgaggagtgctttagttccaactatttggtcaattttagaataagtgtggtgtggtgctgagaataatgtgtattctgttgatttggggtggagagttctgtagatgtctattaggtccacttggtgcagagctgggttcaatttctggatatcctcattaactttctgtctcattgatctaatattgacagtggggtgttaaagtctcccattattattgtgtgggagtctaagtctctttgtaggtcactcaggacttgctttatgaatctgggtgctcctgtattaggtgcatatatatttaggatagttagctcttcttgttgaattgatccctttaccattatgtaatggtcttctttgtctcttttgatctttgttggtttaaagtctgttttatcagagactaggattgcaacccctgcctttttttgttttccatttgcttggtagatcttcctccatccctttatgttgagtctatgtgtgtttctgcacatgagatgggtctctgaatgcagcacactgatgggtcttgactctttatccaatttgccagtctgtgtcttttaatgggagcatttagcccatttacgtttaaggttaatattgttatgtgtgaatttgatcctgtcattatgatgttagctggttattttgctcattaattgatgcagtttcttcctagcctggatggtctttaaaatttggcatgtttttgcagtggctggtaccggttgttcctttccatgtttagtccctccttcaggagctcttttagggcaggtctagtggttataaaatctctcagcatttgcttgtctgtaaagtattttatttctccttcacttatgaagcttggtttggctggatatgaaattctgggttggaaattcttttcttaagtatgttggatattggccaccactctcttctggcttatagtttctgccgagacatccgctattagtttgatgggcttccctttgtgggtaacccgacctttctctctggctgcccttaacattttttccttcatttcaactttggtgaatctgacaattttgtgtcttggagttgctcttctcgaggagcatctttgtggcattctctgtatttcctgaatttgaatgttggcctgccttgctaggttggggaacttctcctggataatatcctgcggagtatttttcaacttggttccattctccttgtcactttctggtacaccaatcagatgtagatttggtcttttcacgtagtcccatatttcttggaggctttattttgtttctttttactctttttttctctaaacttctcttctcacttcatttcattcatttgatcttccatcactgatatcttttcttccagttgatcgaatcggctactgaatcttgtgcattcatcatgtagttcttgtgccatgtttttcagctccatcaggtcatttaaggacttctctacattggttattctagttagccattcatctaatcttttttccaggtttttagcttctttgcaatggtttcaaacttcctcctttagctttgagaagtttgatcatctgaagccttcttgtctcaactcatcaaagtcattctccatccagctttgttccattgctggcaaggaactgtgttcctttggagggggagaggcactctgatttttagtattttcagcttttctgctccgttttttccccatctttgtggttttatctacctttggtctttgatgatggtgatgttcagatggggattctgtgtggatgtcctttctgtttgttagttttctttctaacagtcaggaccctcagctgcaggtctgttggagttttctggaggtccactccagactgtgttttcctgggtatcagcagcggaggctgcagaacagcgaatattgctgaacagcaaatgttgctgcctgatcgttcctctggaagcttcatctcagaggggtacctggccatggaggtatcagtctgcccctactggggggtgcctcccagttagactactcgggggtcagggacccacttgaggaggcagtctgtccgttctcagttctcaaactctgtgctgggagaaccactactcactttaaagctgtcagacagggatatttaagtctgcagaggtttctgttgccttttgttcggctatgccctgcccccagaaggggagtctacagaggcaggcaggactcctttagctgtggtgggctccacccagttcaagcttcctggccactttgtttacctactcaagcctcagcaatggcgggcgccactctcccagcctcgctgctgccttgcagatcaatctcagactgctgtgctagcaatgagtgaggcttcgtgggcatgggaccctctgagccaggcatgggatataatgtccttgtgtgccatttgctaagactgttggaatagcacagtattagggtgggagtggcccgattttccaggtgctgtctgtcaccgcttcccttggctaggaaagagaattccctgaccccttgttcttcccaggtaaggcagtgcctcaccctgcttcagctcacactcaggtgactgcacccactgtcctgcccccactgtcggacaagccccagtgagatgaacctggtacctcagttggaaatgcagaaatcacctgtcttctgcgtcactcacactgggagctgtagactggagctgttcctatttggccatcttggaaccatctcccaaatagactctttggcagcagtgactctccaaaaccaccaaggcctagacctcctcattgctgagaaaggaggactctgcaccttcttaggggaggagtgttgtttttatactgaccagtcagggatggtacgagatgccacccgatgtttacaggaaaaggcttctgaaatcacacaacacctttcaaactcttataccaacctctggagttgggcaacatggcttctcccctttctcggtcccattgcagccatcttgctattactcgccttcaggctgtgtatttttaacctccttgtcaaatttgtttcctctagaattgaggccgtcaagctacagatggtcttacaaatgggaccccaaatgagctcaactaacaacttctgccaaggacccctggaccaacctgctggccctttcactggccttaagagttcccctctggagggcactacaactgcagggccccttctttgcccctatccagcaggaagtagctagagcagtcatcacccaattcccaacagcagttggggtgtcctgtttagaggggagattgagagttcaaggcagctgggcttctgggttgggtggagacttggagagcttttctgtctagctaaaggattttaaacacaccaatcagtgctctatctagctaaaggtttgtaaatgcaccaagcagcactctgtaaaatggaccaatcagcaggatgtgggtggggccagataagggaataaaagctggccacctgagccagcagcagcaacccactttggtcaccttccatgctgtggaagctttgttcttttgctcttcacaataaatcttgctgctcctcactctttgggtccacactacctttatgagctgtaacactcactgcgaaggtctgcagcttcactcctgaagtcagtgagaccacaaacccactgagaggaataaacaactccggatgccccacctttaagagctgtaacacaccctgcgaaagtctgcggcttcactcctgaaatcaagagataccatgaacccaccagaaggaagaaactggacacatctgaacatctgaaggaatgaactctggacacaccatctttaagaactgtaacactcaccatgagagtccacagcttcgttctcgaagtcagcgagaccaagaacccactggaaggaacgaattctggacacagtaatatagatgactaggctcagctggtcacttatcaggatcacaggcagttattatcagatggctgtggctagaatcatctgaaggctcaagagagctggatgtcaagatagattcttcacacatgctcctggagcctaaaataggaggaatggctggggaatagctggacatttctcttttaatgtggcctttctacatggtgacatggtctttgtcgtatcatgatggtctaagggtagactttgaagttacatgataattatttcctttagagccattgttcccagagacagaaagtgaaagctgtgatttttaaaaatttctgggctcataatctgataaagagtcacttcatattctactggtcaaaatgctcacagagtctgccaaaattcaaggagagaggatatgaaccccacctctctgtgggaaaattatcaaacaatttgtgaccatcattaatctactataaaagttatgcaggatagattagcaggatgcttcttatgtttttgttgttgaaataacagggacaaggaataaaaacctgtgcagaaatcagaagatctacttttgcatatacaaagtgaagagttgcttgtaaagcaacaccaggcattatagtgcctgtgaccttgatattagaatcaccttgccctccaaaagtgccatggacatcacttttataagtcagattctatttatatgctctagagttgctggctacttaaaggagaaccttttgtaaagtgaagaaaagtttaaaggcattgaacacacaggaggtgcaatgataaatgttactttaccctctctcattccattagtgttttcttaaaggaatattgggtcctactcaagacttaactgagatggctgatcttaagtgttgaatataagcccccgttcttggtcttggaatgtgaacattattgggtatcattgacggagagattggcaaaggaaatcctgcaagagataggagacctaaattttcaataagtgttctacttggtttccatggaaactgggttaggtagtgaatctcacttgatgtgcacttctgtgccttcttgaacagatctttaggagtcggtaaaacaatagtgggatagcattaataaaatctggaaagacaagtacaggtctggtggaacaaaaggaattgtttggggacactggtgttgattttatgctactggaagtactttgagctgcatacaactcatgtagcatgctcaatgagagacaactaagtataggtatattagtattcacagttgcaagtgacaccaagctaaattgaatttaaaataatataaaatatctaagttttctaatccttatttcaaataagaatcagaaaaacaaaaggctggggttaacctttttctgcatttctgcattgcatggctgtcctgcctaacatcagccttcactgatatctccttaacttaactcttagcaaaccagacatgtagccagaactcttattccctgccaattttgtataatgacactgtagaaatgaaaacttaaaatagccattttttcccatgaaagcttttaatagccatccacaaaacttttcttggattctttgttttaatctctgagctgaacattttcttttgtttcttttatttttcccaacaagtcctccattgatgataatcttaggaaatacagttaagaaaatgatactcttccattagcactgtagtcaaaaaatcattttgcttctatttctgctgtcaattccttttttgttgagttgtttttgtatgataaaagattaataataagaatatactttttactgcaaatattttttttccctccagtgggagtataggtataaataccaagcaatttgaattaaacagattaagtcgtagtattgctattccaattgcttgtcattacacaggaggttatggttacagctgactatacagcactacctgagccatacattttacatttgcaatcggcctattatagatgaactgtgaaaattggagagagctttttatgataattggaagatgttttccttgaagtatgtaaagcccttgagagaacttgaattacttgcttgtaattttgttataagctttaatcctatttatttaacttgaagtttattgctcctgaatatattttcctatgtctttctattgagtgacatacatgctatattttcaatatttttatttgaatatcattacaaattttattttgctttttgttttcaaactcaaaaagttgttttcccttgggcatgattcatagataaatgaagttacttctgggttttaaattaggaatatcaatggaaatacaaagacagcctctctttgattgtacttggttctttctgtgttctgagtaaacctgacctaacatttcagataccaactgggaatctgtaggtgatgtgtgcaacattttatgccacacataattgtgtgctcttttctttttctttcttccccttaacaatctttctctggtttgactggtctcttccctgtttctgaatacctcatgctcattcctactttttgatccccataaaccatttctgtgcctagaatgccctctctcctcttcagaaccatccaagtcttctcatctctccccctgacaagatactccaacttatgttttactgtgttcaagaatatttaatataactactacagcctaaattaatctatcatctatgtgctcgtagcacttatttgctagaccattatgttggtacccaaccatatgtaatgacaccttgcttctctagagatgagaagtgtgagaaagcccacctgaaatgatgatcacagagctgctgcattatgggtacagattttactaacagccataatacacaatttaattttaattattagcgaacttcattatctgttttataaatcctcaagtgataagacacagccaattcccattttcctcatctgctaggtgatatctcatcacatctaagatcccattgattgtaagacacatcactcttttacgtaccacaaagaaaagacactgcccgtaaaactgtttcacaagagtttgctatcactttgaatttgtattttgtacatatcaaaagagctctttgtcatttaaacatattgttttgtttatcacatcaatctttaatttacctggcatacgggatcagatacattaatgcatgtttaaatagtttttttaatctctggaatttcttctttaaaacattctagaccagaggttcttaacatacagtacacagattcttgaaggcggagagtctctgaatagatatagtggtcaactattactgcaacaatgctacattaaaaaccaacccccaaactcactggcttaaaacaacaattatttattttcatctgtacatttgtaggtcagctggaggttagctgacctaggctgggctctaagctggaggttgagctcaggtctaccatgcatgtctctcatctttcttggaataaaaggctacgtggagcattgttttttctcatggtgatggcaacattgcaagaagaatgagcagaaacatacaatgcctcttaaagactagagttagaaattgcattatatcacttatattggaaaaagcaaattaggtggccaaagccagcatcagtggagcaaggaaatattctctgcctctggtgggaggagctacaaagacctatggcaaaggtcatgaatttagggagagacgaaggaatgggaacaatggtgcagcctactaaaatcagtttcaaggagaccaaaaagcctctaaaattctttgctaaaatgttgtatcataaagggatatttttctagagaacatgttcttactattcaccagattctcaaggagtgaatgggattccaaccatttccaagtgagaaccacttactttaggtccttctattattcctttgtttgttcattcaatattaatatacctcagttaatgacccaggattgatttctgtgaacattttaaaattttcaggtgattgaggagttggttgctttcttttgcttctttttttttttttttttttttttttttttgagacggactctcgctctgttgctcaggctggagtgcagtggtgtgatctccgctcactgcaagctccgcctcccgggttcacaccattctcctgcctcagcctcgcgagtagctgggactacaggcgcctgccaccacgcctggctaatttttttgtatttttagtagagacggggtttcaccgtgttagccaggatggtctggatctcctgacctcgtgatccgcccgcctcagcctcccagagtgctgggattacaggggtgagccaccgcaccctaccgagttggttgctttctaccaggtcatgtattttaagagcctggcaggctctaaaatttgatttggcagggctctatcagcaccaggtaacctttctgtgcttgaagcttagctggtacccactcccatagtgatgtgttagtgaatcccatatggaagaaacatagaggggggacattgaaacaagaaagacctggtttcaaattcctgccctgccgtttactacctgtgtcatctcaggcaagtaaataaacctctatgcacctcagtttccttttctgtaaaatgagagtgacagttcttatgctacaaggtcatcgtcattgtgaggattaaatgagacaatgtgtgtatagtatttgtcacatgttaggtgctcaacaaatgctagtccctctcattcccattattgtttacattatgctgacaattttatcctcattctgtaatataaatagtatgtccctatcctgtgaaatattaatgaagaaatttctgaatgctattcctttttattttttgtttttaaaaacagttattagctgtttgtttctatcagcagattctagacccagaataaaatcatatttacacttgggcgtttctatgagctctctttagcctttctctcctggtatgaacgttatggaagtaaagtagcttctttttccctcaaaggggactgccaaggccaaaaggaaattgaactttgtcttcctagtcacctctgatctttgacataacagagactgaggaggtgaaagctaattcttaccaagtactttttgacacagtagattgagcaataatggaaaaagttctgagatgttgtttttcacaaaattaccactgttaacctccaaattacatcaaccgaaacaattttttgttctttgaactctgacacagattgaacgagccctcatcaagagtaagaaaaaaaatttctctaggttagtaggaattggcctattttgaattctattccagccagtaaacatgctgttaactttgaaaattctgtgtagatttaaaaagaaatactctaatagctaggtattttattaccttttaaaattatttcagcctcaagcctaacagattatttagtaatgagtgacatttccgttgcagaatagcaggtggataattaatgaataatgtgttctattttcctgtctatatgtatatattctagaaatataactagtgttataggtaacagttcccagcttgatcaatgtaaataaatataaggcccagttttaaaaacataaacattttaaatctgcaatgcttttatatttcattcatcaaattctagtgagaaaggcattaggcatgtaaaaaataaaagaaaaaaattataaattgtggtgttctgggggagataagctgatgataaaggatatatactatccaaaaaggctgaaaagactactctttaaaagagtatcttcaatgcattttaaaattgatgtacattaatttagctaaattaacaatgggaaattaaatactgttcagcaagcttattgtcctattagaactgtagcttttttggctgcagagggggcattaaatgttgatgatattcaatacaatagccaaaacctttttattccactatggatttgctactaacgtgaatctttaaaagggagaaagcaagctattttgagggttctaatttagacaaggctaatgaattgtgaaaaaaatacattttcatcaaatgtcatcagctgaataagcaaatgcattaagttatcattttatatatgttggtcagatattattctctctcttcttcccaacaattctggtttcacagatgagaaattattttaaaagaaaaaaactttctaaggagaatcttcattaggctttcaatagagattcaccctggacacatctagaaatgtaaacaccatagtaaaaaaaaaaatgtaaagaataaactctcttgggagctgtttgagctggcttataacaaagggaaaagaatgggtgtccattggagtttctggaccctttgaggtcagttgtagtattgctattttatttatttatttttatttttttggagacagagtctgactctgttgcccaggctggagtgcagtggcatgatcttgtctcactgcaacctctgcctcccaggttcaagtgattctcctgcctcagcctcccgagtagctgggactacaggcacgcatcaccatgcctggctaattttttgtatttttagtagaagcgggattttgccgtgttgcccaggctggtcatgaactcctgacctcaggcaatccgccagcctcagcctcccaaagtgctaggattacagatgtgagctaccacacccagcctaatattgttattttatagataacgatgataaattacagaagggataagtagtgttctgttccaggtcatacaactagcaaatgtcaaagcaggattaaaactcagatcattctggttctaaactttcacctgtagtttggattgttgagtccaaggagaggaagatttttgggtcagaagattctgcaaaactgcctgcatatgcttgccttctattcacaaatatccctctctccttatttgtatattgtagtatcaccaactaatggccatttctgatggtcactgggtaagttgttcctctcttgatagctctgctctaacatggaaagtacttatcttcttttatatatatatatatatatgcatacacacacacacatacacatatatacatatgtagttttctttttaaattattctttttttctcattattatactttaagttttagggtacatgtgcacattgtgcaggttagttacatatgtatacatgtgccatgctggtgcgctgcacccactaacttgtcatctagcattaggtatatctcccaatgctatccctcccccctccccccaccccacaacagtccccagagtgtgatattccccttcctgtgtccatgtgatctcattgttcaattcccatctatgagtgagaatatgcggtgtttggttttttgttcttgtgatagtttactgagaatgatgctttccaatttcatccatgtccctacaaaggacatgaactcatccttttttatggctgcatagtattccatggtgtatatgtgccacattttctcaatccagtctatcattgttggacatttgggttggttccaagtctttgctattgtgaataatgctgcaataaacatacatgtgcatgtgtctttatagcagcatgatttatagtcctttgggtatatacccagtaatgggatggctgtgtcaaatggtatttctagttctagatccctgaggaatcgccacactgacttccacaatggttgaactagtttacactcccaccaacagtgtaaaagtgttcctatttctccacatcctctccaacacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcccccactttttgatggggttgtttgtttttttcttgtaaatttgttggagttcattgtagattctggatattagtcctttgtcagatgagtaggttgcgaaaattttctcccattttgtaggtttcctgttcactctaatggtagtttcttttgctgtgcagaagctctttagtttaattagatcccatttgtcaattttggcttttgttgtcattgcttttggtgttttagacatgaagtccttgcccatgtctatgtcctgaatggtaatgcctaggttttcttctagggtttttatggttttaggtctaacatttaagtctttaatccatcttgagttgatttttgtataaggtgtaaagaagggatccagtttcagctttctacatatggctagccaattttcccagcactatttattaaatagggaatcctttccccattgcttgtttttctcaggtttgtcaaagatcagatagttgtagatatgtggtgttatttctgagggctctgttctgttccactgatctatatctctgttttggtaccagtaccatgctgttttggttactgtagccttgtagtatagtttgaagtcaggtagtgtgatgcctccagctttgttcttttggcttaggattgacttggcgatctgggctcttttttggttccctatgaactttaaagtagttttttccaattctgtgaagaaagtcattggtagcttgatggggatggcattgaatctataaattaccttgggcagtatggccattttcatgatattgattcttcctacccgtgaacatggaatattcttccatttgtttgtatcctcttttatttccttgagcagtggtttgtagttctccttgaagaggtccttcacatcccttgtaaattggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttgaggagattttgggctgagacaatggggttttgtagatatacaatcatgtcatctgcaaacggggacaatttgacttcctcttttcctaattgaataccctttatttccttctcctgcctaattgccctggccagaacttccaacactatgttgaataggagtggtgagagagggcatccctgtcttgtgcctgttttcaaagggaatgcttccagtttttgcccattcagtatgatattggctgtgggtttgtcatagatagctcttattattttgaaataacgtcccatcaatacctaatttcttgagagtttttagcatgaagggttgttgaattttgtcaaaggccttttctgcatctattgagataatcatgtggtttttgtctttggctctgtttatatgctggattacatttactgatttgcatatactgaaccagccttgcatcccagggatgaagcccacttgatcatggtggataagctttttgatgtgctgctggattcgttttgccagtatgttattgaagatttttgcatcaatgttcatcaaggatattggtctaaaattgtcttttttggttgtgtctctgcctggctttggtatcagaatgatgctggcctcataaaatgagttagggaggattccctctttttctattgattggaatagtttcagaaggaaactagttcctccttgtacctctcatagaattcggctgtgaatccttctggtcctggactctttttggttggtaagctattgattattgccacaatttcagctcctgttattggtctattcagagattcaacttcttcctggtttagtcttgggagagtgtatgtgttgaggaatttatccatttcttctagattttctagtttatttgcgtagaggtgtttgtagtattctctgatggtagtttgtatttctgtgggatcagtggtgatatcccctttatcattttttattgcatctatttgattcttctctctctttttctttattagtcttgctaacagtctatctattttgttgatcctttcaaaaaaccagctcctggattcattaattttttgaagggttttttgtgtctctatttccttcagttctgctttgatttcagttatttcttgccttctgctagcttttgaatgtgtttgctcttgcttttctagttcttttaattgtgatgttagggtgtcaattttggatctttcctgctttctcttgtgggcatttagtgctataaatttccctctacacactgccttgaatgtgtcccagagattctggtatgttgtgtctttgttctcgttggtttcaaagaacacctttatttctgccttcatttcgttatgtacccagtcgtcattcaggagcaggttgttcagtttccatgtagttgagtggttttgagtgagattcttaatcctgagttctagtttgtttgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatttctgttatgtctgcttggtgcagagctgacttcaattcctgggtatccttgttgactttctgtctcgttgatctgtctaatgttgacagtggggtgttaaagtctcccattattaatgtgtgggagtctaagtctctttgtaggtcactcaggacttgctttatgaatttgggtgctcctgtgttgggtgcatatatatttaggatagttagctcttcttgttgaattgatccctttaccattatgtaatggccttctttgtctcttttgatctttgttggtttaaagtctgttttatcagagactaggattgcaacccctgcctttttatgttttccatttgcttggtagattttcctccatccttttattttgagcctatgtgtgtctctgcacgtgagatgggtttcctgaatacagcacactgatagatcttgactctttatccaatttgtcagtccgtgtcttttaattggagcatttagtccatttacatttaaagttaatattgttatgtgtgaatttgatcctgtcattatgatgttagctggttattttgctcgttagttgatgcagtttcttcctagtctctatggtctttacattttggcgtgattttgcagtggctggtaccggttgttcctttccatgtttagcacttccttcaggagctcttttagggcaggcctggtggtgacaaaatctctcagcatttgctcgtctgtaaagtattttatttctccttcacttatgaagcttagtttggctggatatgaaattctgggttgaaaattcttttctttaagaatgttgaatattggcccccactgtcttctggcttgtagggtttctgctgagagatccgctgttagtctgatgggcttccctttgagggtaacccgacctttctctctggctgcccttaacattttttccttcatttcaactttggtgaatctgacaattttgtgtcttggagttgctcttctcgaggagtatctttgtggcgttcactgtatttcctgaatctgaatgttggcctgccttgctagattggggaagttctcctgaaatgttggcctgccttgctagattggggaagttctcctggataatatcctgcagagtgttttccaacttggttccattctccccgtcactttcaggtacaccaatcagacgtagatttggtcttttcacatagtcccatatttcttggaggctttgctcatttctttttattcttttttctctaaacttcccttctcgcttcatttcattcatttcgtcttccatcactgataccctttcttccagttgatcgcattggctcctgaggcttctgcattattctcgtagttctcgagccttggttttcagctccatcagctcctttaagcacttctctgtattgtttattctagttatacattcttctaaatttttttcaaagttttcaacatctttgcctttggtttgaatgtcctcccgtagctcagagtaatttgatcgtctgaagccttcttctctcagctcgtcaaagtcattctctgtccagctttgttccgttgctggtgaggaattgcgttcctttggaggaggagaggtgctctgctttttagagtttccagtttttctgttctgttttttccccatctttgtggttttatctacttttggtcttctatgatggtgatgtacagatgggtttttggtgtggatgtcctttctgtttgttagttttccttctaacagacaggaccctcagctgcaggtctgttggagtccccttgccgtgtgaggtgtcagtgtgctcctgttggggggtgcctcccagttaggctgctcgggggtcaggggtcaggcacccacttgaggaggcagtctgccccttctcagatctccagctgcttactgggagaaccactgctctcttcaaagctgtcagacagggacatttaagtctgcagaggttactgctgtctttttgtttgtctgtgccctgcccctagaggtggagcctacagaggcaggcaggcaggcaggcctccttgagctgtggtgggctccacccagttcgagcttcctggctgctttgtttacctaagcaagcctgggtaatggtgggcgcccctccgccagcctcgctgacgccttgcagtttgatctcagactgctgtgctagcaatcagcgagactccgtggttgtaggaccctccgagccaggtggggaatataatctcatgctgcaccattttttaagcctgtcggaaaagcgcagtattcggttgggagtggcctgattttccaggtgccgtccgtcacccctgtctttgactaggaaagggaactccctgaccccttgcgcttcccgagtgaggcaatgcctcgccatgcttcggctcgctcacggtgcgcgcacccactgacctgcgcccactgtctggcactctcttgtgagacgaacccggtgcctaggatggaaatgcagaaatcacctgtcttctgcgttgctcgtgctgggaactgtagactggagctgttcctattcgtccatcttggctcctctctaaattattctttaagttctgtggtacatgtgcagaatgtgcaggtttattacataggtatacacatggcatggtggcttgctgcacccatcaacctatcatctacattaggtatttcttctaatgctatccctcccctagccccctgtcccctgacaggcaccagtgtgtgatgttcccctccctgtgtccatgtgttctcttcctaatgtattttaaatacctgagtttcctttttgtgtatggtcagtacagcaaacttgaatttctagaacctgatatagtggtgtcttgaggtttttgtttctcttttgttcctaatagtttttaaaaattttgtagctctcttcactcccacagcactctacatattcacgtgcacacctaattcatgagctctctatacagaaagaaataatgggaatgactgggaacatgctattaaatggatatattttcagatcttccttaaatcattttctttgcagccttctacttctaagaccgtatcatgaggcttattgacacaagggagaaaaagacacatgcaagtaatattaggaatgaaaaggtaatatgatagatataacagagatttgaataaatcagaagagattaatatgaagcaaccaactttatgccaataaaatagaaaacaaatgatatggacatattaatagaatgtataattgatcaacattatctcaagaaaaattagaaaaccttcataaaccaataagcttaagcatattgaattggtaataaaaattatcaacctcccatctcccgcccaaagactccaggcttatgtgattagatgattttattggaaaattttctctaactgtcaagaattaaatgttccaaattacattaacaatttcagaaaagggaaaaaagctacttaatttactttatgagactagcataaccatcataaaaccaggaaaaggcagaatctgaaaagtataggccaatcctatttataacataggtgaaaatgtctgaaacaagaaccattagacaattattactcaggtacaagccccaagagtcatctttctttcctgttttcctgcttatactcaatatctagtgagtgaggtcctgttgactctgcctcttaaacatatctcaaatctgttcaatcttctttgtcttcactaccaccataggcaagtgaacaaatatctcttcctgcagtggtctctgttcactctccactcttgctcttactgcagtacttttaaaatgtaaatcagatgatgtcgttcctgcatcaaaattctctaaatattttccatgatgtatagaatagaatccaaacctctcaccctggtctacaagtccctgcactatctgacatacagcttcatcaccatctcttgctactctgctccttgctcactgcactgtagacatactgatcttcttcctgttatttgaagagaccaagcttgttgccacctcagagaatttatattttctgttccttctgtctgaattactctcctgtaagtgtttgcaaataaatcttctccgtattcaggccttcactcaaatatcgctttctcagagaggccttccctagtacatctccctgtttcttcatttactcttcttcctaccttttactctgtatcccattaaccttcttattttgcttcatagtgcttatcagtatcctccaataatcattttcagatattttagaaatgcattgtccttctatcttttatcagctgcaggtggacagggatttttttttttctttttttcctttgttttgttttgttttgttttgttttgttttgctgtatttctaacacctagaaggctggggaggcactaaatatatattgcatgaataaatctaatgtaaacttccttaagtcacagatgagaaaactgaagcccagggaaggaatgtgacttgatcaagattacttgcccacctgggaatagaatcctttctcctgagttacagtatggtgccctttctgctataccacatgtttttatgtgcctctagccccataattctagtttcaaaaggcaatcccatcctctccctggtggactagtataagtattaatttatagagatgtttatgaagcatactgcaggcaaatcaatatgataatgagagttagatattgatactatattattttgtagctttccaatagtgactgtttcatttcaggattgctttcctttcagaggtaggaaaaatacttatttttaatgtgtgtgtctatcagcaaatatggtaaagcatgttaaggccaagcatgctgagctgatgacattaacttatcctaaataagtctcacatgagccaactggttcagattaaagccccttattcaccatgatgcaaagtacttttacaataaaacaaaaacaaaacaagagatcacatagcaagggtgtgtgtgcatacatgcctatgtgctgcaagttaataagtacattgtgtaagtaccatgagactgtgactgtgccagtggagatacaaaagaagtagcaggcataatccttatcatcaaggatcttacaaaatatagtcttgaaattactagaaaatagttctgatgcattatataagcaaggcaggatagtaagagtaagactgtatctaccagggccagtgagatacagaataagagaaaaatcactatgaggtagagttaatctgaacaaacaacacagagactatgcaatcaaaactatgggtggcctgcctttttactttttgtggcaagactcagtatatattgatatatcattaaaaatcattcattttgtttgtatgcaggctgttaccatcgaccacaggagacagagttttctaagactttaaaataattcttggaaggtaataaggtctggtagttgctttcgattttctaagcagaaacacagtgttcaagtaccctttgtctacattcagaattgggagtagggatgtttcctgacactgtggaatatttcacaaggtttcatcaaaatttcaaaatatcagtttcttcatggtatatcacttcaggtccctgagcaaactggaaggggtatgttctgttttgtttgctctgggtagcctatatctctggaatgtctgtttcctgtcaactgccactagagggaggctgattaagtgcatttcatttgtgaatggaattttaagcaacagtaaaggattctcaccaaacacacacagccctttcaggcctaatcctacaaacccaattaaaggtaatggacactctatttgatgaggcagttcagctaagccagcactctctgatggtagctagagaggttattcagaattttgcaaatgccatccatgtctgcaggaatttatgcctttatatcagctgcatagtagagccttctatttgcaacatgcaaaacagtaaccacatttcttctttaaaaatgtattagggaagaaattatgtactagaatattaggtttcttataataagagctatagggactttaaaaataggttttggttgctgggagtagaaatttggttgggagtgataaattttctgcatttatttatttctgaacatttccttaagcagtgtgtgcaggtaaatgaaaatattatcaaatttattttaaaataggacataagaaccagagcagcgtttctctaaatagggactgcctgcaataagatcactttgtagggggagttgtttaaaaattcagatccctagcttcacactagacctgctgaatcactctctgaagttagggcctgtggatctttactaaaaacaaacaaacaaacaaaactgaccaggtgtttctgatatactctaaggtttgacaacattggaaatcgaaattgtggagtaattacttaggagcaggtttggttagaaagggttacgcagaagggtaatgtgggtttggagtgctggtcaaatttctgacagctttttacctcatttgcatctcaatgttgtttctaaaaaaggaaatgctaaaaaaggaaagtgtctcataaaagagaagactaaaacattgtggcatacccacataatactatacaaccatttaaaataattttataaaatgatatataaatgcatctggaaagatattcttctattgttaattgagaaaagcaagtcacaaaacacacatgttgtgattgctttctttttttattattattatattttaagttttagggtacatgtgcacaatgtgcaggttagttacatatgtatacatgtgccatgctggtgtgctgcacccattaagtcgtcatttagcattaggtatatctcctaaagctatccctcccccatcccccaccccacaacagtccccagagtgtgatgttccccttcctgtgtccatgtgttctcatcgttcaattcccatctatgagtgagaacatgcggtgtttggttttttgtccttgccgtagttaactgagaatgatgatttccaatttcatccatgtccctacaaaggacatgaactcatccttttttatggctgcatagtattccatggtgtatatgtgccacattttcttaatccagtctatcatagttggacatttgggttggttccaagtctttgctattgtgaatagtgccgcgataaacatacatgtgcatgtgtctttatagtagcatgatttatagtcctttgggtatatacccagtaatgggatggctgtgtcaaatggtatttctagttctagatccccgaggaatcgccacactgacttccacaatggttgaactagtttacagtcccaccaacagtgtaaaagtgttcctatttctccacatcctctccagcacctgttgtttcctgactttttaatgatcgccattctaactggtatgagatggtatctcattgtggttttgatttgcatttctctgatggccagtgatgatgagcattttttcatgtgttttttggctgcataaatgtcttcttttgagaagtgtctgttcatatcctttgcccactttttgatggggttgtttgtttttttcttgtaaatttgttggagttcattgtagattctagatattagccctttgtcagatgagtagattgcaaaaattttttttcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctcacgtttaagtgtttaatccatcttgagttaatttttgtataaggtgtaaggaagggatccagtttcagctttctacatatggctagcccgttttcccagcaccatttattaaatagggaatccttcccccattgcttgtttttctcaggtttgtcaaagatcagatagttgtagatatgtggcattatttctgagggctctgttctgttccattgatctatatctctgttttcttaccagtaccatgctcttttggttactgtagccttgtagtatagtttgaagtcaggtagcgtgatgcctccagctttgttcttttggcttaggattgacttggccatgtgggctcttttttgtttccatatgaactttaaagtagttttttccaattctgtgaagaaagtcattggtagcttgatggggatggcattgaatctataaattaccttgggcagtgaggccattttcacgatattgattcttcctacccatgagcatggaatattcttccatttgtttgtatcctcttttatttcattgagcagtggtttgtagttctccttgaagaggtccttcccatcccttgtaagttggattcctagatattttattctctttgaagcaattgtgaatgggagttcactcatgatttggctctctgtttgtctgttattggtgtataagaatgcttgtgatttttgtacattgattttgtatcctgagatttgctgaagttgcttatcagcttgaggagattttgggctgagacgatggggttttctagatatacaatcatgtcatctgcaaacagggacaatttgacttcctcttttcctaattgaataccctttatttccttctcctgcctgattgccctggccagaccttccaacactatgttgaattggagtggtgagagagggcatccctgtcttgtgcctgttttcaaagggaatgcttccagtttttgcccattcagtatgatattggctgtgggtttgtcacagatagctcttattatgttgagttatgtcccatcagtacgtaatttcttgagagtttttagcatgaagggttgttgaattttgtcaaaggccttttctgcatctattgagataatcaggtggtttttgtctttggttctgtttatatgctggattacatttattgatttgcgtatattgaaccagccttgcatcccagggatgaagcccacttgatcatggtggataagctttttgatgtgctgctggattcggtttgccagtattttattgaggatttttgcattgatgttcatcaaagatattggtctaaaattctcttttttggttgtgtctctaccaggttttggtatcaggatgatgctggcctcataaaatgagttagggaggattccctctttttctattgattggaatagtttcagaaggaatggtaccagctcctctttgtacctctggtagagttcggctgtgaatccatctggtcctggactttttttggttggtaagctattgattattgcctcaatttcagagcctgttagtagttgttttctagtttattgaaagtgaaagaaaagaatctgaaaggctcaaagtctctcacattcttcagatggcagagaaaacaattcctcattagatttctgatgttataatgttcaaaaagagcaaactaactttgcaaaagaagattccttaggtcaaatgtggtcctgggtacaaatgaaactaggagtttctctatttgatttttatccacagatttgatttaaaaaaaaccttggggaagctcccaaattgattgtgggttctaaagggagggctttgccaaataaagtcactaacatgcaggaatggaattcttcaccaaatggaccaggcaaaaacaacctctgccctaattcccaaacctagaatgggttatcttattggccctggtagaaatgcctaattgccctttggagtagtctaaccctattttccaggtaagaatttaaacaccagggtttataaatgagtgttcccagctgaggtgagccatcagctgaaaagtgcttgagtggaaaactggcttaaaacgttgcctagaaacaattaatagaaacctggatattaagagtttcggactgaattctatacaagatgaagctgcttctcatgccagaagagacagaaaagacatggctctttggaaagtctcttctctttctataatctgtgctgatctgcagtagtggtgacttgtgattttactttaccagatatactaattactgccctaggtaataataccagagaagattttaggactccaaaaaaaatttatgtaacgtttgttaaaagtccaataattaggaaattagcaagttaggcattaactatagaattttccatggtctgtcgctaccagtgtttctcaactgaacgtttgcaattatctaacacatgctaactctgtcaatattttaccttttatttctggttggtaaccttaggaaaatagagcatgttcttaatcaaaccagagttccaggtttggtttcctactatagtaaccttggctctgtctcatgaccagagatcacaccctagccacatataaaggccataaggggaactgaaagactatgtgtatactttaggtatcctcattcatcaacaagtgatcatgtacttgtcataatcatggcatgttaactggaaaaaaaacaaaaaagtagaggaggagctgaaaaactatattctggttatgatggaccaatggggttacattaacacactatatttaatacatttatttaacatttggagaggtgcagggcaaagggggtttgcatctattccatgccttagcattttacttccacaacctatggtcttaacttctgttgctaacttagttatcactattcaaaatgtaagaaagagaacttgtttgctgatacctcagggatcataagattgtggattctgactagtaattctcaatatgaaataaaattaatagaggacaaaatggagtaaaattaacggaggcaaaatcttagttgagtatcctgttgtgttacaaagctcattggaccatggtctggaagcccgtatactattcttgatggtattaatttttattgtttctcaaatttatttttaaagccttgatgtcctttgaacaagatagcctatggagctcctctgtggtccctaagccacctttacaaaactttagggatttaatgaatatggtttgaaaagaaccaaactactggaaagaagctcaatggccatccataggaaaattcatagatgataatctcttcataagaggacgaacattaagaattaactagatctacgtatgtaacatgaatatgtttcaagcatgacatttaatgaaaaaataagttacaaaggatacacagcataggatactacattagacaactcttatgctacacttcaggtcctcttggcctcacaagactctggggactcttgggcactttttctttcttttttttttttttttttaagatggtgtttcgctgttgtcgcccaggctggagtgcaatggcgtgatctcggctcactgcaacctctgcctactgggttcaagcgattctcctgcctcagcctctcaagtagctgggattacaggcatgtgcgaccacacctggctaattttgtatttttagtagagacagggtttcaccatgttggtcaggctggtctcaaactcctgacctcaggtgatctgcctgccttggcctcccaaagtgctgggattacaggtgtaagccaccacgcctggcttttttttttttttcttttttctgagacagagtctcttactctgtcgcccaggctagagtgcagtggtgcgatcttggctcactgcaacctccccctcctgggttcaagtgattctcctgcccttagcctcccgagtagctgggatcacagacatctgcaaccacacccacttttttttttttttttttgtatttttagtagagatggggtttcattgtgttggccaggctggtctcaaactcctgacctcaagcgatccaccttcctcgacctcccaatgtgctgggattacagatgtgagccactgcgcccagcccaggtgctttttctgcccaagccaattttgtagggactaattctgtttgggctcagactgactttacaagggtacaatcttgcttcatgtctgttttgtgtgacttgtatgtcctgcatggaggcctctctattgccactgaggcataagaggccattggactggctcagcacccttgtctacacaactcagaagtgtgagggatgtaatgctccatggggagactctgaccaatggagactattgctggcagatcatttcttctcctcctcttccccaatatttactttactgagttatagtagtaaatacagtctcgaagcaactggtccctagaaatcaagcaatcaattgtgcttgataccaagcaatggccaactcaggatcatactttcctattaacactttttcccctgattcaccttttctttccccttacttctacaacactgggattacactaccaaatagtagtagcaacacataagattttgcctcaggctgtgctttttttaatgtcccctctaataaatctcatgttgaattatgatccccagtgttagaggtggggcctggtgggaggtgatcatgtcataggggcagatcctgtatcacttggtgatgtccttgtgatactgagtgagttatcgtgagatatggttatttaaaagtgtgtggcccctcccctcccctcccctctcttgctcctgctttcatcatgtgacgtgcctgcttctgcttggccttccaccatgagtaaaagctcccaaaggcctccctagatgcctagcagatgccagtgccatgcttgtacaccctgcggaaccatgagccaattaaaactcttttctttaaaaattacccagtcttaggtattcctttatagcaatgtaagaatggcctaacatgctagattaagacagagtccatttacatacattttaaaaacactaaaaaaggagagattaaagatgctgattagatacagctgggaggtgccttttctgtggaaaagaaccaaaatattgagtatacctgcacactctgaccagatcttttgagacaaaacactgaaattcaatagagaagtgacagaagacaccctggttgaagagggatgaagtgaggctgcctgcttggtattgtgagataccaggactggcccccagaccggtgccattcccaaggaagtgttgagggaagaaaccccgggacaccatattcccactgtggatctctgagttcctagctacaggaattcctccagactccttcagacctttggactggcagagggagctgcctggagataacacagacacattgcttgaaccctagtagagcccaaaagtcttcagtgtgctaggcagcgacagcaaaagctgactctgagctcccccacccccaccccagagctttgcatcctgccctaagttgttacaggtcctgctgtctgctaggcttggagagaacagggccagggaatgctcacatgcccaagacaggtcccactgccattgccatggggctgaggtacagccaaagcatgaaatcccacatctgctaaaccctcctaagactgccggtctggccattcccacaggggaggggccaacaacatagcctccattgtcccgcctaggtggtttgttgatggcctaggtgcagttcacccccctgtcacatgtggtccttgaccttgaggggccagtgaacaaatccgctggccttgtcccagtttcccaggacttgagcacaccatccaggtggatgaaaatgagattcgtagcctgatctctagcaggggaggagccctcactgtcagaataagagaagagcacagctcgggttcatgtaatggcatgggaactcccttcaggagaccgggccaggaagggtgtggcctgatagccatggtttctgcctcagggagtatcatgaatgcctggaatggcttggcaatctgggtacagattgcttgggactagtctagtcagttgggcctgttgccagcattgaatactggagggagatctcccaagtccagggtgcagcagctgggtggggtcccatggctgcctgctgggctgataacccctggcatccttcttaccctgagcgtgctctgtggcacaggagaggcgccgccaccccccactggagggttgtcccagtagcccgagagcagcccctagacccctgcgaaggtaagtgtttacgactgccttggagagcctggctgtgggcttgcccaacccagccctgcccagttttgccccctccagccaccttggtggtagagtgtggagcaggacccctgggagccccataccctgcccatttcaggaacaccctagtacttcccccatcaacaaaggccaagtaaaaagtccactgccatcagcgcaaatgctgtcctcggcaatcgccatctactggctgggacagcaaactgcatgacccatcacaactgcaaatatcactgtacagtgctcagctggttcttgcctgctatcgccacctactggccactagggtgaactgcgtaatctaatgtaatcgctgctgaaagaagcacacagtgctgggaaatgagataagcttcccaaggcctccacctctccatctctgttggtgtggcacagcacaccactacaacaacctacaaacaactagcatcttagaaaaccactacagtaaggctatctataatcaatgaattaatacagagtgttggtgccctaaaagcacaaagaagcaaagccgaaggactctacccaacatacacaacagtaacacactcaagcggggaagaaaaaaatcccaccgaaatgaaagtaagtttaaaaatagaaagtgacagcttctacacatgaaaagggaccagtacaagaactccagcaacatgaaaaaacataacgttttgacacccctaaaggaccacactagctatctagcaatggatcctaaccaaaatgaaaacttggaaatgccagataaagaattcaaggtatggattttaaggaagctcagtgaaatacaaaggaaagtggagaaccaacacaaagaaatcagaaaaataattgaggagataaaagattagatacatatatttaaagaaaacaaacagaacttctgaaaatgaaaaactcactgaagaaattttaaaacacagttggaggctctaacaatagactaaaccaagcagaagaaagaatttcaagcttgaagcccagtcttttgaattaacccagtcaaaaacaaaggaaaaagaatttttaaaaatgaacaaagccttcgagaaaagtatgattatgtaaagtgaccaaacctacaacttataggcattcctgaagtagaagaagaaaataataagaagtttggaaaacgtattttagggaataattcaggaaaaattccctgatcttcctagagatgcaaacacccagatttaagaaattcatagaacacctgacagacactatacaagagaaacattgccaaggcatatagtcaacagactatccaacatcaatgtgaaagaacaaatcttaaaagcagctaaagagaaatacaaatcacctataaaggaaatcccatcagactaacagtggacttatcagcagaaaccttacaagccagaagcgatcaggggcctattattagcctccttaaatgaaaaatatgccagataagaattttaaatcctgccaaactaaggttcataaatgaaggagaaagtattttccagacaagcaaatgctaagggaatttgtcaccactagactggtcctacaagaaatgctcaaaggtgtgataaacatggaaacaaaaggatgatacttaccgtcataaaagcacatgtaagtagaaagctcacagatcctataaagcagttacacagttgagacttaaggtaactaggaaacaaaaccatgacaggtacaaaacttcgcatgtcaatattaactttgaacataaatggcctaaatgtaccaattaaaagatatagacgggcaagttggatttaaaaaaaaaaataagatccaaccacctgctacctataagagacccaccaaatgtctaaagacacctacatgctcaaagtaaagagatggaaaaaatatatattatgcaaatggaaaacaaatgagagaaggggtagccattcttatatctgattaaaacacactataacaatagtaaaaaaaaaaaagacaaagaagggcattaaataatgataaagggttcaatacagcaagaagatgtaagtatcctaaaaatatgtgcacccaacactagagtatcgagactcacaaaactaatactactagacccaaagaaaaaacactgataacaatacaataatagtgggagacttgaacattccagtgacaacacaagacaagccatcaaggtagttggttttctgccttgatgacctgtctagcattgtcaggaaagtcaacaaagaaactctggacttaaactggactcttgaccaaatggacctaacagacatttacagaacattctacccaacaactgcaggatatacatttttctcacctgtgcatggaacactctcgaaaattgaccatatgcttggccataaagtaagtctcaataaatcaaaaacattgcaaccatatcaagtatcatcttggacaacagtagaataaaattagaaattattaccaagcataactctcaaagctacacaagtacatggaaactaaataatttgcttctgaataacttttgggtaaacaacaaatgaagggagaaataaaaaattttgggaaatgaataaaaatcgaaacaaaacataccaaatctctggaatacaataaaaacagtgctaagaggaaagtttatagtattaaatgcctacgtcaaaaaggtagaaagatctcaaattaagaacctaatgtcacacttcaaggaactagaaaagcaggaacaaaccaaacccaaagctagcagaagcaaataaataacaaagatcagagcagaactaaatgagattgagaccaattaaatgatacaaggaatcaacaaaattaaaagttggttttttaaaagaaaaaacaaaattgatccaccactagctagtttaaccaagattcaaacaagcacaatcagaaatgataaaggtgacatttaatgttaaaggtgtagttctgatatcacagaactacaaggaatcatcagatatcactatgaatatctctatgtgcacaaactagaaaacctagaggaaatcaataaattcctgaaaaaaagacaaccctccaagaatgaaccagtgagaaataaaaatcctaaacataccaatgagtaatgaaattgaatcagtaataaaatgtctcccaccaaaaaaaaaaaaaaaaagcccaggaccagatagattcacagccaaattctaccaaatatacaggtaagagtcagtaccatctctactgaaactattccaaaaaaatcgaggagggaatccttcccaactcattctatgaggccagcatcattctgataccaagacctggcagagacacacacaagaaaactttaggccaatatccttaatgaacatcaatgcaaaaatccttaatgaaataccagcaaaccaaatccagcaacacatcaaaaaagctaatccaccacgatcaactaggctttatccctggaatgcaatgttggttcaacatatgaaatcaataaatgtgattcatcacataaacagaactaaagacaaaaatcacatgattatctcaataggtgcaaaaaagtctttcaataaaattcaacatcctttcatgttaaaaactctcaataaactaggtattgaaggaacataccttaatataacagcaacctatgacaaacccatagccaacatcctactgaatgggcaaaagctggaaacattccccttgaaaatcagcacaaggcaaggatgccctctgtcaccactcctattcagcataatattgacattcgtggccagagaaatcaggcagcagaaagaaataaagagcatgcaaataggaagaaaggaagtcaaactatccctttttgcagataacatgattctgtatctagaaaaatagcttcagcccaaaaactcctttagctgataaataacttcagcagtttcgagatacaaaatcaaagtacaaaaatcactagcattcctatacaccaacaacagcaaagctgagggtgatcattatcaatcctctgaaaacaaatgagcaacaaatattttctggcagtgtacttagctccatcaaaggagtgctgggtgaaataaaaatgttatgctctggtcactaccctgatagaaatctttagaatcctgttagaaaatcatttccaatgtctgaagcaaacctgcaaacattacaagaattaattgctgaactgcttgagatgtactagatatgttattcaaatttaggtgtatttcgtggcacatttctgacatgggtatttctaaattttcaaaatatatcgagagaaagagattaactctctgaaaatgtctttttgttcatgatttcctagacaaaaatcctttcttgtcattgcttttgaaaaacataatctaggcccctatttgtatcatcacggttatcaaactttaatgcagtgtcagtgtttgatgtgaagattagattgtcctgaatttggccagtctgggccatatgtgggaggcattataatttgattctgttcacttaagaagtatatcttttaaaatcatttgagtgcaacactatattgaaatgattgttagtgttctctcttgcatcacagttgatgtatcccatcatataaggatgttttcagacctgtaagccctcatattaatagtaaatctttgctcatctttgaactctggattgacacactgttctctcatttccttttgaattgttccactgctcagggttctttgtggcaagtaagcaccactgtttagaactaacaaataccaatcaactcaggcttagggattcaacttgattaaggaccagtgagatttgtatatctgtgtctttagagtctacctgtttaccaagctgtactggaccgggagtcagctttagctttacattgaactagctgtgtgactttgggaaaattactctctggatctatttgggaaaataatttatctggatcttggtttccttatctataaatgaaaacatttacactaggttgtcttaactttaagattctgtaactccaatgcaaagtaaacaaagaccaggtgaaaccatttggcaaacttaatgcaagctaatttctcctattgaagataagactaaactatcaccattccgaagcccactcctcttcctacctctcttacaatttaaatctaacctacctttgaaagtcaactacatctccatcacttccatgaagtctttcctgataacacaacaacctccagtggtatctttttttcaattataggattaattatcatcactacacttagtcttctctatcaccttgtattgttgtttaattttagtgcttttgaggtcaggaatgatgagttatgaacatttatattgcccaaagcacattgtccagtatttcatatgcataataggttctagatttgttgaattaatgttgaaggaatgaatggagtttaaaaatcattctgaaccattttcccaaattcacaatgcaaaagtgattgaatttttcccacctttctttcccaaaaaagatgcataattttgacaatattatacgaaatctaaagtacactttggaatttaccttaaatataaatccctttccttctagtctcctaattttcctctttaaaaagattgagaatacttcctttttagagtggcctgccgtagaaacatttgtattttccttctatattccttagaatacaatgcattttgatcagccagtgtatgaatggcgttttgttttctattacctttttaggaaacatgacaaatggcattgttactcctcaagggagtgtttggttacttgcgctcaccagagccagttctctaggatttgatggaaacagatgctagcattcccatcacaaggtgtatctccagtgtataagtgttgacagaagcaaagtcaaacaatattcaggtcaacatttaatttttttatttttaattattgtaggttcatagcaggtatatgtatttatggggtatgtgagatgttttgatacaggcatgcaatgcatattaatcacatcatggagaatggggtatccatcccctcaagcatttatcctttgtgttacaaacaatccagtgtaactggattgtttagttattttaaaatatacaattaagttattgactatagtatctctgttgtgctatcaaattgtagatcttattaattttttctatttgttttgtatcaggtcaacatttgattagattcattatagatattagtccagcttattccggttccttgagaatttgccaccgagtgtcttatcagtccctcattatccttcttagtctgcattgagaatgtgttagaacaagtgcttagcaactcaaaattcatctagcctgggagacttggaagaaacattttagctttggcctcatgctgtgggagccatgttgtttctctgtcaggttgaggctgtgccgcacttacggaaattagcccaaaaaaattgttttctctctccttttctgtaccagaatgagactccagggtataagcaaaattgatgttgcttgaagaaatttcaaaggttcccaactcccagagctcaagtagccacggaaataagcactggccaaaaaatgtacttagacttgatggtaattgggaaccatttgagggaagggaactaaacatgtactacgtgatgttacttcgtagaataagaaaggcttgtgttgaattggtattttaaagaataatggggaaaaattgggcttctttgtgtgggtttgtaaggtggtgtgagggcagcgtgttggcaatacctaggcaggattgaaggtgataatataaattgaatatatttctggtaaaggatttttgaaaataaaataaactaatgttttcttagattcactcctactttattttcttaaagaaatagtaacccttcctattggtatgtcaggaaaagataatttgttcttaaaattttactagaaagaaaagtatatcatgttcccaagttgacttgtatgcaaaatcaaggttatactttccaaaattaatgcaccttgttcctctgaccccttaggcataattaggggttttgtgctcttacaaatggacttagcaaatgtggcactgacataatcatggaattcatggtatttttcccttgtgattataacaatttggaccccatcaagaaactccttattcagcctttcgtttgttcataagctgacttcttttgacttaagagaagtcagcttatattagtgctaagcccaaaagaaccttctgcaatcacactgcgggggaccactttctatgccctctgctcacatttgtgttccaaatcatcagtgttcactggcccaattaggccctctctagcaacattagccctcagagctttgcttgccaatgtcaacatacattctcagttccagaattccactgtcttacctcaagtgtcacttgagcagcccaggctttcttattatagtgtttatttctgtcactgattcatcattttttatttgtctgactcaaatccaggtagttttgctcaatcgatggcaggctgttaaacagcatgtgtgtttagggcagcaattcattcatccattttgacatgcacacctgacatcttcattaatgcccagcacaaatttctcagattccagatctgcttggtatctccatattccttctgcatccacctctttgccacaaaagacacttcatgtaaatgtcacttttttcaagtttttcacatgttccacagtggaaccatatgcttatagaaatgatgcccttttaggtctgtatccaaacatagcttgtcaatgactgctcacaaattctaagtcagcttataagcttttacactttttctgaaatgttttctttagggcttgtaaacttcttcccatgttattgcttacttgttgtacccctgtgttctttttcgacattaactccaaccaccttaccacctttttattgccctttcaattcatcacattcagctgaactgctgcctcaggcaagtgcttcctctctatgtctgtttattgagtttggggcaatctctgtaacagaaattctgctacaatggtctttcttctatcctatgaccatttgctaagctcttgaaacatcagtcatgttcagttcttagaaaacctacattgaagaaaaaatagtactgataattttatggaattaatttaatatttatagtcagatagtatgagttgcttacctgaagatgtgcagggaacctctggagagccatactgacaagtaagttgtggcttagtctgtatgacttgagagctattggtttttcttgttcacatagttgtcaccattattgcaatattataaacatttcctgagtgctcactatgtgataggcactgtgtcaagaactttacatgaagtaactattcaatactcacagtagcccttcaaagtaggttgtattattatctctgttttacagacgaggaagcagagaaaatcaggagggtaaatgacttatttagggacatacaacaaataagtgttagaataggcatttgaatttaggcagtataacctcagagttcacaaaactcttacccttcgtattatactgtcttcttataatgatagataacatttattgagaacttacgatgagccagtcacttatgatgagctagtatagttagccatattgcattcattaacttattaaatcatttcttcagcccttgaagacaggtgacattatttttcttttacagatgaagaaactgagtgaggcttagagaaaataaacagtctttaaagtgattaaagtgattcccctagtaagtagtagagacaggattttaactcctatcctcaaccattatgccatactgtaccaataaaggactaaaaaccgacaaacagaaaagttgatccatgggttcctacagccacaagcaaaaatcatacctttattcctgctgcttgcaggacctattagctggaagatgttgggctgtatcatcaatatccataatttatgtatacttattcctgggattaaaaatggtgggaattcctaagaagcagggaagcaatactttttttcaagagagttggtttacccaaaaatgacagactatcttgccagaagtagcactaagatagggtggaatagaagctggtataccccaacgaaaagtgaatataaataaatatgtattacagtggaaacagaaacatggcaaaagaaaatgtgaagcacgggattgcactgttataatgccacttctcccccacctcccctaaaaaaaaaaaaaaaagccagtgaactgctaagatctagctgtacctgtctatttataatggagagattggtgcattgaaaaaacaagatttttgattggagaaggttagaaagatgatttaggaatatgagctgctacccaagcaagacaggccaggttggatttccacagtgggaggcatgaagaccctgggtagtagcgaaagctgtggtattatttgtgagaaggccaatgaaaagatagaaaaatactctgagacatattttatctacttctgaaatttaattatgactgactttaatttcaggcattatttatttctacttttgaaaatgtttaaattattgaaaataaattaaaagaacttttttattattggtagaactttattaaaataatatagacatgctttcattggtctagcagtcctatgctaaattaaaataaggatcaagaagctttaactttacttaaacagtggcatgctgctctcagtgactttgttaatactgtgaaaagactttaaaatctcaaatacacacagactcacagatatgtgggaaactatgagtgtgtgtgtgtgtgtgtgtgtgtgtgtttgtatatatatatatatatatttttttttttttgagacagagtttcactcttgtcacccagctggagtgcaatggcgtgatctcggctcactgcaacccctgcctcccaggttcaagtggttctcctccctcagcctccctagtagctgggattacaggcacctgtcacctgtcaccacgcccagctaatttttctctttttagtagagatggcttttcaccatgttggccaggctggtctcgaactgctgacctcaggagatccatccccctcagcctcccaaagtgctgggattacaggcgtgagccaccgcgctcggccactatgagtatatattaaatgtaaattgatattaaatcccaggaggatagggtcagaaacctatgctgtagggtggcatcaaatactacaattttacaggtaaaaaatcacacatacacacacacacacatgatgaaagatctttcaagttcattatttgaagcagtcatgtggatattacttgctgccaaatcaatctataattccagtttctctagaaaagtgggttttctattatataaaagactacaacaatggaaatagtctgattcattcacagtctcacacacacacacaatcatttatgggctgaggatgtacatgtaccatggccttcacatgcccttcaggagaaaatgaattttgggggagaaacagatgttttctattaagtcaagttctgtatggtcggagtttaaggcaaagagttaagctgaatatggaaattaaagccaatttatcaaagcatattttaaaagactttcttgttaatactagagtttgggctgggaaatttctgcttcttaacataccgatgttagtagggatttaaagtttgctgccaggcttctcttggaatattcttccattggcacagccctagagatgctaactctgaaaaacgggatttggctggtagcacctgacacagccaatcttgaatttccactaaagtatctatgaagacatagaaaaatgatgagagctcacaacaatgctgataatttggattgacagtcaaattattgccagaaccagagagaaatttccactagctaaaaatcaggaagaagtagattgaaaagtacaatcagcgaaccactcataccatgctgctagaaatttggtaagccaatatatcttaatgtaaatgacgagttgatgggtacagcaaaccaacatggcacatgtatacctatgtaacaaacctgcatgttgtgcgcatgtaccctagaacttaaaatataataagaaaaagaagaaaaaaaggaataggtccaaaaaaatctcatctttccccccatgcagtctaaatcctggttccaaaacacacattctatacccagcaaaacaaggagtacttgtcttattgcatggaaagtacttttttagatagctagaaggctggacaccaaaccctaaaatattgcttttttctctatatatgcttgagcactactacttccagcaaataattagaggagaagacatgaatgtggatttgggatttctaatatgaagtagtggtaaattatcttcaaggtccattccccagaaacataatgctataagtgggagcaaagaaccttggtaggaaggtattctgggtattctagtttttcatgtattccatcagttctgattatcaataaatcagtcagttgggtcaggagaggatccaatcttagtccaaagaaggtgtattaatgaaatcaagttagacaccaagaacagacagttgaaaatatgagatatatacatcaacctattgtcccgttgcatactcgagaaggggatttatctaaaacccagtttgagcttaacctaggacaattgttgtctcctaagtattggcaagcatgggatcaagatagattggaactcctttgaaaataagcaatgaaagaaaaaacaatgtggaacatatggaaaatttgcaaatgggctaaaggcaaattattttggagatttcaagaaagaacacatttataaaaatgggtttttaaaggaatcagaaaaaatattagaaattgatgattttagctaaaatgcaagataacatagctcttatgaaaaagcagactgtaaaatgtaggtgttcacaatcttttgttaggtcatgtgacacttataaaattttcttttttgaggaaattctggactctttcctcatataaaacaaatttgtaaatacactcacaactttttttttttttgcattccgtttctggggttttacatatcctctgaagcctatgaacttcagtttaaaacatctgccatcaaggaacaaatcaagacacaatgaagataatcaaggaactaataaaaattaggcaacaaaatgagactattaaaaatgtgagataatcaagataaggaaaaattacaagaaattaaaactcaaccacagatgattattatcagtggaggctgcagagaacagaattgacaatgctgaaaatcagatcagtgagaatgtcaaatatacttgaaaaatcatctcagaaagcagtgaaaaagacgaagatatgactcatgagggagaagatgataaatctgaagaatggatatccagtttaataattttaagtattcctaagaaagaaataaaaacaactaaagccataatgaagcatatatttaaaaaaacaaagtttcctgagttgtcaaacagcttgaataggctcatcgtagtctaggtaaaattagtgaaaagggagaagaaagccacatgctctaaagtttcttttaaagtcatagatgctactgcaaatggcatcttcatgcataatcacatatttgtttggcatacaaatatagatagccaacagggattgtaaataatacgaaataacagcagaaaaatatatagtgcctaaaaccttgtgctgcggagtcaggccagttttaccacttagtagttgtgtggatttcaatgagatcagtaactcttctgaatctgtttccacagctacctcatagggccctttgaaaattaaatgaggtagtttatataaaatgcttaataaaaggtctagcacttaggggacactgtgcctaataatattgttgctattatattcaacaatccacaattgtgatatacctagattgttcataattttttgttatgtttgatgctccaacaaatataccagtctcagcagtctctcagtaacattattttacattcaattctgtattaatttcattagtaaaaattccagttgttttaaattccattactttgcacatcaatttgaacatttatttcaaatatttattggggccaattgtagttctttctctatgaattgcccatgtgtgacttttgacattttttttggttttataatctcagtcatttcattaagacttggaaaatcctatataatctaaaggtatttgcatattaaaaacaaaaggaaaactttgttataaagtgtgccaaagtttacaatatttttggccagtgaaaccagagagcataatttttatggcagcaagaaaattgaaagaaagcttcatagaacaatatatgtattcctcttgggagaatttgtgacttctagccgaggctttccttcaaacatgtgaaaattaacatatcatctgctttatccataaatatactcttcggtgatcattttcacttgtaaagtgtgccatacttgcagagccaaaatgtttttttcatttattctgttctactttcttagtaggcacagagtggactggatactttccaagactgaaattcagtatgatcttacaggatctcagttcttggaaactttgttaatgtgcatgtaactattgtgacagggcaagaatgcagtctactaagagcagaaaattctaaatttaggtgtccttggctctgttttctcaagttttgtcaacatcttccatgcatatattcagaactaaaacctctgtcattgctcttactggggcaacgtgtatctgttcttctacagatgagctgccttaacctctgtggtttctaccgagctcaaacttgtccattgaaagcatattctacaccgggcatagctaatgttgtgttgtacattcattgatactatgcttttccctcccctttcaaaagcaccattacctgtcttctcccatttcattccctgtcaaatttatttcccttctcctgttccaaaagacaaagccatataccaggcagtagcgtccatccaagagtatttttcaaactgtggattatgacccattcctggattatgaactcaatttagtgttttgcaaccagcactttaaaaatgacacagaatatatcagggtgtatcacatataggaaggcaagtacgttttcatgaaacaaacataggagtgtactgggtccaacctaaagtgtattttgttctatgggttaaggtcaaaaatgcttgagaaacagtgctataaagcacacttcaggatgcaagacatagatttagagctaatttaagggacctgtcagctgggcagctgccctgggtaccaatctatagaagcaaaaatatttcacaggtactaaaatatcactggagatataagcagatggagaaaattgcatttaccagactctttttttttttttttttttgagatggagtctcgctcagttgcccaggctagagtgcaatggcgcgatctcggctcactgcaagctctgcctctcaggttcacgctattctcctacctcagcctacaggcacccgccaccacggtggctaattttttttgtatttttagtagagatggggtttcaccgtgttagccagaatggtctcgatctcctgacctcgtgatccacccgcctcggcctcccaaagtgctgggattacaggcatgagccaccgcacccaaccttaccagactcttaagtaggaaagtagtacatgtgataaggtagatgaattggtagatagagttgtattgcttagagcagagagactgggctctgcctccagtgatctttcttttctccatgtgctttctccatctccacacagggctcagcctgcttcttcaatagatgttgaacaaatacttttaaacatttggtttgaagagctaccaaattattagcctgctgagtttgctcatatgtcttgactcaagtctgtatagacctttaattgagaggggaaaatgctattgtaagaaatgtatttattaggatagtaatagctgctgtaacaagtaaatcctcaaatttcagtgactttgcacaatacaagattacttcttattcaagtaatggtccattatccattacaggtgtcagcaagtaagtgagtagctttcctccaaaagatgattcaggaagctagatatcttccacgctgtgaccttcccacagagctttcagagtcttctgtatctagcccaaggatggaaaaggagagagtggagaagacatacccagttactacaaactcccatttgaaagtgatacccatcacttctgttcacattccattggcaagaattgtttacttggccacacctggatccaaggattggctgggaattgcagtatctgactaggcaactgccttccagcaacatcactacattaaggcatggggagtgggtggcaggcatgaatttttgatgaacatctggctgttgcagtcacaataagttataataccaatcaaggtgtctctagaaattgtcaacacagaatttggaaacatattgctcctcccattaccatctttaagctcttttgcagtgtgacagggttatgttgatcattaatgcatttatacatttttgtataaaagtaagccatttcattttctatcttactaaagtagtgatttggacatctttacatttagctgcatattgcttttagtttaaaatgaatgtagttggcaagcatgaagtgtataagatagtaaatcctaaattacaggcagccacctcatttattcagctgctgatttccatttggttgtccagacagagcactttgcattatttgatttgtgatatctggatgcaaatggctttaagttttgattaaacacaaagcttgaaaaggtttaaacagtaagccagtaatattgaaaacattacaatctggtttagataaacaatcatctgaatgaattggatataaacatatttattttgggcaggaagcacttgttcagaaatttctcttatgatgtgacttatttaagcttctggacatcaaaatagttcataattatggatgaaaattgttggcaaagacgttactgctttattagaattcttgtccaatatcaatatggtgctattatttgattattgctttatcttttattctctgataatcaggacaaaatattgaaatttggaatattctaatagcaattagagttttcttcaagatacctgtcaacagtgtgtgacaatggaaccctgtgttgcctgtgtctgaaatgcaatgtacaaatatcttcaatattatgaatgcagatttgttaaattacgggtgataaaaatgactttgcttcagtgaaatgattctaattctaaatttatataatgaattattcactcttctttcccttttgttttctgctctagtttagtgagcaggttcattaagtgctaatattaaattcactagagtatacaaaaaaaaaaaacccagtaatagcatccacatggttgattaaatggcaaggtaggaggctggccgtggcgtttaattggaggcatgggagctgttggtttctttgtgtaatctgaccctctgaatgttgattcttctaacaagtgaccaaggaaaaaaggaaagtggtgtcatgggaaaatagcatttgcacatttcacaaataattgataaataaccattatgaatgtagtcattactttacatcagtgtttgcaatgtgtaattcattgaaatatttgtcttgtacaacactccacaagaaagggttctagaagcaaataagttagggaaatgctggattgtctctcagagataatcaacaatgcatgctagcttttttttttttttttttttttttgagatggagtcttactctgttgcccaggctggagcgcagtggtgcgatcttggctcattgcaaactctgcctcctggattcaagcaatcctcctgcctcagcctcccaaatagctgggactccaggcatgcaccaccatgcccagctaatttttgtatggttagtagagacggggtttcgccatgttggccagggtggtctcgaactcctgacctcagatgatccacccacctcagcctcccaaagtgctgggattacaggcatgagccaccacgctgggccacatgttagcattttatgggatttcataaatcctttagttgggaagcctatttgacttttttaaacctagagatctcgatttattttaagcagccttttttttggttgtttagtaaatattaaacctaatccctgaatctgcccaactttttattttcttataagaaagaggtgaaaaataatgcttataatttttaaagggcagaaatatttttgttttgaaaaccaaagttgaggtatataccaaaaataattcaaaacaggttttgaaacaaaaaattccatgggaatgttcatggtggcactattcacagtaatcaaaaggtggaaacaatccaagtgtctatcaacagatgaatggataaagaaaatatggtaggtctgtataatggaatattattggtccattcaaagcaataaagttgtgatacatgctacaacatgaatgaaccttaaaaacatgttaagtaaaagaagccagtaacctacaccgtatattatctgatttcattggtatgaaaagtctggaatagacaaacctatagagaaaggaagtaaattcatagtcttttaggtctggggaggtgggagggtagggctatgacagctaaagggtaaaggatatatcttttttgtgatgaaaattttggaaaattggctgtagtgatagttgcatgtatctgtgaatatactaaaaacattgaattgcatgtttaaaatgtattagttgtatagtatgtatagtatgtgaattatatctcaataaagctgataaaaatgataatcaccatttggttaatacacaaatatccgtaagttcctcttcttaaatatgaagcatatttttaaaaggcagggattatcctgttaaagcttctcagtattttatgatttttcagtttaaatcatcaatagcaatattgtacacctcaaaattggtacatcatataataatatgggctatatgtggatggatatttgttcatatgtagatatacatattttcaagtgacctgttttggagaaatatgtaaaggtatttaaaattatattaccagcatactttcaaaaagttctaggggaaatataaagcaatattagtattatccctgacttgtggcaattaaagtaaatgccccactagaagatacttgggagaagttaggtctcaagattttgttgtgaatgttaaggaaatgcagactaatttcttatttgggggtttattgtggctctcgtctcactggacctttaatcttggtttccttctctagttcgtatacttttcttggatctctgaacattggagtgcttcagggctagttgttggacccattctcacttctttttttttttacattgattttttattttattttattttattatactttaagttctagggtatatgtgcacaacgtgcaggtttcttatgtatgtatacatgtgccatgttggtgtgctgcacccattaactcatcatttacattaggtatatctcctaatgctatccctccccctccccccaccccacaacatgccctggtgtgtgacgttccccaccctgtgtccaagtgttctcattgttcaattcccacctatgagtgagaacatgtggtgtttggttttctgtccttgcaatagtttgctccatgtccctacaaaggacatgaacttatccttttttatggctgcatagtaatccatggtgtatatgtgccacattttcttaatccagtctatcattgatggacatttgggttggttccaagtctttgctattgtgaatagtgccgcaataaacatatgtgtgcacgtgtctttatagcagcatgatttataatcctttgggtatatacccagtaatggaatggctgggtcaaatggtatttctagttctagatccttggggaatcgccacactgtcttccacaatggttgaactagtttacagtgccaccaacagtataaaagtgttcctatttctccacatcctctccagcacctgttttttcctgactttttaatgatcgccattctaactgatgtgagaaggtatctcattgtggttttgatttgtatttctctgatggtcagtgatgaggagcattttttcatgtgtctgttggctgcataaatgtcttttgagaagtgtctgttcatgcccttcgcccactttttgatgggttttttgattttttcttgtaaatttgtttaagttctttgtagattctggatattagccctttgtcagacgggtagattgtaaaaattttctcccattctgtagatcgcctgttcactctgatggtggtttcttttcctgtgcagaagctctttagtttaattagatcccatttgtcaattttgacttttgttgccattgcttttggtgttttagtcaagaagtccttgcccatgcccatgtcctgaatggtattgcctaggttttcttctagggtttttatggttttaggtctaacatttaagtctttaatccatcttgaattaattgttgtataaggcataaggaagggatccagattcagctttctacatatggctagccagttttcccagcaccatttattaaatagggaatcctttccccatttcttgtttttgtcaggtttgtcaaagatcagatggttgtagatgtgtggtattatttctgaggtctctgttctgttccattggtctgtatctttgttttggtaccagtaccatgctgttttggttactgtagccttgtagtatagtttgaagtcaggtagcatgatgcctccagctttgttcttttggcttaggatcatcttggaaatgcgggttcttttttggttccatatgaactttaaagtagttttttccaattctgtgaagaaagtcattggtagcttgatggggatggcattgaatctgtaaattagcttaggcattattgccattttcacaatattgattcttcctatccatgagcatggaatgttcttccatttgtttgtgtcctcttttatttccttgatcagtggtttgtagttcttcttgaagaggtccttcacatcctttgtaagttggattcctaggtattttattctctttgaagcaattgtgaatgggagttcactcatgatttggctctctgtctgttattggtgtataggaatgcttgtgatttttgcacattgattttttatcctgagactgctgaagttgcttatcagcttcaggagattttgggcttaaatgatggggttttctaaatatacaatcatgtcgtctgcaaaaagggacaatttgacttcctcttttcctaattgaataccctttatttccttctcctgcctgattgccctggccagaacttccaacactatgttgaataggagtggtgagaaagggcatccctgtcttgtggcagttttcaaagggaatgcttccagtttgtgcctattcagtatgatattggctgtgggtttgtcataaatagctcttattattttgagatacgtcccatcaatacctagtttattgagagtttttagcatgaagggtgttgaattttatcgaaggccttttctgcatctattgagataatcatgtggtttttgtctttggttctgtttatatggtggattacatttattgatttgcgtatattgaaccagccttgcatcccagggatgaagccaacttgttcgtggtggataagctttttgatgtgctgctggattcggtttgccagtattttattgaggatttttcatcgatgttcatcagggatattggtctcaaattctctttttttaattgtgtctctgccaggctttggtaacaggatgatgctggcctcataccattctcatttctatctgcagattccctttgtgatcttacccagtttcatggttttaagcatgtttatgttgatgactccataatttgtgtctctagaccagacttctctccagagctccagacttgtataaccaacttgactacaccttgtttccatttggatgtctaatagatatctcaacagttaatgtttcccaaactaaacttatcttgcttccaaattctgatttatcccatcttttcttctcagttaatgactaatctgtcttttctgtttctccagttgaaatctttgagtcaccttgattaatcttctttcatatttcaggcatgctaaccccgttagggcttttatattgtttcccctacctggaatgttcatcccctgatatgcatatgattgcccccacctcctccttctagtctttgttcataagtcttcttccttcttagtgacagccacatcaaccacaccacttaaaattgcaactactcagaaccacagatctcctgcctactcttttgtttctgtaaaaccactagctaacatactataaaatttacttacctatcatgttcattttaaactgtctttccccattataatgcaagtttcatgagggcagagatttctgactagtttgttctctttatgtattcactgtgccggaaattaagaccagcacatagcacaggattagcactcaataaatatttgttcaataaacaaataatactatgtcaggaaatagtttctattatttttggtgaccctaaaagtggctcctcatgtgtggaagtagctgatgtggatttaccaaaacaaacaaacgaaacacatccttttataggatgtgtggtgtgtgttttctgactagactaatgtacaatttatgacaatcaccaagtagctgttctttaacaatatgcccgctatccacaaacatttccaactctaaataccaaggagtactctttatcactttctaaaaacattttgaatatttatacctcctctagtagaaaagcaaggactttcatttccggatttttctcttctttcttttctaaacatctcctctagagtaaaatcaaggacattttatatgaaagtttggattatgataacatttaattatcactcatatttcacagagtgtatttttaaaaatttcttatgactttgttctcttctcaggattaacttgtctctgaaaatagatcttttacagcctagcaaagaaagcaaaataatatatgtgcacaattagcacaaattgatcttgctatgtgaactttaatttcagaatttgagatttaaatgactcttctatttaaattgtcaacctcagagtctcattagtctaaattttacatttaatttatgaggacaatgctgcctccttagaactggcacttatactctaagttatatgatgtctagtgggaaacgctggtttaggatttcttttcctaggccttattttcagctatttcattaacttattatatgatcttagactaattatttaatttctgtgcctcgggattttttaatctaataattcagagaaatattcctcttctgtatatatcttagaggagacattaatgtgtgctggacgaagcacaggtttctgggtcataaagacctgggttgaaattctgctcagctactaactaactttgtggctttagggaagtcagtgtcactgatccttatttctgttaactgtaaaatggtgataagacctactttaaaagttgtaaggaatagataaataatttgaaaagtaattagcatatggccagaaccaatcttggtcctctgcctgctctttctcttccacctgcctctatcctggctgtaaaatgtgtttggagcattacattttacatatgcataaagtgcctgtcatttagtgggtgcttaataaatgctagttcaattggctgtgacataaggtaattgaggttactaaataaggaagggtgaatagtataatggtgggaaagaaaatgaggaaaatgacaaaataaagtttaaagaaaaacataagaacttagtaaatataataaatattactatttaacataataatgtactgttggtttgagagtgttcacgttcacaaatgcctaaaatatttagtaaagtctctacaccatggataagactattatcctactgagccctacatttttgcaaaggtttcataagatagaataatatatactcataactaagaaaatgtttaaatgatcaaatccagtactttgcccaacaggtttagcaatcaccgcattatctgctgctaattagaatcaagtgtatgatatacagggctcattaatttctttggaaataagaatcatagggcaatgcgtgtctttacaaatgggtaccagttaattttaataacttaatgtatgccttcttttacatgcacccaaagtgaaatgtatagtgtatacgaataatataaatgtttgttaatgctcagcaagacaaaattttagaatacgccaatgagcagtttcattaattactgtcctattgcaataagtacatattattaacacatctttctttgatgtgattcagtattagtcatgggtgagtgttaatgtgctccaaactatatagaccttttttgaacttcatacaacccactttctttttttttgttgttgccttaggttggaatcagatggatacatgatttttttttctttttcaggattataaaagtagtcccatttttaaagaaaaaatcataaatatggtttcataagatggatggtgatttaatatttttttacaaagtccaaattatcatttattatttttttatattccatgcttgtgcatcttcacaacgattttttttaatgtaaaaacttttttcccagcactttgggaggccgaggcgggtggatcatgaggtcaggagatcgagaccatcctggctaacaaggtgaaaccccgtctctactaaaaatacaaaaaaattagccaggcgcggtggcgggcgcctgtagtcccagctactcgggaggctgaggcaggagaatggcgtgaacccgggaagcggagcttgcagtgagccgagattgcgccactgcagtccgcagtctggcctgggcgacagagcaagactccgtctcaaaaaaaaaaaaaaaaaaaaaaaaaaaaaactttttaaaaaaattattattatactttaagttttagggtacatgtgcacaatgtgcaggttagttacatatgtatacatatgccatgctggtgtgctgcacccactaactcatcatctagcattaagtatatctcccaatgctatccctcccccctccccccaccccacaacagtccccagagtgtgatggtccccttcctgtgtccatgtgttctcattgttcaattcccacctatgagtgagaatatgcggtgtttggtttttagttcttgcaatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacttcttgtttcctgactttttaatgatcaccattctaactggtgtgagatggtatctcattgtggttttgatttgtatttctctgatggccagtgatgatgagcatgttttcatgtgttttttggctgcataaaggtcttcttttgagaagtgtctgttcctgtccttcgcccactttttgatggggttgtttgtttttttcttgtaaatttgttggagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacatttaagtctttaatccatcttgaattgatttttgtataaggtgtaaggaagggatccagtttcagctttctacatatggctagcctgttttcccagcaccatttattaaatagggaatcctttccccatttcttgtttttgtcaggtttgtcaaagatcagacagttgtagatatgcggtgttatttctcagggttctgttctgttccattggtctatatctctgttttgataccagtaccatgctgttttggttactgtagccttgtagtatagtttgaagtcaggtagtgtgatgcctccggctttcttcttttggcttaggatttacttggtgatgtgggctcttttttggttccatatgaactttaaagtagttttttccaattctgtgaagaaagtcattggtagcttgatggggatggcattgaatctataaattaccttgggcagtatggcaattttcacaatattgattcttcctacccatgagcatggaatattcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacattgattttatatactgagactttgctgaatttgcttatcagcttgaggagattttgggctgagacaatggggttttctagatatacaatcatgacatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttcttgagagtttttagcatgaagcattgttgaattttgtcaaaggccttttctgcatctattgagataatcatgtggtttttgtctttggttctgtttatatgctggattacgtttattgatttgtgtatgttgaaccagccttgcatcccagggatgaagcccacttgagcatggtggataagctttttgatgtgctgctggattcggtttgccagtattttattgaggatttttgcatcaatgttcatcaaggatattggtctcaaattctcttttttggttgtgtctctgcctggctttggtatcaggatgatgctggcctcataaaatgagttagggaggattccctctttttctattgattggaatagtttcagaaggaatggtaccagttcctccttgtacctctggtagaattcagctgtgaatccatctcgtcctggactctttttggttggtaagctattgattattgccacaatttcagctcctgttattggtctattcagagattcatcttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattgcatgtctttgattcttctctctctttttctttattagtcttgctagcagtctatctattttgttgatcctttcaaaaaaccagctcctggattcactcattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcatcccagagattctggtatgttgtgtctttgttctcgttggtttcaaagaacatctttatttctgccttcatttcgttatgtagccagtagtcattcaggagcaggttgttcagtttccatgtagttgagcagttttgagtgactttcttaatcctgagttctagtttgattgcactgtggtctgagagacagtttgttataatttctgttcttttacatttgctgaggagagctttacttccaagtatgtggtcagttttggaataggtgtggtgtggtgctgaaaaaaatgtatattctgtttttttggggtggagagttctgtagatgtctattaggtctgcttggtgcagagctgagttcaattcctgggtatccttgttgactttctgtctcgttgatctgtctaatgttgacagtggggtgttaacgtctccctttattaatgtgtgggagtctaagtctctttgtaggtcactcaaggacttgctttatgaatctgggtgctcctgtattgggtgcgtatatatttaggatagttagctcttcttgttgaattgatccctttaccattatgtaatggccttctttgtctcttttgatctttgttggtttaaagtctgttttatcagagactaggattgcaacccctgcctttttttgttttccatttccttggtagatcttcctccatcctcagggacccacttgaggaggcagtctgcccgttctcagatctccagctgcgtgctgggagaaccactgctctcttcaaagctgtcagacagggacgtttaagtctacagaggttactgctgtctttttgtttgtctgtgccctgcccctagaggtggagcctacagaggcaggcaggcaggcctccttgagctgtggtgggctccacccatttcgagcttcggggctgctttgtttacctaagcaagcctgggcagtgacgggcgcccctcccccagcctggctgccgccttgcagtttgatctcagactgctgtgctagcaatgagcgatactccgtgggcgtaggaccctccgagctaggtgcaggatgtaatctcctggtgagctgttttttgtttgtttgtttgtttgtttttgtttttgtttttttttttgagacggagtctcgctgtcgcccaggctggagtgcagtggcacaatctcggctcactgcaggctccgccccctggggttcacgtcattctcctgcctcagcctcccgagtagctgggactacaggcgcccgccacctcgcccggctaattctggtgcgctgttttttaagcccgtttgaaaagcgcagtatttgggtgggagtgacctgattttccaggtgccgtctgtcacccctttctttgactaggaaagggaactccctgaccccttgcgcttcccgagtgaggcaatgcctcgccctgcttcggctcgctcagggtgcgtgcacccactgacctgcgcccactgtctggcactccctagtgagatgaacccgggacctcagatggaaatgcagaaatcacccgtcttctgcgtcactcacgctgggagctgtagaccggagctgttcctatttggccatcttggctcctcaaccaatatttttaactaaatttaaaattacaataaacagttatataacatttgctacagttccagatctgagattcaggagatctctatttgtgaaaataaattgatatgacatgtgataaagccccattaccaaaagggaaatgaataggcaagaaaatagctaaacctaatagtcaggaaatgtaagacctaaaattttgagattctattttttcttttgtaaattgaatgcacaactcacttaaagtaaatgtaaaatcattcatattcaactttctgagctgacgttaccaaaaaagtgaaagttaaaaatacttggcttctattgtaaaattgcaaataaaacccatttcatgaaagtggctttaatattttgatgtttggcttaacagttcaattcaacaaacatttactctgggcaatctaccatggtgtttaagagcattggctttgcaatggaatagacatgggtttggtttcccataccacaatttactgtctttgagtgaattactcaacaactaattgtcttaatttcttcaactgcgtagttgggctttcagagcctactttgcaaggatgtagtaaggattcaataggaaagtgcatgtgcctggctatggtaagcactcagtaaatggtaactgctaatgtcaactatgtgccagactctatatgctggttatacaaagatttaaaaaagacgttatctggcattgatctttgagtgagctacaaaaaggctatgtattgagacaggactgtaatgcagctgccttgacaacatgttccaatcagccacattactgagttgtctgtattgcacatataaaaatatataatatcaaattaatgctaaatgaactctgtatgtgtaaatgttgaagaatgtatgagttttccagccctgatgcaaaattattggtggggcatatattggctgtggtttttcagcacaaaatacccttataaaatgtattttgaggaaattcattataccattaacatttttagagtgagatcaacattttttaaaaagtaaactttgctttactctgaagtgactcactttaaaataaagttggcattttggaaaataggcacaatttttgttgctcatgagctttgcatgaaaaacttgcacgaggccaaaatagcatgcctcaagcatctataggtttattgggcagtctctgtgtatttcttgatagataaaagagagagccctccagaatgcagtcaaatgtgtaatgaatcacaagaacacaacatgatttattttaatgcaaagagtgaatttactttaacaaaagaaacattaacacacaaaataatgttgttatcttattaagagttatgtattatttcccagaagagaagaacttttggggtacaccctaggccctaatcagttaaaggatattacctatatactagattatatggtagatgggcaaaagataggtgtttttcatatcatctgatcccctcatgcattcatcagctgataaagctacaaaaataccattaaaaagaaagatgctaagtccttcttatgcacaacttacaaaatttagttttccaattaatttagcattttattcagaaagagctgtcaactagcaatatatgcttaccaaattctgttcagaactcataatggtgtctcccaaggcttagcagtgttcttctgaatcagaaattcatttatgtctagtgtcatgtttaagtgtggactatgttttgatctgttctttgccaatttgtcattcttggatagtgtattaggtgtgattatcaataatgcatttgttcttcttgggtagcttgtaaagggattctgaaggaaattgcaaaaggaaagttttttttttcttttagtcttcaacaactccaacattgcaggaacatgtgcttacctcccatggctaccacgttgaaaggttactttcatcatttactttgttcatggcagagaggttacagaattgaggaagtcttagccctctcctcaaggatgttgtagtctatttgagaagattaacaagtcaagaagtacatatttacagtgtgctgagtactcttatagaagaaaacacagttgctgtggaaactcagaggaaaataacataactaagttagagaatcctttataaatttggattctctataaacatatatttggatagataagttctgagacatacatgccacatatcctacagtatctatgtttacaagtcatattttggcatcctcttgagtggattaacccttaactaaacattccagatgttaaaacaatatgaaattgttttgtttattccaagaaattcatgcacccaggctcagaaagaaggttgagcaactttatttggcttctctcttataattccctgaagccaagctaactggcttagtatacaatgaacaatgaatcaagaaaataggggtaagtttctagatggaacaaaggtattcattattatgagtataaatattttttctcttatcaactattatcaacataatacatgttctaatatgttcctgatttttctggtgatgtgaatcataaatttagtcaccctaatcaacaagcctggcaacttggacactggcacatctaatatatatttttgtagcaaaactcaaaatcccactttctttttccttagccatttctcttttttgcactttctttgggatgactattcttcttggacagtgaattgaacagtagtgaggaggatagaagttagactgtgttccagactcacaaaattaggctatagaaatcaaaagtgtccagggacagttatgctgaagacagattgaagggatattctttctttctgccctgggccaataggtccaatggaattaattcagctggccagctattttaaaaaatgtcatgtaagtaaaatggttgcaaagaaaaactgcgttaccttgaaagcactccatagataaagcatatgttttacagagcagacattgactctagagaagaggaaaaccacagtgatttttaatcattaattgtaatgactcttcaaataatacataagcaacatggggaagtaatttttcccttcttgccatcattacctaaaaaaccatagctgttttgaattatatgatcaattcaattcattacaagtttcttgaaggtctgttgggtgctatgtgctagaaatatagtgacacacaagacagacatagtttctctcctcatggagcttcaagtctgatgggcaagacagatattacactaatagttagagatttccctcttttcttttattttctttttcctttctttcttttctttttttcttttttctttttggagacagggtctagctctgtagcccaggctggagtgcagtggtgcagtcatagcttactgcagtcttgaggggctcaaatgatcctcctgcttcagcctcgcaagtagctaggactacaggcactgaccgccacacctgagtaatttcaggtttggtgactgctagagtatgaaagtgtaagacgggtggcctaatttaaccttggagcaagtagatgtggccatattgcaaggcaggcaaccccctaaattggggcctagccccagaagttttttggcttcacttaggaaagaattcaaaaatgagcctgtggtggaagaaaacagttttattgaggcagcagtgttacagctcagtgactgctcctgcagagcggggctaccccataggcagtatgttgagaatagtagctcaggggcagttctgcagtcatatttacagccagttttaattatatgcaaattagagggcagggtttactcagaaattcctagaaaaagggtggtaacttctgggtgttgccatggtaatggtaaactgtcatggtattggtaggcatgtcttgtagagaggtgctttctgtgcctctttcctgttgtagccaatcttcaatctggtctggagtggagtcctgcctcttagccagagattcacttaagttgtggcttagagatgggaaaggcagaggagagaatagccagcctctattcttagtaattgttagtatagctgaaatattcctcaaggtcactgggacactttcttcaggggatataagggaagaacagtccctagctgtttaacatgctttctatgtagatagtcctttctaagctgcagagtctgctgttctttacacccctctgtccggacaacagaaatttatttcagctcaccattatatatgttatactcccagatatatatatatatattatactcccatatatatgtattatactcccatatatatattatactcatatatatatattatactcatatatatatttatataaaatactccccattctcagtatccttttctagaatcgtttaactttctaaaaggattagcccttacttattacttgtgaactcttttattatgttctccaagaattctatagcattctcagacccagtacaatgtcttcatccttcttccatttggttttaaaagcttctgtcccagcaggaaacacaaagagttaaacttggattcaaccgcttctatagctcatccactgagagtcttccatgccaaacagcgcatcatcaataggagttagatttccctattagttaaaaatgaccagagaacatgaaaataatttggggaaaaaaataggggttggaactgtgaaatcaacagtatttgttttgaaatgtacccaaaatgatccaatgttgctttctggggtgaagggaagtgtataacaaagagtgggagatcagtacttttttatttgctccacaagtattctgtagaaaacatggtaaactgtctctcaggatacatttgagtgcttgccacaattcaaaagagcctgatctcttctgttgtggcccagctaaagggtgtagaggagagtcctccttttccttcactcacagctttcactgacttggcagataaagggcatccctggaatatgctgaattgaggagggagatctggcttctaacagtcccagcagcactactgactgacactaatcctggttaactcacttcccttctctgggcctcaatttcaccatctgtaaaaacaagaggggccaggtgtggtggctcaggcctgtaatcccagcactttgggaggccaaggcaggtggatcacttgaggtcaggagtttgagaccagcctggccaacatggcaaaaccctgtctctactaagtgtgtgtgtgtgtgtgtgtgtgtgtgtgtgtgttatgccgggcgtggtggcgcatatctcagctactggagaggctgagtcaagagaattgcttgaacctgcgaggtggagattgcagtgaaccgagatgctccactgcactccagcctgggcgacagagtgagactccatctcgaaaagaaaaacaaaacaaaacaaaacaaacccaagagggttcaactgtaattctgtggctttcttcatagcagtaggcattctatggaggcaccattaggagaaattctggtggccaagggtttgccactgacgtacatactctgtccttttttctcactaagagcagttctggttttctctgcttttgttttcaccttcacatacaatatcatttgaccaaagaggttcatatcttaaaaaaaattgtaaaccattgtattggatgatttttaagaactatgactcttttgctggctttaggtatcctactctaaggggctcctatgctgctggatagttgagaatatcagttaataggggtggaggtggcttagctagaaggtgctaaaaacatccctgaagccctaaagggttataatttccccttcttgcatgtatatttgctgctgctgagttaagatatgacaatagtaaaaactggacagtccttttgggtatacccagaggggtttccccatgaatgaagtgggcagagctaacagtctaagcctgaaatggtgtatgctaaagagtagaggcaccaagggtgtcaaacactggtgctgtccacttctgcagtgagcttggaaatcctcaggccaggtgttcttcagaatgcaaagtccctggaattaaaggaggaaacagccttggaaagctttgagtttgcaggggagttgccctcttgtctttggatgggatcagggcagggacacccatgctgaagaactatcaaggaaggatagcacctgagggccaaaggattaagaggccagctgggggttcagagggagggaggcagataatgcctttatgaacccattccacctgattatagtgtaattggattttgagggacttcaagatccatggaaacatcccacttgcttttatttgggattttgactatcagaaactggcaatttgggaacttgactttatattagttttatcattgcaacattttctttggtttcctcttcattttgctaaagtttattttgaaaatgtcatatcctttgttattttccaagggatatgaatttctttaggaatatccaaggcaggtctatcgtcattggtgtgtggcctgtgttattggttggtttaaatactcttctgggctgggcacagtggctcatgcctataattcgagcactttgggaggccaagggaggaggagaggatctcttgagctcaagagttagagacagcctgggcaacacagcgagacctcatctctactaaaaataaaaattaaaaattatctgggtgtgctggtgcatgcctgtagtctcatctactcaggaggctgagactggaagatcgcttgagtccagaaggttaaggctgcagtgagctatgattgcatcactgcatcccagcctgaggtgacagagtgggaccctgtctcaaagtaaataaatgaatgaatgaatgctcttctgtcactatcttgaaattcttaataagttttgaagaaaggatcttggcttttcatttttgtaccaggctccacaaattatatagccagtccttgcccttggtatccattttatcctaattttactaggttatatggttcatgagtggtactagggagaataatagacagaaagggagagatgtgttttgttctaggccccaggtatccagagtgtcattgaacctgactaccaggtcagactgcctggaaattgatagtcctggtgttcaggactgggggtggaatattaagctccagaggcctaggtatagtcatttctgggttgctgcttaggtaattcatgtatatcacgtgtgaattatttttaaggtgcctcatgtgatctcttttgtaaacctgaccacagaagcagggcagatagagtgctggctaaagaggatctattgctgcaactagataagaaaaaagaacccctctagtagcttcctaccactctggaatgctacacacagtacaggttggtaagtgaatgctgccatgtgccttggattccttcttaggagaggtactaatgcattatcaaaattatttaatttttattatttataggcttcttatcaagccttcaggatgaggactaatatgatttcagtgctgtgggtttcagagagaagaaatctatcttaggcttagcaacctgggggtaagtgccaagctgataagcatggcagattaaaagcccattttacctagacatactgacaccaatagtgttgttagtaattgactcatcatcactacgatacatatcctgaggtgttcaccatgagaaatattgtgtctcctttcttttcacagggtctccgtggaattagtaacaggggatgctggttttatgggggcagtctgtggatgtagggagttttaagagaaattagcttgctagtcaataaccagggctttgcttgtacctctcctgatcagatgaagaatcatcttttttttttcttgctctgttaaaaaaaattgcaaagaaagcatgaacaccttaacttctctcatgctagggaaaaagccttaagaagggtagtacatcagactagtgatgcccattcgtgttagcctttgttatttgcagcttacatggcctcatctggaaatgggctatcaggtgtcgtcttatttctaagctggctgttacatttaatacaagtggagtttgtgtgtaggtctactgcacgtattcttggtgctcagggacttatagtggtcccttacagtttccgaaatcaatcttgctctgagatgggggcaccaagtttgcagcatctccctcctacagtcatttagagttattgatttgcattgaaagaaatgaaagttggaacactttttttaaaaatagactttttttctaagggctgtcaggaagatatgcctcttttccaatattatgtgtgcttgtttgacttagtacgtaattattgaggttctctctggcatttgagggtaccaattggggatcacatcccatgaacacagttgaccacatgtgtgccttcagttggtgaccatccacagcaaagggccttacccctctaccttaagatttcattcactctagcttgacaaaacattgggcaatcccatattataccttcccttcgcttccattgctctccccagaatgcctttctctgctttctttctttgtccaaacccatctttcaagcctctctcacatgccactatctccatgaagtcctctctaaggatttcatctcaaactatcatcctatccttgaaatgttgtatgatcattaagctcttaccataatattttacatttagttatcctgtatcttaaagttctttttctcattattattttaagtctttgtagccatatagctcctactggaaatacacttatttattttttatcctgcagagtacctgcaccacttaataaatacacatttgattattaagtcagtgaaagggttcaatcactgatggcttcattattaatgtaaatgttatatgagaagagcagcatttatatcttcactcaaattagcttgtgaggttaactctagaacagaaagctggggaagtctattgaagaatacaaggaaaggaaaactacctaaggttttgtttagaataatcatccaaaaaatgatcatccttgttttaagatgagaaaacagacatagagaggttaactgatttgtccagattgcacacctagtaaataacagaatgaaaacttgaacccaaatcctttgactaaatgctatgctctttcctattgtgagtcatggcatcctggcaaccttgggtgtgtaggtatgggctctttactttttctgtgtcattcttaaaatgtagcacccaggagagtatggggaaggggagcagggagaaaaaagaaataggtatgcattcacatagaaattcaaatactggctaattgcaatatgtgaatcacaacagtaatgttaagatctcctcatttcccccctcattcttacaactcctcccctttccccattttatttcttctcttcacattccaccttccccctcctccctccaagtatctaattatagttttgcaagaaaaattacagactacatactgcaataattcacacctggaatttacattgattttatggcatcaagctctgagtgccactttgcgttgcattcccatagcaacaccaaatcgtagactaggagaaagaaaaatctgagaactcagcatctgcagctcctgaatctcttatatttatgacttggctcttccttgacaagttgcctatttttctaactttgtttttagaaagcatacacaaattaaaatgatcccacttcatattttgattgctttgaatttgaaaaatgcttgaaagggtgttgctctacagtaacagattaaaaaaaaagataattggatgacagacagaagagtaggtgtgaaaaagtttgtaaaagcatcctgagaactcttgtctctcacacctactatagtaaaaatcaaagcaatcccggggcctctggcacatccttctgcctacagtggccctccacttgctgacctgtagactcagaagaaagaagcagccagaggtcaaacattgctgccttgaagtaggatcacatttgtgcatttcagttgaccttctggatcctgagccctttccttattttttgtgtcttgtttgaccagagatctgaattagcttttcagatttgtctgagttgctggatcctttgtttccatccactctgtgaaatgatatctgtttttctgccagccatgtcctgatactaaacgctggtactgttagcatgacttgactctccttactatgggtaatatttttcaaggttccttccaggagtcttagttcaattgtcacctcattttagagttcttccctgaccgatttatataaagtagttccctctaccccattcctccaagaactctcaattcaactactttgtttcattttccatagaatatatgattatattatacattaactgagattccctaatgtgtttactgtttcagtgtctgatcttccccactggaatgtaagagcagcagcctagtctgtcttatattcgacactttattttcagttcttagcacaatgcctggcccagaataggcactcaaaaaagtatttgttagatgaatgaatgaatgaatgagtgaatgaattccgcaagtgcttattgaatacctattatgtgcttaccgcatgattacccattttggaaaatagacaccactggcctcctggagagtttaccagcagaaataccagatattaaaagtctaatgtgtaccatctgtttcgttgctttctgtcactgtggccttcacagcagtaggaactcaggaacagtttcaggccttcacaggctaaaatgtttccaaggtgctcttcagagctggagggcttagtttgcctcacttctatgtttctacacaccttgctttctcctaattcactattgggcaatcaagttataaaaacattgacatagttaagtctgtttcctagtgtaggctcaaaatgattttgaaggtaagtaaatatacttgggaaattgacagccaagatttctgccatgtgcaaccaaaggaaaggttattaatacagtgaagctaggtatatctcttcatggtgactaagctattttagtaattttctttaggtttattgacttctttattataagaaacaatgaaaatcttaaggagagtcactcactggcaagagaaaaaaaaatcatttgccctaagtgcggagaatagaaaactaaatcatccactattactaatgacaaccactacaaaggccatttagtgcgtagcctatgctacacactaaatgtgcgtagctaaaggtgcaatgcactaaaggtgcaatgctaaatatacttactctaaggaaaaggaggacactttaaggctgaaactgggagaattttattctttatgtatgtcattaggaatttcctttcctgggagaagacacatcaacacctcagtgtagggacattggaaggtgcctttaaaaaagacattagttgtgccttttaaattgcttctctccacaattccagggtgattcttcaatctctgcctttctcttcataattcactcaccttctctgggcctctgcttcccctatttggacaatgaggctgatgctatatgctctgtctaataggagcgttggatggctgttatctcatttttttctgtctggttaatagttacacaaatgctaggcattattttggttattgttagtggtcgtcaatatttacctgggtttcttcatccctgagaggggctaatagtaaccagttcgtcccattacatgcctccgcctgacagaattaaagaactcatagtccttgggatctcagcagtcagatatcaaatagtttccctaatcaagtagtattttattagtggtaaccatggtatttcagaagtgagatctggatttaattgagctatgatagagttttccaggttttagtagggatagattgagctttccttttaaacattataaaaatatattgtctccacattattttaattaggaaaaatttgaatagtcttaaggtagtacttaatacttacatttgatcttccaaccaaggaggtttcatcataaatgtagttattcatatgtaatcacatctcacatagtaatgatatttacataacaagaaataattttcttcaggaaagttgagtatgtcctgcacacatcagtatggcattatggaaaacattctgacatctaggcatttctcattgacattaatagggtcaatatcctcacctgtcaccacaaattagaagtcacccctggatcttgttgtgccctgagggtagtaaatagatttccatgccccagacccaaataaaatatcaccagtatcttttctcttccttggctcaggtagtatacgtcctgaaacagatgacaactttaagtttggaataccaattgggtcagaagataaacaaagtgcctcattttttgactcatccatgcttcctccacctccatacaagtatttttgacaccaagtttcttttaatccttctttaagagattcttcctataagattaaaaaaataagcagagtacctttccaaataacaaaacataaaggtaagtatcttgcaagtacataggattcattttctgaatatagtataacttaataataggatgtgcgtgtgtgtgtgtgtgtgagagagagagagagagagagagagggagatagattatgcaatcagatatgaccctttatggatctatgattggtttacaggtacttttcatgacctatgagatctgatggtgagcacatgttactcaaaattcattgatcaattcaggaagcatttgaaaattgcccaataactgcttttcagaactaatatccatttatattcatttatttcaaccaattcctaaacaaaagcttcagagaaaaaaatctcctttgtctttgcctgaaaaatatgtgtaattgttgacttgtcattttatattgtgttacctgcctttatcatggtactacattgtgccagggatttatttatttatttatttatttatttatttatttattttatttattttgagatggagtctcgctctattgctcaggctggagtgcagtggtgtgatctcggctcactgcaagctccacctcctgggttcacgccattctcctgcctcagcctcccgagtagctgggactacaggcgcccgccaccacacctggctaattttttgtatttttagtagagacggggtttcaccgtgttagccaggatggtctcgatctcctgaccttgtgatccacccgcctcagcctcccaaagtgctgggattacaggcatgagccaccgtgcccagccgatttatttcttatgtacccaagaaaaataagaaatagctctctgcccctctctctatccgaattaacatcaaagacaaacagatatgatttacagatactagttggtttagacaatatggtgtactagatgtcctagaaacccttatgataaaatgcctagaaatactgggaaacatataaaaaagtttttttttctttttttttaaatcagagaaagggtcttgctctactgttgcccaggctggagtacagtggtgtaatcatagctcactgcaaccttgacttcctaggctcaagtgatcctcctgcatcagcctcccatagcactggtattacaggtgtgagtcatcatgcccagtcaagaaacattttacaaaatgcatacctgctttcataagaaattcagggaaaacagccagaggcacaccaaaagaaggatctgcaaactgaagtactaaggtaacagtaaacttgcagttgccctgggaatatttttctatctcagttatctaccaccttggattttagtgggctcataaggaacaggagatgaagccttgtttctatacatggtgttgatttgggatcgtgattgccagttgaatctcctatccacatagaaatagtggactaaaaggtatatatatggccaagaataaagagaaactagaagtatattagtttgtcttggcctgggctctgtgaggtaaaaattgtgaaatgtgaaaatgtatatatgtagtctgccttcatgtaaataaggatcttaaatctgcaacatctcatgtgatcctggaaactttgagcaaagaaattaacttaaagtaattccagatttgtatcaccacaggactcttgtatgatgcaaaagtcaactctttctgaaggattttatcctaacaggtcttgtaggattcttaaacatagagcccccatgaacataaattcacaatccaaagttataaaactgacactgaagtagtgtcagaagaaactacagaacagcgtatttgacctttaagaacttcagatactgaaattatcaaatattagatttaacatttatatttaaagtatataaataagaatcagaaacatgaatgaaggagaagatacaataaaatggtgagatatatttgcagaaatatcaaatgtattttacagaaatgaaaaattcagtagatggattaaacagaagattaggcataaagaaagaatgagctataagaaaaatctggagaaactgtcaaggtgcagttcagagaaacaaactcatgaaatatataggaagcatggaaaataaaatgaaaagatttatcatatacctagagtttcaaatgtaaagaaaaagtaagattaggagagaggtgagatccaatgagaaaatgactgagaatattctagaattaatgaaagacatagcttcagagtcaggatgcataatgtatataatgcaggaaaaataaatcatcacctaggtacagaataataaaaccacagaacagcaaaagcaagaaagaatataaatttaaataaatagcaactcaacctccatctccaaatgaagtgaaggagaagaaactaaatatagaaaaagtttggtaagtggaaaacaccaagtaaattggtgaaaaatatcagtaatcacagtaatataaatggactaatgtgacaaattgaaaaagtaattgttagattagacttttaaaacatgctacttatcagacttttctaaaatataggggcagtagaaaaattgaaagtaaaaggatggataaatatttgtcaggcaaatactaatgcaaacgttacatattttcatagctatattatatttcagataaaattgaccttaaggttaaaaaagaagcatactaggaaaaaaagaagtcttacataatgactgagaattcaattcactaggaagttctaacagttctgaatttgtatttacttaacaatacagtctcaaaatacatgaagtaaaaactgactgaataacaggaagaaacacacaaatccacaatcatgagggcagattttaatccactagtcaaagtaatggataaatttaaaagacaaaaattgttggtgagattatggaatagagatcaacacacatttacaaattttagacattgtggaccatatgatttgcagaatctcttacagctactcagttgtgccagtgtagtgtaaaatcagtcttaagacaaaacttaaatgaatgaacatatctttttccaataaaacttcatttatggacactgaaatgtgaatgtcatgtctttttcaagtgtcacaaaatctacttttgctaattttcaaccttttaaaaataagagctcttttttatctcacatgccaaaaacaggcagtaggccagtcttggcccataggctgcagtttgccaatgcctaatatccaagatttgtacaacagaattaataagtttaacttagtgaaaaatcttgcgtgtagtaattagaaaatacatattattctcaagaacatatgggatatttactaaaattgtcacgtattatgccgtaaagcaactaccaatacatttaaagaaatccatataatacagaccatgttctcttaactcaataccatcaacttaaaaataaataacaaggggattatttttaaaacacacttttagaaaaatttaaaatatacatttgaataaatattcacaagagaaaatgttcatattggacattagaaaatatttggagcaagtgaaagatgaaaaaaagtacatgtaaaaacttgtgaaattaacaaactgatatagagaaagaagttagtagcattaactatattaaaaaataaaaggttataaattaatgagctaagtttcagttctaaaagttagcaaaagaacaaaataaacacaaaaaatagaaaaaaagaaaataagaggaggacagaaattaacaaaacagaaaagacaaaccttgtagaatcaacaaagctaaaggttcgttctctgaaaagactaataaaatagacaaacccttggcaatagtaggacgtgtacatacatgagaagaagaaagagaacaccaatgatgaacaatattaggaattaaaaaggagagatatgactagatatgaagtaacaaataagaaaataccaaaagacaactttataccaatatacatgagaacttagacaaaatgcatgctttttaaaagaaaaacataacttccctagacaaactacagaagaaatagaaaaccttagtagacttataatcattaaagaaattaaatctgcaggaaaaaaaagaacaaaaaaaggaccttaagaaaaacactgaaaccacaggaaaattcaactaaacattcaaggaacagatcatttcaagttcatataaactctccccaaaagataaaaacatatattccaaatttcttttctaagaataatctttattccaaaagtagataaagacaataggaaaaatgaaaagtgtaagtaaaacttattatgaacatagatgaaaattctaattcaagtattagtagactgaatcaagcaatgtataaaactgttaataaagtagaccaagttcagtttcactggagtctaaggtttgctgaacattagagaaaatgttaatgtaaatcatcacattaatggaaagtaataaaattatatcaccatctcaatatatacagtaaaaacatttgctaaaaaccagtgcctgttcatgaaacaaaccaaagcaaacacacagttattaacaaagtaggaatagaagcaactgataaattgtgtctacaaaataatctgttgcaatcatcatgttcaatggtgaaatgttaggtaaattcctcttgaaaatcaagaacaggagaaaattgcataacattatcattcctactcaacagtgtaccagaggtcctaatcagtgcagtaagacaagaataaaaggtaattattaaaatgttaaaaatgcaatgttgtcacagtgtatagactttcatgatttgcctacatagaaaacctgagataatctataaagccttagagttaatgatagtttaacaaaaattaaatgtattcctatatgtcagaaacaaacatttggaaaactaattttaggaaaaaaaccgcgtataattgcaagaaaaacaataagatacctagaaataaatctaacaaatgtttaagaccttaatggagaaaatataagattttattgagagatagtagacttaaataaaggcagatataaagcatgttcatggaagactcactatgataaagatgacagttctctccacttaatctatatattcaatgcaattccaatcaaaatcccaacagggttttgttttttgccttttgctgtgtgtgtgtgtgtgtgtgtgtgtgtgtgtgtgtgtgtgtgtgtaagtaaaaatataagctgattccaaaataaatacagaaggaaaaagacctcaggatagccaagaaaatttttatgaagggacatggcttatcagctatcaaggcttattagtaaagctagaataaataagctaattctcttacataaaaactaggccaatagaattcaatataatatagatccaggagaaagtcctttccatatataaaaacttagtatgagtcgacattgaagattagctgggaaagaacaggctgttcaataaatggcactggaatcactggttaatacacgtttaaaagggggttatcttgacgtcacaccatagacaaatataagttccaaacatttaaaagatctaaatgtaaaaagaaaacctttaaaatgtttagaacaatataaaagagactaactttatgacagagtagaaaaatagttctttgaaaggttttataacataaaacataaaggaaaatattaattcattttactataatagaagtaaaatattctgatcatcaaaagcaccacttaaaagtaaaaaagataatgaaaaacctggggaaagatatttgcaaggcataaaattaataattagaatccattctaaaaatgttttactactaatctacaagagaaaacaactcaagagaaaattaggcaaaggttatgagcaggtgtaacctttcataacctctcacaggagaggaaacatgaatggccaataaacacaggaaaagttgtttaatttgacatgtaattagagacatctaagttacatctaaaatgatatgaaatttctccaccctccagattaatagaaatttaatgtctggctactccaagcttttgtgaaattgtgtaggaatggacactctcatacactagttttttttttctttttttccttaaagatttttcccttattatacactagttgttggtgggagtttaaattggtgcatttactgttgaaggcaatttgtcaatatctagtaaaattgaagatggaaatatcctacaaatgagcaattccactactaggtatatttcctagagaaattcttgtacatttacaccaaaatatctgtaagatatatagaactatatcctggtttgtgagaaaaaaggcaaaatttaaacaatgtacctatcattgataggggaatggataaataaattatagtgtagtcataaaatgaaacactaaatagtgaaaataaatgaacttgaggtaaatatttcaacaaattattgatataattgatacagagcaagtgagccccaaaattggaacttagcctgggagagttgttggcttcacccaggaaagaattcaagggcaagcaagtggtgttaggaacttttattgaaacagcagtgtacagcagcagcagaggtactgctccttgcagagcagggctaccccacaggcagtgtgctcagggcatgggcagttctgcagtcatatctatacccacttttaattatgtgcaaattaagattatacagatgcttctagaaaaggggtggtaacttctgggttttctggtcattgtcatggaaaggggcgctaacttctgggtgttgccatggtaatggtaaactgacatggcactggtgggcatgtctttgcagaggtgcttttgcctcttctctatttcagctattcttcaatctggtccagagtcaagtcctacttcctacctcattcccccttcaaagattaaatactcctctttaaccttaagggggatgcaaaagtgcagaggtacatctttgtaactgcatcctgctgagtttatgggcataggcccttcctaccaccagaggaataaaaatctctggatcttatctaaggggcccacaggcaagacgcttttactctctgggtcagtagatgggatgggttggaagtcttgtgccagcattgtctttacctagaactttcgtaatatagaagacacaaactttattaagaagttaagcaaacaaaggccaaagattagtaataacaagacagctattaaaggccctacgaggccgggcatggtgggtgacacctgtaatcccagcactttgggaggctgaggcgggaggatcacctgaggtcaggagttcgagaccagcttggccaacatggtgaaaccccatctctactaaaaatacaaaaattagccgggcgtggtgaggcaggccggtaatcccagctactcgggatgctgagacaagagaattgcttgaacctgggaggcagaggttgcagtgagccgagattgcaccactgcattgcagcctgggtgacagagcgagactctgtctcaaaaaataaataaaataaaataaaggtcttcggagaggtaaaaaccaagtgagacttgggaaagtacttttgttagtcaacctgatatagttgggatcagtgccctggttatatctatgtaaccaggtagcttgcttatagatcttttgaatgttaacctcaatctgtccagaggcgttaatacatgagcagcaggttttattaataactgcacagactccacctcattcagcttgtaaataatccaatcctagtctattatagagaactacatttgccaaagagtccagggactcttgaactctctttagtccctgacctgtgttggtggctaaatattttagggtttcagttaggtcgttttagggttgactcatgatagacaaaaccactccatagtgccactagtcctattgttgccctgattcctgccagagttaatcctattgcttgtttaattctggtgttcctcagtcttagggggttataggctatgaaccctggaggcacaagggtgtccaatgtacattcacccctgtcctaaatttttgatgtacaagagaaagctacttctaaaagaacaagtggctctctgggaagttgggtgtggttatggggtgtgactttttcccacttacggccacaaacaaaaatgagcccagttgaggcacacatcgaggccttacagagtatgatgtctattctttgcttccaagttgggtccatagaaatattcttcccctgttccaatgggggtggtcgaacaatctttgttttccagaagcgggcagtactcccaccttcccagattaggcagttgtttttcccttgcatgttctgatccaatagaagccaccatatatgggttcctcactctcaagtggaatcccatttaccttgctctggccttgggaacttggcagctagaattggatcacagcatcacagggaacttcctcttttatgtcattaaaacaacagtgggtgcaaaagatagaatcattagtgtactggaggtatagatacccaacttcccaggttcaggtaatagtggtgggggagtgcaggtggaatctgttaagtaggggagcatcccacctaacaagtagggagttttggatacttgaggattgctatcattagttaggagatctggagagatggctgtgagagtttatgaataggccagaagatggaactctctatcttggggatgttgataaatccagcaaccataaagatgattccctgatgctacaatttttgaaatatttactatagagttttgttcctacccacactggattagagtaattgggagatcaaacagtattaatagtgacagcatggtatccagctgggctttagaatggcctctacacccaacaagaacaaaagagatgtctccccagaggaggtagctggctaaagcaatagaaaagaaacattgtagtcaagaagagaaaaattaatgctcctatttccacccatggcatcatgttaccactgctggctgagtgttgattcttttaaataggtagtggaagtcttccaaaggtttacagaagtaggtcatggtgccctctctttgtgcctgtgactcataagaaacaggtttaatcctcgatagttgtactcaagtagttattccctgacatttaagtggtggcagtatttaacaatacccagtagggacctttcagttaggttgtaactgattctcagaggatctttctttttggtttttagtaagactaagtcttgtgagaggcaataatttatttccatattctggaagagacttgtgaatctagcctaaattttaaagggggcatagtgaggtttgtctaactccctgatacctgtcatggcctgagttagtttttaagtttctttggaatttcctttgctcaagggacttacagtcaaaagacttatagccaattaaacattctaggccagatgggaatggaggtggtcaggcactcatcagcacttaaaaaccttttaagcaatgtgagtcaaaaactaaaagccaaaaatgagattatatcaagagaaactatattgggtgaagacactgctcccacaggcctctaaaacaaaacactttagcatctggccacaataatagaaccagaagaaaaaactcacaggagccgacaaaaaagctaaaggagggagttacatgaactcactgagaagctttcaaaagaattagcttacagaattgaaaactttctggtaatttcacaaattaataccttaagaaaatttggtcttaaaatgtaggccatttttaaagagtcaattataaacaattttcttttagttacagcaagcttagtcacacacaaaaaatttattttataaattccctttcgtgaaccttatcataatttacacagatcatctataacatgcttggcctttctgacttttcctacactatctctttcttaaataaccaatcattttaatctaggacaataatttactatagagaatccttttgatgcaaaattactcctttttaaatattctttcttgcaaaaaatatattttctgtcaatagcattttttatatctctcttttttacacatttgttccctcatattttgaacctttctttcaataacttccaaattagacaaaaattattctttttttccagtaaagaatacatttctttggcacatttcatataaaactaggaagcaagaaatcctgaactacccaccatacattggcattctatatatgagaactattccacaattttaagattttaaaccacacaaaaagctcattatttaagcatctattccattcacatgtgtttaacatttttacttttaatagctatgtttagaccacctccaagaaccaagatcccatgcaaaggtagtcaccatttaaagccattttaaccattttaaaacctatgaacatcagtgatttacctagctaaaaatcttaaagttaaattttaaaagacgtaacatttctcttcaaatgaataagcctagactagccttgtttaattcatgagcactcttttatcagccaatatgatagcctgctaaacacaacacacattaaacctgtatatacacttaaacacatcaaataaaatgacatatacaaagcaactggattcaagttatttacaaaattgggacttacctatctgccaaattttgttagcaccagtaggtatagaagacaggaagaggcagggaagaagatcccatagcatcaaataaagaaggaagctgggggaactgcagtgctcagggggaaagcccagagtccccaagccaccagagagatcacccagtagtggagacattgaagaaaaatgttcaagcggctgcttgtctgccactgtgggaagctgtccattaggtcaagggtccagacccttagtaaatttacttggacaaggcagctctctgggggctagcagaagaaggttagctctggacacaatattttcctctcactggggacagttaggacatcttattgccaatggtccttttgcttgcagtagacacactgattctggcccaggggcctgcgagttgggattcctttctgggcattccagccgctgatcttgcgatgctttcttgagatgggtaaccctgcagaggcagggggattaaagcatttgctaataattgcattttttggctatttcttttttttcatctcttttgccctgtccctattgttgtagactttaaaggccatgtttaagagttggcttgcaggaatttgcggtttctttgctgctttttgtagctccttcctaatgacaggagcagattgaataataaaatgcgtacccagaagagtttgcccttctggggagtttgggtctgcatttgtatatttcctgagtgcctcaactaaatgaccctgaaacagagcaggattttcaacttttccctgagttatttctctaattttgttataattgactggcttaaccatacacttttccttccacttttttcctacagcacaagtaatagatggcaatatttgatgacatgctaaacaaaacacaagttgtaatgactgtatatacacttaaacacatcaaataaaatgacctatacaagacaactggattcaagttatttacaaaattggaatatgacaagttatttgtgagtaatgacaagttaaatcaaagaacatggtaaacttaacaaactactctataaacttttttggattctttgaaaactggccaaatttgtccttgtataaagccaaatcacacatagaaattggcatataagctccaagtgttttcttatttccattagctacctcctgcaatagatgtaggtttgcctttaggggccccagtacagggcccctctccaggtggtactggttgggcttattttcctgggcagtgtggggtatagctggggctagttggataagtgaggtggctggtgcctgatgaccttggggtgagatcctttgttagagaactggtaggactcctctcagaattgggggaccgaggagactccagggagggcataggctttctagccggagcagctaggaggggattccttaggcatatagctttctggtgcctggaaataacgagagccagtaaagggccataaaaccctgtacatagggatatcctcccattttcctcttttttttttatacagaataagtccaatcgtaaaatgtcgttataatgtataggaccatgcttaggtaaaatctgtttgctttctaatttgtattgaacccaaatggtgttgcaagagaaaatgagtttctttttctctaagctgaatttgaatttgctccaatagcttaaaagacaccctagtggtcagtcctctgggatgctcatcattgtctccatgactaataagaatatttattggacataggactttttctaagtctaatgagaaaaaaaacaactgggcctttgttatttctcccttttagatttctacttgctatctaagtataggtagtaaggtgttataaaagtggattgtaagtatttgccagtgaatgaaatatgacaaaaaagggtttttattaagcaaagtgtagaaggaaaaaataaataaagtaacaataggaaaagaaaatgttgttacagaaaatgataacttttagggcagaaaatgagaaaagacaagaccaagattcctctaggatgggcctccaacccataatactggaaggaatgccaatgccaaaaccctggaacaaccaggggtgtccaacaatactgaatgctgaaaacctggaatacctgagtatcaagccaacaagtgtttctacaccaaatgcccgaaacctcagagtttccaggggttctccaaatgccaaaaaccccagagtatctgtggggcatccaacagtgaaccccaaaggcctgattggggccacagaaaaatgtgactctggtgttcctcagtaaacacaatggggaacctctcataatcaactgccctgacttaaacaattgccaaaggagccaaagccaaaaaaaaaaaagactgcaaacaaaacatgcattttaggactgaaaataaaatggctagtggagcaataaaatagagtcagaagagaaaggacctggtgaagaagtgacaaggatgtgtctcaggacactcaattaatgagtgacttttcactgaccacttagccaaagacttttatgccctaacttatctgatattgtggggaagggttcagaggggacactcacccattcacagtagccaaaattgtgctgactgatcttccacatgggacccggatgaaggtcttccccaggttcccttaacttaggttgacttagctgtcacacatgaggtgcaagtgcagggattgtttacctgccagcctactggtaggagcagcaggtcccattcaaggtggtactactgtggacacttgcctgttcactcagctccactgcccactgggaaagatgatggatctggaaagggcctttggttagtgttatggctttgcggtgttagcagctctttattgttacagcctcagggttatagctctgcagcttttggttgccatctcaccatctcttgccaattgctgcctctccactgatcactgattgccgtcatcgccactgtctcaccatcttacctctccaccaatttccatctctgctctctcactctctctcacttgctgtctttgtccctttgttggtcaccagataacacagggcaggtgagctctaaaattggggcttagcttgggagggttcttggcttcacccaggaaagaattcaagggcaagctggtggtgttagacaacaacttttattgaagtggcagtttacagcggcagcagaggtactgctcattgcagaacagggttatcccattggcagtgtgcacagagtagtagctcaggggcagttctgcagttatatctatatccacgttttattatatgcaaattaaggggtagattatgcagaaatttctataaaagaggtgatatcttccagctcattggcttgttgccatggaaagaggtgataacttccaagtgttgctatgacagtggtaaactgacatggcactggtgggcatgtcttatggagagatcctttcactttttccctgtttcagctagtcttcagtctggtccagaacccaagccccacctctgcagtcaagtcctgcctcctacctcataatgagccaagaaaagcaaggtaccaattgaaatgtgcagagtagttccatttctacaatgtttaaggacatgtaaaacaatgttataaattgatgatacttctatgtatatatgcatctttaaaagaatgcaagagaatgatgaacatctaaatcaaaatagtggttacctcatggtgtgggagtaggaatgggaatacaagagtgtaggagcacacaaagggcttcaattgtattggtaatatttctaagttggttatgtctcatgggtgttcattatattaatagtattagtcttcttcaatgtctaaaatatttcataatatactaaaagtagcatactatgtctctgacactctacactcgcttttcctcctgaacctctgtttaattatgaaactctaagaatattctcattgatgttggaaacaaggcaatatcaccacgatcatttgacttagctctggatgtaccagctaatgcaattagatgaaagaaagaagatatgtaaaaacaaaaagaagaggcacaatcatcattatttgcaaatgtcattatatacctggaaaatccaagagtaccaactggaaattattataattgtataagtatgtatctgtagaagtgtagaaaatataacaacagatttcatgcataaaagctgctaaaacctagcaatataatcttaggaaatttatagaacctatatgaagaaaaaatgtattttttatttttttctgtctctgatgcttgaatcaagatgaaaaaccattaactctattgaggaacatgaatagatggagagaaatatcctgtttttggataggaagacaatagtgaaaagacattaaagtgtaatacaatcccaataaaaataccaagaaaactttggactaggcatagtgatttcaaagtacatacaaaacatgaaaataaacatgtgagaatagctaggataattatgaaaaagtgataaataaggattaactttacaatatatattctaagctcctgtaattaaaggtgcaggaataggaagacaggtcaaagcaacagttttttcattctagaaatagactcaaacactaacatatataattaaagggccatattaaaatagaagaaaaatatgttaaaattgactatacagtaaaaagtaaaggtaattccctctcccattataccaaaattaattccagaaagcccatatatttgaaattatatgagtgaaactctaaaagtattagaagtaaacatggtcatggggaggtagggggatgggagatcttggcatataaaatacctgagatgcaaactctagaaactctagtggaaaatattaataaatgtcactaaataaatttaaaaattctacacagaacaaatatataaaaggggaaattctgggaaatattttgcaatacatgacagataaaagtttgataatttattatgaatcagtacaagatcattcaatacaaaagagtatgaacaagcaatttactaaaggagaaatataaatggattataaacataggaaacaatcatcagttacatttatgagtaaatgcagattaaaatgagtggcaaatagtaaattttgatatttaacagtgttggtaagttaacaaataacatagaagcaaatccattgctagaaatttgtcctactgataagtggttttcaacctgaagcaatttttcccctaaagggacatttggcaatgtctggagacatttatgaggatcacaactgggacatgtgttactggaatctagtgggtagaagccagggatgctgccaaacattctgcaatgtacagtacaacccccaacaataaagaattatctgaccaaaaatgtaaattgtgccaatggtgagaaatcctgctacagatatacttgtgtatgcagacgcatgttcaagggtactcattgccactctgtttgtaaaagcaaaggactagaagcaacctaaatatctatcaatatgggtctagttaagtaaaatatgacacattcacaaagggctgttgtatagtttattttaaaaaataaagtagatagatgctgagaagaatatgtttacaagagacacaaagaaaaaaattaggattcagaccagtgtatgcaatatgtctccatttatgaaatacaaagaaaaacatgaatatatgcatgtatgcatatacgtgtgatgatctgcaagtacacacaacaaatagagaatggtcatctctgggtaatgaactttttgagtgggagactcactttttattgtgttcttttttgtattatttgaaattctactttatgaaaatattattttcacattctttaagaaacccaggctgatattttaactccaacttacctttgcaaggcttctctctattttatctctaaatagaagacacactccatgtaaagttggccaagacattatttttcctttgtgccctctgcctacaaaggcattctgccaattcccatttttgccttttaaaatcctttaagtggttgtaggtgtctggcattttatctagatttttaaacctgtttcattctctatatgtttgtttttgtaccagtaacatgctgttttggttacaaaacaaactaaccttgtagtatagtttgaagttggatagtgtaattcctctggctttgttctttttgcttaggattgctttggctatttggacctttttttgtttccatatgaattttagaatagtttttttttctgtgaaaatgtcattggtagtttcataggaatagcattgaatctataaattgctttgggcaatgtgaccattttaacaatgttgattcttcttatccatcagcatggaatgcttttccatttgtttgtgtcatctctgatttcttccagcagtgttttgtacctttctgtgtagagatctttcaccttcctggttagctgtattccaaggtattgtgtgtgtgtgtgtgtgtgtgtgtgtgtgtgtgtttgtgtgtgtgtgttattgtgtgaatgggattgttcttttttttctttccaacttttaggttcaaggggtacatgtgcagttttattatatgggtaaattctgtgttgtgggggttcagtgtacagataattttgtgacccaggtaatcagcataatatttgataggtagtttttcaatcctcactctcctcctacccttcaccctcaagtaggccctggtgtctattgcctgcttctttgtgtctgtgtgtactgaatgtttaggtttgtgttcttgatttggctctcagtttagacattgttggtatatagaaatgctaccaattttttttacattgattttgtatcctgaaactttgctgaagttatcggatctaggagtctttggccagagactatggggttttctagttataaaatcatatcatctctgaagaaagtttgatttcctctcttcttgtttggatgccttttatttcttcctcttgcctgatttatctggttaggacttctagtaatatattgaatggaaatggtgagagtgggcatctttttcttcttctgattctcaaggggaatgcttccagcttttgcccactcagtaggatgttggctgtggatttgtcatagattgctcttattattttgagttatgttccttcaatgcctaatttattgagaatttttaacatgaaaggatgttggcttttattgaaagccttttctgcatctattgaaataatcatgtagtttatgtgatgaatcatatttattggtttgtgtgtgttgaaccaaccttccaaatacagcatgttctcacttaaaaggcagagctaaacattgtttacttttacaatggatgcaaagaagggaacaatagacactggggcctacttgagggtggagggtgggaggatggtaaagataaaaaaactacctatcatcagatagtatgcttattacctgggtgacaaaataacctgtatgccaaacccctgtgacatgcaatttatacatgtaagaagcctgcacatgtaccccatgaacctaaaaggtagaaagaaaaaactgatcacgtgattcctgttcattaataccccttataatcttctgtttttctttggcatatgtgatcagtatacacattttaatgtgtataaaaaataaaatccttcaaggtaagtcccatctcaaagaccactttctataccaagtcttccctcatcctctcaaccacttggaagtacacatttatagacacataacactttgtatttttaaggcacccataccctgtgctacagtgatttatgagcatttttactttcttctttcctccatatcaaaaactcaccttacattttgagtttttttaagggaaaaatcatatcttattcatctttgaactagttttatagtatgtagcaaagtgcctgaggcataatcattggtcaataaatatttgtcaggttgaaatgaataaaagtttataatatacaggcaaatataaatgggtaaatacaaaacagaaaacaaacagaaaaaaaataacaacagaattagttcagtttgttggtaacctaaactctcttgttctttagtgcttttaaacctatacatttaactattgttaaaaatgtattgttaaacatatattgcgttttctggaacaggaaaccaactgtgtatactgtaatatacctatgtgatgtttttgtatttcttttaacacaaacttttcaattcttgtatagcaattccactgaaattgtaattgctacttttaagtgtcagtcatttttcatatgtctcactgaggaaagtgctatttgtttttattttacatgtgatgcatcaattgtacaagcacatgagacacttattttatcatctctaccctccatgtttcttgactgttacattttactactgaaatccagcatttcagatattcatgaggctgaaacatgtccataatcatcacattccccatttctttgggaacaacatatacatagtcgagaaactcactgtatcttaaggcatgctttgtcatctactaactttctactcattgggatggagttgcactgagagataaggttgcatttaagcaactgcacacacaaggaagaacagtaaccactgttgaatgagtggtcaatgtcataacactgcttcacagggaggtaaaaaacatggcccatttttattagaagctagaattgtgtccggaatagaaaatgctatatatatatatataaaatatttgctctctctatatatagaatattagatatatataatattagatacataatataatattagatacataatatataatagatacataatattatataatattagatacataatattatataatattatattagatacataatattatataatattatattagatacataatattatataatattatattatagacatattatatattatattatagacataatatataatatattatatgcataatatataatattatattatatgcataatatattatacatataatattatgtacataatatatacataatattatatacataatattaacataatattatatacataatattgtatacataatatttcatatatatatataaatatttgatactgtggaatacttttccccagttagtgaggttactttctattgataatactctggctatacagccattttacttgtttctaaatttaaaatcaaatcactttagcaagtatagatgtagaattttaggaacctctggcctttttacaggtattttccttggcaagggctccattgagttggcaatctagtaacctgcattgtgagggcacattataaaagttacaccaacatctaggactaacttttggcttctcagatggaagataaggatataataaccaggtgttgctgttattacctttagtatttgaagcagttgtaatgtttattttatttcaactttgggtaaatttaaggaagcagaggaaatataattagtctataatttaaaaacataaagccaatgtaagaaaatctgccatagttaattatagtgtccagattaagaactttcagcctcttccagaataatgtatgagcgcagagttaatcacatgtgggattttcaaaacatttaattgagaaaaaaatacaaaaaagtacttttgagaaaatatgacccacagcaatcccattatctccactgttaaacctccccactagctgctttttttctcatctgtccttatctgttatcttgctagatgccatgtgaggaggccactaaagtagaaagaaacctgttctttgccttcaaggtagctctggaggcagtaattaatatggaaataagcgctccattgtgtgattcagacaaatatgatgggagcatatagtttcaaatgaactgtggtcatcagagcaggtcatatggagtacatgggccttaaaggatggattacaccattactgtttcaaatgtaatagtgtagaattatgctaatcatgggttagggattccattttacattaaggtcaaataaattttctcaggttacagaagataattcaacctaaaaatatgtttcaaaagagtacctgaatacagatacattttaaggtgtttttattgttttgttattggaaaacagcagagagtagggatgaacgtgatctcttgctattttttacttgttaaggactaaataagaagaaaatgactaaaactgactgcaaaaaataagaataaaaataatagaaaagttacaactggtatttaagagaacatggatgaaaacttatcatattaattaaagcatggtattaaaaagcaaattcacttagctgttcttcctttatgtttataaaagattggattaaatgaccttccagcttcaaaatctgtaaatttattaaagcatagtgcttgtttatctcattttgttttatttttctttatttttttttttgagatggagtctcactgtgttgcccaggctggagtgcagtggtgtgatctcagctcactgcaacctctgcctcccgggttcaagcgattcttgtgcctcagcctcccaagtagctgggattacaggtgtgtgccaccatgcccagctaatttttgcatttttagtagacatagggtttcaccatgttggccaggctggtctcgaactcctgggtcacttgtgatctgcccgcctcagcctcccaaagtgctgggattgcaggcatgagccaccacgcctggcctgtttatctcattttaaataaatatgagtgttttcagagagtgatgatcaaatagcagaatctctcctatcaaattttttaattgacaaaaataaatattaaaaggaccccattaatgctgcatagctaaattgagtaagtacacatctggttatagaggttatacatgctggggatgagtagatggttattccaacctgttactgttctcacagatgtcagtttgtaattactacctcttgtcagaaagatgctacccacatggatttcccagaatttagtgaagagagtcagaatggagaaagtgaaggagctttgggcttggtgataaaaagacaagtaatatataacatttttccccttaaaaaacgtttctcagaataagtgaagcatttaatgaatgcctttggagctatcaaatatttgtcttttcctgagatccagacgcattacatttacaaactaccgagttatgtgtacctgtatttcattgttggcattttttgatagaaacttgtggtatgcaaaaggaaatgaaaagcttatagtagacccccaacactagtcttacaaattcaagccaatacatcaatttcatattattcagtgtcacccatttgcctttgacatctttgctcacaatattttcttgccttgctatttgtccttcagagttctgctcaaattctacctcttctctaaaagttttcctgtttatctcatattccttttccatttctctgaatgtctctgtagcactgaggcctcaattatatgtgatcttacattgttctctaaattcttactctgatttgcttcactatcctgactgctcctccaggaatgggcatttctctagcttcagttcctctctttatacaatgagggtgacaatataaccatgttaaaggcttctttggaggattaaatgagataaaccatgttaatcgtggatagcacagagtctggcacacattaagtatccaataaactttagctattgttattatgtgctctaaaggcttagtaattgatagcttgattaagttttctttcaagtctgaattttaagagaatataattttttgtctgctagaaatagcctcagagtgtgtctacaaaagtagaacaactagttaaacattgaaaatatggttaactagttgctttctctacatgccactaaaaaccaatttggctgaattatctgagtgaaataattgactgtttaggaataatggcatcagaatgtgcataatacataaattttcaccagtaatcactgctaagtaatataagttgaataaagtcatgcccatgaggcatttagatagaattgccacttaactcagtaaaacaaccattttgacaggctttaagataatttttttctgacttcatcaatttattctgtaagttgaataaattgcctgggattttgtgtatagaaacaacttcaatctctttaagtcctgtcctgatttcttttaagtaccaaatacatggaccaatacttactcttcttatactcctgctgtggggaattttccagtttcaacaaaacattaagaaatgacatgaaatgcacatgcagtgtctgcctcacaggcactaatgttaatacaatgcattttgcttgacaaatcagcaccacttgaatagaggccttgttacccatattctcctatatagtgatctctgcattcccattttctcacattttggtggtaaaaaatacattccattttgcagtggacttcactgactatccagacaataagcacaaaattgtctcagcctgtgtgcaaatatcttactcagcagtcagggctactcaggaggatggccttttagcacaggaaatagtgttccaggtttctggaaagatcaagggagagcaaagctttattgagaatgtgactcagtgtgatacaagcttctggcatatacccaaggtaatgtcagtaacttatttatttggaatttataccctgacttttttcagaaggctttgaggtagtttataagttgtgtataatgtaaaaaaaaaaaaaaaaagacaaggaacatttagggcttaaaacaataaaaaccattctgttagtacagctatgttactctcaactacggaactgttccttacttatttaatcagtgaggggttttctcgctttgtgtcctttagcaaagtaggccttaaatgaaaattttcaggcactctttattgttggcaaggtcactggtggtctctgagattttgtgcctcctgcctcccgactgcccaagaaggctgccctcctgcattgtagtttcatcccaaacagggtgcttggggacctagatgcccaccactgagttacacaaatcagcctttagctgctttgtgacagcaaatacaaatgggtatgatgtgcatatgtgcttctcagtgaatcattcatcatctgcatgatgtgtctccccaggcaagaggtatggtagcacagctccctcaagtaaagcatgtctgataaattttgtagactgttagtggaaattttcagtgtttttctttctaaatgcttagtttatcttgcccaccaaaagcatagcacaaacaactttgccaacatctatgaagctctaagaccaagctctgctcttaaaggtttgggaaagtgatttgtattctttagtcttccagagtgaagaattaaagtttccatagttttggctttactggttttcttctgaccactagctatctgctgtggtgcagagacatttcctgtagggatacatgccttagcaatttgttttcatcactgtcacatcaactcagcattttcttgtcatctttcagttctgataaactgcttctgaattgacagctgtcaccaagatgcttacatagcaatttaaggttggtctaattgacaaaggttaaattttctacttgctcactaaacactaagaaattgggggtgattatagttaggagctattgccttgttatgtgtaaatgaattatggaacactgtagtttctatgcatcttaatagaactagatgtaatatcttgtttctaaatggatcaaagattgaattcacaggaactctagaattcattttattattagcattattgataggaaggtgccaatatatagactttgccgtcttttgttagcacatgatacctactctcattccagttaaggcttgaatgcccaagaaggcactatgacaatattactgcttgaaataattttgttttactttttattgtgcttttattgaagtctgtgtttttaaatttaaaaacatgcactccacacatattaaaatgctttttaagatgttttagaaattgtgtgtcaaagaaattcactgattaagtaatgctaccctttcttttcatatgcatatgcaatttttcactgaatatggacatgtacctttctaatctacaaacatacaactatgtgatggtataggaactgctgatactatttgtactcacttaaggtaataaagaggcttatttagggctgatcacaaaatgagttttcataaagtgaattacatttctcattttattactttattatcctttttatatatggatacttcatctcagctatagtaacacagggaacaactggtggacaaagtgtgtgtatatcctcccccagaaaagcctggggtaacctttgagaagtatagtgcataagaaatgtagtgcctaagtatttgctctttcgctcattcctttgtggttaatttcaatgtaggcatactggggtgtacatcttgagcctgggcagcaaacaaggcatagggtttggccattcttattatgctcttggcactgaatactctaatatcattatgcttttccctacaatgagccatctttcttataaggctgtacttctagtcccaaagagagactgaatgagtgtggatggcccaacctaccctcataactgagagaccaactcagattgcatggtttgtacctgctgctagaaataaacgggatgtgaagaagagtaaagaatcatattgttggcaaggataattctcattaaatattttttccagtttgaatcttctttctgtgcatatgtagcatattttgctcccttggactacatcttctcaaaggacagctattattcctattgtttacattcatacagtcctcttactgcccaatatttgaaatattttaagtttacgagggaaaaaatgaacatatgactatattccttcatcaaaaaatggtttcctatttcaatatcctctctgttctctggatttatcaactccaaaattagttttaaccatgtctgtaactataaaagcacaataaaaggtaaaaaaaaattatttcccaaaccatttcagactaattattggaactcattttgtcatgactctatttctcttttattgtcttcatctctttcatttcattgtatgtatgtataacacacatatgcatgtaaaaaatcagattccactgccatacttttctattttcttgtttcttcctcctgcctttaataagctgtaagcattgcttaagttctcctattctgattcatgtttcaggtagctaatgtaccactccttgttttctgtgatgaagttaggaacaatttgactcttgactatcgtttgtgttaccctcagtcacagttgttctgtactagatgttgttgacaaggcaataataagccctattaaatcctacctcttacatcaccaaaatctatgttattggctagacaaattgggccgatgtgtatctcttcactcagaaagttttcatgacttctccatgtataaggactcataagcaaacactatacaaatctggaaaatatatttccttgtgtggtgtaaaagtcacaggaaagtattaaatttggcttgggtaatgggatattcttcctcatttgtatcatgcaaataaaactccgtaacattttacaaatcacatacccaccctctctccccttgggatggggttggaggtgtatgtttttttttaacaatggtagcattctttttgacacaaagcaaggcagttcaaaataacactgaaacaatcctacattcatgcttcttcttcttctttacaaggcatctgacaggaaaagtatcaatgtgctaatctccacagcaaatcatgagataatggacatcttgcaaaagaatataaggtgacttgaggattataaaggtaatcttgtaatgcttttgaaaactcttcgaaagcactaaaacatcaatggcctgagagagaaggaagacctttaaaatatattgcatattattattcaataaggcaaaagcattatttgatgccttctttgggatcagtagcagttgaaagacctgtgttgcaaaattatatttaaaggtcaacagctgttttattccagatggaacctactcctgaagatgtttaaacacttttttatagaaattgtgattactgtagtgatgctagtctatccctatagaatttctaggacctattggagaagaaatactttagtaaggatatttggccttattaaccctagtaaagcttgatgtaaaaaatcataaggtgactaaatgcatgagaattggcttgaaattcagcttactagtaggaggcattaggacataactttcccctgcagatttgaaggaataatgctagacagcattaagtagtgagaatgcttactactcatatacctccttactgtctctccctaagactttgaacatttttagtctttagacacactacttttggccctattcaatgtattactatttatgtacaagatagtaatacattagtacatttaagttattaagtaacccaggcaaaggaagattttatactgtacatgtctgaggctcagtgctcaagggattaggcaagttacatgagtttgtcaaagggaaattcagaggagaagtttacacagtagccagaggaaggttaagagtcttagaatcaggccccaacagaaaattgagataataagcagaatacagacaggggccagaaagcctttcaaagaatggacagaatgtcagaggtctacctgccaactggtaggagattaggagggctgtccagaggggcactgatgccaatgaattgagcctagagtgttcacactgtgttcacattaatggccaaggctgtatctattaggaactcaaaaaatgagtctataagccagaatttcaagggtttcactccctttgttgcatcttttaagccaacatttattgagtacctactttgagccaggtactgagacaggctctagggaattcagaaatttataaaatagggtccctgcctaccaggagcttacactgttgtggggaagacaactaagaaaatctacaattataaaagcatgctgtgataaaattattcagtaagagctaagggagagcaaaggaggaatacctgcattttatgtaggtgtgggttattggtcatatgtgagcaaaaccgaaaataatcttagaaggagatgccactgaagttgaattgttaaaaataaggagatttggacaggtggatgaggaagcaatggaaggcattcaaattagcaggaaaaacatgtactaaggcattgagggaggcaagtgtggcttcttgaaagagccatacataggccagttttgctaaaaatgagagtggaagggaagagattacagaagacaatgctagaaatttaaacaaggaccagatcatgaatggcctttgtagaacatagtagagaaactggatgttaccttggaaacagcaggaaactactgaaggatactaagtagagagtgacatgatcagatttgcattttagaaaaaaagcacactggcagctgtgtgataagcaggggagttaaatgagtacaggagaggtacacagaggggtatacctaagtcagttaataactgacaggttaaataagcccttacaccgggtacttgcatttgtggaatacagagtttgaactccttatctcttcagaattttttagaagagttcaagacattaccaggatgtgatggttgaaggacagtgatttcagacatagccatagattattgctgcataatgtagttggagggctaccaagatgcaggggcagtatttctaccataatgagaatgacatcaaggaagacatcggcctcccacctggccgttatggctctgtcagaggtggaatcctgacttttctcatcaccagcaatgttattagggaaaagcaagaatttgacgtttctctttgggccctatctactgaatatgagtgtttgagatttaacttttttcattcagagaatgaaaaaggccacaaaatccaaacaacctttcaattttcatttataattggtttacaattataccaacatcagggcctctcctagctcaagcagtattgttctatgatttagcttgagcaagaatagggaaaacttaattttagatttgcagtttctcttgagttagagtccacagctacattagtacccacagtttcctttggaagtgaaatgaaaactcaccattacctgttttgaattgtggtctggcagctgagcaccttgacattgtaaatcgagcagagtcacttgaaaggaaataaaagttacactgattttgcacattcatttttttttattgcctaatgctagttgaccaaaatgtattcagccgagagagttgggaaattgattttattgaaattgataagtaaaacatatataaattagtaattacaaaaccataaaatgtttcttataggttaggcatctttatgcatgagtctgatattaattgtctctaatgatggtgccgaattgatccttccattaatattttgcaagttcagctgttatttttggcaccctctgtgaatgtcaacaatttgcttgcaaagaaatgatagcatattaagcttatgtatacaagccaatattatttaacaaggaagtacaatgttgctgaagacaaagctagtttgaagagtaaaggcaaacagctaatcaatctttggttgtgcactattatttaagagggaaaatttaacttaaattttgtttactattaagctcagagtttggttttaaactgtgatttaattgcataacttctagtatgtggttgcctttcatcttgatgttatattcattgaagctttcaaagaagtgcagataggacttatttccatccccaagtcaacatttattgaatttttatgtagtgccaggcaccatactaactgctttcatagagaatatcttattgaatcctcactacacaactctatgagacaagtataatttacatataagtaatctaaactctaggatcatgaaataatatgtccaagatttcacagctattaagtaataaagccaagatgtgaacttcggctgtctgagtctagagaactcactcttaaccactatgctatactgtattacagtttatttttagccaaagctgaaattatcagctaagaagatgattactaccattatgaacaggtattctgggttcagagccaaatttttatgtatattaaaattcttaatccctcctaccctataatccaacttccacttctacataattaccaaagagaaatgaaaacatatgtctacagaaagacttgctaatgaatgttcattgctactttatttataatagccccaaattggaaacaatccagatttctatcaacaggttaatggattgtattcgtacaatagaatagcactcaacaattaaaataggtgagctgctgagatacacacaacatggatgaatttcacagacttaatgatgagggaaagaagccaggcatagccaagtacatactgtacgaatctatttatgtaaagttctagaacaggaaaaactaaactgtggtgaaaaaaatcagaacagtaattacttctggagaggaattgattaaaaagggtacagagtaactttctggggtgatggaaatatttaacttgattgtgatgtgagacacacaggtttatgcatctgtaaaaaacccattgaactatatacttaagatctgtccatttcattctttataaattgtacctcaataaaaatattaaataagcaaacagaataagggcaaagtttaacccttaaaataacttttacatagtccaaatgggtaaagcatatctagttcattatcaggccaggaatccagattcaagggtatctactctgaggaggccagtatgaggctttaaggatgtgcaatgaaattgatagaatgtgcctagccacatggttctaagagttttcacccaaaagacatgagaacaagatatcagggcctaggctgatccccaagaaaattactgtgagctccttgtgggaagacgcagagtttttcatctctgtaataccagtgcttgatacactaggagacttgcaagagtaaagtgagcagcaggacccagtcagctggctgtgatgatagatgtacaagacctgggtatttcagactctcaagtagaagagagccatggaagcaggctgggggctccaaatacgctactgccaattttgctaagacctattcaggtctttgctcaaatgacacctcctcagagaggccttccctgactacttcatctaaaataatcatccttacccccaccatcacactctgtcctcttaccatgctttattcttcttcatagcccttataatatgctacacagttatttgcttacctactctttgtttctagttactctttgtttctaggtacttttattctttgttatctatttactctttggtgtttaatataagcaccctaagagctgggactttatctgtttttctcactattgtatcttcaatacttaaaaaagtgcctggcacatagcagctgtttaataagtggctattaaaagtaacatattagtaagacttgctggctgaaattaaatagtccaggtctatccaagtgagagcagaatctatctcttacatggcataaaagtgtgattacttgtacctagagttatgatattatactcagaaacattggtctgtttcacaaaatgtgcccattgtaactaaaaaaagcaggcaatgatcaagaaaatgcaagtaaaggcctggctatcaggctgaattgagttgcctttagttgtagtttctttccatcacttgggctgtggagttcaaatagtctcaagagcaaagtcacaagctccaatttatctttatgatagaatgtgcagaaagtgctacttttctgtgtgttgacatctgtcagagctagtctcctttcattctaaaagagatcaatccttcatgtgatagaggattatcctctttgccacctataagctggctttgatccctcttatctcttttcctgaaagggtgtcaccattttaccatttctctagcaacctgcagggttccaaacaatgcactattttaatttaaatagagtcatacctactcagccactcacatatatggctattttagtggcttgagccttttcagattttctgaaatgaaatctccaaatatcagattcttaatttaggataataaaagaaggaggttatgctatcagagcaatacatagtgttatgctttttttccccctatcagagtcattccccaaacataataggtttagttttcttcacagtgggaacttgaatttgctcaacaaggaagtatatattgaggttcagccttactagcctcaatgccagtgtgagtcagttcatcttacttcagttcagcaaacatgtaatgaagtcttgctgcatgttattcaatgtgctagataaaaagattaaaaaacagatcaatgaacctttgccctcatgagaatattgtccataagtatgtaccaagcaattggagatatcatgagtaatataaatgagaacatgcagggtaccatgggtacaaacttcaaggagaaaatagtccataggttcaggaaatacttccctgcagaggcaatagttaagctgagacttgtaagataattggaaattagccatggacagactgaaaatggttatatttcccactaattgaccacatctttgattctagcatacatgctagcatacagtcatgccgaagcccattggctctttttcttaagtagataacaaagaactggatgaatagagaatattatgctttgaataagtttattcaatcatttaacaaatggttattaagtgcttactatgtgccagacactgtggtaggccctaagaataagtcagtaaggcagatgaggtgtttgagatcaaagaacttacatctaatggaaggtgaaagacaagaaaatatcaggtaccaataaatattgaaactgaagtagagaaagactgggggtttcctgttaattaggtaggaggtgacatttatgctgagacataaattataagaaggagccagacaagtgagtattcgggaaccaacatcccaggaagatgtagcatcaagggtaaaaacctaaggaagcaaacatttgtcaagctagaaggacaaataggccactatcactggagcatagtggacaagggaagagcgtagatagagatgaggtagacaggagtcagttcatgtgtagttttgtgaacttagggaagtattttggattttatgctaagtgggaagggaatcccttagaacttcactgtccaatatggtagcaactattcacatgtggacattgagcatttaatatgtggctagtcaaaattgacatgtaccaaagatttagtatggaaacaggaatgtaaaatgtctcacaaataattattttatggactacatattgaaatgacaatattttggatatactaggataaacaaaatatattagtattgggttaaccaaaattatctaattttacctgcttctctatactttaaaagtgtgggtattagaaagtttaaagttacattagtggcttatatttgtgttttacattacatttctgttggacaacactgccacagaaggtttcaagcaagtaagtgatatgatattatttctgatcttttgaagatcacaggggctgttgtacagagaaaggattggaagaggcaatactggaagcatgggaattaattaagagactttttcaacagttagaaaaagataatgctggcttgagctaaacagatagcagtgaagataataggaaaaggtacagcttatgatgtttatggtaggtagagttgattttatttccttatagtttggctctaagaagatgaggaaaaaagtttccaaagaaataaagctttggatttttagcttgaacaattgtgtatgtggtggtaccatttagtaagatgaaaaagagaggagagacagtttctgattgagggtagaaatcaagagttctgttttggagatattgagtttgagatacttgctagatatccaagttgatgagtcaagtaagaaattgaacataagactctgaaatttgggaagaggtcggagctgaagatataaatttaggattcctaagcatgtagctataaacaccatctgtgggaaaagaccatcacccagtgacagtctgtagagaaaagaagagggccaaggacagagtcctggggcatgatatcataaagagtttgaataaaaaaggagaatccaacaaaggagatagggaacatctggtgagttacaggttaaaaaggagtggtaacaaagaacacaagtatagaaagtgttactttaagaaggaagtggtcaactaacttatatggtgttgagaaatcaagtaaagtgaggacagagaatttctatttggaaacatagaggtcattggtgaccttggtgaagtatgggtggcagaaggcccattggagtgaaatgagggggaggatgtgagtgaggaagtggagacagtgaatgtgacaactttttcaagatttgccttgaaggaaagtagagaaatggggcagtagcaggagaagaatatggtaacaagggggaattttcctgtgtgtttgttttattaaaatagaacgtacaccagtctcagtggctcatgcctgtaatcttcacactttgtgaggctgaggtgggagggtcgcttgtgcccaggacttcgagaccatcctgggaaacatagtgaaacaccgtatttacaaaaaataaaaaatcaaccaggcatagtagcacacacctatagtcccagctgctcaggaggcaggagaattgcttgagcccaggaggtagaggctgcggtgagctatgattgcaccactgcactccagtctgggtgacagagtgagacccccatctcttaaaaagggttggagaaaatactagagtattttattattttatttatttttgagagagggtcttgccctcttatccaggctggagtgcagtggtgcaatcatagctcattataacctggactcctggactcaagggattttccctcttcaacctcccaagtagctgggactataggcatgtgccaccatgcctggctaacatttgtgttttgtagagacagtgggtctcactatgtgacccaggctggccccaaacctttggcttcaagtgatccttctacctcagcctcccaaagcactgggattacaggcatgaggcactgtgcccagcttagagtattttaaatgctgacagaatgatcccataggaggaggactgattacccaagagagaagggataattgcaggagtgccatcttgagaaatctagatgcagctctttaattggaacagggacacaccatccattgtaacaatagaaggcagagagtgtgccaagatactatgtgtacgtggagtgggagagtgtggggtaggagtgggaggacaggatagggagatgagctcttgcagctgacttgaagacagtggagaaggtgtgaaatattttttaaaagtgcagaagtaaacatactagggaagtgtaggaacatctctaggcaatgttgtgtgccatttgagagttgtagccatgcatttaaagcgaggccaatctgcacagttgtatggtctccaaaaactttctggaacttgaaggaggaactaaaagaagcggcttctaataaattctatagctaaggtcatcgaaggttacttattttttactttatttaggttgcctgatattcacttagtctggcctgctaaacatggacttttccagtatgcgtgggtgttacaacagaaacctttatgtttgcttacaggctcctcctttttctacacagtggtatgcatactgtgactacatgaaaaccagacatccaagtggagacggaaaaatttccccaaacttcctttagttctagtacacattctgacttgtgtatgtgataatacccaatgacattttcccctatgtacaaggcaaacctttaattttattcctggtgtttccaatttcttacttagtactttccatttaatctttcacttcaacattattacccctctcactcataacatttctttttttttttctgcataagacttttctaatttgtctgctgtttctaattcttttaagtatctttgttcctctatagctcctctgtccttcctcaacttctttttcctctttcatttccttctcaaagcctttatagattcaatccctagcaaatcatatatgggtatattttcattgtgctattcctttcatatggaatatattctctcaacaaggtacttactagtatttcttaaaactttctttttgcaaattattttcttgagctagcctaagctccagaggaaggacatctgttactactatggaattgtaattagaagtctactttccatttatagctctaaattttaaaaaatcccttgaggttagtgacttaacagaaaatagagaattgttattggggatttgggacagtataaagacaagtacaagctggagatctttcatgggtggcactgggagtttggggcctgtttgccctctgctaagatgatatggaccctacctgagattattatggcagtctaaaagtactgattgtgctgtcatccatctccagactcactgttggtaccttattttattcatgttcaaaaatggtattatgattccttcactgaccctggcttttttctaaagaaacactcatgtgctcaataattgcattgactaaagtacaaaataaaataaaatttgaattagtaaaggttttaaaacactttaaaaaggtctaatctctggtactttttaaacattctaaaaattaaaggttacattaaaatggtgcctgttgctgaaaacattacactagtcctgatgtgttatatgaagtccatagaactacaggttggttagaattaaattatagttattaaagacaagaatctattagtattgaattccagatataatgagaattttggcttgctgccttcctgccttcagcctccataaatggggcattttaacccctagcattgtccaacacccaaagatcaatctggttcctaatcagaggaaatattaatagaaaggtccactggagtccttagccttgcagtaagtcatccttcttctattctgcctcttgcttttccttgtgaccaaattcctgctttgtactgaaatttaagcaaatgggttcctatttttcgtttaccaccacttgctttccttatcttgtgcctgacaccctctggaactgccagctaaccttttggtgccaggttaccatagcatttggtcctattgaccccttaagatgtcttacgttgcctaatgttggatcttcttgatgccaactacctatctgattagacttcctaacattgcctctgctatgatttgcacagaatacctgtagtattcagaggagtatatctagtctccaggattctgaatatctcctctctggtctattctacagagagtcattctcttttggccctttgctatagttaatcaatgtaatcatttacaaaggaactgagttcttttgcttcattcagtaaaaaataagcaaatcaagatgaaaaagctggccttcaggaggctcaacctgctttatcattgaggtctgtcttccctgtatttgaagctttttaaataaaccattctaaccagaagagagaagatgaaacagttaaagctcaaatcaaacagactcaagaatatttaaataactgctttctaagggaggaaaccaaagcaaaggcattaggagagtgttgattcttagtagaataaacttcatgggtaaattgggcatcttttaaagtgaagctctgtgactatagttctaaccatgggatcttaatagatggatacaccaagcaatgtgacaaggacatggtaaagggctttcctattacacagtaggtaaactcaggggagaaaaagcagaagcaattcataggctcaggtttgcatatcaaaagaatgaaagatgatgtgaaaagtgagggtacttctgaagtgaacagaaatcaaaatctagttaggttggtaattgggaccaaagtgaaagcaaagggggtaaaaataaaagtgatgagtttctgcagaacgaatttcggaagattgcagcaagagttgtgtgaaattgaatgagtgcaagcaggaaatggcacagaatagaaatgcaaaagcattaaacctccttcaatgggatcctaagagttctgcctgttatccaccaataaaaataataggagataaagagcccttctatatctgaactgctatatacaaaaagcatggtagaacaaagggagagctattcaaggaataaaacatcaagtttacagggagacaggaaaatataacagaacaagtttgagtgtaaaataaagataagcctgacaaagaaggagaatgaaaagaagagctaacatacatatgatgccttgaaagcccatccatttcataattttggtttttgaatgataggtagaaatgaactccacctaaatagcacttttgggatctggattgtgtcctacatattttgaaatttctccttgatttggggaatgaagtcttggaatcctttttgaagtcacgaaagaattgaatgttttaaatcttataaacgatggtccatgaattctctgggaaagaaaatcttcaactttattttcataatggtggcatttatattgtttacatacaataccttccttcctagaatgaggaatgtcagtagccattatcccaacccccctaatatacccccacataccaaagtcattatgtgttaatcctataggaaatgggcaatttttctgaagagattctaaattaaggccttttaaaatagagtattcttaaggagtaaaaatggcttaaagaaaattgatctgtgacgctgtagaagattcacagtttcagtgatctaattctgtaaacaccatcataatattatgtcatgcataatttattattgaaatcctgtgtgagaattctaaggttttttcatgtaccagagagttgctgagattggtaaagaaatgggttaactgtttaagataatggtattactctggatgggaggatgcaatcaatggggtttctaaatattccttttttttcaccattgtggaggtatttatatgtaatagatttgcttttacatcagtgttgaggagggaaaccacccaggatatgcttatattatattccttcccctttagtctctcccaaatatgcaatgcacagctgtttttaaatcaccattcagcatgtcattcaatttttattactctacattattataagtatccagtaaaaataagagtgaaatctgatgtggcttctaaaatcaatgagctatcatagaattgacaaaaattttggttgaaatttagagtacttaattatcacccaaaatacagatgctgaatttcatccttgctccagatgcttcttaaaatatcaaatgtttgagatctttcatttatagatttggttttacaggtgaacacaccaaagtttagcaatttttcacatcatatttatgttatatcctctctctcacgtgcatgtgcatgcctccccctcccgaaaccgagggttatagaaagataattactttttttatcctctgtgtatttttgcataattttcttccccatgttttgatttctctggagcaagtttctattagtgctgtcagtctgtaactgggccacttagtaagagtgggagaaggagacttttttcttctgtattacatcttccatgtgattctgcaactctgttttagtcatctgtccattcacgcttgttactcatgttatttttctcttcgtttctgtcttccccattccccacctccaggccccacacactcagatccatacttgcagaggtcattcctcctctcttccatgagaaataataattgacattaaagtagctaatgtttattgcgtgcttgctatgtgccagacatcattctcagaactttgcaaatattatttcatctaatctatgtaattggcttttctccaattttatttcaaaatttcaagaaggttatagaaatgtaaggcaacaaaaagggaaaaatcagacatgtcactcctgagatttccttttccagggcttgaagaatccttacacataaaagatgtttatagttccagatcatctatccaccaccagaaagggcagcccattcactatggatgtctcgatatcctgttttcaatacacacatctctgcttgtgaggcagttttaatgctccaagtcatcagaaaaggagagtgacttggtttcaaatgatgagtgaccaagataagcagtctgaagagtgggttaaaataaagtaaaatgctttgacaggaagaggtcaaagctggcagttgtgttttgaaatcttattaaaagaggctgacatcactaatatgaaagaaacttctttcttgttttttaaaacttttacgatgcatgaggtagacttctttttcaaaaaaaattcccatcttgagtccttgcaatatacaggaaacatgcagttaatgaaatgagaacaggttgaatttgtgataaaaattggtgtctggctctctgagttcagcaatataatttcatttttattagagtcttacctatctttaacattgaaaattatgctaagaatgaaaattttgaggagtatgtaccttacaaggttaagaaatataattttatttttatcaaattatgctcacattttgtgttaaaaattcactgaacgatgaaaatgttgagagaccctgaatcctattttcacctatttttaataaggatcttgtggtacctcgatactgatgtattactacaatttgccttaaaatggtgttcaccatacccctcttttacatgttaagaagtttcatctgcacaatgtgagatgatgttatctaaattcaattcacacatttggttcaaggttaaaatatccccgtccctcagtgaggtgggggaggaaaactgctttgtttaatgttaatggaaaaatttcacctgtgaaataatcttcaaactgtgaaattaaatcccccacgtatgttctatgctcatgccttcagccttcctccctctacaccgatctaccctgtctctggattcttttaagaaagtatttgaataccatgttgcatagagggcaaatcacaaaatctgggcaagaaggattatttatatgacttttgtgaaacctattccctctaaatattgactctccaactagattgtaagtttaatgaggagaagaacaaagattttaccttcctgtagcctcctacaatgcttcgtatagggtagtgcttaataaatacttaatgatattgatctgaaatagccagtttagttggtcagtaacaacccagaccacttaataacttgattgcctataaacatagatatatctatgcaccatggaccaacaacgtgggcatcacctgggagctcataaatgcagaatctcaggcctcacgccagacttacttaaccacgatgtgcatttgaataagttctccctgtgatttgtatgcacattaatgtctgtgaagcactgctccattgcattaaggattaggcactttaccaccatgaacatttctttctttctcttatatttcttcttgtatgtacctctttccccctcttctgcttatattataggcctactagttccctctacctttttagttcaccatgtatttccaagttttgtgaagactagtcctcacaaaaattctctgaactcttcataaagaatagtcaatatctagtcatttctacttcctcagctagttttgttaaaattatacaaacttaaataacaggggagaatttttagccttctcagccttatgttccctagaaaaatgttacctatagtttcgttcagaaatcatagattacaatattattcttttaaagtaatgagcagagttttggtagggaaataaactctccaaaagtaataatttctgattctcatagctatggaatcttacgttttgtatagataaggggcaaagcaagtaagggaaattcgttctgtgatttcagacacatgggggatttttatctttacctaatgtaggtttttgctgtgttttttctctgtaaaagccatggtgcttcaaaatttaatgagattatatgatgtattatcatcatttgcaaatgcaattatcagctgcgattaatcctgctaattccgagaaagccatattgggtgttatttttcccctcctcgtgggtatttgtgttgctcttactttatgaactttgatcagaactactgcagaaaggagggggaaagcaaatgggatgtatgaaataaggctttttatgactggttttatgtagacatttatgagtgcctaggaggaaacatctcacaaaaattcacttcacctggagagaaaacaatgtaaatattagtatatagatataatatatatattactaacaacttgtagaagaaaaaataatactggatatttcttgttgaattcaaacatatgttttattaatttgaagcaacatcagctccttgtatgtaactttctcaggatattcatttaggcattacatgtcaaggaagatgcgaatgactaatcctagagttctgagctctactgaagaaatcaaatggtaagtctcaggcaattactgtatgcatttgagagtaaatttttatcccaccagattacagatgagttcatcaattattgagcacttaagctcagctggaatcctatgaactactgtttccaagaattaagcaagaacacattttgagattgtgtcactgttgggttgcagttgagacaccttgctattaccatcatctctaccaccacataggtaggataactgcactccttgttagatcctttaaggcttgagatgagtgggttagaattaggacctacaattattaaatttcaatctaccagtggttttaactcttccttggtcaattgtgagaacaatcattgcaattatagtcccctctcaaggggctggcagctgcctttcttattccccacttgtgatttacttttataactgtgtttaatgcctgccaacaacttatatccccaactcttccattagtgaaagtcttggtaaggtgctgaagcagatataaagataagtgagggggataatgaaactgaaagaaatgaagttacttgtctttgattgcaaaatataatgggagaactatgactaatgagaggtgctcagttatttattgaacaaacagttcttcagacttgggggaaatttaaaagaataattcttcatcagaaacagctttggaatgctcatatatatagtcctacattcttattttgtagatgtggaaactatgtcccaaaccatgtgatttgtccagaactaaactaaacctgggtcatctgatacaagccagtgctgtttttccagcataatatctcaataaaattccataggccagctgtatctacaactatttggctcaatatcgaagtataacttctttgggctgaagaaggaaactccatcctaatttaaatcctagtgatataaataggatttaggatttaaattgggtggcaacagagcctgacaatccttaaggcttcttccaatgctaagattctagacataaaatccaccagtgtcaaaggtaaaaatgattcatgctaagcacagtgccatacacactagagctctgcgcctaccttttaaggaagatggaacattcaattactacataatcatgtttttcttgaaatgtactttttaataagggcaattctgtaagagtcactgtgggaaagtgaactgataatgtagatatactacaaagatctagtggtgagatcagaaatgatccagaaacctggagcaagtgagaagagaaatgccaagaagagaaaagtctatagtaagaaactacaaaggcaaagtagaaaaattcagaatcgttttagcactataaacactatacattgacgtggaattggttacttactattgagaagagaattgccaagggcaatactatctgtcttagtctgttttcagctgctacaaccgtatactacagattgagtaacttataaagaaaacaagtttattttggctcacagttatggaggctgggaaatccaagagcataatgttggcatctagtgaggatcatcctatagcagaaggtggaagggtgagagggtgaaagaacataatacagaggaaaagggagccaaacttctgtgctaactacactcactcccacaataatggtattaattcatgcatgaggatgatgaagatggagccttcatggcccagtcacctcccacatcttaacattgccatgatggcaacccagctttaacatgagtttttaagtgaacattcaaactataacacaactctttcaaagtgacgagtatactttctaatcaaaaagagaatttttttttcagtttcatataccataggctatttttcaatgtatatgtcattatacaaaaacaagaaatggggaaaggatttcctatttaataaatggtgctgggaaaactggctagccatatgtagaaagctgaaactggatcccttccttacaccttatacaaaaattaattcaagatggattaaagacttacatgttagacctaaaaccataaaaaccctagaggaaaacctaggcaataccattcaggatataggcatgggcaaggacttcatgtctaaaacaccaaaagtaatggcaacaaaagccaaaatagacaaatgggatctatttaaactaaagagcttctgcacagcaaagaaactaccatcagagtgaacaggcagcctacagaatgggagaaaatgtttgcaatctacccatctgacaaagggctaatatccagaatctacaaagaactcaaacaaatttacaagaaaaaaaccaaccccatcaaaaagtgggtgaaggatattagcagacacttctcaaaagaagacatttatgcagccaacaaacacatgaaaaactgctcatcatcactggtcatcagagaaatgcaaatcaaaaccacaatgagataccatctcacaccagttagaatggcgagtattaaaaagtcaggaaacaacaggtgctggagaggatgtggagaaataggaatgcttttacactgttggtgggagtgtaaattagttcaaccattgtggaagacagtgtgacgattcctcaatgatctagaactagaaataccatttgacccagcaatcccgttactgggtatgtacccaaaggattataaatcattctgctataaagacacatgcacacatatgtttattgcagcactattcacaatagcaaagacttggaaccaacccaaatgtccaacaatgatagactggattaagaaaatgtggcacatatacaccatggaatactatgcagccataaaaaaggatgagttcatgtcctttgtagggacatggatgaagctggaaaccatcattctcagcaaactatcgcaaggacaaaaaaccaaacaccacatgttgtcactcataggtgggaattgaacaatgagaacacatggacacaggaaggggaacatcacacaccagggcctgttttggggtggggggaggggggcgagatagcattaggagatatacctaatgctaaatgacgagttaatgggtgcagcacaccaacatggcacatgtatacatatgtaactaacctgcacattgtgcacatgtaccctaaaacttaaagtataataataataaaatttaaaaaaaagaaaatagtgtttttatctctttgtaatactgttttgttaggtgtaactttctaacactgtgtgtttaatggagtattttcctctcagtatgtgtgacttcttatgattctttgcagaaatctctacctactaccttaaagaagcttagctttgagatccacaaactctctggaaaataatctgtacataactttttaattaatttttttatttttaaaatttactgtataatatttaatcatttatcttgtgtctgtaagggttttgtattatcttgtgaaatgatttttgtcatcttttatgtagagttttgtttttgtttttagtcaaaccattttaaaagcaggtagggctcaagagtaaataaacaattgcatatttgaattgctcccctgaaagttagggtatattctattaacccagaaatgccaatctgacatagtgcaaatagaagtttttcccaaaatagtgcttggcaccttggtaatgtgcacatttcctcctattttattacctactgtggtgcaagggtttcactctcattttgggatggactctgaatgtttcatttgcatgccttttatggtggtaacagacgataatttttttacagatacagttttgctttttatcatcatttgtttctcttctacaagacttttaagttggctagttacagactatctgcttcttttaatgtttatatattagaaggtttaatagaagaaatagaatgtcactgtcgtaattggccatttcccccaccttaatagcattccagagcaaagtttctttagatagcaatgctaagcaaaatgcatttgtgcagcttcatctttgattcacccattcttataccatcatgaatgtttttgaaggtctttgccaaataatcttgccaaaggctctaggcctgctgcttggtatttgctgcacggactgggcctgaggaaaggtgagctaaaaagaaattagctgaaataatgagataattctagaacactagaaaatttagaattaacaaagttttatggtgttggataagtcccagcttcaaagcaatttctgaccatagcatttaaattatttcttaaaaaaatctcaatttatttacagctccatagtagagactataggaagtagagagactctgaggataagttattctcctgctgatgtgggccattgccacaggatgggtggagaggggacaatattgaaaacttaagagtaagctcttgaatgaaagttaggggtaaaatttacttggaacttatggcctttggttaagagagtggacttgactccaaatcctggctctgtcctttactagttgtgtgactttgggcaatttacttaacttctataagcctgcttcctcatatgtaaaggtggtaccaacaattcaattatataaatatattatcaaacagtgaaatacctgctatgtattaaatgttaataaatggaaaatggcattaatatttaattctcaatatttattatgattcccccaggtttctcctttcattaaaatatctctgaaaaatgtttcagcttttcttcttgctttttagttgcttctttaaaaacaaaatttattgaggcataacttatataccataaaaaccacccattttattgtatagttaaatgatttttagtaaatttgccaagtttttcaaccataaccataaaccagttagagcattttaatcacagctagtccttggcatccactgtccactttctggccctatggatttgcatattctggtcaattcatgtaagttgaatcaaataatatttggcttatttcacttatcaagatgttagaaaggttcatcaatgtgtagcatgaatcagtacttcgttcctttttatagttgaataatattccattttgtggatataccatattttgtttatccatttattagttgatgggcatgtgggtttgtttccattttttggctaatgatgctgctatgaacatttgtgtgctagtccttgtgtggatatacatgttcttatctcttgggtatatatctaggagtggaattgtgatggtattaatattaatagtagtatttactactatttcataattcacctgacaattagacagttacatagattcctatggcaaaacaaagtaagtaacttcagatgccccttaaaggagcattcctcaaaacaacataaatcagttagctcttaaaaaaattaaaagattcctatgggaaccatctttaatcacaggatagatcatttaaagactttttgcacatcacttttgggagaattcaaaagataatgttttggttttcaaacacctcaagttttgtcttgtctacacttttgtaagatacccatctgaatgtcaataggacatatgatgcctcagaaaggcaaagatttaccagtgattaatacagggtataaataatggtgtctgaatctgtgcatcaaagcaaggaagatagatcttgtgacatccctaccttttttccctgggatgcacaaatcagtccttaatagaagggggagagaggatgaatgctttcatgcctgtcaatggaatgaaatacaattctatggcaaggaaggatacacagtggttcatgcacagcaaagacatcagggctttctaggttttcagataagggaccatattcagatggccctcactttaagcaataattgagttcttgaaaataaatcaatgcagatattgcgggcctattattaatgtgtattttagtagcaactgggtgctagtttgtagaactagtcctcaaagcacaggcaaggctaactttctctttctctctctctctctctctctctctctctctctctctctctctctctcacacacacacacacacacacacacacacagagagagagagagagaataataaaatgcaaaattatcaagttctaatttatgttacaataaaatttcaacaaagggtaagttaggttgcagcactcaggttaattggtcaatgaagtcagattttttccattttcttttattgtagtttctctgctttataatcatttccctacccacatcttttataaaaaggaaatgaggtattctgatttgatctctggtggtaaaactcatttatcagtgtgccaagtgaaaaggatttagtaaggttagatggccgttgagcagggtttctcaaagtgtggccaggtaactttcttcatccaaatatccatttttatcaggctctctaggtaactgtgatgcacactggtttgggaacactgtagtggagtcttgatattcttatatttgctttacttccaactgtttattaaatgtaacaggtgggaagtaaaccaatgggatattgtaagctataattaaagaaaagagaagagagtatatgtgtgagaggtcctatggcttccatcagagtcttggacaactctgttaccccagaaaagattaagaactgttattggaaaccttgagtgagatctctggcttgagttccattccttttgtgcttctagctatgccaacagaaccgcagcatcaaagagttgcatcctcagggtttattatcatgatggaagggagcagatatcctgatactgttccacaagtactagagagggatgtagaggaactgcattgaaagaggtagcgatactctggtaggcaggaagtataaggtcttcatactttctgcctaccagagacagaggtataatgtcaccaggatcctagagtagaaacatcctagattgtagagggcaagagagttttagtccttgcttgctggtatgggtgaggaaactaaagaggcttctggagagcagtgctccagccctttgtcctgacgattctccttctctatgaagaaatcatctaatttttaaatttccttcccttgaaatacctaatttcttgcccttctgcctactgaaaatcctccttattatccaaagcctaggtctagccttatctcctccacaaactttttcacgatgactctttttccacattgatctctttcttctattgtgttttatagcatataatcagtggctcagtacatattgccttacataaaaagtgttacatgtatttgttttatctccacaattggctcataagctactggtaaacagggcataactgccctgactcctttgatatgaatcaacaaatctagcattataagcaccaggcacatagtgcgtattcagtgacttgaactgaagtacctggaatgtggatggcttatgattcttttttatatcatgagtataagtggagagacaagtagaataaatgagaaaggatgatttcttaaggttttttttagcccttgatgttataaaaatatttttccccagggaacatagcttcactttaatttattttttattgttacataatatttgcacatatttatggagtacatgtgatgttttgtggcatgcatagaatgtgtaatgattataattctcttcttaaaactgtatatgttccaagctaaggttctctttctttcttttccttttctatatttaagttctgagatacatgtgcagaacgttgaggtttgttacataggtatacatgtgccatggtggtatgctgcacccatcgacccgtcatctacagtaggtatttctcctaatgctatccctcccctagccccacaaccccccgacaggccctggtgtatgatgttcccctctctgtgtccatgtgttctcattgttcaactcccacttatgagtgagaacatgcagtgtttggttttctgttcttgtgttagtttgctgagaatgatgttttccagcttcatccatatgcctgcaaagggcatgaactaatccttttttatggctgcatagtattccatggtgtatatgtgccacattttctttatccagtctatcattgatgggcatttgggttggttccaagtctttgctactgtgaacagtgccacaataaacatatgggtgcgtgtgtctttatagtagaatgatttataataccttgggcacatgcccagtactgcgattgctgggtcaaatggtatttctggttctagatccttgaggaattgccacactctcttccacaatggttgaactaatttacactcccaccagtagtgtaaaagccttcctatttctccacatcctctctagcatctgttgtttcctgactttttaatgattgccattctaattggcatgagatagtatctcattgtggttttgatttgcatttccctaatgaccagtgataatgagctttttttaatatgtttcttggttacataaatgtcatcttttgagaagtgtctgttcatatcttttgcctactttttgatggggttttttttttcttgtaaatttgtttaagttatttgtgggttctagatattagccctttgtcagatggatagattgcaaaaattttctcccattctgtaggttgcctgttcaatctgatgatagtatcttttgctgtgcaggagctctttagtttaattagatcccgtttgtgaattttggcttttgttgccatactgctttcggtgttttagtcatgaagtctttgcctatgcctgtgtcctgaatggtattgcctaggttttcttctagggtttttatggttttaggtcttacatttaagtcttcaatccatcttgagttaatttttgtataaggcgtaaagaagagaactagtttcagctttgtgcctatggctagccagttttcccaacaccatttattaaataaggaatcctttccccattgcttatttttgtcaggtttgtcaaagatcagatggttgtagatgtgtggtattatttctgagggctctgttctgttccatttgtctgtatatctgttttggtaccagtactatgctattttggttactatagccttgtagtattgtttgaagtcaggtagcatgatacctccagctttgttctttttgcttaggattgtcttggctatgcgggctctttttgattccatatgaaatttaaagcagttttttccaattctgtgaagaaagtcagtgttagcttgatggggatagcattgaatctataaattactttgatcagtatggccattttcatgatattgattcttcctatccatgagcatggaatgtttttccatttgtttgtgtcctctcttatgtccttgagcagtggtttgtaattctccttgaagaggtccttcacatcccttgtaagttggattcctaggtattttattctctttgtagcaattgtgaatgggagttcactcatgatctggctctctgtttgtctgttattggtgtataggaatgcttgtgatttttgcacattgatttattatcctgagagtttgctgaagttgctcatcaggttaaggagattttgggctgagacaatggggttttctaaatatgcaatcatgttatctggaaacagagacaatttgacttcctcttttcctgattgaataccctttatttctttctcttgcctgattgccctagccagaacatccaatattatgttgaataggagtggtaagagagggcatccttgccttctgccagttttcaaagggaatgcttccagtttttgcccattcagtatgacattgcctgtgggtttgtcatagatagctcttattattttgagatacattccatgaatacctagtatattgagaatttttagcatgaagggctgttgaattttgtcaaatgccttttctgcatctatcgagataatcatatattttttgtctttggttctgtttatgtgatggattatatttattgatttgtgtatgttgaactagccttacatcccagggatgaagccaacttgatcgtggtggataagcttttcgatgtgctgctggatttagtttgccagtattttattgaggatttttgcatcaatgttcatcatggatattgacctgaaattttcttcttttgttgtctctctgccaggttttggtatcaggatgatgctggcctcataaaatgagttagggaggattctctctctttctgttgtttggaatagtttcagaaggaatggtaccagctcctatttgtacctcagatagaatttggctgtgaatctgtccggtcctggacattttttggttggtaggctattagttactgcctcagtttcagaaattgttattcatctattcagggatttgacttcttccttgggagagtgtatgtgtccaggaattttttcatttcttctagattttccagtttatttgcgtagaggtgtttatagtattctctgatggtagtttgtatctctctgggatcagtggtgatatcccctttatcatttgtattgtgtctatttgattcttctttcttttcttctttattagtctgtctagtggtctatctatttgttgatctttaaaaaaaaccagctgctggatccattgatttttggaaagatttttgtgtctatctccttcagttctgctctgatcttagttatttaaggattgtaggacaaatgcttgtctatcacaagaaaacatttttattaactgaaaattaactgtagctttaataaatttgaactcggagattttaaaaaaatacttatgcaagtgagtcagattttgtttttaaggggaaggagtgattgtccctcaaaggaaaattattgaccacttctatcacacttttatgtttctgaattgttctttgagagagaatagcttttaaaaacatcaaaaactctagatcttaacaatctaaggacccaaaacctttcagtgtacaattatagtattattgaaaaatagagaagaatgcaaagaggttgcataattgagtataataaagagtaacataatagagagtggagagggagtaagagctgagtatgagcaaaatagaactagtaggtgagaggccatgggcaagtagaaacatgtctagcaataaaagtaaaaagaagaaaaaaccataaaatagaaaacaaaggtaagaggaagactgtttacggtaggaagtttggaaaaaagtgactaagagcaaaaacattgctgacaccagtgcattgcacatgttccagcaaatagtggactgcaattaacaaagctgattctcacctgttcttaggtaagctactgaatgcaacacaaagggttactaagagaggcctcttgaccaaaagtggttccccccactacgtgtgcctggaattcccacaattagactctttctttgagttaaggcttggcattttcagaagtcatctcttaaagggcaatttaaatagactggaagggttaaaatacatagagctttaatatctgctatgaactcttcatagattggtctttcagaatacttttaaatgtgccagctacccaagaggagcaaagcactgcatgatctgaactgtctagcctcatctcttcctaatccctaccttcttattacactctagccatgaatgaacacatcatggttatttgttatcctgtgactttttatgtgcattccttcgctcagtatgccttcctcctacctttctatcaactgcagctcaaaaagcatctcctctgtgaagcctcacttcagttgccttctcttgtacttccatagcaatttacatatgccttactttgagcagtattgttgatgtattataaatagtggtttcagtatttgtgttcctctctagaccacagtttcatatccataaaccaaactatgcttattccataatcacacgaatcacctagtaaggcagtactgtgtttaacatagtttaacctctctgcacctcagttttgtcatttaaaaaccagggataacaacaacgataacaaatagtattattgagagatttaaataaaataatgcatgcaagtgatattaccttagtccattagatatttcaagcctaaatatatggaaaaatacgaaagaaaggagttaggaaatttgaatactatttggggttcctgcactaactcacttttcattcccagcaaattaccaaggcccttgtttttttctatttccaacacgcactgccaagatattgatctcttacattccctatgtaactattgagtttaaatagaaagagtaacctaaaaggagattggagcctctcagagtgagatagctaagaaataccaggtgttgctatggctgagaaattgccagtcatctttatcacagttgttgccaattcttgagggcttacttataatgtgtccatgcactaggccaagtattttgtttatggttctctatttttagtcaattataaaccaaggttggtttgtcactgggcaggcatgcaatgggagtatttaagtacagaattgagtagcctgggagaatatggctgtattctttagtagcatgttttgctttcttgcagaatatattttttcttttcttcctttgtttacagaaatctgaagaaaaccataccttcaactattgtgtgaagtttatgtcatatctagaagctagttcatggaaaaagctacaaaaattgaaacactagctctataaaaatcagccataagtgccttcttactggaatgagattactaaggtataattagtagtaacacatatattagcaattagaaagtcagtagaattgaggcatgaacaaaagaccatctgttatgagagaaatatccaaccctcataatcagtaggtaatagatactctgttcttgaaacataacagttaaaggataacaaaggaatgtcttattgcttgctaaaaaatactcttgggaattccccaaaaagagctacactgtaatagtagaagttctgatttttaaaaattgagctagaaataaatctggcaacaatttttctctaaccttatcctgatgttcagggactccctcaaaagtaattatagaactcaactgttcatttttaactaaagtgatttctggttatgattaaaataaactttgaatttaaaatctctctaactcatatataaaattcatataaaggatatttggtttgcctcctgaatataggaatcataagagaccctggagatcaggggaaaggtcccagattttggagccaaagaaacctgaaacctgagtattaaagttctgccttacccatctcatgtgcaatgtgtggccctaggaactgattgtgtttttgttgttgttgtttttagatggggtttccctgttactcaggctggagtgcagtggctcaaactattgtgctcaggtgattcttctgcctcagcctcctgagcagctagaactgcaggtgtgtgccactacagccagctatttttaaaattttttgtagagattggtgggggggagggtctcaccatgtttcctaggctagtcttgaactcctggcctcaaaagattctttcatctctgcctccaaaagagctaggattataggcgtgtatcactgggcccgacctaggcagtgtcttaacctcgttaaaacttaatttccttctctgtaaaatggaagtaataatagttcctagctcagagtgttattgtaagttttaaaggaaatagtgcagtcaagcatttagcagcttctgctgctgttgttgtgacagacagaattctggacagggtggaccagggatttacattgaatgacagtctgatgtctttatttcatggagacagattggtctagcatctgtaaagtgaggattcataacattagtacttactacataaggctatgaaaatgcaaattgattatatatgtaaaacctgcatagtgcctggcatgtatgtagtaagggctcaatgaatgttagaaactattgttatgttttggcacagtgtctggcacctaggctctcaatatgtgttagctcttattgctatctctgggaatctagtaattatcaggtgacagagatgccccagcattgtctagtgttttgggaaaccccacacttctcatggacttgaacagtaactcagcaaggtggacagaggactgaaaaaataaatgacacctcttatataatgtatattagataagggagaatgaagactttatgctaaattaggtgactaggcatacgtttaaagatattccatccctgctttagcatatccatttattttcacataatttatcatggttatttgaacagtgtcagcaggtttctaagacaaagccacactgcaaaatcagttggcatctggtttctcttcagttctaatctgattaccagatctaacttaaggagatagacttgaattatttccagagaatccatgtaaacattccagaaatcccttgagatgtacttaagtgaaagttctggtttgcatccaattgtaatgcaaggtcagggtctccaacacaaatgtcatttcaatcttttagtgattattctttcagtaggagcatggatattagttctagggtgctgtggctctagggccatctgaagggctgtgtgggtcagggaaaattacactgaggaattgtcctacatatttttatctccatgaaatcaggttaaaagaagaacgaaaagagatcagtgagatggagggaaagcccattcttaggtatgctgctcggagtttatgggtggccgtggggcttatatacatataagctcaagaattatagaccgctctgctgtttgcctcactgggtcacttctcagtccatcagcagtgcaattcttcccaaaacaccagccagcactgacaacatctctgccctgagtaattatttagtgtacaggggaattctcaggatatcgattgtttcaggagactcagatatctatgatgttaacccattttcatttgccataactatgcctactctattaagtttacttgttctttaggtgtttttgattatgactaggattggactgcccaaaacaatacgtgggtatttgcctatgataagctaacttgaaccttcttatttcttccctttctttctgccttcctttttaccccatttattcaaatagtaaataatatttgagcatatgcttaccatatgacagaaaggcagaatatagagctggagatacataatggcaatcaatgcatgcatagcccttgcccttagacaatacatttagggtgtgagcattcacatcaaccatataaattgtaggaattggtaagtgtatggaggtaatgcttaatgtatacttctgaaccctctgtatattgttcttatccttcataagatttatgtcagttctcatttcccatgagaaaaattttaaaaatataaagaaaatatagaattagatgcagcatcccatacattatgtatatacatatatacacacattatatatatctatagataaatttattttttaacatacagatttgaaatatttatagactaagtttactgaaactcttgtaaagctaggcagcctagcacttagaaggatgaggggatgtaagaaatgtgactgtttccaaacaattctcttattctcattttgctctcagagaaaataaagaagaatcagattgtataatttctgaagattctgctattttatttttaagtgcctcttttctaaaggattcacagtcacacgtattaaatgacttaaagacacatccttctctcctctgtctcaatgaatagtttggtcaagaaccagaagaagtttaaaacttaacactctaggttactgaggaagtttgaagagtcttttcttggatatcccaggctccttgactttcagctctgtgatttttcatgggtgctaaccacacagatagttggcatgagactgtcttgttaaataggatgtgagagacattgaaagcttcccccaccagcctcctcagaggtagagatgccctcccctattacagtggctcctttggggcctctggaagactgtatttaaatttcaaatatctgctcttagagggctgcgttacactgttctgtctcatggaggaaatggttagtgggcaagcagattttctcttgtggagaatggctcagaaagggtccaaaacctgtgaaatgccttcaggtggatttctacagtttaagatcggaagattctaaggctgctgaatcttggtacttcttgatagcagctgtgaagcagagatgtatatacatgaaaatgaaaaacataaggcactagatgaaagagaaattggtgtagaaaggagatagaatgttagtgacctaatataacccttccctattttataattttgtcggtctgacactgccttcctgtaaagagctaatcacaatataaggattagcattctcaagttatctgctccacttgactgtgagtcctttgaaagtaggaaccccaattttagttgctttgtatcacttgctcctaggtcttgcctgatatataataaatgttcagcaaatgctgggttaaaaaaaaaaggaatgtcatttcaggggtctgaaactttcgaatcttctctcacattctttattttggccaaaggtcttatcagatgtcttccctgatcaccctatctaaaattacaccatcgtgctccagcctcttgttttattttgctatctagcagttataactatctgaagttatactatatgattaattcttattctgtttattatctgtcttctctgatataatctaatactcttaatggcagaaaccttgtgtacgtgtgtactgctgcatctccagtacctagaacagtgtccaacacaaaatagcatctcaaaaaatatttttgaagagtgtgccaagagcttgaggatgttcttccaagtggttttgctgcattaatttttgttatatttggattccaaataatatcagatatgtttggaagataatattaaacatagatgcttagggaaagaaaaatctcttttaattctaggtttaattgctccaaatagtcaataaagtggtaagaagaataaaaaagtagaatagacatttaataagaaagccttttggcaacataagtatattatattttactcttatcggggcaggtggtttttgtaagtacttgtttatttcaaaagggtggtattatttgaattaattcactagttaaaattctcagagcctaaaagtgattttttccatttcaattatctttattttctaaaatattttcaaagacagtggcttcatgctgaggatagaggatgtagttgaagaactgtatgtagctcatgattaactgaaactctgtgaaatgagcctcttcatgtatttggcaattattatacttctttaaaatatgattcaaaagatagaaataatattttacaacataaagatcatttgtcttgttttattgtatgttctgcatctaacagttcacttaacgagaatagtcccttgtgtcaaattcaaattctcatttggcacttttcctatacaaattgctttctgcccatcatacaattttgctttgaagcattctggcaatgggtgatatagggagacttagaaccaaattctgcttttaatatggaactggaaacagtcctttcatcttccaggtgatctttatatcatatgtatacaacactttctttttcaaaagtctaccctctggattcagctatgataactatcgagcacagataattaagaacttaggctcttacaatgtttaaagtagcccaagagagcatagaagttctgttcttagaggttcagaaacaggtgaggactgatggtaacaaaggttgtgaaaattcgacattgctggttttgttgtttagggcaagtggcagtctctgaaatatttactggttgagcagagaatatttgttatacttctccaatcaaaagagaaaagaggaattgttaccaataactgaaagcttttacaactctctaacttccttataaggtatagcttctgggagatgtgttgggcagacttcagtaaaagaagatagcatgtttatgttgacagagatgggtcagttacagatttgtccagggattctcattagttgttatctttctgttaacttctttccaacttctgatgtatgagtacagttgttacagtgtttttcacaattttcttttgttttcttgattaattttttttttttggatagaaatacattttctatgcctacttatagcaagtcaggctttgtctttctgaaccattttctctgtggtgacatttggaaatgaacttacaacgttttccactgtgtattgtagggggattattatagacaaaaactcttttaagatacctttttttgttcctgcttagaactattatcagtttcacaaactctttagtcttcttgtcttaggtaggatcaaggaagaaaagagggaagtttcaaaatactttttctagttctccctgcttattatcacaggagaaagctaaaactttgttacaagtaaatcctttaatataattttatttgaacacttatagcactacttattgggcaaccatgtggttagaaccagcttttttgttttttgtaaaacagaattgaagttgaaacaattacttctgccctctaaataattagactgctatactctcctcaaagtataagctgattagactttatctttgacttcagtgtgtttctggcctgccgctaaatgtcaaattaatcttaaacgcccataggattaatgttgaaaattgttacacattttttattcattcatcaatattgcaatatactccctttttcctctttttgggtatggggctgtaaagtttatttgatttcttaaagcacaaagaacctcattgatctcaacataaaacttattatgttactgcaaaataaacatgaaaataacattgaaaaactgtgttcatatattatttataagaaaaagccatttgtaaatgcctgtcagtgtttcttgtagtgcttccctttttaaggaatccattaaccatgatattgttttatatttgacaaaaactattttatggaagaaaagagtgttgtttaagtaactgcagctgtttctgcagtccaggtgggaagaataaagacatctggtttgtttgaggaaacacattaatgagtctttcagttatgaaagaaaggccctgagcatagggtagaggttgaaataaatgggaactaattgattttcccatgaagataacaacattttgaattttctaccagacagcaaaaaagacaagagttgggaccaggaatctgcggaaaagcattgatgggggaatgggctccagaaacatgatagctggccagcactggaatacaaccatgagaagaactgaagcccgatagtcaatgtctactagttgttacctgctctgtgcagcaatcttcctcagttaggctaacctttagtgaaagcctacaggtttgggtaccctttatgtgaaatgcttgggaccagaagtgttttgaattttggattttttaaaattttggaatatttgcattatatttactggttgaatccctaatctgaaaacctgaattctgaaatgctctaatgagcatttcctttgagcatcatgcaggtgctcaaaagtttcagattttggaagaagtaaaattatactgctttgcagataatataatcttatatttgaaaaaaattaaagactccaccaaaaaactattagaactgataaattcagtaaagctgcaggatacaaaatcaatattttaaaaaatcagtaacatttctatatgccaatattgaacaatctgtaaaacaaaaaagtaattctgtttacaatagccacagataaaattaaatacctaggaattaaccaaagaaatgaaagatctccataatgaaaactgtaaaacactgatgaaagaaattgaagaggacaccaaaaaatggaaagatattccatgttcatggattagaagaatcaatattgttaaaatgtttatactacccaaagcaatatacagattaaatgcaacccctataaaaataccagtgacattcttcacagaaatagaaaaaaaatcctaaaatttatatggaaccacaaaagactaagaatatcccaaagctattctaatggaagaatcacattatctgacttcaaattatataaccaagcaatagtaaccaaaacatcatggtaccggcataaacacagatacatagaataatgaaatagaatagagaacccaaaacaaaatccacatacctacagtgaactcattttcgacaaagatgccaaaagcatacactggggaaaagacagtctcttcaacaaatggtgctgggaagacgatatccatatgcagaagagagaaactaggcccctgtctctcaccatatacaaaaatcaaatcaaaatggaataaagacttaaatctaagaccacaaactatgaaactgatacaagaaaacattggagaaaatctccaggaccttggtcagggcaaaaatttcttgagcaatacctgacaagtaaatgcaaccaaagcaaaaatggacaaataggatcacatcaagttaaaaagcttctgcacactaaaggaaacaatcgtcaaagtgaagagacaacccacagaatgggagaaaataatttaaaactacccatctgagaaggattaataaccacaatataaaaggatttcaaacaactctatagggaaaaaatctaacaatatgagctaataaaaaataggcaaatgatttgaatagacatttcccaaaagaagacatacaaatgagaaacaggcatatgaaaaggtgctcaacatcattgatcatcagagaaatgcaaatcaaaactacaatgagacatcatctcaccccagttagaatggcttatatccaaaatacatgaaataacaaatgctggtgaggatgtggagaaaagggaacccttgtatactgctggtgggaatgtatattagtataaccactatgaagaacagttgggaagttcctcaaaaaactaaaaattgagctaccatatgatccagcaatctcactgctgggcacatacccaaaagaaaggaaatcagtatattgaagagatatctgcacacctgtgtttgttgcagcactgcttacaatagctaagatttggaaacaacttaagtgtccatcagcaggtgaatggataaagaaaatgtggcacatatacacaatagagcactattcagccatcaaaaagaatgagatccagtcatttgcagcaacatggatggaactggaggacattatgttaagtaaaataagccaggcacagaaagacaaatatcacgtgttctcacctatgggatctaaaaatgaaaacaactgaactcatggacatagagagtagaagtacggttaccagagactgggaagggtggtggagagctggctggaagctggggatggttaatgggtacaaaaaatagttagaaagaatgaataagacctactatttgatagcacaacagagtgactatagtcaataataacttaattgtacatataaaaataactacaagactgtaattagatttatttgtaatataaaagattaatgcttgatgggatagatatcctattctccatgatgtgcttatttcatagtacatgcctgtatcaaaacatctcatgtatcccgtaagtatatacacctactatgtacccaatcaaattgaaaattaaatttttttaaaagttttggattttggagcatttcagattttgcatttttgtattaggaacattcaacctgtacatgcaaaagcagtgtgtgagtagcaccatgaggagtcatgcatagtgggttgtattaacatctggagtgagtcagtgtagagaaagaacttatcagtaataatgatgccaagattgctgaagttgatcaaggattgactgggaagctagaattcagaaataaaggtaatgaaaatgaccaagaaatataagggcatatcaaagaaagtgctggattacctgcaattacataagaacaaggacttgagttcttttctttagatattaaaagaaagtataagtccagaacgttagagaagtaggagacattcaatttatatatatgaggggttacgagcataaatacatgctcctggagcatggtgaatttataaatacttatgtatttagattttatatatttttcattcttgtacttggtcagttgtgccgtctttaaataaagctgttcaagatctgtttgcagtacctttgtattttgcttgagtgcaccaatttttatcttagatttatgaagtctaattatcattcaacgtctttgttcaagccctagacacatttttccttgttttctcatatctcaattttcaagttaatgattataatgacatcatgattttatgttaagagtcttttttttttagttgaggtctttttattttattttttattttttatttatttatttttattttattattattatactttaagttttagggtacatgtgcacaatgtgcaggtttgttacatatgtatacatgtgccatgttggtgtgctgcacccattaactcgtcatttagcattaggtatatctccaaatgctatccctcccccctccccccaccccacaacagtccccagagtgtgatgttccccttcttgtgtccatgtgttctcattcttcaattcccacctatgagtgagaacatccagtgtttggttttttgtccttgtgatagtttgctgagaatgatggtttccagtttcatccatgtccctacaaaggacatgaactcatcattttttatggctgcatagtattccatggtgtatatatgccacattttcttaatcctgtctatcattgttggacatttgggttggttccaagtctttgctattgtgaatagtgccgcaataaacatacgtgtgcatgtatctttatagcagcatgatttataatcctttgggtatatacccagtaatgggctggctgtgtcaaatggtatttctagttctagatccctgaggaattgccacactgacttccacaatggttgaactagtttacagccccaccaacagtgtaaaagtgttcctatttctccacatcctctccagaacctgttgtttcctgactttttaatgatcgccattccaactggtgtgagatggtatctcattgtggttttgatttgcatttctctgatggtcagtgatgatgagcattttttcatgtgttttttgggggcataaatgtcttcttttgagaagtgtctgttcatatccttcgcccactttttgatgggtttgtttttttcttgtaaatttgttgttcattgtagattctagatattggccctttgacagatgagtaggttgcgaaaattttctcccatcctgtaagttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatgtaagtctttaatccatcttgaattaatttttgtataaggtttaaagaagggatccagtttcagctttctatatatggctagccagttatcccagcaccatttattaaatagggaattatttccccatttcttgtttttgtcaggtttgtcaaagatcagatggttgtagatatgcaccattatttctgagggctctgttctgttccattgatctatatctctgttttggtaccagtaccatgcttttttggttactgtagccttgtagtgtagtttgaagtcaggtagagtgatgcctccggctttgttcttttggcataggattgacttggaaatgtgggctcttttttggttccatatgaactttatagttttttccaattctgtgaagaaagtcattggtagcttgatagggatggcattgaatctataaattaccttgggcagtatggcaattttcacgatattgattcttcctacccatgagcgtggaatgttcttccatttgtttgtatcctcttttatttcactgagcagtggtttgtagttctccttgaagaggtccttcacatcccttgtaagttggattcctaggtattttattctctttgaagcaattgtgaaagggagttcactcatgatttggctctctgtttgtctgttattggtgtataagaatgcttgtgatttttgcacattgattttatatactgagactttgctgaatttgcttatcagcttgaggagattttgggctgagacgatggggttttctagatatacaatcatgacatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttactattttgagatatgttccatcaatacctaatttattgagagtttttagcatgaagggttgttgaattttgtcaaaggccttttctgcatctattgagataatcatgtggtttttgtctttggttatctttatatgctggattacatttattgatttgtgtatgttgaaccaaccttgcatcccagggatgaagcccacttgagcatggtgtataagctttttgatgtgctgctggattcggattgccagtattttattgaggatttttgcatcaatgtttatcaatgatattggtctaaaattctcttttttggttgtgtctctgccaggctttggtatcaggatgatgctgacctcataaaatgagtaagggaggattccctctttttcaattgattggaatagtttcagaaggaaactcttctggtagaattgggctttgaatccatctggtcctggactttttttggttggtaagctattgattattgccacaatttcggagcctgttattggtctcttcagagattcaacttcttcctggtttagacttgggagggtgtatgtgtcgaggaatttatccatttcttcgagattttctagtttatttgcgtagaggtgtttgtagtattctctgatggtagtttgtatttctgtgggatcgctggtgatatcccctttatcattttttattgcatctgtttgattcttctctcttttcttctttgttagtcttgctagcggtctatcaattttgttgatcttttcaaaaaaccagcccctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatttccccgtattcattccggagcaggttgttcactttccatgtagttgagcagttttgagtaagtttcttaatcctgagttctagtttaattgcactgtggtctgagagacgttttgttataatttctgttcttttacatttgctgaggagagctttacttccaactatgtgttcaattttggaataggtgtggtgtggtgctgaaaataatgtatattctgttgatttggggtggagagttctgtagatatctattaggttcgcttggtacagagatgagttcagttcctgggtatccttgttaactttctgtctcgttgatctgtctaatgttgacagtggggtgttaaagtctcccattattattgtgtgggagtctaagtctctttgtaggtcactaaggacttgctttatgaatctgggtgctccagtattgggtgcatatatatttaggatagttagttcttcttgttgaattgatccctttaccattatgtaatggccttctttgtctcttttgatctttgttggtttaaagtgttttatcagagactaggattgcaacccctgccttttttgttttccatttgcttggtagatcttcctctatccctttattttgtggctatgtgtgtctctgcacgtgagatgggtttcctgaatacagcatactgatggggcttgactctttatccaatttgccagtctgtgtctcttaattggagcatttagcccatttacctttaaagttaatattattatgtgtgaatttgatcctgtcattatgacgttagctggttattttgttcgttagttgatgcagtttcttcctagccttgatggtctttacattttggcatgtttttgcagtggctggtaccggttgttcctttccatgtttattgcttccttcaggagctcttttagggcaggcctggtggtgacaaaatctctcagcatttgcttctctgtaaagtattttatttttccttcacttatgaagcttagtttggctggatatgaaattctgggttgaaaattcttttctttaagaatgttgaatattggcccccactctcttctggcttgtagagtttctgcagtgcgatcagccgttagtctgattggcttccctttgtgtgtaacccaatctttctctctggctgcccttaacattttttccttcatttcaactttggtgaatctgacaattatatgtcttggagttgctcttctcgaggagtatgtttgtggcgttctctgtatttcctgaatctgaatgttgacctgccttgctagattggggaagttctcctggattatatcctgcagagtgttttccaacttggttccattctccccatcactttcaggtacaccaatcagacatagatttggtcttttcacatagtcccatatttcttggaggctttgttcatttctttttattcttttttctctaaacttcccttctcacttcatttcattcatttcatgttccatcacagataccctttcttccagttgattgcaatggctcctgaggcttctgcattcttcacgtagttctggagccttggctttcagctccatcagttcctttaaggacttctctgcattggttattgtaggtatccattcatctaattttttttcaaagtttttaacttctttgccattggtttgaatttcctcctgtagcttggagtagtttgatcatctgaagccttctcctctcaactcgtcaaagtcattctccatccagctttgttctgttgctggtgaggagctgcgttcctttggaggaggagaggtgctctgctttctagagtttccagattttctgctctgttttttccccatctttgtggttttacctacttttggtctttgatgatggtgatgtacagatgggtttttggtgtggatgtcctttctgtttgttagttttccttcttacagacaggaccctcagctgcaggtctgttggagtttgctagaggtccactccagaccctgtttgcctgggtatcagcagcggtggctgcagaacagcggtggctgtagaacagcggatattggtgaactgcaaatgctgctgcctgattgttcctctggaggttttgtctcagaggagtacccggtcatgtgaggtgtcagtctgcccctactggggggtgcctcccagttaggctactctggggtcagggacccacttgaggaggcagtctgcctgttctcagatctccagctgcatgctgggagaaccactactctcttcaaagctgtcagacagggacatttaagtctgcagaggttactgctgtctttttgtttgtctgtgccctgcccccagtggtggagcctacagaatcaggaaggcctccttgagctgtggtgggctccacccagttcgagcttcccagctgctttgtttacctaatcaagcctgggcaatgcgggcgcccctcccccagcctggctgccaccttgcagtttgatctcagactgctgtgctagcaatcagcgagacactgtgggcatagggaccctccaagccaggtgcaggatataatctcctggtgtgccgtttttttaagcccgttggaaaagtgaagtattagggtgggagtgacccaattttccaggtgccgtctgtcacccctttctttgactaggaaagggaactccctgaccccttgcacttcccgagtgaggcaatgccttatcctgcttcggctcacgcacggtgcactgcacccactgtcctgcacccactttctggcactccctagtgagatgaacctggtacctcagatggaaatgcaaaaatcacctgtctgctgtgtcactcacgctaggagctgtagactggagctgttcctattcggccatcttggctccaccctcttatgttaagtgtcttattaaaaactacattcaccagtgtgttctgtgacacatctaattattcacataaagggaatcactttcaaaaaattggggaaatactgtaagccagagtctacagttcacattaagaaactaatagtctctgagaggtcccacaggggaataaaaaaaattaacatggtttaatgtagctttatttgactatggaactcactttttacctaatacctatttatatcccatggaactaatgttcattaaaacaaataatccaaagtgtttttgcattatctcacttattctcacaaataaaatattaaaaaggatttactggtcaaaggagaaaaaatcacataactccaattacatttaaagcatatttatatttaaagagattacactaaaagcaatgtgtaccttttattccatgagaaattaatttaatctgactgcttgcatcttattctccacttaagtttgctgagcatcttttctttattctccttagtacagtgttaaatatctacagtcatccactgaacaaatattccacagcattgcttttttttgtataagagtcttttatgtttttaatccagtatctcccatagtctacatggttccctctaccaaccatggcctctatggaagatcatgaggtatcagtgtcattcttttggtaatgagacaaaatcaaaagtaactcctcctcccaaatttgaccaatgtctacaagaaagacactttacctgaatttatcccttcttaattctaaatttctggtcacctcattgaccctttcccactcccagcacccaagaacacagacccctgaaacaccctgggagcatagacaatcatggatccaggccatatcctgtcattaagattttagaaatgagaacacagaaagtttaatttatttaatcaagatcatacagctagttaatagcaatgtagaaacagtaatctaaatttttggccacatcttggcttctctggctcatggatcaatctctggtattttagagtttccaaggccaacgactacctcttacaacatacacagacacttacatatatacagaagccaaacatataccacatttggaaaaaggcatcagtgagatatcttacaggaccatttactaaaataaaataaaaattccagaaatatttttcttatgaaaattcaatgacagtttttgtttccacataaggtttttagagaagacttgcttgtctgtcctgcacctgctctaatgtcatggaatgcctgaaagagtctcttggtgtcaataacccacatgttcaagaattccccaaatttcacgaacgttacaaactataatacttttatggcattgaatttaaactctcaacagtgatgcacaaaaattagccatgacagtgcttttggagatattgcagcaaaacatgataataatatacaatacaaagggataaaaaccaaagctcatagatgtctacataatgagatcttctattcagaattactatatatttatcttcaccatattgacttgtctagagaaagtggagaaactctatcttagctgacaagttaactccccatatgcttccaagaaacacggaaatctagaagatgaagtcattcttctgtggatattaacatgcacaattttgcagacataaattttttgagaatctcttagaaaacaaagggagtaggaaaaattagtaagaggatcaaataaaagtgttgtctaagagggctgagtggaaacttggtgggatgatgctcattatcttgatgtcagaattggttgttgaatggaaagataaaggagaaatgatggagaagatggtgatattacctgacagaaggctacaggaaaattgaggagtagtgtgaaagtgatttttttgggaaaactgaacaatatgtattgttgggggaaaatgggcctcaacagagtgaagtattcttgtcacggaaaagatagaaaaagggttgggtagttacagggggacaacaatgccagactggggagtgtggactggatacaagagaatgagggagctcaggatgagcagaagggcggggaagcaatattcattaagcaccttctatgtgccagtcaataggccaggcttcaaattattaccttgctgaaatcttcacagcagccctctaataggtatttatccctgattccatatccatgctctgcttcccctcctattacaatggctgaagaattcaaacccctttcaaaggctagcactgtcatttgtcctctagatcccatcccctccatttttctttttattgaaacattctcaatggtattcaaacatactctgctctctcttctattaaataggcaaatgcaactcatcaagctctttttctcccttgctactgccccatttctctacttcctttcatggcagaacttctcgaaagagtttttcacaatcacttcatttccacacctctaactgacttttgaacacaactagaggaggagtaggaggggacactcattccaaagtgtccaattaagcccaatcctttaaaagtattatgttgtcatgatggctgttaagagcatggtgaaaagatattagaataagatgtggggaatcatgaccgtgagacagagaaagtagtcaaaggttttccaccttttaaaaatgtacttgatcccccactaattgcacaaactctgcccctcagacctagatccacccacagcatcaggcccacacttctggcttcaatccactctattctgtcctctatccactccaataaactgaaacagttcctattagagttcaccaatgaccatcattttgcaaaatccaatggtaacttccctgtcctctttatactcaacctctcagtagcatctgatcctgttaaccatgtcttcttgtaccaccatttctgctggattgctggatatcatactctcttgtttttctcctagtttactgtctagtcattcccactttcctttatgtgttcctctttctctgacttttaaatcttgaactgcaggccactggggcagaggaagcatgcacactagtgcatggtgtttggtatctcatcataccactttggtggaagagcagtggctgtagaatctgtttctttttttaactttgattttagattaaggagtatatgtgcaggtttgctatatagatgaattgcatgtctcggaggttttggggtacagattatttcatcgcctatgtaataagcataataccctatagattattttttgatcctcaccttcttcccagccttcatcctcaagtaagccctggtgtctgctgcagaacctctttctaggtatatgattagtgactgaacctccagtgccctgtctcctggtgctagaggattatttatttatatattgcattaacttctagttacttctttgcacctctgccctctttctgcattttgcatccctacaggactatgccctttggaatttatcctcctgaattcactttttacttaactaaagtagtatattagagaggacagacaggtagtttcaataagggaatatcaatgcctataagctctgttgtcatatcaaggaaaaatgacatatttcagtagaattaggaaatggactttctcttgtttaagggctgtgaggtggtaatttataagggaagattaaaagaacaaagtacatataacttggcttagagggaggtctaaagatctgcaaatatctctaactgcacaaacattagcaagagaaaatattgatttagcttagtacaagctacaaggtgctgtaactaagaataatgaagttaaattttaagaacacagagagaatgccatgaaaatattagaataaaaatagagtgagctatggaatattctgcaaagggaagcttttctaataaagggaaaacagctctgtgagatgaaacaaatcgttgttatgcaagatcagtgacatcctcaactccaagtctgcacaaatgtaagaacactagttttctatcttgtgttacattaattgggatgacagttcctatgcttctcaacatacctataaataggttctgggtcaacttctgcctgtaggtattccttgatcttttaaagacaatgattacccacttaattttttcacttcagagaacatacagaaaaagagaggtccttcacgtcccttgtaaggtggattcctaggtattttattctctttgaagcaattgtgaatgggagttcactcatgatttggatctctatctgttatcggtgtataagaatgcttgtgattttttgtacactgactttgtatcctgagactttgctgaagttgcttatcagcttaaggagattttgggctgagacgatggggttttccagatatacaatcatgtcatctgcaaacagggacaatttgacttccttttttcctaattgagtaccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcagtacctaatttcttgagagtttttagcatgaagggttgttgaattttgtcaaaggccttttctgcatctattgagataatcatgtggtttttgtctttggttctgtttatatgctggattatatttatcgatttgcgtatattgaaccagccttgcatcccagggatgaagcccacttgatcatggtggataagctttttgatgtgctgctggattcggattgccagtattttactgaggatttttgcatcaatgttcatgaaggatattggtctaaaattctcttttttagttgtgtctctgccaggctttggtatgaggatgatgctggcctcatataatgagttatggaggattccctctttttctattgattggaatagtttcagaaggaatggtaccagttcctccttgtatctctggtagaatttggctgtgaatccatctggtcctggactccttttggttggtaagctattgattattgccacaatttcagatcctgttattggtctattcagagattcaacttcttcctggtttagtcctgggagagtgtatgtgtcaaggaatttatccatttcttctagattttctagtttatttgcgtagaggtgtttatagtattctctgatggtagtttgtatttctgtgggatcagtggtgatatcccctttatcattttttattgtgtctatttgattcttcttttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttctctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccaggtagttgagcagttttgagtgagtttcttaatcctaagttctagtttgattgcactgtggtctgagagatagtttgttataatttctgttcttttacatttgctgaggagagctttacttccaactatgtgttcaattttggaataggtgtggtgtggtgctgaaaataatgtatattctgttgatttggggtggagagttctgtagatgtctattaggtctgtttggtgcagagctgagttcgattcctgggtatccttgttgactttctgtctcattgatctgtctaacgttgacagtggggtgttaaagtctcccattattcatgtgtgggagtctaccaagggacgtgaaggacctcttcaaggagaactacaaaccactgctcaacgaaataaaagaggatacaaacaaatggaagaacattccatgctcatggctaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacgctacctgacttcaaactatactacaaggctacagtaaccaaaagagcatggtactggtaccaaaacagagatgtagatcaatggaacagaagagagccctcagaaataacgccgcatatctacaattatctgatctttgacaaacctgagagaagcaagaaatggggaaaggattccctatttaataaatggtgctgggaaaactggctagccatatgtagaaagctgaaactggatcccttccttacaccttatataaaaatcaattcaagatggattaaagacttacatgttagacctaaaaccataaaaaccctagaagaaaacctaggcaataccattcaggacataggcattggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaatctactcatctgacaaagggctaatatccagaatctgcaatgaactcaaacaaatttacaagaaagaaacaaacaaccccatcaacaagtgggcgaaggatatgaacagacacttctcaaaagaagacatttatgcagccaaaagacacatgaaaaaatgctcatcaccactggccatcagagaaatgcaaatcaaaaccacaatgagataccacctcacaccagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacacacacacgtatgtttattgcggcactattcacaatagcaaagacttggaaccaacccaaatgtccaacaatgatagagtggattaagaaaatgtggcacatatacaccatggaatactatgcagccataaaaaaggatgagttcatgtcctttgtagggacatggatgaaattggaaatcatcattctcagtaaactatcgcaagaacaaaaaaacaaacaccgcatattctcactcataggtgggaattgaacaatgagaacacatggacacaggaaggggaacatcacactctggggactgttgtggggtggggggaggggggagggagagcattgggagatatacctaatgctagatgacgagttagtgggttcagcgcaccaacatgtcacatgtatacatatgtaactaacctgcacattgtgcacatgtaccctaaaacttaaagtataataataatataaaaaaagaaaaagagagtatttgtgtggcacactggatatcacggcagactagccaggggctctggctacatctgaccctgctaaaccactccaaggactgaggggatagatatgttggctcacctggaagcaaatcttggcatactattgttcttcaacacactttttaggaagcactgtgcttttcatttagacttgggaggcagccagtctccaacccccaactcccaatcccttcttctattcctcctgtttcactaccttcttatggctctactgaaataagtcccttccgtctttctctttcctcatccccttctcaaagcagaaaaaaaaaaaaaaaacatgttttgctttgacataataatccaaacaatttctcccaagatccttacaatgtggaaagagagccatagtcagtatatcctgaggaggtaggtaggcatttttctagttctctaggacacatctagcttaccactactgtttacaagtctgagttgaagggaggcaatggtcaattgttacaaacttcataaactgaccaatgaatatttgcctggtccatatttaggttgttcttttcatcatgaaaagttccccagtttactaaccactagcaaaggtttgtctcttaaaagttgctaagtctaaataataacaacaaactaaaattctagaattattgagtctgattttatgagtatcaattacagtattttaattatatattcctgatcatacttaaggctgatgactatttaaaatttggcaaaaagaaaacacaacagtcttagagtactaagccaagttgtaatgctcaggccactaaatgcattaaaccttgtactcagaacacttgtataaagcctggaacacttatcagaatgtcaaaacaatcaggaagataacagtctttgcatctgagagattcagtgggataagtggaaagagcacaggaccaagacttaggagttctgggttctctcaagtcttgttcctgtcatttgcaaacattgtgcacttaggcctaccagatcctcccaagtgttaatagttttgtatttaaagacgaatgtggttagatatggtgaactgaacataggcctgaatctctactccatccctaaaccccactgaaatgacattaaaggaataaaaagggtataactcattaaaaaaaagactgagtaggaaatgacatcagacagggggtggtaacaaaaatttggaagctggaaagcagatggacaagtgttacactgactcagctgaccttgggaaagctaagcctaagcctgaagaggagggggatgcaaaggcaagaagcaagcccatttccaccatagaaccccagaaagtttcaaaagttagaaatatcaaataaattttcaggcagggaagtaggttgagactgaaaacaagtgaccttatgaaatgtctttaaagcaagtagttagacccctagatatctttcccacactgtactcccagataattgaatcctccactcctattctgattggagacagaaggtttactctttggggaggcttaactactcaggctctaggcttaggaacagtaggcccagctgaggacagcaaagatgacttgtactgaaaacagggaaaataagggaaagtctacatagtcaacaatgaacgtcccaatgccctttttccatactcagtttccagaaacaggtagctaaacttctaccatggtatagattggagccagaggacagataactctaagagcaatacttccaagtggaacatgagcctgatagcatgctgacaacttgaatgtgtagttagaggaggttttcaattattcagagaatttggtgatgaattaattactggtatatagaaagctaagcaactgaaaaaaatgagccaattaatgagctccagaaaaattaaaatgtcatacaagcaaagaaaggtaatcataatagagtgagtagctcagctataaataatgtgacataatcaacaatattgtaaacactgaactgatttaaccaactatggtgtatgtgctgggtagaaggggccttttaggaaagtggaattctcttcttataataggaagtcagcaggtactacctaatattgaattttaaaaaataacagtgtaagtgtataatttagatgtgtatgtggaggcaaacatcagaagaaaaagagcagagagttggatgttgtttactttgggagaaaatatatcagcagttagacagaacagagcaggggactgctctttgcattacaagcctagtagtactgcttgacttttattgtgtttatttatttttaagtgacaggtctcactctgttactcaggttggagtgcagtggtgtgatcatagctcactgcagccttgaactcctgggcttatgcaatcttcccacctcagcctcctgagtagctggaattacaggcacatgccaccagacttggctaactttttaaaatttttattttatgtatttcacagagatggtgtcttgctatgctgcccaggctagtcttgaactcctggcctcaagaaatcctcctgcctcagcctcccaaagtgctgagattacaggtgtgagctaccacacctggcactgcttgactttttaaagtatgtacatttattacttagattaaaaaattaatcttaaaaaattattaaatttggctaaataacctttggtctttcctattttgaaaatgtaatgactatgcaaaacattaatagtttcttctgagagcttgaacctcacactctttcatgaaattagatattacttaggaagagaaaacattaagacttccagatcctcatagacttcctagtacatgaagtgctcaagctactcatgtgggttgtttaaactgcagtttaaatttagtttggtgcatttactttctgccacatatatatgactgtttctactttggatattgcatgacatccacatatatgctaatcctgaaaaatagatggaaagcaaatatggcttgaagtaaccaggaattgaaaaccaccatgaatagtgtcagcctgacccaggagagaactttttatgtcccatgaatgactcttaccctatctttcaatagtggctgcactctgctttctgatcagaatttctctctggattgaaacttttatttccttctctttgcttgattcttagcatttactgaaaaacatcagttaccagtgcttacagacatcactagcagtaattatcaaattccagactaaacctaccttttgcttcctagtgaatctaagagctgattcttctctctcccattcctctttgtccagtccctgcattatatccagtgcaatgcatttaaaaaataaactacacttgacttcctaagaaccttggctataattttaaataaaagaggttggtgaccatcagcattatgtgtaagtcctgtttactggtaggtttgagcacagtgtccattcttgtattcttactaattgctattctattagacaccattcgtttttcattgtcctttctctacatcgcctactttacctacataagcactaacctttttttttttttttgggggggtgctagacctagtaaaagggccaacacaagcaatttgtctcaggcatttctctatctcccttgttctgccgccttcctcccatttggcagatagaacctttcacatgattttaaaccccattctgcccgctcccttcactcctgaatatctagaaattccagtaaaattccttccacatacaagaaagcatcccatatccacacctatctcaccctcccttgcctaacagaacttaactccctggatttccattcagcttgagctacgttctttctcatcacatgcagggagttgcatataccccttacatagagagttcttttatttttgaatgtagacttaatttaaatatttgaatttggcttaaaagatgatgcatatctagtagacaccattaaatattattccaaaaagcatcacagctttagcaactcatatttccttcaggctttttctttcagattaattcaaactattaattttgaacctctatgtatgctcggtatgccattttactctgtgtaaaattggcatgctgttttagccaattaaaacggaaaatatttctgtttggttttaattgatttatctatttattcacttactattattttggcaagaaagggagttcacttccctgaactatttcctttggattgagaattcttgatgttaggttgagtgttaatggttttcagtccagctgttaatgatgcaggattcctatgctctagggagattttagaaggaattaagtgtgaatacctcctcacctgcttgtcttctattctaacaagagcttttgctcattaaaaagtgcctgctctagcttaattcttctcagagtgaacacttcaggattatgcaagcaggctaggtagtctcctctgattcaatattcatacctttgaaaagagatataatgtgatgaaaaatagagatgctaactgaagaacaactattatttgctattaccaagaaaaactggatgacattaaagaaaatcccagattaaccatgtgaaaaaacttaatctgggaaaagaaactccttctgggagtcagtagattgagggaaaagaagagagatagaaagaaatggaaggtatagaacaaacccaatgaaagcatggtgactcaacagcctgaagtatctgttttagaaacgacttcccagaccaccactgagaccagtgcgaatgcagaagtgagcaagtaaggaagcagctctgtaaaggaagaaggaatagagatcacatcgcagcaggagtgtccattgtgacagtctaggtaaaagagagagaggaaccacagctgtgaggggacaagttggttcctcaaaagatattaatgaggttttcatgacatgtgtcaggatgcaaatgacaggggaagagtccacttaacaatggagttgtcaaagatgtaaaaatttgcagcactacttcaatattatttcacttacttaatgtattttcatgcttaatgaactaaatcactggactgatttgtttagggcagcactgtccaacagaaatataatgtgcactacatatgtaattttaaaatttctggtaaccaaactaaaaaatataaaataaaacaagtaaaatgaaatttagtaatttaacacaatatagtaaaaataaccattttaccaactaatcaatgtaaaaaatcattgatgggatattgcacattttttttcatgctgatacttcaagacctagtgtatattttataattacagcatatttcaatttggactagtcctatttcatgtgctcaatagtcacacgtggccagtagctgccatagtggacagtgtacatttagaggaactcatttttgcatcactacctatgaagtagtcttgaaaacaaaacaaacaggatatgattaagccactatatctgaactgtccaacaccgtcaacactagcaacatgtagaaatttaaattaattaaaactaaaaatccaatccctcagttgcactaaccccatttccacttctcaataaccacatgtggctagtggctcctctgttaggcaccacagatttacagacttaatgcctttatcttccaaactgaaaattagagaacaatgtctaaatcactggcaatttgtatcatccttgatgaaaacaaacatttcttctttttcatttcattccaaaatccccttttgccctgtcaacttgttcccacctatcccctcaataaaaccttaccatggtcttgcctgcaggatgcaaaattgtttgagagagtactgaaaattcagtcatgagggtagcatttcttactacttatggtttttttttttttcaagtttcatagagacctgtggcatcttgtgtttagaatatatagcaaacctggtaaagagtggtgaggagtggatttctgaaaatgctgacatatctttgaaaatattataatcttagctggcactatgacaattgtagaatgtatggtttgaaaattaaaaagaagagaaatggaaacatatagcaacattcgtttttaccccttcttcatgttaggcagattttctttttcttgtgggtgctctgggcattgttctaacttggtatttgcaagtcaatggcaaggcctgttcagtgctgagggaattacatagtcatagacaattagtcttttaaaaggtctgctgcttggaaatttgccactaaactcagtatagcctcagcacataatgtaaattcttaatgattataacttttctaaattcagcccttaacaaatctcataatagtgttttgaaacttttaaatcaaacataacccaattaggttggtatttgattaaactgaactgccacttcactgaagtgtttaaataaatcaacattaatatgcttttattatagtaaataaagttacttctatgtagttgaaatgtcaatactcacacatagctcttgaaaattaagtactccttgcactttgaataatgaatccagtattaattggggggaaactattgatttctttttataggcctgtggaagtactttgccccaaaactctacaagttcttaattaaaaaaaaatagtaaactaaatatctgttaaattctgaaactactgtcagagttgtccttatagtggttctgattcatggccttttctccctaaaaatgcaacacagactgatccttcaaataataattataaagaatctttttcattctaattgaataaaattgttagaagattcttggatgctttgcttcccacaaaatacttgcactgtgtgtccaataatagattttctctagcagatagtcattatcaaaggttaactagcatcaagtggtagaaaaaatcctgtttctgtccataggtgcagcatggtgaattccaatatctcatctaaggagtaaaaagtatgctttttggaagtaggactcagtacagctttccatttgtcatttctattgctattctacaggtagttgctataagatgatgctacatttttttatggcattcgcagatttacatttcattgatattctatctttatgtatactttagcagtctatttgatttttgactggttgtctgaatcctctgtaggatgagtctcaaagtagcctaaattcttatttaagtactctctaacagtgtgttccttacttttaaaaagttaagcctaaaagaagtctgccttggaactcttgtttactggacatagatgtttacacatttttgttacaagatctttggggtgtcgattttcctcccaaaacctctgtggccagtgcacctttgcctgagtttttgtcctgtgtcccaggtccaggaagaatgaggtacacagacaagtaaagggtaaagaagtcaaagaagagctttactgttagaacagctcagaggagacctgcagtacctagatcctctgaaggcaggccatcccctgagtgttcagctctcagcagagaggaggccctggagagggtggcttttctctgcaggcagattgttcagacatctctgcaggtctctgaagctctcagcagagagggtagctcctttgtgcagctggtcatccagttgtctgtccctcctctgccctctgccctgctccaagttgggtgcttttacggacctcggaggagaggaagtgcgtgctgattggtccgagggaagccatgggtgggcccagagcaggcacactaagtccccattccagtgggtctgcaggactggcagctgggccctcagccttcaggccctccctggcctgaatgtggggacctactggggacccacccctttttgcccaggaatctgtctgcctcctgctgccatttatggccctgggctcagcccaaccccactaccacatcagagcaggcgccaggagaagacagaggccaggcagcggagcagacaccccgagcctgcagggactggggggtcatgtctgcccctgaggtgcaggctgcagagatgcacaggtcctgtgcctcggagggcagccgcagctgcacccagggagcttctgctcagccaactcagaatgggtggggctcctgcttgtccctggcttctgcctggtccatggagtgggaagcccaggtcttcagctgctggtcagccagctgcagctgcatccgagagggcagatccccccaagagcacagggagggtcggatccactacacagtttgggtggccgtagccccgcccaggagggcagggctcctgtctgctccaaagagcaggaggcctgggtctgcagccacggtttgggcgactgcccctgtatctggggagctcctgccctaactcagaaagggcgggcctcccaccggctgcatggagtgtgcagctccagccatgcctccctgcggtagccggtgtgatggcagcagccactgccatcagtttcagctagaacaactatgattaattagaattagcctgggagttgaacaatgagaacacatgaacacagagaggggaacaacatacaccagggcctgttgagggtggaggatgaggaaacggaacttaagaggacgggccaataggtacagcaaaccaccatggcacacatatacctatgtaaaaaacctgcagtttctgcacatgtatcccatttttgtttttgtttttgaagaaataaagggacaaaaaaaaggattagccttgttatgactgacagaaaaccttaaataagagtgacttatacaacgtatgttacttttctcatgcattcaagtgcagaggtacacagcatggctggtatgggctagctctttgatcttgcagctcttccatgcttagcctatattctaaggcatacctcatggtcaaagaggccttcctctagccatcatgtctgcattctacccagcaaggagtaaagggaagagaaggacaaacttttccctttaaggacattctcaggagttgcatgctctgcttccacttagagcccattgtctgggactatctcctggccacaactagccgtaaagaaaactgggaaatatagtctttatgctgggtgaccatgtgttcagctaaaaatttagaattctgttataatggaacacaagggatattgaaagaaaattaggtgtctgtgtaatactgttctctggaatggaactcatggtcagcaaaagactataccgtgagcctggaagctgttgttagaaaaataaagaaagcaactaagattctgttagagctttccaaaagaagtacttaaactaccttttttttctggtttggtattttttcagagcccctctcatcacagcatattaaaactcctgctcctctcatagaccttaaatcccttggatttcagctgtttctttttttttttctttttttaactttaagttccaggatacaagtgcagaatgtgcaggtttgttacataggtatacatgtgccatggtggtttgctgcacctatcaacctgtcatctaggttttaagccccatatgcattaggtatttgtcctaatgctttcgctccacttgaccccacctaccgaattgccccagtgtgttgttcccctctctgtgtccaagtgttctgattgttcaactccctcttatgagtgaaaacatctgctgtttggttttctgttcctgtgtaagtttgctgaggatgatggctagaataatcagttggaaatgcagaaatcacctgccttctgtgttggtcttgctgggagctgcagaccggagctgtttctattcgcccatcttgtcccctcccctcagctgtttctcatcaaaacttcctgtactgcctgaagaagttactttccaattttccaccctagcataatgtatcatttagagaaaaaaagctgagttcttttctgaaatgcctgaaaattttattcttttccattttgcttttttcttttgccacacattaaaacacctctgctgatgttaaagctgcctgtacaaccccaaattaattgaagttttggagttgatcaagtaataataataatagccactgtgttttgagtgcttactctatgccaggcaccatgctatgggtgtcacttacattgtgtcattaagtcttcagaacaactcgttaaggtaggactatagatgaggaaactgcagcccacagagattacataacttgcccaaatccttatagctagtaagtgattgagtatagaatttatacctaagaaaacagagtctagaacctcctcctcccacacaccctgattggttgatattacagtatgtcctcacttaatatgttcatcaatagattcttggaaactgtggctttatgcaaaatgacatataacaaaaccaattttaccacaggttaattgatataaacaaatagagtaaagttctcacagcatatgtctggtcaaaaaaacatcaacaaccttttaaataaaaccaaaacacttataatgttaaacaatgaaataaatgtgagcaatacttacatttttaaaagatttaattagccaggcatggtggtgtgcacctgtagtcctagctattttggaggctgaagtgggagaattgcttaagcctaagagttccaggttacattgagctatgattgtattactgtactccagcctgggtagcagagtgagactctgtctcgaaaaataaaataaaataaataaaaacaagataattatttacccactgattacagtcctgggtggcaggtggccagagcctattctggcagttaagggtcaaagtgggaaccctctgtggacaagacaccatcccatcacatggcacactaatacacacacacacacatacacacgcatacacacacactcacactgagaccacctaacatgcacagctttgggatgcgggagggagccagagtacccagagaaaacccacatagatatggggagaatgtgtaaactccacacagatagtggccctagcaaggatgcatttttttttcatcatgagtaaaatgatgttgctttgatgttcaagaaactgctgtattgtatatggaaaaatctagatctgtgctatctgatatggtagctgttaaccacatatgtctgtttacttttagttacttatttgtttgcttccttaagacagaatcttactatgttgcccaggctggccttgaactcctaagctcaagtcatcttcccatttcagcctccccagtagctgggactacatgtgcataccaccatgtccagcttatttacatgtacagttaaattgaaattaattaattttaaaaaagtctcagtttttcagtcacacagtcacatatcatatgttaattagatacacgtggctagtagctactatatggaacagtgcaaatatgaaacattgctattaccacacagaattttcttggacagtactgatctagataaccctgctcctaacctagatttctttttagcctaaattgtctggctggctgtgtagatatggccaaagagaaataggtgcagcctcttaaagaagatatctgaatttatcattctgccccataaatttcacatttgtaaacaaatatttaagtgaaaaatgtgaattttccttgaatattatctccaaaattatcaacccattaagatatcctcattataacactatttgttatgtatatgtgaatagttcactggtgaaatcatgtcagacatatttcaattctacatagttgtcttagtctgttttggctgctataacaaagtcccatagactgggtggcttacaaacaacagaaattttttctcacagttgagatcaaggcactggcagatttggtgtctggtgaggtcctgcttcctggttcgtagacagtggtcttcttgctgtgtcctcacatggcagaaagagcaagggaggtctttgggcctcttttataaggacactaatcctattaatgaggactccattctcattatctgatcacctttccaaaagccccacctcctaataccatcaaactggggattaggtttcaacatacgaatgttgggggaaacacaaatattcagtctatagcaatagttaatgtctgatataacacagctgacatacatagccttcatggcatctgttagcccttttagcattataaagaataagttggttcttattatttttagcattacacagtgaatgttttgattggcaaaaaataaaataatgaggaacacaagaatacttatctgtatataggaactacacacagtcactctaatctcatcccattggctattttatgatttaatatttaaattgaaatctaaaacgtgagtacttagtaaaaagactggatttgtctgtgaatttgatgtacagtcaaatgcaaaatcttattctttagaattgcccacagttacaactccgaaaccactgtaggaaaagcccccagtctcactaaatcactctgggttttttcctgaaaaagcccagtgggtttgcctagttggaaattctatattaagagactactctggtagttggccaggaaaagagcaaccaaaatgacttaatacactactgcattcaattaggtccacttttcttctttcaaaggtgaaaggagaaacatttgactttaaaaagcaacatcttcctataattcgaatgtctattctttgtgtgcttaagaaaacattcagaacagaaattgcaaatatctcattacaattttgaaagaaaaaaatgacagctttcttctagtgaatattacaaattaatgattttcctacatatatttcttatgaatatatgtagctccaactaaaaataataaaatgtcatattaagaaggcaaatattctcacctccatatactggaagtcttctttgtgctagtaggtattctggaaaatctaaatttgcatttcaatcaaagaacatcaataatcggacagagcagactgatgatctttcaaagttccatttcaatgcacctctgagataaaagaggacttctgacaattttcagcatcctgtattgcattgtctattttgaggtattatgtaaaatccaaaaatatgttttgtcattataaaatccatacctctgaactggtttaaaaaaataagcatcttaacaggtatgataattacagtaccaatttgaagaaatcaagaactttaagattgggagaaacagttaagatcatctaaaccacagagaactcaccattaccattggatgtagtagatcagaccctgaatcctgaaggagaaaatgtggctgtaagtctcagctctgagattatttgtgagactttgtctaagtcactttctcttcccctggacctttgtttttctactctgtaaagagaaattaaacttctttcatatctaaggtctatgtacaatttcttgctatctgccaaaagttaagcagccatttatatagtactttagcagactctacttcagtaaaacactaaattagctagactatattactattaattaaatttggaggaaaaagaggctaaaccccaagcaagctagtatcgggaattcatatgaaaaaatgacttctaggaaatgtttttaggtcaaaacacagtcctagacattataatttttgcatctcctgctctgtagagtgaatattgatgtgcatggtgatgaccatgacgttctgaatggccattattgcccagtaacaatgcagtcctatgtgctagactgcattcacttgagcttcaactcaatttgcctgggccatttaaaaattaaaaataattttaaacaggagttgaaagcaacaaaatgctttctgctcaacttttgttagacaattcaattacctacaatatcctattctgtaagcatactagttaatcaaggttttactgtgtattctttaaactagcaagttagttaattaattggaggaagtgaaatgtttggccaggctagatgtctgcactgatgtaactgcttggattttattgttatgtttagtaaggagcaaaattgcatgaacagtgacatgtgtatgtttggctaaggaaaaggcactttatttatggtgagaatggtcaggctttagcagaagtagttgaaattgctatatgatacccagattatacagtttcccagctgatccagtaaatgatcctgaggcctccttacctatttctaggaacatttattaatgaattatcttttttggtcttatttcctatgccaaacaataatctagctacctccatctatcagagtccccttataatgaaggaaacagcaggatctctattgtggggaaggaagtgaagctgttcatctttgtatctctaccacaaaccacagtatctagcacatagtagatgattaataaatgacaaataaacaagggattatttttgactgattggttattttatttttatttatttatttttttttaatttatttattttgagatggagtctcactctgttgcccaggctggagtgcggtggcatgatctcagttcactgcaacctccacctgctgggttcaagggattcttctgcctcagcctcccaagtagctggaattacaggcatgcgccaccacacccagctaattttttttttttttttttgagatggagtctcactctgtcgcccaggctggagtgcagtggtgcgatctcggctcactgcaagctccgcctcccgggttcacgccattctcctgcctcagcctcccgagtagctgggactacaggcgcctgccaccacgcccggctattttttttttgtattttcagtagagatggggtttcaccatgttacccaggatggtctcgatctcctgacctcgtgatctgcctgcctcagccttctaaagcgctgggattacaggcgtgactcaccgcgtccagcctaattttttgtatttagtagagacagggttccaccatgttggtcaggctggtctcaaactcctgacctcaggtgatccacatgcctcaacctcccaaagtgttgggattacaggcgtgagccactgcacctggcctgattggttattttaggtggtagagtaataattgctctttcagggacagttttgtagtcatcttacattaggtttctcaaacaaattttagccaagaagaaacaacatgttacctgaacatatgtggaaacttaacctcttcctttctgtgcccctgctgtcaataagagaaaatcagccaaatctttgataacaaatgtctgttgtaaagacacatagtagagattcaattaaatttgttaaatgaatatgttggaaacaagggcaacttatcaaataaaggtagagccattttacagacttttttccttttctccagaaaaaaaaggaatgtatgacttagaacaattcagataatatcattgataacatggagaaggtatgcacatggaaggaaaaaaattttctgttaaatatgaacaagacttggcaccaagtgaggaagatgccatgtcagtttccatgatggaagccaaatatattaataagggtaatcacaaaggcagtttttgtcctaattacagttaacccttgaacaacatgagggttggggcagtgacacctcttgcagtcaaaaatccatgtataacttaaaaaaatgtgaatacacagtagatgtatatatttttggggtacatgagatattttgatactaacatacaatgcataataattcacgtcagggcaaatagaatatccatcacctctagcatttattctttgtgttaaaaacaatccaattatatccaattatactctttcagttatcttaagatgtaaaataaattactgttgactagtcatccattgtgctatcaaatactatatcttattcattctatttaactgattttgtactcattaaccatctccacttccaccccacccccagtacccttcagagcttttggtaaccatcattctactctctatctacatgagttctgttgttttaatttttagctctgacagatgagtgagaaaatatgataattgtctttctgtgtctcacttatttcacttaacataatgacctccaatttcatccatgttgttgcaaatgacaggatcacattctcttttatggctaaatattacttcattctgtagatgtaccagatgtgccaaattttcttttctttcttttttttctttcttttttcgagatggagtctcactgtgttgcccatgctggagtgcagtagcacagtctcggctcactgcaacctctgcctcccgggttcaagtgattatcctgcctcagcctcccgagtagcttggattacaggtgtctgtcaccatgcccagtgaatttttgtgtttttagtagagatggggtttcaccatgttggcaaggctggtctcaaactcctgacctcaagtgatccaccttcctgcctcccaaagtgctgggattacaggtgtgaggcaccgtgcccagcccacattttctttatatgtttatttgttgacagaaacttaggttgcttccaaatcttggctattgtgaatagtgctgcaataaacgtgggaatgcagatatctctttgatatattgatttcctttcttttgggtatacctaacaatgggattgctggatcatatggtagctttatttttagtgttttgaggaactgccaaactcttctccttagtgcttgtactaatttacattcccgctaacagtgttcaagggctcccttttgtccacatcctcgtcagcattcattattatcttgttttggatataagtcattttaactggaattagatgatatgtaattgtagatttgggtggggacacagagacaaatcatatcattgcccattcaatatggtactaactgtgggtctgtcatatacagctcttatcgtgttgaggtatactccatctatacccagtattttgagtatttttatcatgaagaaatgttgaattttatcaaatgctttttcagcatcaattgaaatgcttgtatggttttatccttcattctgttgatatgatgtatctcattaattgattagcttttgctgaaacatccttgcatcctttgggtaaatcccacttggtcatgacgtatgatcttcttaatgtgttgttgaatttgttttgctgtattttgttgagaattttgcatcaatgtttattagggatattggcctgtacttttcttttttctattctttttctttttcttttttttttttttttttgatatgtctttgacttgttttgttatcagggtaatactggcctcatagaatgagtttggaagtattctctcctcctctatttttcagaatagtttgagtaggattaatattatttcctcttaaatgttacttttctgttcacatgttggatttctttatgatttaatcttggtaggttgtatgtgtctagaaatgtctcattttcttctagattttttaatttattagcatatagttgctcatagtggccccaatgttcctttaaatttctgcagtatcagttgtaatgtcttctttttaaattctgattttatacatttggttcacctctctttttttcttagtctgattaaaggtttgtttacaccgtttttactttcaaaaagccagcttttcatttcattggtcttttgtattatttttttatttcagttttatttctgctgtgatctttattatttcttttcttctagtaattttgggcttggtttgctcttgcttttctagttccttaatatgctacattaggctgtttatttgaagtttttcaactttttaatgcaggaacttattactataaactttcctcttagtgctactttcactgtatcccataggttttggtatgttatgtttccattttcatttgtctcaagaaattttcatattttcttcttaatatcttcattgacccacttgtcactcaggagcatactgtttaatttctttgtgtttgtacagttttcaaaattcctcatgttatttatttcttgttctattcccttatagtcagataagatgcttgatattatttcaatgtttttcaatgttttaagacttgttttgtgatctaacatatgttctatccttgagaatgatccatgtgctaaggaaaaataatgcatattctgcagccattggatgaaattttctgtatatagcagatccatttgttctgtagtgcagattaagttcaatgtttctttagacagatcttccagaaagaaaatcaacaatgatgaaagtgccttgttgacatctccagctattaatattattgcattgggacctatctctctcttcagctctaatatttgctttatatatctgagtgctccagtgttgggtgcatatatatttatacttgttatatcctcttgctgaattagcccctttatcattgtatagtgacctgtctcttcttacagtttttgtcttgaaatctattttgtctgatacaaggatagatactgctgctctttttggttttcattggcatggaatatctttttccatccctttattttcagtctgtgtctttatgtatgtctcttgtaggcagccaataattgtgtcttgttttttaattcatacagccactctatatcttttgattggagagtttagtctatttacaatcaatgttgttattgataggtaaggacttactcctgctattttgttatttgttttctggggttttttgtagtcttctcttccttctttccttccttcctgtcttccttttagtgaaggtggttttctttggcagcgtgatttaatttcttgctttttatttttgtgtatccactgtatatttttttatttgaggctaccataagacttgcaaatacaatctaatagctgaatattttaagctgataaaaacttaatgctgtttgcataaacaaacaaacaaacagaaaagttctataaactctacaccttttttgtccttgctttttaactttctgttgtttctatttctatcttattgtactatctatatcttgaaaagttgttgcagttattattttcgattgtctcatctctttgtcttgctatttaaggtaagagtagtttacacactacactcatagtattacaatattctgtgtgtctttgtacttactattaccagtgagttttgtatcttcaggtggttacttattgcatattaacatcattatctttctgactgaagaactccctttagtatttcttgtaggacagatctagtattaataaaatctctcagcttttgtttttctgggaaagtattttaccttcgtgtttgaagtatagtttcaccagatatactattctagggtaaaagtattttttttccttcagcactttaaatacatcatgccactctcgcctagcctgtaaggtttccactcagaagtctgctgccagatgcattgaagctccattgtatgttatttgtgtcttttctcttgctacttttaggatcctttctttatatttaacttttggtagtttgattattaaatgtgttgaggtagttttctttgggttagatctccttggtgttctataaccttcttgtacttgaatattgatatctttctctaggtttgggaagttgtctgttatccctttgaataaacttcgtagccctattttgttctctacccccttttcaaggccaataactcttagatttgatcttttgaggttattttctagatcttggaggcatgctttattgttttttattctttttccgtttgtctcctctgactgtattttcaatagcctctcctcaagctcactaattatttcttctgtgtgataaattctgctattaaaagaatgcatcaaaattcaagcaagccccagaatttttctattattttaatctctttgttaagttcatttgataaaattctgaattccttctctgtgttattgtgaatttctctgagtttcctcaaaacagctattttgaattctctgtctgaaagatcacttgtctctgtttctcaggattggtccctagtgccttatttatttagttcattttgtgaggtcatattttcctggatgatctgaatgcttgtgctcacataatgacttcactctccttcctccaagcacacagattatctttctgtgccaagtgctcacctcaggggatggggtaggggtggtgtaggtgattcaagactgtcttctatccttgtcaatgcttatttccttaatatgttgtttgtcagtgtctgcaaattgatgagttaggtatttattttagtctgggtttcttttgtactcattcttcttgagaaggctttccaggtatttgaagacttggatgttgtaatctaagccatacctgcattaggtggcaccccaagcccagtaatgctttggttcttgaagactcacagagataccaccttggtggtcttggataagatccagaaaaattatttgaattaccaggtagaaacagatgccttgttttcttcccttactttctcccaaacagagactccttctctgtgctgagccacctggaggtggggatggggtgatacaagcatccctgtggccacccacagtgactgcactggatcagacctaaagccagcacagcactgattcttgcccaaggctcactgtaaccactccctggctaccacctgtattcactcaaagcaccagggctctacaatcaccaggtggtgaagctatctaggacttttttcttccctacatggtgataagttaccccaggactcaggcaggtccagagatgctatttgggaaccaaggagtggagtcaaaaaccttagaaatatacctcgtgttctattttactgcatcagagctggcactcaaaccatgagatgcaatccttcccacttttctctcccccttccacaggcagaaaagtctcacccatggccaccaataccacaagcctatgggtagtactgccaggctggcacaaatgttctttccatattatgatgttaaaaccaggtactgtggcctcttatctgatttttggttgttacgaagatgctttttttgtgtgtgttgatggttgttcagttagatgttccttgggttagggatgattgctgtaggcttcttttcagccattttgcttcaactcttccaatgtataacttggctactcaaaatgtaaccactaatatctggaaaccttgttaacaacatagttgattaacacatattttgtacattatgtgtgttacattctgtcttcttacaataaagttaaagaaaatatcattcaaaaatcataaggaaaagaaatatatttatttatcattaaatggaaatggatcatcataaacgtcttcatccttgtcttcatgttgagtaggctgaggaggaggaaaagggaagggctggtcttgccatcttaggggttgcagaattgaaggatgtgaaggtggaaggggaggcaggagaagcaggaacactcagtgtaacttttattgaaaaaaaatctcctcctcctcagcttcaaatcttaaaaatgcaagggcaggatcaagatcggttccctttgactcagagtgaatgcaaatctgtggagcttctaaaacctacagaccatatgtactgacactaaataattttaaactgatttaggggactgcatgttatatagttttctggaaacaaagctatgagactgaaactgacagctcaaatataatagttgcatttgattgaaaaataaaactaaaatttgctgttaatggaatatctagcccctgaagagtattgagtcaaatttaaataactagaagggtccaccacatcgtaattgtttgagggttcatatgacagacatggaaatggttctgtttggtttctattttgacatacaatagatcttcttggatgggttttgctgacaacctgtggttacaaaaacgtctcctgggtggtctgagacttcattccatgtttatagattatttatattaatttatttctattaggctcaaatactataattggcatctcatcgtaaaaagcactagtttctccctctggttaggcatcccatctgatcccagacagaataaaaagtgggcaagttgtaggggaacatggaatgaggacaaaaatgattttgagaaaaatcaaagattgggaatagagtctcaattgaataacctactggtagtcttggaaaatagatagaactgatgagtatgaagaacattgcaaaacgtacaaaatattttcagtgttcaaatacctaaaagctctcacttttatataaaatgctggcagtggggttgtgttgcctatgctattttaagaaatgggttctaactacactttgttttaatgtaattgttgttttgcaagttccgctgagtaagacctactgcatagaagatgtcactttaggcaggagttacattaaatttggtaaccaagacagaatacctagctgttgggtgatgattctttttaggtttatctgtatgtttatctctctcccttcccctaccccattccttacttcccaactctggagggggattcttgaagtggttttcagatctgtcttggtttaacacagtgggtaaaagggaggttggaataagctgaacactgcaagttactggtggtgggagacgggctatagctgaagggaggtgtgatgactctgaatgggaagcaggctgaacctcattggctcagaaatgaaaggctttctgtttcaaaacacttataccaacattttcctttctgtcctcactcccagaattcaatctcttccttgcttctccctaatacttcagggagacaattgcctttgttctggtcccagaacatatcttcatcagtttccctagtcatcctgcctacttaccacatctcacccttgttgcctattaattttaaccactttatatccaaaattatacttgatttactgagtaacagttccttgaaacaaaacctactacagtagtaccaactgtgatagtgactaaactcaaatgtgtcctaagagcagctactgacattttgactgacaaatatgattgttataagggatggagaagtgtattttgtcagttacatatatgcctggacttactagccccatgaaaatgtgtttttgataggtgtctcagagttgtgaaattcaagtaccaacttgaatttaaaaaataccaatgtggcttgtgggaactctcagtaagtctgtacactcaaataatcaatgctttgatggtgggtagtcttccctttgttatcatgctcccctttctccgtcgacacatattttaagtgacatttattaaatattattcttcatcatgaaggaggcaaattagggcagagtataacaaatagcatcaggaatattacagtgaactttgctttaaagctaagacagacaaggcaatagagttctaaaaggaatgccaaaactctcccttcccagaatcttctttgaaatgttatctgagttaatgccccatctctttaaatatggcctggaagtggtgtcaggagggtgctttaagaattttagacttcggttaagctgggcagattggttggaactggtgaattggaaaggaataccaatttggcaagtttatgtttcagcatgccacacaaagttaaaaactgcactttgttttaatttaattgttgttttgcaagttccgctgagtaagacctactgcatagaagatgttaccatgtagtcatcagtctctaggctggttgttcttaactgagggtatttaggaaactttaaaactcaggtaaaatacctgcagagacacacacacgcgcacacacacatacacacgtgtgcgcgcacatacacacatgcacatgaatacacatacagagaccctttccatctcctttccacctatgctggaggcttggattcagtagatctgaagtggagcctgagcatctgcattttaaatgctccatagtacattccaatgtacagccaagactgaaaaacccctggctcagacacttcaatttggtctggagtttgatgtcctgtaggtgctttattgtgcaacaaacttatttaacaagtactatttgtcaggcactgttccaagcattctataatagctactcatttaattctcataccaaccctatgaggtaggtattatcatcatccctattttgcagatcaagcgaaagagagatacagataatcttctatcttaagtaaaaagacataaaaactatgtcccattgaagcatactattaagttaattgtatattaaagtgctgtgaacattgtgaaataagtacatatgattaactgagggtatttaggaaactttaaaactcaggcaaaatacctgcagagacacacacgcgtgcacacacacgcgcgcatgcatgcacacacacacatacacgcatgcacatgaatacacatacagagaccctttccatctcctttccacctacgctggaggcttgtggcattaaccagagtgaaagaagacaccttggtctggtttatgaatactgaggaatacatgaatcatctttactctcgatatctttgaaaacaagatgaatagctaaagagtaggctctccagtaaaacttcactctagaagatgagaaaggagcaataagacacaagtcaaacatattataacatgtgaatgtttattaatatcattaaaatatatgattgggtcttccttttttgcctttttataaattaagaaaaaccctggtctacttgatgaccttaaaatggactccaggaataataatgatatgatctattactagcaaattcagcaaccaaaacttcagaaaactagtccataagttcagtattctgtgtttattaatccatagtgatgtgtcaacctttacaacacagtcttttattagtaaagttaaatcagacagaactatagatacaaaaacacctaggttccagtctcagccttgagactaatgtgttctacgttctttcccctctcaaagccttagtttcttcatctgtaaaatggatgcgtttgccctagataatctctccaaggtctctaccagtataaaaagtctataaatatgttaagaactattgtgacaggaagctcatggcttttgtttcttcgatgtaataatttgttcctgcctatctcctgggatctctgagtgagcattggttagaaagaatgttgagctctctggtggacagctgacttctcttacccagcagaaatgaatctgtcaactttcattaggcattgtcgggtagcatcatgctcagtgatagattgtaccagaagtagtgttaggttgacatccaattataccaaggttctaaaaaggtagtctatttcactcttcttaaaattcctgagaatttgggatgctgcaaaacacgtaaaatggttgataggaagcaaaaaattgtttgccatgcattttaatactttcattttgaggctattgaagctgtatatggtcgtattatcaatagaagtgccttaaaaaattgtcaaggttagaagaacaggtttctggaacacctcacagttgtgatcacaactgagccttgtgcttttagccaaattgctccctggcctgttccccaagatggcacaatgtcaggagagcttcctcctaaggaaaatggcccaagaaagaaaaaagataggggtggtggttaggaagtgaaggaggcttctcctgatttccttgaccttttaaacagccataccatctggaaacagagtgggcagcacatcacacagagtgggcaaccacagagtgggcagtggcaaatcagagtcatctggactacatgaataattatgtggacatttaaattcccacccaataaaatccactttacatttataataattttaaaatattaagtgaataaaaatattaatttttccaaactctgcaagccttcatttggatttggctgtataaatctggcctgaagataatttctttctatttaccaacatagaaaggaattcaaattatgttgttaaatgaaacaagcaagttttataacacagttttagtttgattctacgaaaacaatgtagtatattttagaaaaagaaatgggaacattatgttgtatggagcaagggctgggaattctagaaattctagataactttatctttgttatatatttctatatttcatttttatacaacaaaaacattttagctttacatcagattaaaacaaaataaagtcttgttttagaaaaaaaagtaagggatatttgagggctttgggggtaataattattttcttccaacaggagttgaattatcagaaccttttcattatcaacttttgtccttaaactaaaagttaaaatctattattctcattgggattgattttctgtttcttgctttacctcaacaacccttttggcgaagatccattgaataattcaagaattctttctaaggtataaaacaagtcaagatggctagccccagctccttggtcccttgcctgggtgagaaagatctcagcacagcttcttttgctgggcatagaatggcttttgattttcttgatgtggctgttacctgatatttcaagagttgctctgaatatgccttggtaatctcttggtctaggcaggccaggctgaagagactattttgctcattgtagaatagtatctcataaggctccttattatctgggcaaaaccaaaaatctgctactctgcctctggccccagcagagccttttctaattaatactttatttggcagcagatgttttctgtgtgccatacactgaggcaacagctaagcagaatcccttaagtgaagatattccactaggaagggcaccttcccccaacccttcaggcttctctagtttgctcaggaaggtcttccttattgtcatatcttaaggcagtctatttttcttttcataattggcttactctctaaatagttactgtgttttctcaaatttctaaagccataaagagtatgttcaccttttataataccagcactttgggaggctgaggcaggtggatcacttgaggttaggggttcaagaccagcctgaccaacatggtgaatccccgtctctactaaaaacacaaaaattagtcaggcatggtggtgagtgcctgtaatcccagctactcgggaggctgaggcaggagaattgcttgaacccaggaggtgaaggttgcaatgagccgagattgtgccactgcactccagcctgggcaacagagtaagactctgtctcaaaaaataaaaataaaaaaatatatatatatatttatgtgtgtgtgtgtgtgtgtgtgtgttcaccttttaaacaatataaaagtatacagaacaaaacatgaaaatccccctttgtttccttccccatcttcaatggtctgatatacatctttccagttccctttctatgcatttacatacacatgtatacataaatatatatgatgtttctttgcatccactaaaattttctgcaaggttgaaagtgttctaaatctgtgctatgcaatatggtagctacatgggacagctgagcacttgaaatgtgactagtgtcactgagggactaaatttttaattttaagtaattcaaatttgtttaaatttaagtttttaattggcaacccaatgggaaagaagaaatgaaattttctctgtagacaacaagatcatatacatagaaaacccctaaagactccatgaaaaactgttaaaatgaaaatggtaaaagtgcaggatacaaaatcaacacagaaaaatcagtagcatttgtctatacaaacaataaactatctgaaaaagataaagaaaataatcccatttaaaataaaatagaaaaaatacttatgaataaatttaaccaaagaagtaaaatatctttataccacaaactatcaaaattgaaataaaaaaatgaaaaatacaaatacatgggaggatatgttcatggagttgaaaaattaatattgtcaaaatagccatagtacccaaagaaatccacagattcaacgcaattcctatcaaaattccaaggccatttttcacagaaatatacaaaaaaaaatcctaaaattcatatgaaatcacaaaagatcccaaagagccaaaacaatcttgagcaaaaagaacaaaaccagaagcatcattctatctgatctgaaaatttaccacacagctatagtaaccaaaatagcatggtagcagcataagaacacttatacagaccaatggaacagattagagagccaaaaaataaattaatatatttatggccaactgatgtttgacacaggtgctagtaatatacaatggggaaaggactagtctcttccatacgtggtgttaggaaaactggatatccacatgcagaagagtgaaattagactctcacatcatatatgaaaatcaactcaaaatgtatcaaagacttaaatataagacctaaaattgtaaagatactggaagaaaacacaggggaaaagcttcttgacattggtctgagcaaagattgttttggagatgacttcaaaaacacaggcaactgatatagtttggatctgtgtccccatccaaatctcatcttgaattgtagttcccattatgcccatatgtcaagggagggactgggtgggaggtgattggatcacaggggagtttcccctaagctgttctcataaaaatgagggagttctcatgagatctgatggttttataagtgacagttcctcctacacacactcttttcgcctgctgccatgtaatgcatgcctgcttccctttctgccatgattgtaagtttcctgaggccttcccatccgcagaaccattagtcaattaaacctctttcctttataaactacccagtcttgggtactatctttataacaatgtgacatcaggctaaaataggaaattagtaccacaaagaatggggtactgctataaagataccaaaaaatgtggaagcgactttggaactgggtgacaggcagagttggaacagtttggagggctcagaagaagacaggaagatgtgggaaagtttgcaactttctagagatttgctgaatggttttgtccaaaattttgatagtgatgtggacaatgaaatccaggctgaggtggtctcagacggaaatgaggaacttattgggaattggagaaaagatcactcttattcttttttttttaaattattactatactttaagttctgtggtatatgtagaggacgtgcagtattgttacataggtatacacgtggcatggtgctttgctgcacccatcaaccagtcatctacattaggaatttttcctaatgctatccctcccctagctcctcactccccaacaggccctggtgtgtgatgttcccatctctgaacacatggaacaatgaatccatgtgttctcattgttcagctcctacttacgagtgagaacatgtgatgtttggttttctgttcttgttgtttgctgagaatgatggtttccagcttcatccatgtccctgcaaaggtgatgaactcatccttttttatggctgcatagtattccatggtgtatatgtgccacattttctttttttttcttttttttattattatgctttaagttttaggatatatgtgcacaatattcaggtttgttacatatgtatacatgtgccatgttggtgtgctgtacccattaactcatcatttagcattaggtatatctcctaatgctatccctcccccctccccccaccccacaacaggccccagtgtgtgatgttccccttcctgtgtccatgtgttctcattgttcaattcccgcctatgagtgagaacatgcggtgtttggttttttgtccttgcgatagtttgctgagaatgatggtttccagcttcatccgtgtccctacaaaggacatgaactcatcattttttatggctgcatagtattccacggtgtatatgtgccacattttctaaatccagtctatcattgttggacatttgggttggttccaggtctgtgctattgtgaacagtgccgcaataaacatatgtgtgcatgtgtctttatagcagcatgatttataatcctttgggtatataccctgtaatgggctggctgtgtcaaatggtatttctagttctagatccctgaggaatcaccacaccgacttccacaatggttgaactagtttacagtcccaccaacagtgtaaaagtgttcctatttttccacatcctctccagcacctgttgtttcctgacattttaatgatcaccattccaactggtgtgagatggtatctcattgtggttttgatttgcattgatggccagtgatgatgagcattttttcatgtgtttttttggctgcataaatgtcttcttttgagaagtgtctgttcatatcctttgcccactttttgatggggttgtttgtttttttcttgtaaatttgttggagttcattgtagattctggatattagccctttgtccaatgagtaggttgcaaaaattctctcccattctgtaggttgcctgttcactctgatggtggtttcttttgctgtgcagaagctctttagtttaattagatcccatttgtcaattttggcttttgttgccattgcttttggtgttttagacatgaagtccttgcccatgcctatgtcctgaatggtattgcccaggttttcttctagggtttttatggttttaggtctaacatttaagtcttcaatccatcttgaattaatttttgtataaggtgtaaggaagggatccagtttcagctttctactcatggctagcccgttttcccagcaccatttattaaataggggatcctttccccatttcttgtttttgtcaggtttgtcaaagatcagatggttgtagatatgcggcattatttctgagggctctgttctgttccattggtctatatctctgttttggtaccagtaccatgctgttttggttagtgtagcttgcagtatagtttgaagtcaggtagcgtgatacctccggctttgttcttttggcttaggattgacttggcaatgctggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggttcttcacatcccttgtaagttggattcctaggtattttattctctttgaagcaattgtgagtgggagttcactcatgatttggctctctgtttgtctgttattggtgtataagaatgcttgtgatttttgcacattgattttgtaacctgagactttgctgaagttgcttatcagcttgaggagattttgggctgagacgatggggttttctagatatacaatcatgtcatctgcaaacagggacaatttgacttcctcttttcctaaatgaatgccctttatttccttctcctgcctgattgccctggccagaccttccaacactatgttgaataggagtggtgagagagggcatccctgtcttgtgccagttttcaaagggaatgcttccagtttttgcccattcagtatgatattggctgtgggtttgtcatagatagctcttattattttgagatatgttccatcaatacctaatttctggagagtttttagcatgaagggttgttgaattttgtcaaaggccttttctgcatctattgagataatcatgtggtttttgtctttggttctgtttatatgctggattatgtttattgttttgcatatgttgaaccagccttgcatcccagggatgaagcccacttgatcatggtggataagctttttgatgtgctgctggattcggtttgccagtattttattgaggatttttgcatcaatgttcatcaaggatattggtctcaaattctcttttttagttgtgtctctgccaggctttggtatcaggatgatgctggcctcataaaatgagttagggaggattccctctttttctattgattggaatagtttcagaaggaatggtaccagctcctccttgtacctctggtggaattcagctgtgaatccatctggtcctggactttttttggttggtaagctattaattattgcctcaatttcagagcctgttattggtctattcagagattcaacttcatcctggtttagtcttgggagagtgtatgtgtcgaggaatttatccatttcttgtagattttctagtttatttgtgtagaggtgtttatggtattctctgatggtagtttgtatttctgtggaatcgatggtgatatcccgtttgtcatttttcatcgtgtctatttgattcttctctcttttcttctttactagtcttgctagcggtcaatcaattttgttgatcttttcaaaaaaccagctcctggattcattgattttttgaagggttttttgtgtctctatttccttcagttctgctctgattttagttatttcttgccttctgctagcttttgaatgtgtttgctcttgcttctctagttcttttaattgtgatgttagggtgtcagttttagatctttcctcctttctcttgtgggcatttagtgctataaatttccctctacacactgctttgaatgtgtcccagagattctggtatgttgtgtctttgttctcgttggtttcaaagaacatctttatttctgccttcatttcgttatgtagccagtagtcattcaggagcaggttgttcagtttccatgtaattgagtggttttgagtgagtttcttaatcctgagttctagtttgattgcactgtggtctgagagacagtttgttataatttctgttcttttacatttgctgaggagtgttttacatccaactatgtgttcaattttggaataggtgtggtgtggtgctgaaaataatgtatattctgttgatttggggtggagagttctgtagatgtctattaggtccgcttggtgcagagctgagttcaactcctggatatccttgttaactttctgtctcgttgatctgtctaatgttgacagtggggtgttaaaatctcccattattattgtgtggtggtctaagtctctttgtaggtcactaaggacttgctttatgaatctgggtgctccagtattgggtgcatatatatttaggatagttagttcttcttgttgaattgatccctttaccattatgtaatggccttctttgtctcttttgatctttgttggtttaaagtctgttttatccgagactaggattgcaacccctgcctttttttgttttccatttccttggtagatcttcctccatccctttattttgagtctatgtgtgtctctgcgtgtgagatggggttcctgaatacagcacactgatgggtcttgactctttatccaatttgccagtctgtgccttttaattggagcatttagcccatttacatttaaggttaatattgttatgtgtgaatttgatcctgtcattatgattttagctggttattttgctcgttagttgatgcagtttcctcctagccttgatggtctttacaatttgtcatgtttttgcagtagctggtaccggttgttcctttccatgtttattgcttccttcaggagctcttttagggcaggcctggtggtgccaaaatctctcagcatttgcttgtctgtaaagtattttatttctccttcacttatgaagcttagtttggctggatatgacattctgggttgaaaattcttttctttaagaatgttgaatattggcccccactctcttctggcttgtagagtttctgcagagaggtcagctgttagtctgatgggcttccctttgtgggtaaccagacctttctctctggctgcccttaacattttttccttcatttcaactttggtgaatctgacaattatgtgtcttggagttgctcttctcgaggagtatctttgtggcgttctctgtatttcctgaatttgaatgttggcctgccttgctagattggggaaattctcctggataatatcctgcagagttttttccaacttggttccattctctctgtcactttcaggtacaccaattagacatagatttggtcgtttcacatagtcccatatttcttggaggcgttgttcatttctttttattctttttttgtctaaacttctcttcatgcttaatttcatttgtcttccatcactgataccctttcttccagttgattgcatcagttactgaggcttgtgcattcatcgtgtagttctcgtgccatggttttcagctccatcaggtcctttaaggacttctctgcattggttattccagttatgcattcatctaatttttttcgaagtttttaacttctttgccattgatttgaacttcctcctttagcttggagtagtttgatcttctggagccttcctctctcaactcgtcattctccgtccagctttgttccgttgctggtgaggagctgcgttcctttggaggaggagaggcactctgatttttagagtttccagtttttctgctctgttttttccccatctttgtggctttatctacctttgatctttgatgatggtgacgtatagatgggtttttggtgtggatgtcctttctgtttgtcagttttccttctaacagtcaggacccttagctgcaggtgtgttggagtttactggaggtccactccagaccctgtttgcctgggtatcagcagtggtggctgcagaacagcgggtattggtgaactgcaaatgctgctgcctgatcgttcttctggaagttttgtctcagaggagtacccgggagtgtgaggtgtcagtccgcccctacttgggggtgcctcccagttaggctactcgggggtcagggacccacttgaggaggcagtctgcccgttctcagatctccagctgcatgctgggagaaccactactctcttcaaagctgtcagacagggacatttaagactgcagacgttattgctgtcttttgtttgtctgtgccctgcccccagaggtggagcctacagaggcaggcaggcctccttgagctgtggtgggctccacccagttcgagcttcctggccgctttgtttacctactcaagcctgagcaatgcggtcgcccctcccccagcctcgctgccaccttgcagtttgatctcagactgctgtgctagcaatgagcgaggctccatgggcataggaccctccaagccaggtgcgggatataatctcctggtgtgccgtttgttaagcccgttgggagggcgcagtattagggtgggagtgacccgattttccaggtgccctctgtcacccctttctttgactaggaaagggaattccctgaccccttgtgcttcctgggtgaggcgatgcctcgccctgcttcggctcacacacagtgcactgcatccactatcctgcacccactgtccagcactccccagtgagatgaacgcggtacctcagttggaaatgcagaaatcacccgtcttctgcatctctcacgctgggagctgtagactggagctcgccaaattttctttatccagtcatgctggagaggttgtagagaaataggaatgcttttatactgttggtgggagtgtaaattagttcaaccattgtggaagacagtgtggagattcctcaaggatctagaactagaaataccatttgacctagcaatcctattactgggaatatacccaaagtattataaatcattctactataaagacagagagacacatatgtttatggctgcactattcacaacagcaaagacttggaaccaacccaaatgcccatcaatgatagactggccacgttttctttatccagttcttgtgatggtttgctgagaatgatggtttccagcttcatccatgtccctacaaaggacatgaactcatccttttttatggctgcatagtattccatggtgtatatgtgccacattttcttaatccagtctatcactgatgggcatttgggttggttccaagtctttgctattgtgaatagtgctgcaataaacatatgtgtccatgtgtctttatagtagaatgatttataatactttgggtatattcccagtaataggattgctgggtcaaatggtatttctggttctagatccttgaggaatcaccacactgtcttccacaatggttgaactaatttacactcccaccaacagtataaaagcattcctatttctccacatcctctccagcatctgttgtttcctgactttttaataatcaccattctaaatggtatgagatggtatctcattgtggtttggatttacatttctctaatgaccagtgatgatgagcttttattcaggttggttggccacataaatatcatcttttgagaagtgtctgttcatatccttcacctgatctttgatggcgttgttttatttttcttttaaatttgtttaactttatagattctggatattagccctttgtagattccggatattagccctttgtcagatggacagattgcaaaaattttctaccattctgtaggttgcctgttcactctgatgatagtttcttttgctgtgcagaagctctttagtttaaatatatcccatttgtctattttggcttttgttgccattgaatttggtcttttagtcataaagtctttgcccatgccaatgtcctgaatgttattgcctaggttttcttctagggtatttatggttttaggacttacgtttaattctttaatccatatgagttaatttttgtataaggggtaagaaaagagtccaatgttggttttctgcatatggctagccagttttcccaacaccatttattaaataaggaatcctttccccattgcttgtttttgtcaggtttgtcaaagatcagatggttgcagatatgtggtgttatttctgaggcctctgttctgttcattggtctatatacctgttttggtaccagtaccatgctgttttggttactgtagccttgtagtatagtttgaagtcaggtagtgtgatgcctcaagctttgttctttttgcttaggattgccttggctatgcgggctcttttttggttccgtaggaaattgaagtagttttttccaattctgtgaagaaagtcagtgttagcttgatggggatagcattgaatctataaactactttggtcagtatggccgttttcatgatattgattcttcctatccatgagcatagaatgttttcccatttgtttgtttcctctcttatttccttgagcagttgtttgtagttctccttgaaaaggtccttcacatcccttgtaagttgtattcctaggtattttattctctttgtagcaattgtgaatgggagttaactcatggtttggctctctgtttgtcagtttttggtgtataggaatgcttgtgatttttgcacactgattttgtatcctgggactttgctgaagttgcttatcagcttcaggagattttgggctgagatgatggggttttctaattacacaatcatgtcatctgcaaacagagacaatttgacatcctcttttcctatttaaataccctttatttctttctcttacctgattgacctggccagaacttccagtactatgttgaataggaatggtgagagactgcatccttgtcttctgctggttttcaaagggaatgcttccaatttttgcccattcagtaagaaagtaagggatatttgagggctttggggtaataattattttcttcctacaggagttgaattattagaaccttttcattatcaaattttgtccttaaactaaaagttaaaatctgttattctcattgggattgattttctgtttcttgctttacctcaacaacccctttggcgaaggtctattgaataattcaagaattctttctaaggtataaaacaagtcaagatggctagccccagctccttggtcccattcagtatgattggctgtgggtttgtcataaatagttattattttgagatacattccatcaatacctagtttgttgagaatgtttagtgtgaagggctgttgaattttgttgaaggcatttcctgcatcgattgagataatcgtgtggtttttgtcattggttctgtttatgtgatggattatgtatattgatttgcatatgttgaaccagccttgcatcccagggatgaagctaacttgatcgtgctggataagctttttgatgtgctgctggatttagtttgtcagtattttactgaggattttcgcatcaaagttcatcagggatattggcctgaaattttcttttttttgttatgtctccgccaggttttggcatcaggatgatgctggcttcataaaatgagttagggaggattccctctttttctatttgttggaatagttgcagaagaaatggtaccagctcctctttgtacttctggtagaattcggctgtgaatctgtctggtcctggactttttttggtcagtaggctattaattactgcctcaatttcagaacttgttattgctctactcggagatccaatttcttcctggtttaaacttgggagggtgtatgtgtccaggaatttatccatttcttctaggttttctagtttatttgcatagaggtgttcatagtattctctgatggtagtttgtatttctgtgggattggtggtgatatcctctttatcattttttattgcatctagttgattcttttctattttcttctttgttaatctggctagcggtctattttgttgatcttttcaaaaaccaggtcctgggttcacagcgttcaaactttactaaggatcagactgcttcctcaagtggttctatgatctcgggtatactgaatgggagatacctcccagtaggagccgacagacacctcatatgggagagctctggctggcatctggtgggtgcccctctgggttgaagcttctagaggaaagaacaggcagcaatctttgctgttctgcagcctcctctagtgatacccaggcaaacagggtctggagtggacctccagtaaactgcagcagacctgcagcagacgggcctgactgttagaaggaaaactaacaaacagaaaggaatagcatcaacataaacaaaagtacgtccactcagagaccccatccgaaggtcaccaacatcaaagaccaaaggtagataaatccacaaagatggggatagaccagcgcaaaaaggctgaaaattccaaaaaccagaatacctcttctcctccaaaggatcacaactcctcgccagcaaggaaacaaaactggacggagaatgagtttgatgaattgacagaagtaggcttcagaaggtgagtaataatgaactcctccaagctaaaggagcatgtcctaacccaatgcaaggaagctaagaactttgaaaaaatgttagatgaattgctaactacaataaccaggttaaagaagaacataaatgacctgatggagctgaaaaacacagcacaagaacttcatgaagcatacacaattatcaatagctgaatcgatcaagcagaagaaaagatatcagagactgaatatcaacttaatgaaatgaagcaagaagacaaggctagagaaaaaaagaatgaaagggaatgaataaagcctctaaaaatatgggattatgtgaaaagaccaaatctacatttgattggtgtgcctgaaagtgactgggagaatggaaccaagttggaaaacactcttcaggatattatccaggagaacttccccaacctagcaagacaggccaacattcaaattcaggaaatacagagaataccacaagatagttgtcaagtatctactttgtcaagtagagcgaccccaagacacataattatcagattccccaaggttgaaatgaaggaaaaaatgttaagggctgccagagagaaaggttggattacccacaaaggtaagtccatcaaattaacagtggatccttctgcagaaactctacaagccagaagagagtgggagccaatattcaacattcttaaagaaaataattttcatcccagaatttcatatccagccaaataagtttcataagtaaaggagaaatagaatcctttacagaaaagcaaatgctgagattttgtccccaccaggcctgccttagaagagctcctgaaggaagcactaaacatggaaaagaagaccggtaccagccactgcaaaaacataccaaattgtaaagaccatcgacactatgaagaaactgcatcaactaataagcaaaataaccagctagcatcataaagacaggatcgaattaacacataacaattgttgcctcagagggtgcaagtcccaagctttgacaacttccacatggtgttgggcctgcgggagcacagaagtcaagaactgacatttagaaacctctgcctagatttcagaggatgtatggaaacacttggatatccaggcagaagtttgctgcaggggaagagctctcatggagaacctctgctaaggcagtgtggaaggaaaaaatgtagggtaggattcctcacacagagtccccaatggggcactgcctagtggagctgggagaggagggccactgtcctccaaaccccagaatgatagatccactgacagcttgcacagtgtgcctggaaaagctgcaggcactcagcaccagcctgtgaaaacagctggggaccgggggtgccccaccttgcaaagccactggggcagagctgcccaagtccctgtaagccaacctctttcattagcatgacctggatgtgatacatggagtcgaagaagatcagttcagcgttttaatatttagtgagtgcctcacttgattttggatttgcatagggcctgtagcccctttgttttggccaatttctcccatttagaacaggagcatttacccaatgcctgcaatcttatcatatgtaggaagtaactaatttgcttttggttttgcagcctcataggcagaggggactagtgttgtctcagatgagacttcggactgtggacttctgagttaatgctgaaatgagttaagactttggggtactgttgggaagatatgattgattttgaaatataaaaagtacatgacatttgggaggggccagaggcagaatgatatggtttggctctgtgtctccatccaaatctcatctcaagttgtagtccccataatccccacatgtcgagggagggaccagctgggagatgattggatcatggaggcagtgttccctaggctgttctcatcatagtgagtgagttctcatgagatctgatggttttataagtgtttgatatttcctcctacacacactcttctcttgcctgctgccatgtaagacgtgcctgctttctcttccaccataattgtaggtttcctgaggcctccacagtcatgcagaactgtgagtcaattaaacctctttcctttataaattacaggcttgggcagtatctttatagctgtgtgagaatatactaatacagcaaataaagcaaaaatacacaaaatatcaatctaaaaatcttctacacagcgaaggaaacaacagagtgaagagacaacctatattgaaagaaaatatttataagccatacatctgataaggggctcatagccaaaatatataagcaactcaaaaaactcaatagcaagaaaacaaacaacatgattaaaaatgggcaaaggacttgaatagacatttcttaaaagaagacatataaatggcaagtaaatacatggaaaaatgctcaacactgctaattattagggaaatgcaaattaaaaccacaatgagatatcacctcacaccagtcagaatggctactataaaaaaggtgaaagataaatgttggcaagggtgtacagaaaagagaactcttgtatatcattggtgggaatgcatgtaagcacagccattatggaaacttatatgaaagtttctgaaaaaactaaaactagaacttccatatgatccagcaattccattcctgggtatacagttaaccgttgaacaacatgggagttagggatgctgactctcacggcagttgaaagctcatgtataacttttgactccccacaaactttgctactaatagctttctgtttactggaagccttactgataacatagttgttaaacacatattttttatgttatatgtgttatttagtatattcttaaagtaggctagagaaaataaaatgttattaaaatcataagaaagataaaatatatttactattcattaagtggaagtggttcatcataaagcttctcatcctggtcatctttacattaagtaggccgaggagaaggaggaagaggagggggttggtcttgctctcccagtggttgcagagttggaggaacatctctatataagtgaacctgcacagttcaaactcatgtcgttccagtgtcaacagtatttacaaaggacatgaaatcagtatgtcaaagagatatctgcacttgcatgttcattgcagcattattcataataaccaatatatggaatcaacccaagtattatcaacctaagtatttacctgtggaagaatggataaagaaaatgtgatacacacacacacacacacacacagtggaatattattcagccttaaaaagcaaatgaaatcctatcctttgtgacaacataaataaacctagaggacattatgctaagtgaaataagctatgcactgaatgacaaataaggcataatttcacttatacatggaatctaaaacagttgatctcatagagccagagagtagaatggctgggggtggggaatgggaaatggggagatgttggtcaaagggtataaagtttcagttagataggaggaataagttttttgagatctattacacaacatgaaggctatcgttaataatcatgtctatttcaaaattgctaagacagtaaatttcaaatgttcttaccacaaaaagtgataagtatttgaggttatggctatgttaattaccttgctttaatcattctacattgtatatatatgtgtgtgtgtgtgtgtgtgtgtgtatataatcagattgtaccccataaatatatacaattataatttgtcagtttataataaaataaataattaaaaaataaataaaatttaagttttagtagccatatatggcaattggctatcatattacgcagtgcagatcaaaatagtagggaccaggaacttagaaaacagcaacagtgtgagaaatataactatgggtactagggtaccagtgttttactagagatgcatcatctcactttatcttcacaatcctattattaacagatttttaaaaaaaccctcaggcatagagaattttagaaagttgtccaagacagaaggcattagagtgtggattcaaattcagacaatatagctccagaaagtacccccctgagtttaagcatgtgggaaatcatgtgataaactggaaatggcataagttttggtatagagaaaactaattttggatcttcatcctgccacttattggactctgtgtgacattaggcaagtcacctatcctctctgattctttattataaaacctataatatgggactcacaatacttctcaccatcaatgggatatacactttaatatatcatatgttatttccccctcttccatcttccctatcaaataagtttgcctttggggcaaaactacctatagtaggggatgttttcactggccatgaaacagattaaaattaactgagattaaaacagatcaaaattaagcaaacacattattccttgtgggccagggcttattatcacagaattctagatagctgagctaattgaagggcaaagaagtctctggaactaccacactgaatgtaaggataaaggcaaggagcagtttggtctgctgcagattaattggctaatgcctatggtttgtaatcagattgtggttcaagttctagttctaataattactacttgtgtgaccttgggaaagtcacctaccctctttctctctgttttctcatatataaaatgggggtaataaggaagttccagagactttcttgcctttcagttatctcagctgtctagaattatgtactaattacatgttgtcttgtaacctttgaggaaagataatatgtaaagtctatttccctgaaattcagagctggagttgcttttgtgttcttgatttcttcaattttcttatctctgaaaaaaatgttggcacttctgcctatgtggtttatgaatcctgccatagttcgattagagtaatgtatttttgtaacacatttgaaccacatgcttgtgacatactccattgcatgactctttcgttaagatctactggaaatgtcagagtctctttaaaggcagttgttaaacattaacataagaatgtttgttaaactcttccagaaaaggatactatgtaaatcataacatcatttaaattggtcaaccactattaattcaggctaattgtggaagagtccaagctgaactgctgataaatctaaagagtacagtatatataaaggagtgctagctagctggtgatgagtaagactcatggtgggcctactttaatgaaagatatcattcatttgtaattgtaatcactataataatggagtggaattaaagtaattgaaagcacagtttggtctattaagtagtttgaatattcctctagcatttctgtttattccattaattttcttagcaatatcctttcatagatatatcctttcatagatattgcaaggtcaacttaagcccagcctgggtccaaatgatcacaaaacttgagtttattaggtccacattaatgaggacttattataatgataaatctataaagatcaaaacctggggcaggctatcggttatgctatctcttatttaattgctttggtttttttctattataaatttcacctttcataccactctacacatgatgttgggattagaacagtctcctgagaacaccataactaaatgtgtatgcttaaatagagacccacttattggtgccagttaatccttaatgaatgtaacatcaataaagtaggtaataaaaaaagttaaattttattgctaatcttaaatcctactttaaggagaagaaaaaccttaatgctatggctagagttgagtagcactagattagcattggtgtacattaataatgaaaatagctgagccccattagtgtcacttaaagttttgtgaattagagatatggccctacaaattaaacaccttgaatactgaatgggggaataattattatttaaaaagttaaaaccttcacatctcttctaaaggaaaatttttcattggtatagaattacataccattcactctacagtatgaaaaggatggaactttgcagaccataaaaagtataataaaggagccactaaaattgatttttatttaagcagattactagtgttttcttccttaactggaaggagtgccctgtactcctccaacctattttcagccatgatactatttctacatgcataattagacactgacccctttgaggaagtttaaatgtcccttattatccccaacctcaactccaaaacctttttcagccaagcaagagaataggaaatatatagaaatgaatgtgcaaaactttccaacatgtgtgcatatagaacaaattgtgaggtcagtgaagtgagtccctattttccttcttactctgtatgcttctttgtctccaaccatgcccaacccagtagtttcctctgtagcccagggtcttctacgtcaatgccctaaaaaagcctgcactccccttccccacctcattttccatcccctactccgcctccacaaaacttacttgttctgagtcaattttatcagatccctgctgtctttcaagagtgttattagtagtagtaatggcagtaggaggaatcatactataacaaggaaaactaatagccagtgtgagtataatgactgttatattatgctccaggcactctgcaagcattttacatccagtacttcatttaatcctcacttttacagatgataaaattgaggcttagaaagagtaagtgtcttgtctaaggtcccacagtgaataagaggactcactcttgtttgtttgttgtagctcttaactgctacaactctatactgcctacatagttttaggaaaagcagtaagagttaatatcccagaaagcattttgaaaaaagttaaaatggttgttccctcctaaaccatttgtagttcattatcggactttgctgtattgtcttatttttaaagtagggggatgggagagagtaaggaagagggaggaaaagaaaggaaggaggataaagaggaagaactgactttcaggccagaatggatactttgccttagtcaaacatccgagtacataatatctaggcttcttattctccttgacaagatgcaggccagtaatgccatgaaactggcataaatacagttgtccctcagtatctccaaggattggttccaggacccccacatattcccaaattcttgcatattcaagtcccacagtcactgctctgtagaacccacatatatgaaaagttggccctctgtatacacaggttttgcttcctgcaaatactgtattttctatgtttaactgggggaaaaaagtatgtataagtagaactgtacagttcaaacccatgtttttcaaggatcaaatatattccccatctccctttcccatccactcacaaattcctggtccaatcacttgtggctgaggtagcaggattggtttcacacaatataaataatagcacattgtgtgagaaaaaaactgtgggacactttccttaaaagttctatacatacagacatagcaggcctctgaggttacctcaacttctcttagagcctatcaagtacaaatatgtatgattctcttagggcttaattagtgggtggacaatataaaagttgaggacatcctccaaatgacagaaagggtggccttatctcaggaatgagagttcttctagccctaagactaatgccatgaaatatttgctactacacctttgcttctttctcatttccaaatccagtactctctcccaggtacactctggggtcttattggtttcatctaaagttcctaatcagccattaatgattctggctccctgaatgtaaaatttcttttgttttctttaatatgaactgtgaggactcaggatccagctggccctagatacttagggaaactattgagctctgctttggtggcaattgccttggctagttgaaagctctgtttagttccccatctgtgtttgtatgtgacttatataaattagttacttttgaaattgcaggtggttttaaaacaaaaactcgtattctaagtaaaaggataagtgagggctataccttctgaaactaacctgaagtaagtaatcttgtatcagtttcctgatcatactctagctttcttctccaactggagtgaccctttacaagacatggtctgaagctttttgcaaagacagcctcttctcaaatgtatacctggcagtaattttcccatgaatggtcttgatgctaacaatgtctgattcatctgcctttttattctcttctgttactaactcactagaaataatctctgacaaagtccacatgtatgagaattagccttagaacaagagaagccaagacattggctattagatgttagggtgatcaaccatcctggttttcccaggattgttccaagattaacactgaaaatcttgtgtcctgagaaaaaccctagcccaaagcaaaccaggatggttagtcaccctaccagatgtacatgtaggctatatggtgtattagaaagaacactggtcttcaaaagtctgagcccaagtcttactactgtcacttattatgttaaccatatagtcttctattttttcataatacttatcagaattttaattttgtattttgatatttatttgtttagtgtttgtctttctcattagaaggtgagccccatgagtgctagagtcatatcttgtttgttccccattacaactccaacacttacaatgcctcacaagaagtaggcactcaacacttatccattgaattaataaattagtaagtcacgactgctctagttttccattttctcatccataatggagacattacttacttccagtagttgtgaggaattgagacaatgtgtatgtaaaagagacaatgtgtgttttgtaaaccatacacaaaacattattaatgatggtacttatgatgtgtgcttgataataatatctgtcttttattgaggaacctattcagtggtaggccttttcaatgttttttttatttcattgttatcgtccttcatataggtaggttggtattttatccccattttagaaattagaagattgagtttacaaagaattacggccaactacaaggctagagggcacagtctccaagactgcactcacttctgacaccaactgcaactttggatgattcccaaaaccactcttatgtaggataaatcactagaaagactcatagaacttactgaaagctatcatactcatagttatggtttattgcagggaaatgatacaaattaaaatcaaccaagggaagaagcacatataccagaatccagaagtactaaatatagagcttccattttcctctctctgtggagtcaggacatgttactctcctggcatccttatgtgacagtgctcatggtgtattaccaaccagggaaacttacatgagccttgttgttcagagtttttattgagactcgattacctaggcatgactgatcatttgcccacatagttgatctcagtttctgggtagactgataccatccaatccaaagctcctactccaaatcacattgttagtatctgtctatcataaggcccctaagcaaataaaaattacctcctgggagctgagggcaaaggccagacctcttttggagcaattttaaattctttcttacagaaaggtgcagagaggtcaatcaacttgccaaaagttgcacagctggcacatgtacaccctagtcagcctccctctagtgcccatgctattattttccattgtgtgccctgtgtgcctgaaaaacaatgcagttttaatgtgctataaaataatgtataaccctatacatagaataaagaaaggcctaactggaagtaaaaaaaaataataggcagaaattgtactactttctcatctacctttttcctctcatagctctcaaatttgaaccttcctttattccttgaaccataacataggcccatacttggaaaagtgcaaagtggacaaaagtgggtagaaagtttgtctagggtatgcttccactctaccaacctcccctcttgtgcactagggcttataaataccctcatatgtgcacacatgcatgcacacacagaaacacacacacacacacacacctcaactcacaaaggggcctattttttatggtctgtctaaaaaattcaattttatgtgttaaataaaaattggaaatccttcctacggccatttgcttttaaatatgagcttcttaaacatagaataactatgatgacaaagaaattaacatcatttgatgagatttataatagggatttgtggttatagagtctccctgtgtctccaatcacagtatagccagccatcccatacatttgtgtgctagaagctggagaagggtgtggaaaaatgacaagtaataacaggagagggaaacaagaaaggaaggagggatactctgaagctctgaagtaatctgtacctattcagaagtggagaacagaattcaaggggccacattacatggaacatcatccaaagtttagataaaccagagtaagcctagcgaagactgaaagagaaggcaaagggtttggtacagccattttatttgttatcttttagatggaggagaaggagtgcaaaattatagctaacctactacagtggctagcagtagaaacagcacagaccttagagcgaggcacaccagagtttaaattccaactccaccgttaactatgtggccataggaaaattattttgcttctccaaccctcagtctcctcacttgtataattgatgctaatactaaaacacatctcctaggacccttaaaagagattaaataaggtaatgtatgcacagtatctctgaggtcagttaccaggtctttgaggtcagtattgcctggaatccttacttggcaatgggtagaggtgcaagtctgatgactagagcatgtgctgagccacctcctcagatgtggcaaaatgtgagtaaagctttgttatcctacttggtacaatggaaatatcttgcattatggggtcaatacattcaggtttcaatccaggctatgctactttcaagctatgtgacctacaggaaaatgtttagcctctctgtgactcagtttccttatctgtaaaatgggtaatagcacacatagcttgcaagttctgtaaaggacctatcccaatatattgctttcttatgctccacagtgtttccagagaccaaagaaagagcatcttcataaacagatagatccaataaaatattttcatgtaaactacatatcatacatatgcatatatatacaagatgtatatgtataaaaatatatacatacattgaaaaaattctttccttgagtaatagtggcaccaccctagttgaaatcaattgaccataaatgtgtatgtgtgtgtgttttctagactgtcagttctactccattgatctatgcatctatccttttgccagtattgcactgttctgattactatagctttgtaagttgtgaaatcaagaagtatgatactgcaaattttgttctttttttcagattgttttggtcattgagtctcttgtaattccacatgaattttaaaattaacttgttcatttctgcaaaaaaaaaggcagttggaattttgatagggattgcattaaatctggagatcactttaaagagtattgccatcttgacaacattaagtcttccaatctatgaatacaatgtcttacagcttacttaggtctttaatttcttttggtaatgttttacagtacttagtgtgcaggtcttgcacctccttgattaaatttattcctaagtatttttttcatgctattactaatgggattgttttcttaaattcattttcagatccttggatgctactattaatatatatttttgtataccaatatcgtatcttgcagctttgctaaactgttagctctaatagcttttctgtggattcctgagtattttctatatacaagatgtttctatatgcaaatagatagttttacttctttttttccaatatggatcatttttattccattttcttgcctaattcccttgcctgtcaccctgtacctccagtacaatgttgaatagaagtgaggagagtaaaaattcctgacttttttctgatgtttggaggaaacatttcaatcttttaccactaagtatgcttctagctttgtgtttttaatagattacctctattggattgaggatgtttctgtctattcttagtttgttgagtgctttttattatgaaaggttgtcagattttgtcaaattattttcctgcatctattgaggtgatcatatttttttcctttttattaatattacaaagctacagtaattatgactgtgtggtaatggcataagagtaggcataaagttcagcggaatagaattgagagtgcagaaataaactcatatatctatgtcaatttttttttacaaggatgccaaaagcattcaatgggaaatcaatagtcttttcaacaaatagtgctgaaacagctggatatccacatgcaaaagaataaatttggaccactttctcatgccatatacaaaaacgtaaactagctcaaagaggtagatataagagctaaaacaataaaactctcagaagaaaacataggcataaatctttgtgatctttgattggacaatggtgtcttaaatatgacatctaaaacacaagcaaccaaagaaaaatacataaatgagacttcataaaaattaacaacctttatgcatcaaaggacactagcaagaaaatgaaaagatcgcccacagaatgggagaaaatatttacagatcatatatctggcaagagtctagtatccagaatatatcatgagctcttataactcaacaatgaaaacacaccttaaatttttaaaaaggcaaatgatttgaatagccatttctccaaagatctacagatcaacaataagcacatgaaaagatgctcaagatcatcagtcattagggaaacacaaagtaaaatgacaataagatatcatttaatatcacatggaatggctataataagaaaagaaaaagaagtattggtaagtatgtggagaaactgggaccctcatgcattgctgatgggaggtaaaaatgtatacccattgcagaaaacagtctggcagttcctcaaaaagctaagcctagagtgttatcatatgaccctggcccaccaattatactcttgggcatatatccaagcaaaatgaaaacatatatttatacaaacacttctacataaattttcatagtagcattattcatattcataacagccagaaagtggaaatatcccaaatgtccatcaacttatgagtgtataaataaaatgtgttataaccacacaatggagtattttgacataaaaagggaattaaataatttatacatgatataacatggataaaccttgaaaacattatgctaagtgacaaatatcagacagaaaaggccacatattgtatgatttcttttatatgaaatgtccagaataggcatagagacaaaaacttggttagtggttgccagaggctgggagaaaggggaaatgggctgcgactatttaatggacatgggtttctttttgaggtaatgaaaatattctggatttaaatagaggtgataactgcacaatctcgtgaatatgccaaagccactgaattgcacactttaaacatacaaattttatgttttatgagttatgtattaataaaaaagttaatttttaatccaaaaagcactttgagaaaaaaattaaaaattaatatgtgtcagaaaaaaatacggacaatacaaaaatctatcacttgccctaactcttgccaggtgtatctgtgatactttaggctgcccaaccagcctttcacaagctgtagcagtttcaagatgccagggctggcagggcacagtggctcatgcctgtactcccagcactttgggaggccgaggcgggcggatcatgaggtcaggagatcgagaccatcctggctaacactgtgaaaccccatccctactaaaaatataaaaaattagtcgggcgtggtgactggcgcctgtagtcccagctaccgggaggctgaggcaggagaatggcatgaacccgggaggcggagcttgcagtgagccgacatcgcaccactgcactccagcctgggtgacagagcgagactcagtgtcagacaaaaaaaaaaaaaaaaaaaaaaaacatgccagggccccctcagagtattggcccaggtccaagctaattcagactgtgtgaaccttttcttctttctttacaacagaaattagcaagggtgtctcatttccaggaggggaagtacagaaaagagtactgtggttatatatctccaaagttagctaagatgaagctgcagattcaagattaagcaacattaaatttcagctgaaattgtatatctgtctgctgccactttataaaatttttcacttaagatgacacaaaagcctatttattgagttgtgtacaccattaaagtttaaaagtttgacatgcatatgctgttttttgtgtggcagtaattaactgtaattgaaaaatatcccattttttatggttctctgaattttcagtgatcttttcccctccctccttcctctcctctaactctgactgcttcaccataacataatcctcccctgccccacattcaagctactttaatagaaatgtaagcaatttaagtagggtacccgttacgtcacaaggttttaaaattattaaggctcctactctcctagtcgggtctatctttgagatatgtgactttatgcctggaaccatgggggagtggagctgggaaatatacccatcacatagaagaaaagggctctgttctataatattccttttgtccatctcaccttctctaagaatggaacataaacctcattcaagaaagatgtgtgaaaaacacttctgagatagcatatagtagaagaagtgtctatgccttcatcaggatccctgagaggtgaaatgtcctttttatagctggccaattctgaattttaatattatctccttcaaggagactcaggcctccttgctaaagcacagcttataattcttccacttgtactttctaggcaggatttttataactagatctacttttcttcatcagtctcttgctttctggcttcactcatttcatctccggttctacccataattcttggctgaattcccacttgatcctactactggtcataacctaccaggaaaaatccccatgggacatcattcactctgaaatatttttgtcttgcctcagagtcacagaaatttcgtcacctaagcaaggaaaatatattttcaaatagtaacatggtgtctgcctggacacaatttaaaataactcttaggaaaatctctgatcttgtattcccaaatatttggatatattttgatctgcaggtcttcttcatgctgttcatactttgtatgaaaggagtgtgcttcacaaagcatcagactgaatacaagaaaatcaatacgcaatctgtgtgataattaattaaggtgccagaatgaatgactttttcttccccttctgatttgggtcagagtcgtgtttgatttgggaagttgtccattttcaattatggtttgttctgtgttctttttatgtgaccagaatgaatgactggcagaaaatcatgttatggcaaaaatctatgggataagtttaacacgctgaagatgtggtttggcaaaagttatttccaagaaaaggctgataaatcagagtgagatcgtttaggagaaaggcatacctacatgtataggtaagactgtgatgaagccaactttattctctgtgcattgttttcagttttcacatacagtcattaagcaaacatttggtgagcaaatactctatgtcaagcattgtacaacgcactagaggtgcagctatgtataagaatgttgtgcgttcagaaaatttctaacaagggagagcaacattaaacaaagagtcccacacataattcattaagtacaattttttgtagtgctacaaagaagtatacagtagttccccattgtatcagtctgttttcatgttgctattaaaaaatagctgaggctgggtaatttacaaagaaaagagattgaattgacttatggtcctgcaggctgtacaagcatagtacaaacatctggtcagcttctaatgagggtctcaggaagcttacagtcatggcagggggtaaagcgggagcaggtacatcatttggcgagagcaggagacgggtgggagaggtgccacatactttttttttttttttttttttttttttttgagatggagtctcgctctgtcgcccaggctggagtacagtggcgcgatctccgctcactgcaagctccgcctcccgggttcacgccattctcctgcctcagcctccttagtagctgggactacaggcgcccgccactacgcctggctatttttttttgtatttttagtagagacggggtttcactgtgttaggcaggatggtctcgatctcctgaccttgtgatccgccagtctcggcctcccaaaatgctgggactacaggcgtgagccaccgcgcccggccgccacacacttttaaacaaccagatcttgtgagaactcactcactatcatgaggacagcaccaagccattcatgaggaatccacccccatgacccaaacacctcctaccaggtcctacctccaatattggggattacatttcaacctgaggtttggaggagacaaacatccaaacctcatggatttttggatgatgacaaacatcatcccttatctgtgtttcactttccatggtttcagttattcatggtacagtacaataagatattttgagagagagagaaaaatagaatacattcacgtaacttttattacagtatattgttatagttgttatagattttattattagttattgttgttaatctcttactgtgcccaatttataaatgacaattcatcatagatctgtatgtagacgaaaaacatagtatatataaggtttggtactatccacagtttcaagtatccactgggggtcttggaatgtatcagccacagataaagaagaactactgtaccttgtctagctggatttttccataactctaaagttactattcagactaaagccaggaaacatccagaaagctttctatggccttctgtacatgaaggctaagggcataaataaataatggatggagggattccttctcagggataaagtgagaggtctggtgacctcagtttggggtctagagtatcagacaatgtgccccaaccaaagaaagcactcaataatgtaatgcagctcattcccagtccaaagctcagcttcctttatgcttattttacttggtgagaactagttctcattgaacattgcccagagacaggttgataatgatgatcaagaacaggctgttagtgaactccagaggtggtagggctgatgacagacctaattctctggcaaggggatggccttaatgtctattaataataattctggattgcttggtgttaaaaatatcaggatgattgaatgaaggaggctagagaacatctataagtgaacagggtcctattcattctggatgatataggcatcaccagcctgaaggcaggggacctggaacagatctcttcaggtataagattctgtgaagtttaacttgctgaaggattaacactcctagaagaatggctgaatgccaattccactttccttaaatgtgcattgaaatagtacttgctggtgccaatttattcttagctctgtgggcctgcccatggatatttcacatagaggggaacattacttatatttgatgcaagggtcccagcctaaaggtgctcacagttttcataactcaatttagtgtaattatactcaacttagggaatgaacaactcccgattcctctccccagtgggcacatgattaattggcttagtgacgaaaaaaatggcttcaacacagacctaagctctagtgggctcccagaagattaggttttaaatttcgatagagtttacttggccctctgtcattaaactgggataagtcaagtttaaaaaccaaggcctttttatatcagcaagggcagaaaaaccctaaagtaaggacaagagtttatctagcatatatgccagacagatgccaaatgccagttgactagcacatctttatggggaaggatgccgcattttaataattagccccattttagaataattggcatgtagaatctttttgagatcctttggagataacattttttaggagtcattctgattctatttgcatgttaagcccttaccagtatctacttggtctgggctgttgcaaatgtaatgatcttagtcatgttcagtcatttgtgtaaccaatatactatatacgtaagtgtatttgtagccatctgagcatgaatgcatgtttcactccctttgtgagaatttggagatgttaaaaaaaaatgggcgtctgtaggaatggtgtatcccctttggcaggtatatgttgccactccacttacatactctgagaactctacaatcagggatttaaagacattgcttctgttaaatgttccctctaaacatgtatgtctaactgggggtaatgctttgcaaagaacgtatgctctagaaaagggtggtttcaaaatcagttattgccactcagcctgcagtcatcatttagctgaatgcaggaagcagggcttttttacgtttgactcttccataccattgtgacccccatgcctaattcaggaaatgatgtggaatagaaaaattaaatattttaaaatgcgcaatgtgtggagtgtggagagagacactatttaaagaacacctatagggaattcttagtcccatctagttttcgagagtagtcatgcagaaagtggtaaattatacatttagctgggcccaagtttctgaggagtcaggtgttacaagtctgatttcatgtcatcctcttccagtttagctgactagtctaacccttcacccacaccaattgtgctctctgaaggatttcagtttagctgtatgctaggccaggaggtaaataaaggcagataaagttatggcatccagttgcctcagctcttgaaaagatttgattctgactctaccctccccaacacaccgcacaaatgctatatcattctccttcatcctgtacaaatattctgtttctgacaacccacatattctcaactgacttactagttatttagccacttatattaatcagggttctccagagaacagaaccaattgtgtgtgtatgtatgtgtgtatatacatatgtgtacacacacttacataaccaatgggctacatgttagggcatttgtggctatctgaacatgaatgtatgtttcagtctctttgtgattgaaacataaacacatgtatgtacacatgtgtgtatatatgtgtatatatataaagtgatttatcataaggtattggttctcattattatggaggctggtaagtcctataatctgctgtctgtaagctagagaataggctattgcaataacccaaaatgaaagctgacagtgatatgaacctggtgctggcaatagaagtggtgaaatgtggttggattccacatatattttaaaaacacaggcaacagtatttgctgatgggttggaatgaggggtaagaaagatagtagtaaaagatgatagcatggccaagcaaaggaaaggatcaagttgctccttactataatgaggaagcctggaagaggtttttgggggtggagaaattttgagcacagttttaaacatgttcagtttgccaccttttcaatattaacatacaaattagatgtgtttggtgcctggaacagtgcccagaatgaggcccgtactcagtaaatagttttaactgaatgaattaatactctttaagttctctctgcctcctctcagttacaaccacatcatctcaccaagttagtctgcttcttcattataactgattctcacatttggtgttaagtgagcctaaaaacacaactgatgatttcctttgacctctttctaagataactctacttagtctcacatactttctattttctgggagtgtcaagaaggccctgtttgctctggtttcccatctgtgagcaagaaaaacaggtaggaagcctgttattaatcttcttgcatcaatacttacattgtaaacctatgccgccatctttcattagtcacagagaagactaattacattgactagactgatgaactcagtatgcaaatgttcatgtaataagatggtctgcccaattttctcctgcagttattcaaatacctccccaatgtatagcaaagccagaaagtcctacggttcactaatgttaaaaagtatatatgtgtgggcttctgggcctatggatacataaatatgtaaaattggccatctttacaacttgatggtggtcaaagtagaactaggctagggtactgggaccaagaaaggcagttaatgtgtatgagtgtcccctaagggtatgatatttgacagggatttgctaaccaggactagcacagactagtcattacaacctgaaggaggcacagtcatccatgaagattatttctgctgtgctgagggtaagctgaagataaagggtgttcctggtcccataataaaagagaaacaatgaattattttgtataaggcagttttcaaacgcctgggtaaaagtctaccctggtggcttcctttcctgaagcaatggcgttaatcactggaagttaactagcaggtccaataactgtagtcacaataatgagaacctggcaaacagtattttgttcagaggagtctgagcttcagggcctgtcttcattagtgggttctagtttagctgagagttgtgggctgagcagaacttcaagctctttctgagccccagaccagctatagtctcagaaaaggattttgtgccattaaaggtgggtcattagctataagcgttttatctccaccaagaggggtaaatttcccactgattattgtgctctgttttggagaaagtttcagaaaaaaacactagtgacgaagctttatagcagatgttgggggtggagagttattttgttattttttgtgtgcatgtgtgtgttggcaggaaggtataagatctaaaaattaaatttaaaaaacataagaattggaaagtaaggaacaaatttattgaaatctggtgagtgtaactggatgaacaatggatgtaaagatgaacagcttctcatggccaaactaggactagagctcttagctggactctggagcagtcagggcacagaaagaactcactgatccctaggcaaaggccaatggtgctaggggaccagagagggaagatttgctcagcaactcattcattcttcattcatttattcatttaacaaacatttattgattagtcactctgagctgtattggggcctcagtctacattgatgaatcaaacaaacgtgacctgtcccctggaattcacatcccagtggctgaaatggacaaatatgtagggaaaaaatacagtaataaaaagctgtgataaatgctattgaatgctgaccataaaatagacattgcacaaggagatttaatctttccacttcaaggcaaggatagaccctgtcactctctaacattttttaattacttgaaatgatttaattcttaaataatatatttattttctgttttctccaagtacattgaaagccccctgataacaagtcttgttcacaattacatgtcttgttcactgcagtgtctttctcagtgctcaataattacttgttaggcaattgaatggatgaattttttattatcttcatgttaaccctgttagatgtgaaatacaaaaatcaattatgcccatcttatagatgaggatatgaggctttggaatggatctggatttgggaatcagcatcttattaagatataactactactaataataatgatttattggatgctcactatgtgtcaggcagtgtgctaggttccctgtgtggatcatgttattgaatcctcacaacagctctgtgacatagatgctattattatcccctttatatacatgaggagtatgaggatcagagagataaagttactcattctagatcaagggggtgacagtccacaactaatttgaatgtctgttttgaagacctaggctcactccacccactataccagagtgcttgcatggcctttatctgttctacaggagaatgccaggcagacactgtttctgacttactttactacccgttgggctcgttagtttggtttgagtacagaggaggaaactagaaccagttagttccttatggttacatagtcttttatgacagagctaaggccagatctagggcttctggcttccaggccagttttctttgatgtgaccacgtgatctcttttctcagtgactttgaaatttaatccctcctataaaggtttcctttctgaatggggccacaaatattaaaagctccttgtactttcagaaacttgaaccttatacatgatacttgtatatatctgagcagcccccaattcgatatttcatattgagaaggaagaaaatgacctgagcaaagtagaatcaaaattctcctcatcctgaaaatctaccctcagctttgtagtccgccaaataagttcctggacgatttgtggaagagaagtagcccaaaagactgaaaacaaaagcacactgtataaagacaggtaggcagaatgaaataactaaagattcaccggtgcagagatagtgaaaaagcaaccccctcttcagtatggatttcaggagcctcaatgcatgaaagtcccatgattttcttcttaaaattatctttgtatgattcttaagtttgaaaatgtaaaaataacaagaataagaaaatataaaaaggttatggcaccaactgtttgtcactggttcatttattactatagctgtcacctaaaaatgtatgaagaatgtgacatagaagagctaagttcaggtgagagaacatattcatggttaagagcatggcctctggagccattctacctgctttggaaaccgggctcttccatctactggattggcagccatggaggagtcattttatctttttggacctcagttacctcatctataaaataagtactagttggataatattatattactatatattatatatgatattatgtattctgtttttcttaggtcattttccttcttgtcaatatgaaatatagaattggagtctactcagaaatatacaagtgtcatgtgttaagtttaaggtgctgaaagtacaaggagcttttaatatttgtagccccattcagaaagcaaatctttgtaggagagattaaatttcaaagccactgagaaaagggataagataaaatagtcgtgctgaggaaaataatattatccacactaatacctacaacctagagtttctgtaagtactaaatgggattacaccaataaaaggcttagaacaatgtctgtcataatagtaaatggtaataatagtttttattacatgggggaaagatcataaaattaaaatttatttccttatattctaccatgcatttcacatttattgatctctccttctgggccaagcagtgtgctaggcacttgacagatggatgagatgcatcccctgccatcaaggagtatccaatctaggagaacacagactcatacacaactgattataatgatatgtctattcccagtaagcatttccaaccacaggcattatttgccatcatgtatctctttctctttatcacattgctattcagcatacagaatgttaaagaccagatggtgttaagctgcccattttaggactagttgtaaaagttcactccttatctcacatttaacacattatcttaatgagaaaaccattcacaaagcatttacggagtacttactcttagttggtaccttgagaaggatataaaaaggagtgcagctatggggctttgggaaaagcaccagacttgaagtcagaaatcttgagtttgagtcagggctttgccactgatcaaattgattgaccttggatgagtcacctaaaaactgtgtagctgagaatattaaatgaactagaaaataggaaaacagctggctttcaataattttccagttattcagcctttcattttttcagtataagacacaagacactgacgaattaatgaatgtcagtaagatggacgaattcactgtaaaagatatcaaagcaattttgtgattaacatagctttctcctgacacctagagaacccaaatgataaagtggggagtttgaagaagtaagcagctgagtgcttcaggaggattcactagtggtaggtgcaggatggctttttggctggggcaacaatggagggtcaccacttttaatgaattcattctttttgagaatatttagaaagcaataaaaggtcaaatctggcatctcatcctcccatccattatcacgtcactgaaattgacttttgctaagttcaccaatgactttattgtcaatgaaaccaatggtcacttctgaatcctgattttatgtgactgtttagtagtattctccatagttggccactctgtcttccttgatacagttacttccttggacttctgtaacacactatcctgatatactttacaggtgctttttctcagtctcctttttgagcccttcttctattatctaaaaattatatggcagaggtcctcaaagctcagttttttctagaccctctttattcttaccactctaccctccctaaattcagttaccatgtatacataaatgggccccaaatccagctctgctggactccagactcacatagccaactgccttgtcaacatctgcatctggatgtccacatcctacaggtatgttaaactggacatgtcacaggatgaatttatcaactcactaccctctgcaataaccttgactgtacttgactatactcctcttcattcctcccaaatcaaatgcaccagcaagttctgtttttgttgttgttgttggttttgtttttgagatggagtctcactctgttgcccaggctggagtacagtggcacagtctcagctcactgcaacctccatttcctgggctcaggtgatcctcctgtctcagactcctgagtagctgggactacaggcctgtgctaccatgcccggatttttttttttttttttttgtatttttggtagagacaggtttcaccatattgcccaggctggtctcaaattcctgacctcaggttatcagcctccgttggcctcctaaagtgctgggattacaggcatgagccatggcaaccagccaagttctgtcattttttgcaccaaaatatactttggctatgttaaagtctcttaatcttctctgccaccaccttagtctaagcctcagtggtgtctgagctagaccactgcaacattctcttaactgaattcagcatatatactattgccatttgcctggatgatattttacaaacgtaaattagataatttcatgcccttgtttaaaacttttaaaataggtccccattatccttagaataaagccccaaataattactatgctctataaggccctgcatgaactgacctgtgtccatatctctgacctcatcttgtacctttctcccatttgctctcccgcttcactctacaaacatattgggcttcctgtctcagtgcttcagcattctctttctctctccctttcttacatttcagatttcagttcaaatatcacttccaccaggaagccttgcctccaggctagcttagtctacctgttttgtgttccatagaaagctgcactctctctttttccctctcagaacccattttcttacttgtttaatgttttccttctccattagactcttaagtttcatgaaggccagaactgtgtctgtctaattcaccaagcacgatacctggaacatagcagatatctttaaaaaatgattcttacacaaatatccaaagcagcatcattcataatacccaaaacgtagacactgcccacatctgccacttgatgaatggataagcaaatgtgatatatctatacaatggaatattatttagccatgaaaaataataatgtattgattcattatacaacaaaaatgaaccttgaaaatatataataaagaagtgagtcaccaaagatcacacattgtatgattccatttaataaaaaaaagtccagaataggcaaatccatagacacagaaagtacattcatggttgccaggtgctgagaagaggggaaaatgagaagtgactgtcaacagtatggaattacttttggggatggtgaaaatgttctaaaattacataggggtgatggttgtacaactctgtgagtataataaaaacaactgaattgtacactttaaatgtgtgaattttacatatgtgaattatatctcaataaagctgttaaaatgaattaatgagaataatataaactatagatctgacaacgtagaaaaatgctgagtgacttttaatttacgagagagcaaagaaacaagaaatagtaaagcttcatctcgtgaattgcacacacttatttcatgcaactgcttttacctccttaggaaccggcaactgaaagagaaaacatgggtcctaaatttggaaaggacctcagagattatgtaattcaactatctcactctacatatgagaaatggaggtgcagagggaaagtgactctacaagttcgcacagcaaattcatgaccagacatatacgaaagcctttgtctcctgagtctcatttcagggttctttccatgatacccagccaagtcagcttccttaagagtttttccagtagcccttcacaacttccgtttacaaagtagtaatccctatctgcaagggaagctgtgagatatagtttctgttagtaaggaagaaagggagaacgaccctttgggaggcaacttgtattttctgccacaagttcttttgcggaaaattttggattggccagtatttagatctggaagaatccaatgttctctgctgttacctctgaagtcagcatgaacatttccagtacagtgtgaatacaatagccacacatggaacccctttcatgataaacatctttagccccagttgagagtctccacaattcctgagcaatttgcatttggcagggctgtgtgcaagacattactggctcaaatgaatgtaaatttactttagaaacaaatcaaggtaacattcactatcctggaataaagaaacaaggtgaaagatccttttagaatgcaaattgcaacctgttttgtaaaaatactgagtgacagcaggcacagtggctcacacctgtaatcccagcactttgggaggtcaaggtgggcgggcacgaggtcaggagtttgagaccagccttgccaacatagtgaaaccccatctctactaaaaatacaaaaattagctgggcatggtagcgtacacctgtagtcccagctactcgggaggccaaggcaggagaaccgcttgaacccaggagacagaggttgtggtgagccaagattgtgccactgcactccagcctgggcaacagagcgagactccacctcaaaaaaataagtagataaataaataaaaataaaaataaaacatggagtgactttacttgtctttttaaaaaaataaaagtttaaattttctttcctacaggttttttactatatctaattacactggctttggaaaagagttgataaacatggataatattttaatttaaaattgtttaaaaatgtggccaggcatggtggctcccgcctgtaataccagcactgtggttagaatgtaacaaaaattgcaggaattaaaaaaaaagaaaatgttttttaatcattcactttacttttgagcctagtggttttaataggatgtaattaacaacattttccatgtttttctatttgttttctctgcttgttgcaaactacctctttaaagtaaaattgtattggagaagtctagggtacagtggcctcttctcttgtagtttgcaacaacttttccccaagtaaattgatactaatggcactgaaaatacctggaagcttgatgtctagaggacaaaaaggaaagagtggctgcttcttccctatatactgtatgctaacaaagaaaccaggtctgcagaatccttttaactttcttgacttagtttcatatcaaccccaaaagtcatgtagtattgaccatttgcagaacagagcaatgacaacaattcctccagataagttaattatctgcattaaagaatgcctcatgtttcttgatctactaataatattagataacatgggctattccaaggcattttaatgagtaccctggcgatgacagtctttgggaaaatatttctgacttctaattaactttaaaagtttccttgggcattttttctggttgttgttgttttgaaactgagaatgaaagaaggaaattatatggtagacatttaatgcattctttctgaatctttctgtagatgacataaattaatggctgttctcatttttcatgctcccatgcatgaaaagaaagaaattaagacaataatgttatttaactattataagaggaattcatctttgatcagaattatccagagctttctacctctggcatctgtgtactttactgagacacctcctgggccaatgaaccaactcaagctctgccaaatgtaaatgtttaaattttagtgattccggccccaaatcttactgtctatatccacagcattgggagaacacccttttctgaagcataagaaattctattacccagcagcctgggataagttaaattagtcagtagacaatttcactacaggagtatctgcctctaggaaaaccattaattttgtttaaagtgactgtgtcacaattattgaggacttttcaaatttttctattgccagagagtcttgcttaaagagaagaatgttgattgactacataatttttcttgctcctctcctcctcaaaaaaatcacacacacaaatatgcaaatatgtacagatatttaactcaattttgactgacctttcaataagttttctggataattaaagtagggcctttataagttaaaaagataatcaaaactgtggtactggacttatgctatgcacgaatgacagtgtctcacataaaggtattatatagaaaaatgaacagaaaagtgaataacaaattgtacgaaatgtaaggtgtgtggtctattaatctaaagtacaacaatctcactgaatatacgtatcagcttacatttttgatgttatgtttcagtttgcatttttgtgaacatgaaatcctcaaatgcaacataagtctgtgtgggtcaagtcggccatcctcactgcacacatgtgcgaatgcaggcatcccctgaatccaaaattgttacaaaagaaactgctaaagtagattaattctgcatgtagctttcttggtgcccttaagggcagcaagtattcctccagggaattatgtatgttcactcttcattgttttcctctaaagggatcatattatcagtgaaagaccctattggtcccaggcctactttagaagtgtcttttaaaagattgctaggccttcctaagaattaaatagaagaaaaaggcagtctgtacagatctcacctctggtaaccaaaagcaagcatctttgcagctaactttgcttctgttgcaattgatacagggacaaatggctgtaattatataggggaggataccaaatctctatttagagaccagagctctattagcagtgcattttccagggtctgatgactagtaaacaggaaataagcctatctaccttgaatgagcacagctatccccctggggagttccattaaggataacagtgatgatggtatgtgccactactgggcactcttctatgcagcgcatgctaagtggaaatggcattcttttctcagactctctgctcacttcctgtactgtatataactgcattatgagatcttgggtgtccttctacagaggtaggaccaagtgttctttcgaggattgagagaagagagatttggaggtgggacaatctagccaaataatcttagtcactttattattcataaggatgttaaccaagagttccttagtagcaaaatgagattctttatgttgtcagttttccaaaatatattccacttctctctgtctcagagcaggccttttcagagtagaacattgtgcctccactgaatggtaccttgctttggctttgaagtctctctatcattttgtattcctaactcctctccccaagtctccatctatctgtcctgaatcctctctgacagtcatcttattgtagattatatatgaaatgaaaaccaactagattttttcagttattgctgttgcttgtcattcctttttcttctccatattctgacttcagatttgaggaatggctacaattcttgattatctatgataattgtggggcccatgaaagctatttattcaaagcacaatgtagaaaaagggagggctttagagttgcacagctctacactgaaatcctatcactatcccttactagttaactgattttgggcatattaagttctctgagccttgtttacttcctctggaaaatgagtgtgaaggactaaatgtttatgctccccccactaaaatgtatatgttgagattctaacccccaaggtgatgatatgaagaggtggagcctttggaaggtgattaggtcataagggctgagccctcatgaataggattggtactctgaaaacagagacctcaaagagttccctaagctcttccgccatgtgaggttacagtgggaagatggttatctgtgggggaggaagccctcatcagacaatgaatctgctggcaccttgatcttggacttcccaacctgccgaactgtaagaaatgaatgtatgttgtttatgagctacccagtttatggtattttattatagcagcctgaacagattaaggcaatgagtctaataagaatatctactgtttggagttttaggattgaaaattattcccctttgcatattctgagttaggagccactctttgagtcaggcaaatggagatacaaatgtcaatttcattattaataaagttgatttaaaccggagactgattactgctactactttcctactcatccaccttgaattccaaacttacccagccaggcagtcatagacagaactgtgcaactgtggtcttgccctacaacgggaaatccttccccaaaaactttactaatggctaggctgggaatttacaggttctccaaaagagagactgaaaactcataagtgaatgaatcatacctgctcagtcccttctttcaatgttgccaagcagctttttcccctcttcagttaggcaggagtggtgagggatgacttggaattgctcctcccctattctttttcttctctatggaaacttgagcagtgaggcacaagagttgtcttattaacagctaggattagtgtgaggattaaatgagataccacatgccaactatcttatatagtacctggcacatgatagaagttcagatggacaatacaggaatcaaaatccagcattactcattagccatgtggttttgtgtctggaatttgtgggttcttggtctcactgacttcaagaatgaagctgcagacccccgcggtgagtgttacagttcttaaaggtggtgtgtctggggtttgttccttctggtgttcggatgtgtttggagtttcttccttctggtgggttcgtggtctcgctggctcaggagtgaagctgcagaccttcgtggtgagtgttacagctcataaaggcagtgtggacccaaacagtgagcagtagcaagattcattgaaaagagcgaaggaacaaagattccacagtgtggacggggaccagaaccggttgccactgctaggttgggcagcctgcctttattctcttatctggccccacccacatcctgctgattggtccattttacagagagccgattggtccattttgacagggtgctgattggtgggtttacaatccctgagctagacacaaaagttctccatctccccactagattagctagatacagagtgtcgattggtgtatttacaaaccctgagctagacacagagtgctgattggtgtatttaaaaaaccttgagctagatgcagagtgctgattggtgcattcacaatcccttagctagacataaagattctccaagtccccaccagactcaggagcccagctggcttcacccagtgggtcccgcactgggccgcaggtggagccgcctgccagttatgcgccttgcgcctgcactcctcagcccttgggcggttgatgggactgggcgccctggagcagagagcggcgctcgtccgggaggctcgggccgtgcaggagcccatggcggttggtggggaggctcaggcatgggggcgctgcaggtcccaagccctgccccgcagagaggcagctaaggcctggcgagaaatcaagcacagcagctgctggcccaggtgctaagcccctcactgcctggggcttgtgggccagccagcagctctgagtgcggggccgctgagcccacgcccacccagaacttgcgctggcctgcaagcgcgtgcgcagccctggttcccgcctgcgcctctcccttcacacctccctgcaagtggagggaagccggctctggcctccgccatcccaggaaggggctcccacagtgcagccgcgggctgaagggctcctcaagcgcggccagagtgggcactgaggccgaggaggcaccgagagtgagcaagggctgcaagggctgccagcacgctgtcacctctcagttttaggtaatttacccaacctttctgaacttcccttgtttgatctttaaaattaaggtaataacaattagcttgcacagttgtaaaaattagagaaaatatctgtgaagggcctggtgcatagtaggtacttagtaaactgcaactattatcattatcatgatccagttgtataaattgatttgtagattgtgtcctgcatttttttttcccatagcagattgacatagcagtgctcacatttatcaatgggaatagtcaagggttgaattggtaaaagtgtagctgagaagcaagtccaggacccaaggcaagcattctgggaatgtaagaatttctgtggctcatccatagagcagcaaacctacatgtaaatattttagaggtgactgaagtttgaaacgtccttttgtaatataagtatatttttgaagattaaaaaaatatttgttttgcaaagaacattttttcccatatggaactaattttttggtaggaaattagacttgtagagacaaggttttcatgcctttcattcttttcaggcttacaaagtatttcctatctggaaccccagttcttggccaatttaatgttgctgacaattgtatttggtaggataatttcagtttcacctaggttcagagaataattgccaatatatttcggaaagactctcttaaaatgttaagtttttccctagagagcaatctagtacaatgaaatcttcttgaaatattatttgccaccattttagaccttccagtttggtgaacgtattactgtcatacttcattactgtgtatttttggtgtacctttcacatcaaaaccaccattcaaaacattttgtgatttaaaagtacaaagtcttaaaaaagaacatagcacttcttcttatcagaaatccagcacagatgagaagatttattgtctgatagtcaagattggattgtgcagttgtttgtgagaaaccagtggatttgatcagaaatggaatgagtatactgatgtggcagagagaatggaaaatttgggttttgggtttttgacttttttggggaaaatgtctctaaaacattgttttcttaacaaattaattctaatggaaaggtagtaatcatttaggtttaaccactgaaacaaacaagttgctttcccagagttgacacagacactcaacaggtgagtgaatgggctctgtccttgaagctgtgtccccacccaaatcttatcttgaattgtagtttccataatccccacatgtcccgggaaggacctggtgggaggtaactgaatcatgggggcagttacccccatgctgttctcatgatagcgagtgagttatcatgagatctgatggttttataaggggcttttcccccctttgctcagcacttctccttcctgctgccctgtgaagaaggtgcctttcttcccctttttcttccaccatgattgtaaggttcctaaggccttcctagccatgcggaactgtgagtcaattaaacttcttcataaattacccaatctcaggtatttctccatagcagcatgagaacagactaatacatattgctcataagagggactgagtgagagtaacccagctacactactgtataaacaagccagagcttaagggatattgttgagatcattaatatcatttaggtacatgaagtacagtgacccactttctaccttccagaactaggcagaataaagatagaaataaactcttcttttaaactgtctctgttagttgttgcctgacagacttgaagtcaatgttggacccataaacctcaacaaatattcaaagggaaattccaaaatagttgtttaaagtggctaagttttcaccccagtgtagagaacaaaatagtctgtatgtactgtgactgtgtcaagaaaatatttgaggtggcattatcaaacaatttaaatgtggtctttgatgatccagaaacaaaaaaccaccagagaagtcaatctgttattccaaaggtcagggccatcagccccagtagctgaaaaaaggaaataatgcaaagagcttctggtcctagggctgatcaagtgagaggaaaggacatccccaggaagccactcttctgtattcttggctcagaggcagctggtaatgccaagtgagttacatatttactccattcacaaatgtgcaagtaaattgaggccaatttgtgttaggattaaatttattccaaagaggtgctcacttgagtggtcctagcaagccagccatttttagttacttcagctctatgggtaagtttaggaataccaaactagcaaattaagaaggaaaaaaaggaaaaggaaaacatgttataaaaatctaaaatctccatggacttttgagcaatttctgttgttcttctgaaatgtattgcttttcatttctccagatttgatgtttaaatgatagctgacaattcctgtttgggaaaactcatgcacagatagttattaccctgtaagaagagatgtgagcgtattcggaaatgttcatcatgtgccatagctcaaaaaacatatggtacacagccccaataaaaatgagatgcagaaattaaaatgggcgggtgcttctggtttttgtttgttaactgcaactatgtaggtctaaacttcatggttttgtaggtaagttactgatacagtggttagccgtgccagtgtcttggggacaagccttatggatcccagtattgcagaaaaaccaggctcagtgcagttgttacatttcacaggacacactttgacctgtgatgtagccaggtttttagttacaagctccatcataacagggctctgttgtgttttgtacagttcaataaatcaatttgaacagatacatctcttgttggaaagaacttagatactttttttttaatgagggagcaagcatttgaattgaaggatttgaatacaaattgaagtatattcttacatgtcttagagattatatgattgcaaaaaacaggaatcttcacaagttaagcctagtaaaggagaatgcattttagggtaaaggaagtctcatggaaccccaactcatgggggattagaaattgtcaggcagctagctcatctttccatctcttgctctctgtagcaacacaatctgtcatctctgcttctttctgcacagcggctcgatcctgcattctacaaaatggcttcctctgcctggctcttaatttctacttccccacacctccagctcagctgtagctttaggttgttgttgcacctattctggccctaaatgtttttgacctaatgctttcggtgcccaataacttctgacctatttagtctttgttttctctttgttcaaattttcaagaaaattggattggcttttgccagtcaacaattgattcactcccagcatgtgtgtccacttaggcagtgtttgggggaaaaagtgttaacaaaaaatgtacagctgtaagcaatgtagtttaaactaaaaagttagttggatactgtgaaatgactaatgtatcaaatacatccattattgtaatgataatgatgataacaatgactatagtaattaaattactatagtaatttagtatagtaattaaaacagctacatttatggaactctttgtaagcttattatatagacttatttaatcttcacaacaactctaaggagtaggtattattactgtcccagtttttactgatgggaaaatttaggcacaaagaagtgacttatccaaggtcacatggccattaagtggttgaacaagcctcaaacccagacagtctgacactagaattttgatgctctactgatgattctgacactgttacaatgaatttgtgaaatgtggggctgcaagatagcttctttgtgaagaaaaaggaaaattcatttaaaccagcaaaacctgtatgatacatactagatatatatatttagtccctccaatatcctttacccagggagaaagggattaggatctcaagaaatatttgtgtctctatgtgggtggaaagagaagaattactctctcatctgagttattttagtacttttagataaatgaaataacctttaaatattcgtgatcagagcattacccaattgtctctttgccttcatatttatttgaattcaaattaaatctgccttttagcaactatcgagaataagatctggcactttggagtggaagccaaaactggtatgtatgtgatgttactgccctcttcccaagccaccattttattgctcttctgggaatccagttaaattacagctgctgatatattgtggactgaggatctaaattcaggctttgaccaagtcatgggctggtttctttgggcaatatttcacttcctgttttatctgtgctgtcacctaaatttagcacttagactatactccccgatgtctgcagaagttttaaattattttccagtgatgcataccgtgtctatgcagaattgagtgtgacagatttgcagtaaaatcctggagctctccaactcctttttaaatgaattagatcagtagctctcacggatttgacttggaatgggttgtaaggtgatgtgtttcctgcaaaactgattgagttctctttggtgtccttttttttttcctctgctgtgcattttaccatttggtggactaatcagtttcttaaaagcaaaagatggatgctgccttctaaaccatgggaggtgtcaaatgcctgctgcattaagaccctttcccctacttgcaggaatgatagctatgggcagaactgtaatagtgttctaaattgagaaatcttgaataagacataaatctaaattccacacctttcttttttaatgtgggcttcaacaagcgtcagctataattggtagaacagcctgacctattaatccatagataaaaatgattcaattaaagagaaatataaatattgaaggtaatgtaaaaccaaatgaagcacatcaccgaatttatgtgcaaataaattaacttgaataaaaattctccagtacatacaatgtccatatgctgtcttggtaatgctataattaagtcagagagtcatgtcatactggccttttccatctgctctgtgatctgttaagggacccattcaaacagaatgacagctgacctcaaaatgatacactctactactgccattttaacagggctgttggttatgcacattttgtcttcatttatactgggctacgagtgtttttccattaaatcaagtaaattggagcatgtggttttctattaaataggtttatttaaaccaatattttattttctgaataaactttttttttatttttcagaagcaattgattgtattggagacatttttgttttgttttgttctaaattcaagtggtgttagaaagaaacagtgattaagaatagcaaaataaaggcactcttctctttttccttctaattcttgttattcgatcaaagcaaagtggttaattcttggagcctcaggatgttgtgtatgtaattgacacaaaagatgtgtaaaagaggagccaatatttataatactaattgatttcatttattttacttcccttgtgtatgcctcactgtcattcttgccattatcttaatgttcttgtttccaatagcactcagaaaagtcattttaaaggcaggggatctggagcacagatgtgtcaggtgtaaaggctctcctccacagagacattcaaattggctaaaggaaaccccacggaatagtgcagctgaagatccagcatttgtccatctgtttatatccaggttaccttgtgacagtctatttaatttctggtccctggagtgtctctatttcaatagtacatgcatatttcttttattagaactgcagaaggggaaaattggtaactcttggaaccaggatgacctttagaagattacatttttgttttgttttgaacaaataacacaagttctacaagagggtttgctctagtcaaacactcaacttcttagagggaattttaaatgtctcctatttggccttggaggaaaaaaggaagaaagaaataaattatacttgcaatacaacagagagtgcttagaaaatgggtttaaaatatattacaatttaaaaactttttaaagtaaaacccaagccataccagagacagacagtatccatagagtgaccaagactgacccacataagaggctggagaattacaaaagatgatcatcagacagatgcccattgctctctggggaatcttgaccttggcatgttggtttctgaattaattcagagaacctaatttgccaatgtggaaaagtcacataatacatggtatcttatttataaataaaaatccagatggaatttcttagtaaaatgtatttaggtaagtctacaagggacaaggaccatattcttttacttatgcagtctagaaacatttgctgagcatctaatatgtccctggcattattttagcttcaaatgatgtgttagtgagcaaaatgaagtctgtgctctcataaagctaacattacagtgtgggggttgtgggaaggcagacagtaggcaaacctgttatctgttctgtacagggcccaggacccattaattagccttgcatctggatgttggttcaaagataaatatttatgaggctttcctgaaattgtaaactttatacccaagagcatcctgatgagctaaaatgaaattgaccacatatactcatttcaatgaaataatgtttgaaaaatttcctttcattttgcccaagtccatatagtactttattgtagtgtggtgaaaaggatataggattagattctgccaagaaacttttacctgaggtatttatatcccagtggagagaaacaatgatgcctaattaaaagataaagatagaaaaaaggggcagagccagagaaggaaaaatagggagtaggggtggaggtagggttaggaaaactttattcctgcaatattctttaaatatataagaatttattttcatatcagggcaatatcctagtagcttagtttagttggtgagagccccacgttaggatggcatcatagttaaagattcagttcttatttgaaccagttagcttaaatctatcccatccctttaacccaaccagtcatgatacgaatatcagccacaaatcacaagcagttgcacattttccacactactggaaaaaaagaatgaatcaaacacatcttctttctgtatgatcagtgaggcatgagaataattggtagattgatgatctgagatgtagttgatgagttagaaccatgaattctgccagacctttggaacaaagcatattaaatagtattttttttgtgggtgccaatggcagtggtaacatgggagaggattatttaaaattgtgtttaaatattcaaagctgtatgtgctaggtatataagtgaactagtatttctcttcccttaagtaacctagagataggactacatttatcaacgttctctttttatctccttctgcagtcttccttcaaaacctacaggcttttaaacaaagaccctccatgactcttatcaacatatctgttcctgggcctctcccaaaatgatttagagataaattgcctcaaacctggcttggtttaatgctataatccattatggttccttttggaggtagcaaattctcatcaacttcattcttattaatcacctatctaaatgtagcatcatcagaacaatttcagaggtttttaaggcacaaccttgacttcctgtcatttgtaaattggcttataacagtcctggcactctgctaaagtgcttaactggtcattattcctccttgtactacatagcctttatgctgccagtagcccatctcgcctttctgatgtcccatcatattacctttaaaacagtaattttgtttttttgaactttgtgatggggggttagagtaggtcataggctatttttgagaatctagagaaaacagaaatctctacacaggagaaaatatacatgaacatatggttttgtgtacactttcaagggatttgtaaacttgtgaagcccatccatatacctcagagtacaaagtcatggcgtcaagattatatgatttacaaacatatttaattgaagtaaaccccatatatgcctatttataggctcataaatgttataacatttttatttttattttatttttccatctaaacttcctccactcagggtcagatttgcattgtggtctgccagcttttctagtcttctttgactccctcctcattttctattacaggaatttcccttaatgacattcttgcatgttcaatcctttcttggcatttgtttctcagagatcctagactaacacattcttctactacttctataaaaagatactatcatattataatatttttaggactattaagagaaggtgtctatttctgttttttccatttctttgaatttcactttaaatttttttcacctgctttgaaaaacgtgattgttcattaagttagccacagtgacaagtgtataaaatttgaataaaatgttcctggtatgtttttatgattcccaaatgcattttctttctcctttctttccctcctttcttttctttctttccttccttgcttcttttcctttcaattttatttaaagattttttaaatgtatgttacaccttacaaaatcatacatttatctaaggatagtctgaaattcttggttccaatgacatttcatttgtgtatggtactttctttaagctgcttgttgttgatttccaggcacttaaaaaagagaatactgtttgttaagttccaatatatttctgtgttaaaggtacaatggttaatgttatcatttccatgagtgaaaggggttgtctgttttattttctaccacatatattcccagaacttagcacagtgcctggcagaaaaaaggtgctcaataaatgtgtgttgaacgtataataaggcattagagcttataccttgaaaaaaacttaatgttttaaaaagtcatttaattatcctaatcccacaagcttcttaaatgttcatccatttttcccaaagtcacgtgctaactctttactaattctgtctaaatggctattgcaatgacaggtatcccagggaaggaaggccagtcaaaataacaaaatatctttaaaagaatgaaactgtatttcattcaagcacagaaattataactaaactaataaaaactgtttcaatagaagttctctgattatgtttaagaaataggtaataatttattacttttttctcagttgatatttacaaaatacagttgacccttgaacaatgtgggttttaactgcatgagtccacatatacatggttttttcttcaacgaactcatatcaaaaatacagtattcacaggatgtgaaccctgtgtatatggagagccaacttttcctatatgtgggttccacagaactgactatggaaatcgagtagagtgggtcctggaaccaattccccccgtgtatactgagggaaaactgtacttaaaatcaatcctctctgagaataaaggcaataaataaataaatatgaaaataattctctcaagtatgttaaaaatagtcctagaaaatagaattccagaattagaagggaccttagaaactatgtagttcaagtttttatccagtgtaagaaattcttagacagtacccctctgtaatggcagaacatgctatttttgtaggtagtctatctcattgctgagaagttcttcctaaacactgaggcaaatcctggttgtctgtaattttcctgtacttgctcctagttaagcctctgtagccatacagaatcaatgtactttctcttccatttgaaagtgctctatgtatttgattatatcaaatggatgtcacagatttgctattgatctatcatgtaattctataccagtctatactacctggtgtctgggaaatttcaagtaaggaatcagttggaaaaagccatttggagattaaagagacatccacagctttctctctgatctgccctctctctaggaaatcacctcccatgactcattgctcataaggatgtggatatgaaatcatgctagcaaacatccctgcataattgacactggctattccctatgtagtaatttgtttactatgttccttttttcctcctacatatgttggaaagcaaactttaacaaggttcctttctgaattcttataagttccaagctagtttcttttgttaaggattaaataaaatttccattcagctatttgctaaggaggtgaaattatgtttttagtgtttggaatatagcaggtgaatcaaggtgaattaatacgccattgaaattagttgcgaaaaccattctctttatcttagttctcattatagatgtgtaggtcagtaaggtttgtgtcataatgtaggcatcaactgtattattttctgtgaataccgacaaaacatttctttagtaacaaatgtaatcaggcaacataccagatattcagtattcttcccaagttgattgggcattgcttccagtttctgccagaagagcatcaccacatattacaagaagcatagccctccactctataacctttgatattttgcccagaaatgttgagagttggaaatcaattacaatatagcaaaaatgtatgagcatcagctaaagcttcatctttgcttccttttttctctctgaaaaattgagtctggtgattcttcagtttttacatgtgtgctatagagactcctaaaagagcaagcaaggaaaggaatttaattgctaaatgcacttgagtagatctcagataagaacaggtaatctttgaagttataaagcagcaagagaccaataactttttctctaaccaatggtttcgatatttggaagattgacaggcttagagacactttcttattccagcaaaagaataaatgtattgccagctacctccccaaaggctgtcaaccaagtatttgttcaatatatttatcatggtttattattttaatttatgcgtaggtatctgcattatgtcctgaataagtcatgtgactgaggaccatcagtggctagtttgagcatgagtgtaagttgcatgtggtagttttgtaggataacacatttttaggattggaagaaacagaacttttcagtttccaactatattagactaggaaaattatacacttaaaggaacaaactggcttgtccaaattcacatggctggttcataggaaacacagtggtagaactctttatgtgactctagttagaagtccttatccaaaaataatggaaaagaccaccaaaataatttcttcaggtttttataccaaatctgaaccttgccaaataagttgtattaaactaaagatttcttgtatgtaggtcattatttaatacctttaacagtatttcacaaggaaaatgcaaacaaactaaaatgcttcagtttggaagagacagacaaatgaaaaaaatttttattgagaattttaaaataggtaagcaaaaactacaaatagaaaacagccagagtatacatacatattcagtttaatctcctagacttcattccatttagaaatgtgggaaattttataatacatatagtactcagagatatttttgtgagaatgcattgtgatttggtgtgtatgcttacaactaaattgtaataatccaaaggagtctgctatctatctctaattccttctgcttaagtaacatgtaccaacccttaagcagtggctaaggaaaggacatgacagaactcttgatcctccttttttatgtccctgggcttcttcctgccaggttttgctgaaatatctcctctttgccttaagactgttattgctcattcttatttgttgtttattttttatgtgcttgcccaaaaattggtctgtgttatgacttttttcattctttcccttcctattatgttgccgtttactaccctcctacatcagaactacttgccttccactactttgaaacaatattaacaacatgatgtgtatatctacacaactttctatatgcataagcatacacaggaaattttgtttgttttacacaagtgaaattatgctatgtacacttctctgcactctcacttaatggtacattttggaaattccttcaagtcatttggtatgatacatataactcatattaaaaaaggtatagtgttgtgagctctgggtatatcacaatttattcaaccatttccctggtgtttactgactccatacatttgataatattattgacccaccgtgttctttctttttcttctgattctatatagtttatgctctgactgacccactacttctagctcttgcttctagttttccttgcattgccctctagtgatttcttatatttaggccttagttctatgaatgaattgtaagcttcttgaagacatacatgtttcgtatctaatattagctatagtacaaaacaaaatgtgtccacaaagtaagagtgttagattgataaattggccatggtggagtagaagttttagagctgtgaatctagactagggaagaatagaagaatctcagagccttaattaacttttctgttgtgttgttatttctgccaaacatctaaattttttccaaatccaactgagagtatatctcttctatgaagatatttaattctgtgaagtttttagtctctaataacttatgttgtcttagtccattgctgctgctataacaagataccttagactgggtaatttataaacaagagaaacttgtttctcacaattccagtctcacaattccagaggctgagaagtccaaaatcaaggctgccagaagattccaggtctggtgagggcttgctctcagcctcatagagggaaacttcttgctgaatcttcatatgtcaggaggtgaaaaaagggacaaacttgctacctcaaatacttttataagggcactaatctcattcatgacggcagagccctcatagcctaatcaccttccaaaggcaatacttcttagtaccatcaccttggggtttaagttccaacatgtaaattttgaagggacatatacattcaaaccatagcatatggcaccctctcagatcattgatttttgtctcatccccctgctgactcttaggcaacatggttgatttattggcagaatagaaagactgcaggggtttttagatcgggggtcattcctaatctcaggtaactctgcaactgctgctaatatctggaaccaggaggtatctcaaatgatatatcatctaatttatatattgaagatggctgggattaaagaattccttagtatgcagcccaataccacaagcctattgtgaaataggtgatccttcttgaccttttttggtgtagatgccctcaccatccaccaaagcccagttcattaaagcttgggcaactcttctgcttagaacccttcagtggttctccaaaacatccagattaaagtgcaagttgattaatattgaaaacaagactcccacatcatcttttctcatcccacctacgtattcagcttaatctttcaacacttctgttgctgctgctggtgctaataatgatgataattctgatgataacagctaatgttttactgagtgttttctgtatactagacacatgtattttgtatttgaatcttcacaaaacccctataaggcaggtacttttgttatgcccattttacaaatggataaatcaagcttcaaacaagttatgtaacatgatgtcacaaggctattgagagaactaggaatgtttgactaaaaaatccatgttcttaaccactattccagtgctcctcaaatattgtgcacagtaatcccattgactgcttttagaaaaacatgattttcagacctcactcaagagatttggattcagtagatcaagatttagggccaagtaatatgtgcatttacttagcacctccaggtgattctgatgtattaccgccgaccatttgagaagtactattctgtaccaatgcctctcaaattttaatatctgtatgaatcaaatcacttggtgaccttattatccctgctgatgctgaatcaatagaattagggtagggcctgattttctgcatttctaacaagcttccatccaggaggatgcaaatattattggtccacagattacacttgagatagaagtcctatactacatgccttagtgataaaatgcgagtttagcataagaatgaggtatatttcagttaagtagtgtgttatacaaatagatatatccctaaaaaactcagacacaaatcttttctgtcacttgaattccattttcacattgactttcaggatcatttcagagttactaccattatttatttttagtagatctctagtagcctaccacttcaactttgtcagtcaagtacttagtaagtgatgacctcttaagcaaacactcaagtaccctagaagagcttactagaaacagaaagcctgtcatgagtcctctaataaagtggatattctttttgttatataaatacgaaatttgaaaagaggaaaagcaaatgttagatttctagatctgaaaaggaccggagaaacaatttcattcaaactgaattttacaggtaagaaaaggcaggcaagaatgggaaggtagtgtaactaaatttacacaggggattagtggcagagctggaactcaaattctagtcttgttggagtttttatttatttgttcttgttggttggttggttggttgtgttttgaaagcatatccttaattccatcttagcttcagtgttggagatctgtacttctaagctgtatttaaggggaaagggcaacaattacagctgtttttcctaagtaaataggactctacatcggggttagcaaactttttattttctgtaaaaggccagatagtaaacagtttagaccttgtgagccataaggtctttgtcacaagtgctcaattgctgtcatagtatagaaacagccatatataattatatataacatattaatatataaacaaatgagggtggttgtggacactgaatttagaatttcatataatttttacatcatgaaatattattattttcactttttaaaaaccatttcaacctgtaaatatttttttttttttgctcataggccaatacagaaacaggcagcatactggatttggctcaatggccataatttgctgacacctcctgtaaattagtttagttcttccaaacgctaatataatttatcctcaagttgagcaggtagttcttgaacattacatagaaaacaagttagctattcaaagttcactggtaggattagtggcattgcatgaattttgtttactggaaaaatgtaacagtcagaaagagatacacattagcttatgagtggggatatctgctttgctgaattatttctaatctccagagaggaaaagtaaagcccaaggcgtaggcataccataaaacaatttgtttcatgatagccatagtagtctttttgactaaaagggcattgaaattcttttaaagacttctgtgaattggctgccatgctctgtgttactctctggtgggtataggaaatttgctgaagtcttaatatgtcctattcctttaattcgtggcagggaggcaggaaaatgaaaatagtttgaaagcaactgaagtatagatggcacttggtcaaataccaaaggtttcaatgaaagtcgtcttggttcattgtcagatcatcccaaagaatcaagaaaaaaaaaaaagaaaaagaaaatgtcatattagcatagttgttttgcaaatgtcggctttaacaatgctcaggttacaaagttgatgctctaccacatatttatttattttaatttaaaaaaaacacagttggaaattcaaccagaatgttgtcaaatgcattgagccttttaaagttttattgaaaatggtggttaagctgcttcctctcaaaaagttcatttaagataatttcgccatttaaaaggaggtgaggatccttataataataatagtgatcaaactttgaatgcagagttctttcaaaaaatagattttcaggggaaaaaaaacacaagaacaaatttaaccattccagtatgatagtttcacagactgcccagcttttggataaccacctgcaacagaaagatagctaagaaaagaggacaatgtgcctggatggtttcccactctatttcctttccaaaacaaatgagttcccttatataaagttatcctataagagaaccaaggaaagtattcttgttagggatgtatatgaaagaaataattaaaatctgagtctatttaccagaagagattatgttgtttcttctattctttatattgtgattaaagtagagagaagacatttttgggcaaacttactagggggagaagtgcacaatttgaagtttcttggtttctcaaagatggaacttaattgaaatcaatatgagaaaaagcaaaaaatagaaagtgctgttctgaacagaagaaacttgaattagctaaaagtgtgatatgtgtagcgttccttgcagtgttgaaatgtattcaataaaaatgtttctatgaagtaacatcactttccctatttcactggcaacagttgagattcggaatcaccaccgttgtttcttttatagcatccactggtaaatctgatgatatctataactgtctaaaaattataccaaaatgttgaagtggagatgatagatttcatttttctcagttaacacattatgagaaatattctgtgtaaatataacctctgaatcaaattcttttttctgtactgattttcataattttagagagatatgtaacattatttttattgatttttaatagactatggttgatagcaccttagcattgtttcttttccctcttcatttctaatttttgtcaaatggcacattataagcagataaatgtacttgcaacttaaggaaattcaactttaatattttctgtatggtaaaaataatttttatataaataactgcttcaatttatctcttcttaattttagcatttaagtaatgcatctgatgtgtgtgtgtgcacacatgcacacaccccaaatgtctttcaaatgaatttgctcacagaaccaacaataacaataattacaaatattataatatttttgttttagttcaggctgctataacaaaatactttagactgggtaattactaaacaacagaaatttattgcttatacttctggaggttgggaagtccaaggtcaaggcaccagcagatttggtgtctggtgaggacctgttcctcatatatggggacttctatgtgtccttgcctggcaggaggggcaaactccctcaggcctcttgtatatggtaactaatctcattcatgaagaatttaccctcatgacctaatcacctcccaaagactccacctcttaacaccatctactttagggattaggtttcaacatatgaattttgaggggacacccgtagtcggaccatagcatttttatagtataccatcacagaaagacctgcaggtattttcttatcagaaaataagacattctatcacttttctattttagtaagatacattatagctttgtgtttgtaaaattgtctttctaatctcagactgcattttatttccatttgctgtttgacctcttcagcttttgtgatttctgatgccacagactgcttttattaactttaaacatttacttgtgatgccagaacaattcaaaattgatttagtcatattagctaattatctgatcaattcagtgagcaaattcaattcaacctcttttttgatagaattagccaatggcttaaatgaaatttcttatcaaataaataaaagttgtagaaccagtagtcatgtagacacagccatactatgagctttcttccttaccccatgttattgaactattgtaatatgttgcacattcattcattcaacaaatatttactcattgccaattatgagttgagcactgtgctaagttctacagatatagtaagtatctctctctttagtatgtttacacacagaattattcaagagtagtcacttagtttttcctactctatcaacattgtggttttaatagccatgtagggttcatttagttcaggtacttaatactactgtctacaggagccagatatctgagggtgaggagagactttatgaacaataaaaagtagatgattatggaggcccaaactctataataaggactatatacagtttacaaagtctatacaatgaattctaatatcagcttccatttgttcttcagaaaggagctagtactagtcctggccaattatggatcttcttgtgtgtgccttatgtttgtacctaatctcagagtctgatctctacctttttcttttcttgtaagatccttcattctataacttaatcgttggcccataactccagaaattactgtgaaattgctgtattcctgcatctccaactagagtttgctatctctgtggtctcactacatggatcaaagttgttctgacggtgataaccaagatgacaaaggagtgctactttggaaaagccatatcttacttggattcagagctacaaaaaaaaaaaaaaaagatgcccacttgcaacattgctatttgtccatcccattttctgagtaatacacttaaacatattcaggtaatagtagttactatttaatatatttaatatgtatgcattgccaaaccttgtggaatatactagcatgagaaatctcatcctcatccttttacttcacttgttctctaactattgtagtgggtgactggtggttcagtagttagagcagccattaaatgatctggtgtgtttataagattctcccacaaaaacttgtaactattatttagtttcaatttttcaaaggctgaccaaacatcaaaattagttggctgtttatctagattaaaataaaaggagaatgtcaaaagcaaatctttatgccattcaagcatttcattatccatttgcaggctgcatgatagggaaagcttcattttgcaatagcataatacagataattgctaatgaaatatatttgacactactaatatatgatggtagaatgagactggagaattaaaatgtaaggtccttgagaatgtgagctgtatcttaaatcatattttccaaccctagtaactgcacagtgatgggcacataaatgctcaaaaattattacgtgattcaaaaataccaaaataattatgttgataattggatcctgctctagcttaggggtttcataaggaagtttgagaaatagccaccttttatagtcttccacaaggagatatgttatgcagatgcccagatcccccaaagacaactgcctttgcacactgtgtcaagtgggatttagggttttgaattactggttgtccttctgctctactgaaaccttaagcagaggttctaaaaacataagctgtagatttgggactaactctgcattttggcacttgggattactatcacagtgaaacatgggagagaagagttccacagatggccaagcaggcagtatcattagctttaatgaaatcagctccatgtatgcccaataaagcgtgggatgaagactaatcacaagcatcaaagaagatagtgttttgtgactttgtgcattatcgaatgtattcaagtgttaaaaagatgactattcattgcacttgaatatgcgtctaggttaatttttttttattgaaaggaaatttcattaggatagtgtttattcacattgatccagctgacttcagaatatggttatatatttttctgcatccaactgctattataagacccaggcttatattagattttctctggtattaattttgcttactttgacctttatttcctgttccacctgaaccctcctttctggacagttgcgaaaggatgccataaatatcctccacaaaggcacgtgtaaatgtgatcatattttcgtgagtctttgctatgtgcagtgcacaaatgctatgaaataaatgagcacttggatgactatagtgagtcacaccattaagagggtgtgctcaagtatagtgtttgttgatatgcacaaattaattctaaagagtgttatcataatttgctcatggtatatgtattcagattctttggaagaactgaagccatcattagaaaattacagtattatctcaatattttagttgacaggaggttgtaacaacaaactttcccattgtcttctaactcctcttcattgtatcactgactttgtgtactgcatagcaagagataagaggagcaggaatagagaatgggtaggactaatgtgaggaaattttctggagaagtccatttcaatgttagcttgtaaaatgagaaagatatgtgtaaggaggcagtagaaccaaattaaaatgccctgctacattcttttatgccttggcatgaagagatcttgggcagagataaagctatacaaattcatatggataaagtcatttccctatcagaagccaccccatgccctgccaagtaagccaagttaggaatgtggtatctgagtcattgtgtgctttctgatgggagaatgaagacttatgagaagagaatcttgatgaaaggagagggcagaataccagatgtcctaaggcaggtagagagagtagacagcactgtaagaggatggcctgtctttccacatataaagttgtgttgtccaatgtaatagctactaactacaggtggctatttaaatttaaataagctaaaattaaattcaattaaaaattcacttccttagtctcagtagtcacatctaacatgctcaataattgcatgtggctaactgctgctgtattagcacagatgtagaacatttctaccatcacagaaatttcccttggacaactctgttctagagcaatgagcagaaataactatttgacacactgggggctgggaggtctctagagagctatgagtgctgacataaccagaaaactattttttggtgaataagtgggaacaccaatggtatcaaagtgggaatcaacatcacaaacaggtatatatttcaccatcctggaaaataaaaatgcaactctgtaatgctttccactggaagaataaatatgaccatatatttcaatgaaggtgattgagggtttcttcttcattttttaaaaatttgtgttgatttggtctgatgtttttaactaaagacacctaaatgacttaattgttaaactgtcatctattttagtctcatttcctatgtgaaactagttgtcatactcccctcaaaatataatctaggccaggtgtggtggttcacacctataatctcaacaacttgggaggccaacatgggaggattgcttgagcccaggagttctagaccagcctgagcaacatagtgggacctcgtctgtacaaacacaataaaaaataaaaattagtcaggcatggtggcatgtgcctatagtcccagctactcgggaggctgaggtgagaggatcacttgagcccaggagatcaaggctgcaatgagccatgattgtgccactgcactccagcctgggtgaccgagtgagatcctgtctcaaaaaatatgtatatataatttattcataggcaaggattgtgatacagttgttcccagtaagtccttattgaattaaaaggaagctgcctgcctatgcttggtcagatgacagccactagtattaagtctccctttgcaccattcctggctacctcaactgatcaggaagaaaatccatttatttcaaataaatttgaaaatattatatttgcttgaacaaatttgtttcaaatgctgccttacaggaattaaggcattcatttattttttcagtcttttattcaataatggagcacctttcatctttgaggcactatcagcaggccttgtggactttatgaggttaaattagtcactctttgccctgaaggtatttataatccaatgacatataattaccaaaaaaaaaaaaaaaaaaaagcagaaaatgaaaaatcaccaaaaagagaggtaaaggcaaggtgttataagaaattagaggaagaaagaactcctttggggttgggaaactggaaggagagctgctattgagtacctactatataccaggtttttagcctatgtaattccactgttatgcctccccatgttcaaaaggttcattctgttattgaaatcatccatttttagtagtagctaaatatgaatattcttagagtccagtgggtagtggatagcatttcttgactttgtaacttgcagaaagtcagcctcaaatcagcatttgggagtaccttacctcttcccctttccacctctctgctgtcttcctagagttctggctccatcatgctagtggcctatatggtggaagcctgtgagactatcattcctggatccatgctggttctttcagacttccacagagataaggttacatgcctttagattcatgataatgaggcatctataaagagaaataaatctctctcatactaatggtgataatttattgtgtaaaactttgccttggggtgctaaaaagaacgtttaccatacataaggggtaagattggaaaggaactatagagcacagcacttccgcctgctccttctcccagcattcacatgtattatctcatctaatcagaaagattttatggaagacattgaggaatgtagatattgaatatggtaagacactgtgtgtaaaaggacaaattcaagtgccaagtttgttgttgttgtcactgcttgtttgtttttttgttattcaatcaagcatattacacagaataaatcatatatagattaattctgaacagtgagtcattgagtttgaaaaaggggggagaatgtggaagggatcaatgggacataatgctgcagaagttggtaggaagttggctaggttgaagagggtctgaaatgccaactaagtggcttttcttagtttgggatgctaaagcaaagtaccagagactgagtggcttctaaacaatagaaatttatttctcacagttctggacactggcagccagagatcagggtgccaacatggtaaggttctgatgagggctgtattccaggttgcaaattgctggcttctccttgtgtcctcacatgttggaaagagagctagcgctcatgtctcttttcataagggcactaatcccattcatgagggctctaccctcatgacctagccatcttccaaagacctgacttccaactactaccaaattgggattagatgttcaacatatgaatttttaagggacacatccagtccattagaggttggaaattattccatagaaaacaagtagccaaaccgtcattgaatgcgactccagctttttaaacatgatgcatattgcttgttctccctttttatgaactaaactcacattcacacagacagatgtcatctaacacagtgggagaggaggatgtgtggtagagctgcctacttggttcattcagttaccatcaggcatcgaatggttcacatatgctaaggggaggagagagaaacaaaagaaataaaattgatgacctccgacctgaggaagtttatagttcaattaaagaataggttgtggctacatttaacatgagtgaaaaacactgtagcagaaaatgttattgaatactccatagtcattctccttttaccttcctattagaactccaattttgttgttggcagcaacctgccttctcagatttgcttacacctaaggtggctgtgtaacagacttctgcccaatgacatatgctgagattaggcactacctcttccggctttccttcttttcttgactagaatgcagacattaggctggaagtggaacaaccagcctgggaccatgaagtgacaagtacaaagttggcaatcaaatgccaaagatagaataaaaggatataatgaacctggaacgtgaatggcattctggcacaaagcagccctggtctgtttacttctggcttttttgttatgtgagatgaaaaaatcatccatttgcatcagccgctgagattacattttctgttactactcaaagccaaatgcaaaccagttgatacaatactcatggaatagccaatcccagagtgcaaatgaatatgcaaatgcaaagaccctaaggagagtttatggaaaaatttttcagctaggtgtttgaaggattaaatgaataatttcagatgttcaatagcaaatgctaatgcagggttgtaatataaaattatgttcatgagacgaaagcatttaaaggaaaccaattgtgaaataaattagtattaggggtatgagaaatggatgtggatatgtagaggtgaagaggtgccagtggtggggaggagcatcagaaatcatggggcccaaacagcaactagaaaagcttccaacctcgttatcccaaaaagaggttgcaagggaatgacctggccagaatagaagcccttgccctgatattcacatccttatttattctgataaatgaatctataatgtgtctcaggccaagcctaaatgaatgccattctttttcattagtaagttatttaaaatcaatgttttcgttaaaagaagctttcagatgttactaatttaaatctcattaactgcttactttattttccagagttcaatctaagctgcatctttcatttagattttaagctataggctatatgtaattctacaaaaatgccctagatagaaaggaaggagtatttgaagcccacaggtgaacattagtttagaaagcttcaagcattgcaagtctttgaatgaggtttacctttataggctacttaagggatgtcaagcagaaataactggtggtatcatagcttacaatgctggggttgggggctgagatcttttctccatcttaaatttgcaactcaaaaaaaatttggttacaattttttatgtgtagcactaaaggcacactactgtgttccagagaaaggcaacctcagatctcatttttgatgccatgtttcagaatatttagttttaaatagagcccccaaatgacattataaagggcatgcagcttaaggcaagctgtcatagagactaaaaatttaatacagttttcctctaaaagtggttggctacaagcgtaacagtggcaccctattattttctttgcataaaattaacatatcacaaccaatagttattttcaattatgtggcatcaaatgaatcttaagagattgaaataagatccatggtagctttggaggatttctgcaattgacagtttgacacagcatggcttcagattatgtcaaaactgacaaaagcatgtgtagcctgcttaaaagaatattttttcaattctgtcttgttggaaatacttgccatgaagtaataataatacctttaatatgcaaatgattataactgcatttattacactgtcaaatggaaactcaaataccagctctttgttttacaacccagcacatcacacaaaataagagaaatgactgctttcatcatagagttcataagtggaagaacaaattctcttttccctgaggttgctttcattttctctcagatatgttctttttccacaactctgaaaaaaaataagaatttagttgatcactgaagcattctgacattcagattttctccttagtctttatctccatcctgatgatcctatatgtgtccaacacttttgcgaagaaaaattgcacctttgaaggggactttacagtaaagtaccccatataactatctttattcttatccattgtttgatcttactgctcatttttaaaaacttcccaggggtctcattttttcctcatcacttaaacaggaataatgttttgtgctgttcatttctccagcaacctccacttcattcaccttggctcatttcattagccaacagtccctgaagcactgccatcttccactccttgctggagaggccctgcctggatgcggtggtttttccaccattaggcacatgcggtgggaggggtggagaagcagggggaagtagtttcttcgtatcttcagtgaagatactttaaatctgtgacatttttttttttagctttcacattcttttttttcttttattattattatactttaagttttagggtacatgcacgtaacatgcaggtttgttacatatgtatacatgtgccatgttggtgtgctgcacccattaactcgtcatttagcattaggtatatctcctaatgcatccctcccccctaccctcaccccacaacagtccccagtgtgtgatgttccccttcctgtgtccatgtgttctcattgttcaattcccacctatgagtgacaacatgcggggtttggctttttgtccttgcgatagtttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaacagtgccacaataaattgacaaatggggtctaattaaactaaagagcttctgcacagcaaaagaaactaccatcagagtgaacagacaagctacagaatgggagaaaatttttgcaacctactcatctgacaaagggctaatatccagaatctacaatgaacacaaacaaattcacaagaaaaaaacaaacaaccccatcaaaaagtgggcaaaggatatgaacagacacttctcaaaagaagacatttatgcagccaaaaaacacatgaaaaaatgctcatcatcactggccatcagagaaatgcaaatcaaaactacaatgagataacatctcacaccagttagaatggcgatcattaaaaagtcaggaaacaacaggtgctggagaggatgtggagaaataggaacacttttacactgttggtgggactgtaaactagttcaaccattgtggaagacagtgtggcgattcctcaaggatctagaactagtaataccatttgacccagccatcccattactgggtatatacccaaaggattataaatcatgctgctataaagacacatgcacacgtatgtttattgcagcactattcacaaatctgtgacttttgaaagatgcttccagcatatgggccttctctattttctcacagagacactttaattcagaacattaaatacttaggtctccatcataggtgggaattgaacaatgagaacatatggacacaggaaggggaaaatcacacacaggggcctgttgtagggtggagggagaggggagggatagcattaggagatatacctaatgttaaacgacgagttaatgggtgcagcacaccaacatggcacatgtatatatatggaacaaacctgcatgttgtgcacatgtaccctaaaacttaaagtataataaaacaaaacaaaacaataaacaaaataaaaaaaaaatacttaggtctcctagtgtacatcctgtactccatagattacagtcagagtctcctttcaacagatgggtgtgtgtgtgtgtgtgtgtgtgtgtgtgtgtgtgtgtgtgtgtgtgtaggggggtaaattcattgtctttcctctgttttttcacttcccccatttgcttctgccaatctttcctgtgctcttggctgatttcccttctcccattggtggatctagctacttactaacaccaatacttcatcattcccagtactttatttctttggattattctttactatgatttttcctcccatctacctatggtaggtaaatgagcagacttaccttcaatatgggaagattctgggccaagacattttgttctttcttttcactccgttgaatcacagttcaaactcgtagttaagatgtaagtcttctgcttaaacccttcagtgactccctgttgtttacatgataaaagtgtagctccttagcctggtaaagatgttcaggactaggccttagtaactatcttctgtctctgactatcactcaccatcttcttactttgctttttagtcatgaagaattgtttctacttttcccatgtaacccaagtgatttgatgcctctgtgtctttgttcacagtgtttcctgtatctggaatatacttttgcttattgtttggccaataatccatccccaagtcctgcctcccatccccaatgcctgccaattttagtagtacatagtaactgctaaaattgtattggttgaatgattgaatgaatgaatgttttttgtacatctctcaacttttctcagggattctttcactgagtatatccacacaccctcttcaccagtccaaggagctagtcaggtacctcttcttgcccccaaatcaccctatattccccgccatttataacacttactataatgctgtgagcttctctaaaggcaaggaccatattttattctgctgtgtccccaacacatgaaagagggcctggctgaggacggatgttcagtaaatgatttttgaacttaaatgtttcttgaacctatttcctattttggtgaataagaatcagcaaatcccttgtcaagtaaaacctaatttctgcttttctaacaccaaaccagtctcctgaagccagaagatctcttaagtcctttgaatagtgaccactattttagatattaaactgaaatagagcatgtaaaatttcattatgaaccgtacagtgttatactgatgagttgcattattatctgttttgtacatgtcaaatgaaacttctcagaccacttccaattaaggctggggccctgtactttcctacttcttccttcccctgtttcctgtagtccctaaaaaccctagaattcccctgcaatcggtagttgagtacacagaaggaggcaggttggttaagaactgtcagagttgagattatttactaagaatagcattagcaggggtctaactttattagattcaaaattgcccagctgctaaggtggccctgcagactcaaagtaacacttaacagattcaccagataatcccagcatggccacttacttttaatctgctttccagtctttcagagagataggaagtccccctctatgtccctgtggatgtcgaatcatttatttggggggcctaggtttactacagtgatccagcctgcactaatgtcagaatcctctcctttgctactaaaactatatagtacctctcactcatatcctaaaaaatccaatctcggctgtgaatgacattaaccctgttctaccctgctatggtttgaacgtttgtgtcccctccaaaatcatatgttgaaatcctaacccccaatgtgatagtattaaaaggtggggactttgggaagttattagatcaaaagggtggagccctcatgaatgaggcaagtgccctcataaaagaggcctcagggagcttctttgtcccttctgttacatgaagacacagtgagaaggcaccatctatgaagcagaaagccctcaccagacacaaaatctgctggtgccttgatcttggacttcccagcctccagaactatgagaattaaatttctattgtttataagccactaaaattttttgtcatagcagcttgaatggattaagacctgccccttcctgcaaactaaatatatcctactctgctttctaggattgtccagggggttctattcccattcctactgaccttatgccatattcttctggctctaaatttgcattctagaccttcccagggccttgccttcttattcctgttggccaaagaaagtcttagaaaatttcagaaagcatcttatagccctggtttataagagggtagaaaaaggttttcagccctactcattccttctacctgagtagcctagagtttaccaaattttcttatatggctaatataaatatttgtatcttatactaaagaaactaccctttctggctttctagtaacttaattttttaaaaaatatagcgactttattgagatataatccacataccatgcagttctgccatttaaagtgtacacttcagtgatctttagtatattcacagagttatcttaccaaaccaaatttgcatctgtccccctggtgcagcaaaaccaaacagtgacattgggatttgcagtgagaaaaaatgagacatttattgcaggagaccaaacaaggagaattagacagctaatgcttaagacctgagcttacctgaaaacaggtaagggtttttaaaggttgggaggcagaagttataggcaaagtcataaatcattacatagaagctacattggtttggcgtaaaaaggcaggacatcttgaagaagggtattataggtcatagattttggatttaaaggttttctgatttgtgattggttgagtaggcaaagttttgtctaaaatcttggggtcagcagaaagaaatgttgagctctggcatatgggtgtgactttctccaggcccctcaggaagacatttagaacaaagaagggatgtcagggtttagtcctcagtttccccagagctgaagtctgtgtgccagtggatggcattttccatttgatgggggtctgggtttctgaaaaacaactcagagacatagttaacatgttatctttagtttctataggaaaccaaacattctgtcactctaacttccttggctattattttaagctattattaccttctcacttatcaggctgctcatttacttctcagggttagctcggtgactagaatttcccttgaaggtacagagattttcctttatttccatgcatgaggggaggacaagaagaacctaagaggggtccctgcttgtctcagttgtgtaatcattaccacaatcaatttaggaacattttcatcatgcccaaaagaaacccaggcctatattaacagtcatcacccatttcctctcaacacccctccaatctcctggcaaccatgaatctactttctctttctatgcctgttctggatatttcatatacatggaatcatatatgtggacttttgtgccttctttcacttagcataatattttcaagtttcatccatgttgtagcatgtatcaaaacttcattcctttttatggctgataatattccattgtatgtatatgcatatttatatcatgttttgtttatccattcatctgtttatggacatctacattggttcaacttcttgactattatgaataatgccattatgaatattcatgtacaagtttttatatagacatatgattttatttcttttttgtatatacctagaacgagaattgctaatttacttctaaaattaagacccgagactgctatagaaaacaaacatctactatgttctctaatgggggtggagggaggaaagctttgccattcccaccttgtaaatcagtagggtaaacaaacctaattattaaaaagagttgctcttttcctgtctttagagtaatcaaagcagagcattattggtacacaagccccacgtcaggaggtaattgttttattttttgtgtttatcaaaagtcaatgatatattgacatttgcattactagtcatcctgtttcaaagtgagtgatgaaacactcttctcctaggaagctatttttttttctccatatatggacagagctaattaacaaatggacctatggccacctccatgctgtgacacatattctatattctcaggagcctgtgcatattacaattctggtggtaagtgtaatgtcgtaactttcattttatacctgaagagcagtggttggttgacagcatacaaaggaacatatgtgaaaatgtactttactagttggattttgtgaatagtatgttatgaatttgtcatgtagtagatttcatgaaacctgtatgttttaaaaaaatttccagcattttattgatatttagaaaatctgttttggtgccaagaaatagaagtgcaatctcttacaggcaggtgcaagggtgaggaatatagtgatttatagtttctccttaaagagggtttctgagttgccatttcacatccattcatggatttaaaattgtttttctgaatcttaggcatttttaaaaggaaatctccttgaatagcaagaaaattatcataggtcttgctattatctcaatatttgtgtccccctaaaattcatatgttgaagcctaatcctcaaagtattggaattaagagttgaggcctttgggagatgattaggtcatgacagctcttttataaggattagtaccctaataaaagaagctcaaagaatcttgttcatcctgtctaccatttgaagacacagcaagaatgtgccatcttgaaagaagagagcagccctcagcagacactgaatctaccagcaccttgatcttggacttcccagcccccagaactgtgagaaataattttctgttgtttataaattacccagcctgtggtattttgttatagcagcacaaatgcactgacagaggtcaccagatgcacatgttctttggctctgtatacaaggcttttaaaaacaacaaaaattagctgctcctgtagtacgatgctcttatctttggtttctttatgggagaggatctatggaatctttttaaatgccaacatgaatttaaggtatatctatatgtatgatccccttggactgaaatttcacttgagtaacctgaggacctagaaagagtaacataataaaagcccttaaatgaaagttctacaaaatctataaaaaatagcgagaatagaggaaattgagcagcagacttaacatctagttcaagtcctagtctgctgcttattaggtatatgacaatgaatatgttgcttaactattctttgccttagtttcatcatctgtaagtaggggtagtaataatagtacctacctcatgatgttgtggagatcaaatgagaacatgtatattaaggcggtatacaaatggtaaaacatggccaggtgtggtggctcatgcctataattccagcactttgggagggcgaggtgggtggatcacctgaggtcaggagttcaagaccagcctggccaacatggcgaaaccccatctcaactgaaaaatacaaaaattagcagggtgtgttaacaggcatctgtaatcccagctacttgggaggctgaggcagggagaattgcttgaacctgggaggcggagattgcaatgagccaagatcatgccactgcactccagcctgggtgacagagcgagactccatctcaaaaataaataaataaataaataaataaataatacaaatatgtgtttacataattattttaaaattgatttatattttaataatcataagaaagcaaggtcctatggtatgtggattgaggtataggggcagcctggatttacatgaatttaaattttcgtcagttaacacaagttcctttcaaaatttaggcttttgtttccctttacttcttcacagtaacatatatgagatgaagacactcatgtatcagattagttcaacatcaatatagaatcatcagccaagcagggacatgacatcaaaacaaactaaacactagttaatgaagaactagagcatgcaaatactattatcaaaagacacactgtgtcatcaggacttgattttggttattctctttggtactgggtcagagttcaacctttaattttggtctgccagtgaggtggagtgatagcaaagcggagcaacctctactttcaaggtcctgaggtacaagcctagtttcagctacatctgtttccactaggcccattgagggttaaaaatctatctgttcaaatatttcactggagctagaaatggcttgtttaaagggcccacaggtgcctttctttctctatacagtgcattctttttggtgtatctttgcttcttggtcttgttaaacatcttcattccttggtgtaaatgaacagctgtctcagtagaaaggagatttgctgtctgtttcagactagactggactgacagttcttaggctgcctcagccttaggggaaagaactaagtgatttgtctttcatggaggttaataagcacttctcttgttggttggtttgtgtataaacggctcaggctttggcacgcaatctgtcacggatcttaataaattaccctctgtttatgcacttagaagtaacacttgtattaccagtatggcaaccaaatgttgaagtaaatcaccacacgtgacaaacagaccttaaatcatttgcccaactatttccttgacctgtcttggaatgtgaggaaatggaaaaaaaaatcaagtgataggaatgttttgcatttgtggagaaatagaggaaatccactgtagttttaagggaaaatatgcatagcaactataaatccaaggagattgtttaggtgtcactatttcaaagtttgctatatattttcaagttgttaggaaatatttctaaattgtgtctacttccctgtcttgataaaaagttgatcaaagttaaataaatctttctataatgctgggaaatctcatcgtgtccctgagcatctttactgtacaactgtggtgcttggtgtctctggaccactgctttgatcatcagtgaaatatgtctaggatcatagatggagatgtaaaaggtttaggaaattgagctgaattgcgttgagcacttcattccttggaagtatttttagtaaaattactaccatgatttttttctatgtgacttgacattttttttaagtggaacattcaaaacatgacttgagagttcttttagttgtgatctggctgattaagattttattctattagaataattagagagaaaaagggaggtagagagagagaaagacataatattatattaaccaaaatggtgtctactctacaggcacatttacgatgtagaaggtttttctgtttttttttgttttttcgtttttttggtttgtttgttttagtctagagatttatcatagtagacaggagataattcaactaaaaggaaaactccacttcctctattttattgactattgaagttgggagcaagatgacaaacataaataataaaattgggatagtacccagaacctatgttgtttcaacataggctttcagttttcattagaaagtgggcaatatgcaaatgcccatcaatcaacaagtggataaaaaaactacagtgtatatatatatatatgtgctggaatactagtcagccataaaaaggaatgaaataatgacatttgcagcaatctggatgagattggagactattattctaagtgaagtaattcaggaatggaaaaccaaacatcacatattttcactcatatgtctgaactaagctatgaggatacaaaggcataagaatgatacaatggactttggggacttgggggagagggtgggaaggaggtgagggataaaagactacaaatacagtggagtgtatactgccctggtgatgggtacaccaaattctcacaaatcaccaccaaagaacttactcatgtaaccaaacaccacctgtaccccaataacctatggaaaaatggaaataagtaaactatggtatcactataaaaaaagtgggcaatatgattacacgaaaaagtcttattcccagaaaaaatattttttcaggtatatactgctgaacatgaatgcatacaattcttcttatgaaagaattttcaggtggttgactctctttctatttgtagtgcactgaatgtgctctatggcccataaaaataacaaggaaacttcttattatttgatactgcattattctaagttgcctctgcatagcaacaacttcttcctttgttgtttggtaaattctcaaatcaaattaattgagacattttatgtgccctataattcatttagatcatacatggtgagcattacatgcaaaatcttctgactatccatatgtagtttacatgggccttattcaaaatcacttaaaagtctagtcagaaaactttcaaattcctgaatatcacgaatctaatttaatgagtttgaatgtcccctatgaaattcacattgagatttaattgccattttaacaatattaagtggtgggacctgtaaaaggtgattaggccatgacagccctaccctcatagtgggtatatataacaccattatagtgggagtgagtatgttattaccagaatgtgcttcttataaaaggatgagtttgcccctgttttgtctctctcatcctctgtttgctcttctgtcattggattgtatggcaagaaggtccttgccagatactggccccttgatcttgaatttcctactcaccagaactgtgagccaaaacactattgttcagtgtaaattaccagtctgtggtattctgttatgggtgcacaatcatactaagacaatcagttgattgttttgtttatttagcttaaatgctgactgcaagattttttttttcttgagacaaagttttgctctgttgcccgcaaatttgacgtgtgtgtgttagttctctttcaacatatattaataccagattgactttgaatagttcttccaacttggagttcttttgggaaaatgagcaggtctctgtaaaggacaccttgtgaactagattatgtgctaatggtaaataccattttaacatagctaacatttattgaacttgttttatattacagccacatgacgtatataaacttaattctgacaacaactcagtgaggtagacattgttttcattacttccaatagatgaggaaagtgaatcacagggtggttaaataaattgctcaagtttgcacaggttcaaagtggcagacctgtaatacagactcaagcactctgactttagttttgtaaagcaaaaaatatccgagacagattttaatcaatttaaatagaggcttattttgccaaagtgaaggaccatggcccatgacagcctcaggaggtcctgagaacatgtgtccaaggtggttgggttacagcttggctttatacattttagggagatggaacttataggcaaagacataaatcaatacatgtaaggtatacattggtttgtcccagaaaggcatgacatcccaaagcaggggcttccaggtcataggtggattcaaagatctcctgattggcaattggttgagagaattaagctctgtctgaagagttgaagtcagctcgagtgaagataaggggtgttgtggaagccaaggcttttgtcatgtatatgaagcctccaggtaacagacttcagagagaatagatggtgattttctcttatgggaccttaaaagggtgtcagactctccaaaaatgacctagtaagggaaagagattctttctctacagaatgcatatttcccccacaagagacagcttcgcagggccatttcaaaataggtcaaagaagtatatttgggtgtaaaatattttgatttccttcagggcctgctatctgtcatgtgatgtgataccaaagtcaggttagaaattggtatcttattgctacaaatattctgttttatcggtattaagatctctgttttaatgttaatgctggtcaattgtgtctaaactccaaagggaggaggctataatgaggtatgtctgaccccacttcctgtcatggcctgaattagtttttcaggtttctttgggatccccttggctaagagagggatcccttcagtcagttgaggggcttagaattttatttttggtttacagtatctacactttcaatcactgaatcatatgacccagcaatgccaccatatgttatagtagagcaccattatatcagaattgttggttgatcctcttgtgccctttagcctgtgtcccattttgtcctctcctatccttggtgccaaacacctatttcctacatttccttaccatcagggcatgctatatcctgtgcagatggctttggtctttaatagtagcatcttgatctcctaatagaatcagagttgtcaagtttgttttgttttgttttctcctttattgtgtttaactctctgtttgttacactctattatttctttctattgttcctgtgtctcctccactggatcctcttttcttgttctcccttttatttttttcttcattctttctctttataaatgcatttataatcatggctccagtgaatacctctgagcagctttctcgccaacctctatcaccagctgtaatcatttttataagctcttttctctctaaccatgtactatatcctgccatgagctcacttagcctaaaacaaacttatcaccctctttaccaaaccagtttgacactacctttaaaattttaatggcacgattcagccttaaaacttccaactcatttgttattcaaccttcttgttcctttatcttgtcaatcatcaagtcctgttgatccttctttggtaatatatctcatccattaattcctttgtattcccagggcctgaatattttccaggcctcattatatcttgcttgtaatagtataataatctaactagtctcctggcttccatggtgcttaccccctagtgtctttccccatttcatatcctcatcatctgttccactgagggtagagagaaggaatataactataataaattaaagttaaaataagtagaaatagaatagtttgaagtcagaggagcaagctgtcattgttggttgagataatcagggaaagctttaggaaggggatggaatttagaatttatataaataaagaggtctgaggagggcatttaagattggggaaaactgggtgaacagaagcttgggatggaaatgtaagaagtttggggatacttagtaggcctggctgagctggaccattattgtaggaaaaatgaggttgaaaatatagtctgggctctgattgtagggatccttggataccaggcaaaggaatttaaaatgtatcatgtagaaaatgggtagagacatgatgaaattggcatttcaggaagatgaatctggcagctgtgtgtagggtagattagtgggaggagagactacagagagggggcctggttaggaggttgtaatagggttcagatgtgagttaatgatggctttgaatagaacgacagaacagaactgatgagatggatgcagatgtgcaaagcattatggaaggaaatttgataaggtttccttgagaggctgaatttgcaggcagttgggagaggaaatgggagggttggactctgggtgaccaggagaatatgtatcaaaatgttcccatccttcaagcttcagtgcttcctcctctaagagtacttgtcccaacggagcactgtgagcaagccactttgactgtaatagatgctcaaatagaattaaggaaaagcccactccagctggcagtgactttgcatgctctaaactcctagacacctattgactctacttttagtaagcacttagcatacatgatttctactaaactagcttttaatttgaggatgttttacctctacagtgagagagatcaggagagttttgagggcagaaatcatgctttattccttagattcccacctacctagtccagttttagacccatactagttgttaaaaatattttccttgattgtttcctttcatcctcttagggggcttggattgatcatctcacaggtatactttcctatccattattatgctgatgagacttacagtttaaatacattaccacacctgagcctcaggtacttatagaaacttttcatgtcccatcttcatagtctcttttccttttccagtgcagtttactgagtctgatcacgatcacgtattttgtgtttcagtaggtgcttgttaattgttggtttactttaagattcctggctgtggtataagctctgctacatagctaatgcagctttagttccatctgcatattttagcaacactacacaaagtgaatgtattggcacaaatgacagactttgttggtttaattttgtaaactgtttaaaatttggttcatttcttttcatttgcaaaatatttttattcaagtgtattatatagctattcatctcagaagaaatttgctattgcttgaaaaatacagtttgctttatgatcccaatattataaaggttcagagaaaagaatatctctacaaacaaaatatttatttgatctcgagacccttctcaaatacattttattcgtatctgatcagaatttctagaaacatacaattacacgttaccttaaattggtaagatttaatgtatttgacagtaattcccattaaaggaaactgttgcaggactctctctcctatgactatattagagccctgaattccaatgccagatctgccctttaatttctttgagaacttaggcaaggcacttggcattcctgggtctctttctcccatctataaagcaagagtattgaacaagatcacaagatcaccttctatgctagcattaattttggtttcgagttagcaaaaaaaaaaaaaaaaaagatctttcctttttttaaaaaaagcatatgccatgaaaatttcaagaactaagggcagattatgccccaacatacacagtcctcatagaaattggaatgggggacaggaaagccatcaggattggaggttattttgtctcaggatctggctaactacaaagctctctctctctctctccttttccccacatatctgcaatattctctttctactgctgacttccttgtatcttcagcttacatatggcccagaaaagttctatcttcaagtcccccatgtccttctaactcagccgctacaattatcaggctcatcctctcaattttcaattataaaattcaagagagaaaataattgactcaactcattttttaaagccagatcttgtaaaacatagattggctggtcaggctatagaatgaatgcatttgtaagaattgttcacaatggtccaattagttgtggccagtggaggtgggaggttgattcatttggaactgaaatgagagttaaggattgcaaaagttatattctagaaaagcacttagacagataaacaggtactctgaattgcacctaatacatcttccatcactgaaattctgttaatcaaaaagtattatttcttattgaatgacaaaagagatggtgctctaatggttaggatttcaggaattagtcagcaagtaggagagattttagttttgttattgttaaaatataaattccaatgtaaaagtaagatatgcttccagctgttattatttatctttagaatgtatgagttttagcttcctttttgaaaaggtgagcattggattcatagaaccaacttgtttaaaaaaagagtagaactatggggcacggaggaaaagcttcatctacagtaaggctgttttttacatcttaaccttaaaaatctaggcaaggacccaccaggcgccgtggctcacgcctgtaatcccagcactctgggaggctgaggcgggcggatcacgaggcgggcggatcacgagttcaggagatcgagaccatcctggctaacacagtgaaaccccgtctctactaaaaatacaaaaaaattacctgggtgtggtgcgggcgcctgtagtcccagctactcaggaggctaaggcaggagaatggcgggtaaacccaggaggcggagcttgcagtgagccgagatcgcgccactgcacgccagcctgggtgacagagcgagactccgtctcaaaaaaaaaagaaaaaatctaggcaaggacctcaataatgcatctcagtcttcacatgtccaaaactgaacttttgattcttacctttccctcatctactccttgtcacttcttttctttccccaccaaatggcaattccattcattttggtgcagacacgaaacctgagttattttttatttctctatttctccaataccccacatccaattcatcatccagttcttgaaaatatattccaaattttatcatctttgccattgctaccttgctagttaaagctatcatcatcttttactgggactattgcaatagtctgtgtgatggcttgttttgggccacataataaaatacgtaaagtagattttcagggggtggcttgaataggaaaagggaactcttttagagagtcacataacatatgggttctggtcccatttcttctattaactagctgtgcaaactggggcaagtcagttcacctctctggaacatgaaggggtttctaatggatctctttctgtctcggcattccgcaccatacttgccctcatcaccttgcttctgaattccctgctgtgctttctactgaccatctggagggaccctctcttcacagcatccagtgctccaggctggtgactgtgggaaagggagttctactatttatggtgctcactgtgtaccaggcattataccaggtgctttatgcacgttatctaatttaaaattctccataactatatgaagtaggtattattttattcccattttggagatgaataaattaagctctagatgcattaaacagcttactcaagttgtaaagctaataagaagtggatcagccttttccaggctgtttgtaaaaggaatatcattctgttttctagaacttggagcttcgagggaagttttgactataaaggtcaagagtggagatgaggaaaatttcaagtgctgatgttattcccattcagattgagaagccaagcaaactggaaatcctcatctgtttctgaagattcctacagaagtctttccccacctcctctaccaccaaaacaggaaacaaggcagggagacagaaagaatgggataggaaatgagatatgaaataggatagggaatggcttggtttttctgtaccaaatcccctatgggacactctttttgtatagaaatgaactaatgtgcactaacttggtggaaatgggataagaggtcctgaatctcataagtttccaaacacattctggaaacacattgctttccacacaaattactgtaatagatggggaattttaagttccaaactgaaacagtggaagaaccatttgggggcagacatgtaaagcacttcaggctgactccttctcttcactccacataggtagctgttcactctgctttctgcaagacttttcatgctctctgacatttggcttaatctgataccagagaataggtgattattttgtcatcaaaaaagtagaaacattgaatttgaagggaatttaaaattcgtgtagcccaggcctttttcctgagaggaaacagattacatgggttaagtgacttgcggttactcagctaataattagatacagctgacttaaagaacccccccccccactccaccccatttttttgtggttgtttgtaacaaaaatatttgctttcacaaagcgtaatctattggggcctgacctagtgatccaatctgaggcctgtatgatttgaacatttgataaacactagagctcaaagaaagccttcaccaacttttgttgcctggatttctttccctcaaaagttgatgagaatccatataactgatgaatttctttgcagtccgtttacgggtgtgtgattaaatcccaggtttctcgtggatgattctgagcttgcccatgctttaaggactcattgatccctgcatttattctacagcccaatacaagcagatatggaaattgtcctggcatcctggatgcattcttccatgttatttttattatattatatgatgaaattttgtaaatatgtttcctacatccagggatgcctgcacaatttaggggcactcaaaagaagaatgagagaatggacttagaattatgtgtaatatatattttattgtgctcatatatttagaggccttccccatttcaattgtgcaaatgcttgaaaaagtttctctggaaaaaaaaatatattaaaacagtttacccatctacacttcatttcattctccccaaaactaatcatctagaatttaaaataaaccataaatctaagagagaatgtaggggagagggaaggagatagaaagaagagggtattgattgagaggttgattgatttttattgtgatttatctgaggtcaccaaaaaggcatctaggtttctcattttctctgcttttaaactggacaagtctacccatttaattcttccaaatacaaggaagaaaactaaacagaatatcttattgaaaatttgcgcttctggtcaagacatgaaaatatttgcaatggtccatctggattgtaatctctagataggtagacagtgttcctttgaattgtgcatggtggcagggcacattggctcacacttgtaatcccagcactttggaaggccaaggtgggaggattgcttgaggccagcagtttgagaccagcctgggcaacatagtaaaacacaatctctacaaaaaataaaaaacaataagctgtgcatgggagcatgtgcctgtggtctcagctactcaagaagctgaagccggagggttgcagtgagccatcattgtgccactgcactccaacttgggcaacagaatgagaccctgtctcaaataataataataataataataataattgcgtgtgcttaaaataactcactacttaaattgctaatctgttttagaaagtacatcaacagattactgtgtttttttctcattcacttgaatttaaaattggatttttggtaacaagatatgaggcaaatgggtacaacaactgtacagtataaattgctccaggtgatggtgccatagcaaaattattacaggcagattcaagatacaaaaattatttatttgacagcaagcagaatgacaaattactcagaggctgtgtacatgtgcttctataattgctcataaattattatggttcatgttaaaattcaacgagtttgcctagaccacatggttttattttaaataagaaagtggcaaattattagcaattgggaaatgtaatctgcagtataaaatcattacactggaacgtggtaattttgtgtgcaactttttcatttgctatcgcctatctgtcaaaatcttcattttgtaacagtttttaagattatggagcttgcaacagaaaaatctgccactcgaatctcactaaaatattatttgccataaattagagttaattataaggtggatataacttggaccctctctgaggggatttagttactggatggcataagatacttttcctcatgatgtggctttcctggctttggtcctaaaagcggtgttatgggagacttcaggtgacttacctcttcatagcttcttgaactaagtttaatgattggaatacattttcttagcccaggaataaatgtctagtttttcaacccagtctatgcccactcaccattgttagatgacactgtaattccagagttacataataatataaactagttgtcatacttacgctacaatggcaagagcacttgttatagagtcaaacatggagttgtaacttactgtatgacataagtaggttgcatagctcctctaggcctcagtttcctatataagttgtaataccgtgaactctctgtctaccatccatgactgctgtgaggaagaaaacaaaaagccatgggaaagtgctttgtaaataaggccccatagaaatggaagacattaattttttgctgaactgaaaatcaattgctttacaatattattcagagtatatgtggtgagggaaaattttggaacttaaaaagcactcaaatcaggcacagtattccagggcatgttatgtatagtggccacaatcttctaaagagaaaataaacacaactttccttaagcatttatttctgagtttcaaataatgttaggacaaagatgtttcatcatttcatgtaactgaattattatatatttttaaaatgcttaataagagaaatataatgagtgcttttttataagcatttatacatacacacgcacttacgtacacatacttaggaaaacgtggatactgtgtaacaccatgtatggagggtgtgttagtccattaggtcttttataacaaaaatatcatagactaagtgtcttgcaaacagcaaacatttatttctcatagttctagaggctgagaagtaagatcaaggcaccagcagatttggtgtctggtgagggtctgttcttcccattcctcatagacagtgccctctagttgtgtcctcatgtggtagaaggaactcctaatcacctcctcaaaggccgcacctcgtaattccatcatgttgggagttacaattttaaaatatgaattttggagagacgcaaacattcaaaccatagcagagggacagttaagcaattgtcttggggtccctttaacttctagatcagctattgcaaaactatgacccaggggctaaatctggctcaccagctgttttgtagttttactggaacacagtcatgctaatttgttacatactgtctatggctgctttctcactaccgtggtagaattgagtatttatggcacactatggccaaaaaagctgaaaatatttatcgtgaggccctttacagaaaaagtttactgattcctgttctatgctttgctgaaaaggctgctcaaaaagcctccctcgcttttgccatttcaaatgaaatgcacatttcccccttgatgtgcaccaggtttgtagttacttattttgccaaaagaaagaatacaaaagggtcaactgacatgactccgggttttgcttttggtttcttccatttatcttctcaactttccccataatcaataagaatagtagataatcttcactaaatggagttttcttgaaagtttggaaggattttatttttcatgcaagtattttgggaaggtgaactgtattttctagaacctttgatatctctgctaatatgtcgtgcatattttacattgagttagcagaatctgcaagtatgataccacaacaaatacattctgtgctttttaccttggtttctgggagctcctgtcatttctgtatctctaggtcttgagagtgtatggctgaacaacaccccattcctaagaagatggtcatttcaggctcaaaaaagagagtagctacttatagttaggcttggccctaagtaggaagagactggcccaaggtcctttcctatgtaaacttgtctgtcatgtcactgaactttatctaaagacctgccatttgattgcaccccctccactccacctgagtactacagaggagagttaagagaactcttccaaaggttatctttatacagtagcaatactctctacaaggtatctcagcagctgacgaattagacatttattttaatgagttgaagacattcatgtgttcttgtcaacagttaaaggtaggaaaaaataacctaaaatgatttcaattgcctttggaaaaaaaaaaaacaagcagaaatcttgtattatcttggaattcactgattctgagctgacagcagattgctcagtaatcgggctgtgtctcagaagcagtgatttgattgagttctcatattcttctttgaatgagagatgttggtaagatggaaactggcctgagctgatcccaaaacttaccagactgaattatggttaaatgtgttgagagtgaccaatgtgttgagggcgaccaatctgttgaagtttgcccaagactgtctgtatttaaaactgaaagtcctgcattctgggtaacccttcagtctcaaggaaactggaacaagttggttaccccagggggactatgagataaaataatagctcgaccttgatactgtgcaaagaaatgtgaataagataggtgaaataccagttagtgacagaagtgagaaatgctattaagcaaaaggaacagggcaagaacaagagctctcttaagttattgcaatggttagcatacttcaggggctcctgacttaaccatatcctcctttaagtactttcaattcatgctctatatctgctatggattgacattatagcatagtgcttaaaacctcagccttgggaatcagacagtgtgggtttaaatcctggctctaccactgataagctgagtgagtttgaacggattatatacactctctgcctttatttcaccatctgtaaataaggttactaacaacagtagctgccttgtgaggcttagggagagattaaacacgtcattttaaatcactttgaacagtttctggaacatagtatgtgcttagtgttagctactattataatatttaaatcctgttttattcttctttgcacatatcactaccgtgtaggtgtctcataggcacctccagctcaatgtatctaaacctgaactcttcatccttgtccccaaactgctccttctcctgtgttggctctttcagtgaaggaaggaagttactttagattattctggaaggaaggaagttaccttagattattctgcaaaccttagattattcttgattcttttctttccttcaccctctacatacaggaaattatcctttgtactccccactgaccattcatttattctttattatatattcttccttttattataaaacatttgagtgccacccactgttccataaaaatttgggagcttaatagtgttgccactgaagcagaaacctaaaagccatgagccctttccatagttctccacatgcaatctcttacaagtctgatctacctccacatcacttatatccctatctactctactgttctctttgctacttccttggttcaccttcacttttttatctcaactatggtgacaatttcataaatgatctctgtgcttctagtcttgacctcttccagtctttgtttcacgctactaccagaatgatctttgtaaaaagctaatcattagagatccttcaatggctccacatggctttcaggataatttccaaacttcttgacttactatacaaggcctttaaatgatctgtctcctatttacttcactggtatcttctaacatttacccatatgctctagccatatggaaccacttgtaatttcctgaatatgtcacattgtttcaggccttcatgacctcataattgtagtttcctttgcttgggatgtcctgtcctctgtattcatctagctattggctcctcatttttcaaaatttagttcaagggccaattcctctgcagatccctctttgatcttccaatctggctcagtagctcccaagacacctcattctttctttcgtggtatattgaagatacctctggtatgcttaatggttaaaagcatagccttgggagcagtatccttgaatttgaatattggctctcacacttaccagtaaagtggccttggatgggttacttaatcctcagtgtccttgtctattatatggagaaatcatattgataaaaactacttgcaaggattagataagttaatacacgtaaagtccttagaatagtacctggcgcatggtaagcccattgtattatctattaatatcatcaccacaagtacttatttaataatcccactagaaggtaagcttcctgagacaaaggcccatatattatttgacagtgtagccccagggcctattccagtgcctgacgtataggtgctcgataaatgttgttgaaaaatgaaggaataaataaatgaaataaagaaatggagaactgaaatgccttccccctccaaaagcaattaacttcccaacccaccaagcgccatttagcttcatatacctgcaagagggagagactagtgactttagctggtccttatttttacatttgtaacatctactgtgctatttggaggaaagtatgcaggcttggctccattttcaaatgccagaagtttttgccttcactatcactttaaaccttgtgaaaataatcaaaagatgatactgtcccctattgcaaaagtgaaattctagcaaatcacaaaagaataaacggtgaaaagtcttcttaatcatggagctagctgtgctccatcctgctcattctggacacttggagagatgatttagagaatttgccagattgcagattaatcagaaagcacatgaactaaggtgagtgacagcacagtaagaagaacatctctgcttcacataaatggagacaaattgacttacatttgaggctgtacagttacacaggagaagtcttcttggttgtgtttttaaagtggagtggggaaaagccatcaatttgattggcaactcttgtataataaaaacttaaactaactacaagaccatttttataatgccaccaaatgttatcagccttattataaattattacattactttcatctatttctctttgtcatcgttactactctgtgggatttgatcttgcccttcttcaaccagataactaggcaagctggattaatggtccaacttctctcatctcttatctgaacctacaatcaaggagtccccagatcatcaactgaagtagtgagatagcagtttgaactctgatattcagatatagtgagatgggggaaagggttggcccaacactctgtgatgaagagatgggaatatttatcattttatgaccaacaattttctggccctgccaaaggaatttctgcctaaggaatgatttcataactctgagtcagctatatgggctgagatgagattttcaggagatatttttacctttacttggtcaattttgtttttccttcttcagacctgtttatcatggacttgttccatttgcaaaaccacttttgcattgtagctaatgatggcaaagcacctggtcgatttggttgattcagtctactggtgagtcactttaacaggagatgactccccgccattcccaaaaaaaggcagttctttgaaaacagctttggaagggctgtaaagctaagagagcatagcaatgcctcctccccccgcccacccccccacatacccacatccatgtggcttcacttgcagtagaagtggcacagcttcattgcaaaactgtaaagctggggaagtgtgtcttcaggagaggcagggaaagaacatggactttggagtcagagataccctgttttgccattttattatagttgttattattatcagttgcatgattagtatttacagagtatttgtaggtgccaagatctaagtcaaagtcttttatataatttgcatttcattctgtaatgacccatgagaaaggcactattataattccccttgtataggtggggaacctgaagcacagagaggttatcttaattgttcaaagtcgtacagccaagtcaatggcagatcctgaattcaaacatcggtatatctgattcttaacatttttcttctgtttctctaacaaatacatgaacttaatgaagtaatataatcctgagtttaacaaccattatgtcagagatcggctacagtgatgccaacacattgatccatcagcccttgggatagccagacaggcctgggatggccagccacattggtctgctagaagtcttgtcattttatcccaatgaggcaatacattttatagttttttatgtgtacgattacatgaaaaatttgggcagcaaaatttaacttctacgagtgtcagtgttttcctctaaatgcggggctattcatatgttttgctaaggttttggtgaggattaaatgagtcattgtattagccagtgttctccagagaaatagaaccataggaggtgtgtgtgtgtgtgtgtgtgtgtgtgtgtgtgtgtgtgcacgtgcatgtaaagagagagagggggagggaaggaggaagagagagagagagaaagagagagatggattaaaagtattggctcataagattatggagactgacaagtcctaaaatctgcagtcagccagctggataccctggagagccagaggtgtaagtttcagtccgaatgtcagcagtcttgagacagaggaagagccaatgtttcagttcaatctgaaggcaggaaaaaaaaagattgttccagccctaaagcaatcagacaaaaggaattctctcttactctgacttttttttttttctattcaggcctttaatggattgtatgaggctcacccacagtggggaggtcaatctgctgtactcagtctactgattcagatggtaatctcatccagacacaccctcatagacacgccagaataatgtttgaccaaatagctggataccccatgggcctgtcaagttgacacatgatattaaccatcacagtcaactaacatgatgtttgatatgtggtaaggacttaacaaacgatccctcccatcaggtccccttctttgatgtttataacaactctacactgtaaacagagctactctttattttacagataagaaactcatattatacccaggtatcttcaaatcttctatccttttaactataccatataaccttcatgccactttttgtcgaatgatgttacttaataaggaccagagagcccctatgggccaaatactcctttcctttttccttctttcagctctacccaattaaaagtcactatccagagtacaatttattcagcaggtttgtgctgggtgatgatagtgggtattggcttaatttgataaaatagtctatgctaatacataataatgatatctctgctaggagttttgtcatttctagagtacaagacactctaattcagtgaaaaaaaaaaacaaccatgatccctgaagtctctaaaaggtggtacaaagcaagtaaagcacttttggttgagaaactttcagtttctttctttcttttttttttttttttttttttttttttttgagacagagtgtgactctttcacccaggctggagtgcagtggtgcggtcttggctcactgcaacctccacttcttggctcactgcaacctccacttcccaggttcaagcgattctcatgcctcagcctcccaagtagctgggattacaggtgcatgccaccacacctggctaattttttttatttttaatacagagagtatttcaccatgttggccaggctggtcttgaacttgcgacctcagatgatctgcccgctttggcctcccaaagtgttgggattacaggtgtgagccatcactcctgggcccagattatttcaaactgaattagactttatggatggtagggatttggtggagtgggtggggaggtaggttctgcttgttcctcctataaattgagttggtcctaggtagtcaggaagaataggctttttatgctgtagctttgaaagccaatggacatcaacaaggtgtccatctcaggtaccttctcctagccacctgataatattaaaatcaatgtcatgaaggatcaaaagcaaatagccacaatttctaacttgttataaaaagcttccatgcagcttgataataatgaccctctaaaaaaatgtaaaacaaagggagagagtctttggaatcatttgtatttgtcagctaaaaaacagtgggcaaatatcatgataataggaaaaaaatacaaatgagcatataaaaatatttataatatcttaagatgagattatcagaatagttaaattatggttgccagtatgaactgaattatcacttctgatattatacattatttccaataatatagatgatcattccttatattaaatatttcaaatgttataaattatattaccaataagaataatcactgctaaagttataaatcaaattgtacttactattactaatattgacaataactaatacactagagctaactagatgatgttagatactgtttgttctaagtacctgacatgtattcattattaaatacaatgaccccatgaagtagtcacaagtgtcatttgttttgctgacatggaaactgaagcacagaaatgttaatatgacttccccaagaaaacttagctaagccataacaggagtagtaagtggacctagttccagcacccaagtccttaaccccatgctatactgccagtcaagaaatttcttttctagccttttctagtatctcactccatttaagaatctgtagaattaggcaaagagtagtgtaaaaagttcaagaagaactagacttcatgaggatttcgatgaagccctgcttctttcatttttaatttttgaagtaggattcagaaaagtttagacactggccagaagtcacacaacattagtcaaggtgcagccagagattggagcctgtgcctaggttcccccaattatgaaggtaacaggcagcggtaaagggtggtagacttcccctggagatgttcagcttatattccttcatggagttgttgagccagcagactgagataaaagatgcaataggattttaaaagaaagttcagttttgggaggagtctaagaccctctatgaggccccacctctgctaataaaaggatgtccaaatcttttgagaattcaccattttggtctcaaaattgaaagaaaatggccctatttgatcctgggagttgtggcatctatggaggcagacaacacttcgagtaggtatccccacagtgtctctacagaacctgtgacagagacctctggggcccatggtaggagaagtttcccaggatgtgaatgcagaagagccatgtgtcactgaagatggtcacacacagggatagagagaataggactgtggaaatcaggaagaaggtggggtatgtggtaggtgacagaaacagcaggtcccccgttcaaggccagcttgctccctttggctctcaactccacatccccctgtagcatagggagtaaggctaggtttatattctgaagggcagtcttttccccctgccctgtattttggaggtctatggaggcagttgatctaccttccatcatatagaatgtggcacagctgggaacattgatcttaatatccccatttgttcctgtccaggcttcaagcctgctaaactcagtacggactcaaatagtcaaaaactgcatgttgtgggtgtgtgtgggagggtggtgggggtgggggtgctggacagaccttattaaacacactcccattaatctctacctcaccttacctggcccgcttacctgcttatgtcagcccagaacatatacacccagaagagtggagactagtgctggtggaacagggaatgcccctccatgtccacctctaccactggcagttcatgcatcagaaaatctttccagaggagtcacgatgtgacagtgtcaaatcatagattcctttaaatccaacccttctctggctctagatggagtgagaaaagaatcagctatgcttggccagtcttgggtgtatatttggaggaaactcaatggtcaaaatgcccccatggcatgtgtggaaggcatgagggtaaagggtttgaacagagcaaaggcagcaagggcaagaggctgagaacattatggacaaaacgaatcatcctcctgaatggatgaggagaggaactgatatgtggggccccctcaggggcctgataacctgtggaggagaaagggaaggaggttggggattaagaagttatattagttttctattactgccataacagattatcacaaatttagaagatttaaataatacccacttattagcttacagttttgtatgtcagaagtctaggagggcttacctgagttctctgtttagggtttcaaaagtcaagtgtcagccaggctcagctcttacatagggcttctggggaagactccactaccaagctcattcaagttgttggtagaattgctgagattcttgtctccttgctggctgttagccaggagctatgctctattcctagttgagtttgctggcattccttctcaagtgtcccccctccatcttcaaagctagcaattttacatagagtccctattgtacctaagattttttctgacttccctctcttctgcaactcgagaaagctttctgcttttcagtgcccatgtgattaggtcaggcccacctgaataatctccctattttgtggtcaactgagccatataatgtaacattaccacagaagtaatatcctgttcacaggttctggagatgagaatgggggcatttggggggtcattttagaatttctgctacaagagtgtttatggagttggagggcagggacttagtatttcactaggaacaccaagctccaaagactcaccccatattcttagccaaatcatggtctagaaccttaaactttggttggagagataggcgtagggataagatgatgggcataccctgttaatggtaatctcttaataatttgtggtctaggtggtgatgttgggcctcagaaactgaactacaatgactaggggtgaggacagaaggtccttaagattctgggacttaagattttcccatccccaagtcttctaaaaacagagtatgcagagctgtcctccccacctggccacctacatggaaatattattcacccctctggaatttcatgataagacctatgtggtagggacatttctgatgtctctccaggctcactcatgtctcagtcacattaaacaacctagcgatatgatgaataacaactgcgggtttgcccgtggatggttcaggacagagccaggagcaatgcggaagccaacaggaaaatgaggtctgatatctaactctggttttctagagggaggagagtttccttggagaagggaaagaaagtagccaggcctctgttgtctggtgggaggaaggtacactgaatctggagctcctcatagcagtgttcttaaccttggcagtctgggttgtgttactgtcaaagtttctgcaggatgcccatgctcaatgacagataaataattaacaagaggaggctgtggcctggcctaggtagttgtgccctggtaacccatactcccttggttttaccctctagagctttctcacccagccgtctgctagcatatggagttgatgttgaggtgttatacctagagttctaactgctgcttctttttttttttttttcttgtttgagacagagtttcgctttgttgcccgggctggagtgcagtggcatgatctcggctcactgcaacctccgccgcccaggttcttgcaattttcgtgcctcagcctcctgcgtagctgggattacaggcacccgccaccatgcctggctaattttttgtattttagtggagatggggtttcaccatgttgcccaggctggtctcgaactcctgagctcaggcagtccacctgtctcggcctcccaaagtgctaggattacaggcgtaagtcactgcacccagcctctaactgcttcttaagcagacttccaaccaatccttttttttaggtctcatctttaccctcctaccacttctagagggaacccctgcctctaatcctttcctatgaggagctgacaaattttcaaatctccaccccattaacaaatctcccttgttccttctctcaattcctcattcaccctcattcatcatcatcattcatcctttcataacccattccctgcttccccacggatgaagactcactccattctcttggcaatcttccaggccatatcagttgagctggaccttatccaagtatatattggacacatgcaggctggaagtcttaacccgctgtttgatcttgaatattggctgcataaacagacataaacaactggctgttgacatgacatttttcctttgagcagggagggcagggagggtggatgaagattgggaggatggtaccacagctggagagaaaagggctgttgtcatccacttactgagtacaaggaagagtatctttctttacccttttgcctttttaaattttgcttactctttttacctgggctagtaggaagctaagagccatattgaatgattaaaaaaatttttgaggaaaatttattgtgtaccaacactatacaagatgcttttggcctgagctatttcatctgagtctgctgccaacataaggagggacaaattaatccccaccctcaccctgtacgctctggctgagtcccgaacatcagcaccttcaatgtcacccactgctggtgcctttgactgttttacacatgagaaagtggggaactcttcttcttcactgatataacaataagatcgctataatttgaataaaatactagttatgtgtgataattattcctatcaatacccatgaaagtagtagcggttaagagaaaggaacctggactcaaactggttgtgggacctcaagcaaggcatttaacctctgtctcagtttgctcaaattaaattgggtatatttataacatctgtcttataaggttgttgtgaggattaaatgagtcaatgaatgtaaagcacttaaagcagtgcttaatacacagtgaggagttaagaaactgtactattattatcatcattactatcattattactactatttaccagcttataaatcacttaaacttgacaaaaaccctgtaaggtgtaaatttctccctaatttacaagaaactctcattcctcacagtagcattaattccaattatagtactaacaaatgcaaatctcaatcctcacagtagcattaattgcaattatagtactagcaaatgcaaataataatagaaataacagtgatgcttcataattatgtccattttacagatgcatgccaagattatcaggagtgatattaattatgattatgctatcaatagagtatgttactgatattccaaaatcatcttaatttaacaggtaagagcagataaaacaattattcttatattggtatccattattaggatagttaccaaaataacattagcaataataataatgataacgttaactaggtaatataattttgccatttcccagagtggaaaacaccataccagcagtaccaggaatggcagttactatggttttttttaaaaaaatactgtattcaaatactgcaaataactgcattaacattttacctcacttattctgattctgacaagatgaaagggtaatatcaggattcctttaacagcatataactaatttgttattaactatatttattagtaaattattaattaaaactgtgctgtacttactgtaatacttgtaatgattatgatatacataacaatacataatatataatgatattgattataacgattaatggtatgaccatttagttatgacctgaattataataattgatgctgtaaaggtgaaattattaaataatataataataacgtaaacacaaataataatgggtgcagagtaattatactcagttaacaaaaagtaaagcgtaatagaaactttcctggtagtacttcctggttaactaatattataatattatgatattaatgtaaccaccaataatagtattaaggatatactagaattaggcccctttcactgcagagacagtcagtacatgggcacagttaaatatatttaatcctctaacatcaacctaaatgcatatagtaacatggaatatcctgtaactacacccatttcccagagggaaaaaggtgaggccagcatactgggtagttattagggcactaacactacagagacacaagttatactcaggaagtatgctatatgtggccatttcccagcaggaaagtctgggacagcttggccatgggtgatgccccttgatcagcctcataatgccatacttctcattcaccccaatgcatgcccccagtcctggccccgagaagctttccaggatcaccggcatcctgagagccccagtcttacctcagccttcatccacagagcatgctgccttccgaaggtcattgtcaactggcacctccactgtgccagttgcataagcacttcctcctcaagggcacctactgacatgtactcccaggtaccccacagcaacaccaccccatccacctgtggggagagaaggggggtggggctgcttctgggggcaagcaaggaggagtcctccctctttcattaccacccctccttgacattaacctgggtgaggccatagttcaccaggtggactatgtgaatgaatttgcagggtggaggaagtgctcagggtctgggagctgctgcttgagatgatgaaggaggggttttaacccactgatccctttgtccaatcagatctggaattaatccaagaatcagtaaatttcccttactcccaacctatttgaacagatacatgaagaacactagctatcagtgagtcatgtagctatctgagggaacagtgtatagcaggggtcttcaacctcctggaccacagactgtggcctggtaccagtctgtgtcctgctaggaaccaggccacacagcaggaggtgactggcaggtgagccagtgaagcttcatttgtatttacagccactccccaattgctctcattactgcctgagctctgcctcctgtcagatcagggacagcattagattctcataggagcacaaaccctgttgtgaactgtgcatgccagggatctagattgcatgctccttattagaatttaatgcctgatgatctgtcactgtctcctatcacccccagatgggaccatctagttgcaggaaaacaagctcaggtcccactgattctacattatggtgagttgtataattattttattatatattacaatgtaacaataataaaaatgaagtgcacaataaatgtaatgccctagaatcatccccaaaccatctcctcccccaatccctagaaaaatcgtcttccatgaaaccagtctctggtgccaaaaattggggactgctgtgtagaactaggcatggggcacagccattgcaaaggcctgtaggctagaagctgctttactggttttatgaactctctgaatggccctagaatgtacaaatttgtgtgacaaataataaaaatacgtaccaactaacaaagcttttcccaaccctatctggctctactccctcttttaagtataattacaattttatataagaaatgtttatgtttataatattttatataagaaatatactaggatgaatcatacaaaattgtcaatatttgaactttctaaacaatttacctttcttgatacataacaactgtgtgtatttatggggtacatgtgatactttgttatatgcataggctgtgtaatgatcaagtcagggtatttaggatatccatcacctcatgtttttatcattttgatgtgttggacacattttaagtccacacttctagctattttgaaatacaaaatacattgtttttagctatagtcaccttattctgctatgaaaaattagatcttgtttcttctatctaaccatatgtttatacctattaaccaatctctcacctcgccccacatacacccttccccaactctggtaactatcattctacttgctacctccatcgagaccaattcttttagctcccaataggagtgagaacatgtgacgtttgacattctgtgactggcttatttaacttaatgacctccagtttcatccatgtttctgcaaatgacaggatttcattcctttttatgaccacagagtatttcattgtgtatagataccaaattttctttatccagtcatctgttgatgaatacttaggttgattccatatatttactattgtgaatagtgctgcaatttacatagcaatgcaagtatccctttaatatacggattccctttccttaggataaataaccagtagtgggattgccagattgtatggtagctctgtttttagtttctttttgttttgtgttttttctttggtaaattgccatactgttttccataatggctgtattaacttacattcctaccaacggtgtataagagtttccttttctctgcatccttgccagcatctattatatttttctttttgatgatagccgtcctaattagggcaagatgatatctcactgtggttttgatttgcatttccctgatgattagtgatattgagcatttttcatatatctgttagccatttatatgtcttcttttgagaagtgtctatttgtgtcttttgcccacttttcaatggagttatgtttttttcttactgagttgtttgagttccttgtgtattctggattaactagtctcctatcagattaataatttataaatattttctcccattcaacaggttatctctttactctattgattattacttctactgtgaaggagttttttaatttaatcaagttctatttgtctacttttgttcttactgtctatgttttagaggtcttagccataaattctttgcctagactaatgcccaggagagttttccttaggtcatctcttagtatttttagtttcaggtcttacatttaagtctctaatccttgttgagtttctccttgtatttggtaagagataggaattcagttttattctgcatgtggctatccaattttcccagcaccatttattgaagagggtgttcttttcccaatataagttcctgttggctttgtcaaagatcattcgtctttaaatatgtagttttattcctgggttctctcttctgttccattggtctgtgtgtctatttgtataccagtgtcatgctgttttggttactgtggctttgtaatatattttgaaatcacgtaatgtgatgcctgcagctttgttctttttgctcaggattgctttggctatttcagctcatttttgggttcatatgagtttttgggttgttatttctaattctgtaaagaatgatgtcagtattttgataaggattatattgaatctgtagattgctttgggcaatatgtttattttaacgatattaattcttctgatccatgagcataggatgtttatctatttgtttctgtcaccttcaatttctttcaacagtgttttacagttttccttgtagagatcttttacctccttgtttaaatttattcctaggtatttttttttttttgtaaatatagtgagtgggattgctttcttgatttttttttttgcctaggtcattattgatgtataaaaatgctaaattttgcacaccgattgcgtaacctgtaactttactggattaattgatcaaatcaaagagttttagtggagtctttaggtttttttagatattagattttatcatcagcaaaaagggacagttttacttcctcatttccaatttggatgtcttttttttttcttctcttgcctgattgctctggctaggacgtccagtactatgtttaacagaagtggtgaaagtgggcatcctagctgggcacagtggcttacacctgtaatcccagtactttgggaggctgagactggcaggtcacctgaggtcaggagttcgagactagtgtggccaacatggtgaaaccccatctctactaaaaacacaaaaattagccaggtgtggtggcaggcaactgtaatcccagctacttgggaggctgaggcaggaaaatcacttcaacccaggaggtggaggttgcagtgagctgagactgcaccattgcactccagcttgggctgcaagagtgaaactccatctcaaaaaacaaaaacaaaaacaaaaaaaaaagaaaagaaaaaaagaaaaaagtgggtatccttgtcttgttccagattttagaggaaaggctttcaacttttccccattcagtatgttgtcaactgtggttttgtcatatatggcctttacctttattaatttgagatgtgttccttctttgcctagtttgttgactgtttttcatcataaagagatgttgagttttatcaaatgcttttttctgcatttattgagacaatcatatggcttttgtccttcagtctgttgatgtgtcgtatcatgtttattgatctgcatatgttgaaccatccttgcatccctgatataaatcccacttgatctcagtgtattatctttttgatgtgctgttggatttcattgtctagtagtttgttgaggatttttatgtctatgttcatcagatatattggcttgtagttttgttgtgtccttgtctggttttgctatcagtgtgatgctggcctcatagaatgagttagggagaattccatcctctttggttttcttggaatagtttcaggaggattggtattagttcttctttttatgtttgatacaattcagctgcaaatctatctgttcctggggttttcttttttgggaaactttttattaatgatgcaattgtgctactcattattgttctattcaggttttctatttcttcctgatttagtcttggtagcttgtatgtttccaggactttatgtatttcctctaggttttacagtttgtgagcatacagttattcataatagtctctgatgatcttttgtgtttctgtggtatcagttgtaatgtccctcactttatttctgattttgagttttctctcttcttggttcgtatagctagtggtttatcaattttgtttatcttttcaaaaatccaacttttcattttgttgatcctttgtattatttcttagtttctatttcacttagttctgttctgatctttttatttctttccttctgctaatttggggcttggcttgttcttgctttttagttccttgaggtgtattgttaggttgttcatttggcatctttctacttttttgatgtaggtgtttactactataaacttcttagtacttcttttgctgtatcccgtaggttttggtatgttgtcttttcatttttatttgtttcaagaaattttttatttccttcttaatttcttcactaacacagtggttgttcaggagcatttgaacaacttcatgcatttgtacaacttccaaagttcctcttgtttattttttgttttattctattgtggtctgagaagatatttgaggtggttttaacttttaaaaaaatatgttgagcctttgttttgtggcctaacataccatctatcctggagaattttcaatgtgatgataagaatgtatgttctggctgggcgcagtggctcacgcctgtaatcccagcactttgggaggccgaggcaggtggatcacgaggtcaggagatggagaccattctggctaacaaggtgaaaccccgtctctactaaaaatagaaaaaaaaattagctgggtgtggtagcgggcgcctgtagtcccagctactcgggaggctgaggcaggagaatggcgtgaacccgggaggtggagcttgaagtgagccaagattgcgccactgcactccagcctgggcgacagagtgagactctgtcaaaaaaaaaaaaaagaaaaaagaaaaaaagaatgtatattctgcaggtgttagataaagtcatctgtaaatgtttgttagatccatttgtttaaggtcctatttcaatccaatatttctttgttgatattttggtctagatgatctgtctaatgctgagattggggtgttgaaatccccctcattcttatataggagtctatctcttcctttagatctaataatattttctttgtatatctgggtgctctggtgttgggtgtatatgtattcagaattattatatccttttactgaattgatccctttatcattttataatgaccttctttatctctttttattgtttttgacttaaaatctgttttatatgatgaaaatgcagctattcctgctcacttttggtttctgtttgcatggaataccttttccatccttttactttgtctatgtctttatatgtgaagcgagtttcttgtaggcagcacgtagttgggtcatgtattttttttatacattcaaccagtctttatcttttaagtggaaattttaatttgtttataatcaaggttattattgataagtgagtattcctgtcattttattaattgttttctggttgttttgtatgtgtcttggtcttttgtttctctcttactgtttatcattgctgtttgttggttttctatagtggcagcagtgggacagacagatggataggatcttggactcctggccagcatgtgtggcatcagcaataatagtagtggtgatgggacaacacttggactccctggcagcactcactattgttagcaaggatgggaggacagtctgcagcccccagctgggtgcatgcaggtgggtgcaggtagtggggatagtggcaggctgggtgggctcatcctcgggtctctggtaggaatgcatagatgccagcaagggtggactgggcatggtggtccctaggtgcctgcatggcatcctcggcactgtggcgagtggagggtggtgtttcagactgggtgggcctatctctaggtcccccagtggtgcacatgggcacagattgtgataggcagggcaggatgacccactgtggtgggtgcagagagcctaatgtcagagtgcatgaagcacacagtggttctgttgctgtaggatgggcggtggggagtaggcgggggggcaatggttggtgttacttggagcaactccaagccagtgggcagctttcaggctttggagaatatttgttgtggcctctggtggcagcagcagcagcagttgtatgcagggaaagcctgtcctcatggtgtgttagtgcacagcagccatgctactttggggatagaggttgctgtcaatggcagcatccccaggcaagtgggtggctttcaggccctggggagcacatgcttcaacgtctagttgtggcaggagtcacaggtgtggtggcagcagtgtgtggggagaacttgtcatcaagtcacatgctagtgtgcaatggccctgctgctggtgtgggcagggtttctgtcaacagcttcagataggcagctctcaggttttagggagcatgtgctttggctctctttgtcccaggggcagtctccctgacatgttacactgctctgtttcctggagtataggaatctgtaggggctagaatgttgggaaccctgccacactgccaggcccagctggcattgcaccactgaagctctccaggtgaatgcagctggatgtaactggggctccaggggtttggagatgcagggactaatgtcagcacagaatccagtctcttgagggctggctctcaacatggcaccatggcacagtttcttaggtctcaggggatgtctgggatccaggattagctagcaccctctgtggagcaagctgtcacatggtctcctggaagctccttacattagtgccaggttccaggaagattcagggtctctcctatggctagggttgcaggagatcatggtgggaatgtggactgctggggtcactcacttacccttcccccacattggagagtctctccaggcttccagcctatcctagccaagcaagcggcctcactttcctttccatccttttcttaggtgtttcctgtcacttctttgttgaaattcagcattctctcttaggtgttctctttgaagtgtaattatgtactattttggttcttctttgtggaggaggtgagtgtttgatacctctagtaagccatcttgaatccttcctgaatatttgcctttttaacttaaaaaaaatttcatataattaaactattgcagttgacatataaatgtaattatatatatttaattataacaatatgtattatatacattatataacaacataaaatatttgaagagcacatgatataaatacatacacatttataaattatgaatataatatgcaattgaatacatttaaataatataatttataaaatatgaatatgttgtacaatctgtaaaatattggaatataagttattataatatagcatataccaagtatacatatgataatggtatatagtattattactgtatactatacatgtattatttcgtagtattatgtaaaatgaatatgtttgaaaatataggttagaatatttcataatgcccttttactgtcatgaagtgaaatttataggtaatatgactcacctatgacctaaatttgaaaaaaaatgtaatgaatttaatataaagatgaaatataagtaatttagtttgaactaatatgtattatatgtaaaggcttgagaggtacagtagaataattaacaaaataagtatataattaacataagcagtagtagtggtagcagtaggaataggaaagccttactgagcattatctgtgtgtcagtccctgttctaagtactttcaggtgtgtgatcacctttacgtacactctcttagacgtcagttgactggaacacatctcagaagaaccttcagttaactgacatttattcccacctacaccctctcccttgtaagacaagcttttagtcactaatatctttttttcaagatacttatctatgtatataagagcctaaacttgaaataaatagtggttatctcaaggcaggggtttgatatgaggaatgaggataggactgtgtgtgctgaataaaggagacattagctatatctgcaatgttttatttctttaataaaacaaagctattgaaagtgaattggaaaaaagttagcattattaattttgaatgatgaaatcctgagaatttttaatattattcattttagttctctgttaacattgaaattttaaaaaataataaagaaaatcaccaggagactttccaagtgatcacatatgcagcttatcttcccaaccttgaaactcaccaactcagataatccattttaccggtactgggttagaacttgtctggtttagcaccttcatttctttaaggagtagaaactggctttccttaaattgggtatcttgttaatgaggcagaggtggaaagataactcagattttctgatctccagccagctctctactattttcagtaccttggcatttgggtccaggatgatgacctcaaaagcctgacatatcttcagtcaagccacaaggattttattcgcttcacaattctctacttattgggacagaaaagtggattcagatgttttagaaaagatttctgaaaatccaaaggttaatttccagctaatgtgaaaattagttaaccaaagcagttcactccactagcccttaattatgtgagttatcgcaggatgagaatttatggattcagcactgtatatccacaggttccacatccatggattcaactaagcatggatcaaaaatattaaaaacaatataacaataaaaataacccaaacaaaaatagaatataacaactatttacattgtattaggtattataaatactctagagataatttagagtatgtgaaacgatgcgtgtaggtcatatttcaaatactacaccattttatatcaaggtcttgagcattcaaagattttattatcttaatgtaggggagagggtcctgaaaccaatcccctgtggatactgagggctgactataaacctgaattcagtaagacctcctaagtttctgatctaggaggtactgaggggagatgaagagtaaaaagaaagaaagaaaaacatgagtctctgaccttgactaaagtgcaaatcaataaggtaggaaaaccaagatgccatttgacacctacttaagctcagagcatgactaggatttggttgggatatgcatggaaggtgggaaaaatggtatgaggatgaagacaggaaagagctggctgagcaaaggcccacagcataactgctttctgacaaggttggataaggtgagacagggagggaagtcagcctgtctagagcaggaagtttctcttggagagtggtagacagacacttcgatagggtagggctgatttgaaagggtgtgggtggtagactttgtgattttgactattcagcatggaatcacgagttctggagtacagttgtagcagagaaattattttgttattcctgtttgttagatgctagctaacccaattaaaaaatgagcaataactgaacaaacatttctgaaaaacacacacaaatgaccaacagatatatgaaataatgtcaccataactaattaccagagaaatccaaattaaaaccaaaatgagacatcaccttacacctattaaaatggctattaccaaaatgataaaagattgtgttggccatagtatataattttaatgtagcaaacccccacagtgtgaacatgcctccctattcagcttcctctctgatgactgtctgccatcatgctatacttcaccaacccttaactgcttacagttttgagtacacactctattcctcacctttgtacctctgctaccacagtcctcttcatctggctgaactctatctggttctttagactcagcttaatcaatatccaggagcctacgcttaccctaaaatgacttttaagaaatgcacataaaaaacttgtaaagcactgatacatagaaaaaaaattaccataaactcttaaccctaatgtgagcattataactgtttgattattttccttccagccttttaaggcctattttatttaaacaatagagattttattgtacaaaattttgcattctgttttttatttgatttgacattatcctttgagcattatcccatcattaaaaaaatatttaaatggccttataatatattccaccatgttggcttacttcaatacatctaattattcttctattaaaaaaaaacagattgtgttggcaaggttgtggaggaaagggaactcttgcacactattggtgggaatggatatttgtatacacacacacaatggaatactattcagcctttaaaaagtagaaaatcttgttatttgcttcaacatggatgaacctggaggatattatgttaagtgaaataagccaagaacagaaagacaaataccgcatgatcttacttatatgtgggatctaaaaatgttgaacttacagaagcagagactagaatggtggttacaggggtggaaagtgaggaatgggataatattggttaaagggtacaaagtttcagtcgaacagtaggaataatttcaggatatctattgcacagcataggagctatagttaatatatacctgaaaattgtgaagaaaggcgatcttaaatgttatcactacaaaaaaataattcatgtgaggtgaaggttatgttaattagcttgatttaatcattttacaatgtatacacatagaaacatcatgtcatatatcatatatatatacaattttatttgttaattagaacttaataaagacaaaaaaagaatattgaaataatccaagcaagacatgagaagcacttagatagtcttcagtgtctttaagaatagaaaggaagggaacagatttgagtaacttcagaaatggcaaggcttaatgttttatggaaagggtaggaggtggtcagtgagaagagaaagtcaagattcagggatgactccacactttttggcttggatgactgtggacatgagaggtggggcagatttggtaggggagagaagctcactgctgagcatcctggatttgaagggacagtagaaaccctgttacagggtttggtgggcagtgctactaccctgtctcccacaggcacattagcattaacatcagtgcatctgattgtcttggctagtgtctaattcccaaggagactcatcaggcctcaggaaatcagaagttgaggagctggttgtaatgcctcaccatggcttcactttcagaatgcattggaggctcattcatgggataaagatgaaaagagtgatcttgacaaagcattgcacagattctataatgagagggaaatgaaaatggttgtcagcccattattaagtgtaataactaggttgcaatgagatgaaggacttcatttaggcagatctttcccattgatgaatagtagggggtaaaagtgtgaaagggaagcatataatccaattcataaaatatgtaaactgaacagaaatttctggaaaggtatttttaaaaacttgaggcaataatcattcattgtatatatagagctggagtgggaaatctttctattgatggacaatgatgcacagatgaaattttaaaaatcagtatttttttccactgacagaactttattttaaaaaaaatgacaaaagctctgtctgtacttctaggctaggagaaaagaggcacaggtgtagcaacaggggcacaggccactcacattttagagagtttgacttgcttgtgcctgtggagtgcccatttgaggcagacggagtccactgtgctgggtataaacaggaagaaacttttcttagatgggggcatatctgagacagaaatagaaggcattcaactcccacattaaaatattaggaaaaagagcacaacattgtattcaataagtaaaatatacacaaatgttaaaataaacacaactatatttctgtttttttaagaggaattgactgaattttatttatttatttatttttgagacagagtcttgctctgttgcccaggctggagtgcagtggcacgacctctgctggtgtgcagtggtgcgatctctgctcactgcaacctctgcctcccggtcccaagcgactcgtgcctcaccctccagagtagctgggattacaggcatgccccgctaatttttgtattcttagtagagatggagtttcactgtgttggccagactcgtctcgtactcctggcctcaagtgacctgcctgtctctgcctcccaaattgctgagatcacaggtgtgagccaccgcacaggctcacacacaactatattcttaaatataatggtaggatgggataatcattcctagatacttaattttaaataaattgttatgggtcagataaagttttccaaggtctagatctgacctttggaggttacgtcaagaacatgaattattaataattaattactctgtaaacactgtgtataattcatagataaataattagcatacattaccttacggctattcttcccacaatggttattatttgggaatatgatgtccctcacctggaaatgtctactcctggagaggcatgaactctgtggaatacatatgacaatttggatagcaccaagcaaattttaatcttttactagctcatgggctgggatgaagaagagtataggaggcaggatatagaacacataatgactaagattataagttctgtgtctaacttatttgggttagagtctgaattctgccactacaacttgagtgaccttgagcaagtcacttaaactctctgagctttctttttttcttatcagtaaagtggaaataacaagagtccctccctcccaaagttgacatgagaatgaaaggagaaaaatttgtgcaaaacacctagcacagttcttggatgttctattctaagggctcaatgaaactcatagctgctgctgctgttacacttttctgtgctgggtcattcactgggtggggggatgggggtgtagcctggttccccagtttgagcaagatcgcagctgtattctcaacttttggcttctgtcacctacaatggtgcatccccataggtgtgctgtgattcttctcaagcaaccagcagttggtcaatgataaatccttagttttaaagcttatgtggggaaaacatgtaaaacaaaaacttggacagctcgccctctagtggtaattttatgaattgccccccaacaattgcccttttagctcacaggaaaactgatagtaaaaatgaatgggattaagtttacatagttgaaacacctggtttaacaaatgaatttgttaatcacaaacacataataagctagtatagggtacacatgcttgcatattttctcaagtgctgattagccattatacctaacaagggatttccaatttggggaaaaaaaaatccagaatcagcaattctatacatagttatatatcctgtcccccaataaataattgtacatagtcattagagtctagttttattgcactcaatgttctttttttctaaaataatgttataattgttgataataacaacttatcctcttacaggtatgtataaacttttcacagggttttgtttttacaacagatagatgcggcaggatttgccttcctggttgtactgaagaggaagtaggaggcttatctataaagaggccaaatgagtttgcttgggacacccagggcactttgcaggggactgcactaatttttactcctaggaatctcctcctggcaaaataaattgcatagatgctggcatgttcctttctagtctttagatgctccttctttggaatctttatgtcaaactccctaaacatacattggttgtacagatcagaatgaaaatgattaaaatagagatacgagttttatacaagtggctttcttcactccattataattgttttggagaactcagatattaaagcattttgtttgtttgtttgtttgttttgagacggagtctcactgtgatgcccaggctggagtgcaatggcacgatctcagcttgctgcaacctccgcctcccaggttcaagtgattctctgtcttggcctcccaagtagctgggactacaggcatgcgccaacatgcctggctaatttttgtatttttagtagagacaggatttcaccatattggccaggctggtcttgaactcatgacctcaggtgatctgcccacctcagcctcccagaatgctgggattacagctgtgagccactgcacccggccgatattaaagcattggtacccacaagactaaaccaagagtaataactttttgagccttatagaaatctaagtcaagggagtagtgatgagaatcttaaaaacctgcaattgttcttttaaatactgaaattgctattcataagacttgagtgaacagagaaaggataatataggaataggaggtgttttcaaatccagggacaagaatatttataatcatactcactgattgtgaaacaaagggcagacatacattcacttatactttcagtgggttcgttccgtagcaagcttcagtccaactgcagagtttcactattcaggggaagtagtgaaattcccttccttcaatgcctccattcacatttgtggctggtcagggagatacagttatcaaatcacctgtgggagaagccaagctatctagtcaacagtcttctcaggagccctgcaaggagcttgcttaaataggtaccactggaattgtgaacagtatagggctggatacctcctgtggattgcaggcttgtgcagatgagatcaagcgcaccagttggctccctctatgggctactcagttccactgcggccccaattgatcagtagcctgcacctttgtcagctgcatcacagatgtattcattcagtatttgccaaatatgtatggagagtctacatgcaaggggctctggaagtatggcatgtgattgcaaactcctgatgacagaaatctgacttgcatgcattacttttaatggcacttggcaaattcagttatatgtgacctttcatctcttcttgcccttttgtgactttctgacacctctaagctcttccctcttaacgtcagtgttcaatccctccatgttgactgatcacctgacttttcaggcctcttacctcagcctatacttcttagttgcttccctagtcccaaatctaaaaataaatgtgctacatccttttctacctccttttgtcccactcttggtttattaagaatagcaatccaataaaaattaatcataccaacttgttggaatctagtaggggtctaatactctaatttaggtttaaggctacaatgccttagctcatggaaattgatttctactgatgagagtgtagtgtgggaaaatatttggtggcacgtaggcattcatagatccgtgttatcatacctctggtccattttaatgggaaaattccctgagatctcttgaaatatgttgtaaccttacactgcaaatactaagggaaaagaataaatggggataacgtttagaaattattttctccattattgtattgctgttctctggctattgactaccttataactaaatactctgatacctaaggcaagggaacagaagaaaagagaccataaatctattaagtcaaatacatattgctcacatggcccttaaagggaaatgaattatcagtgtacgctccaggtctgcatgataaaactaattgtaatggcaattaaatgtcttacactgccattgagcatgctcgctgtgactctggagcagatacattgattaccttcagtacttaccatgtcccatcacaaataggccaaagcagactgttaacattgtaaaagtgtagaattatgcaatagatcacttagaagacttagaagagataactaaagagatttgggaagcaaattgaaatagcatttcaatttttttttctatcaagtaggtaatgatagagtttgatgctattttgcaaagccaaatttgttaattcaaaaatatttgctgtgcattttaggattaggggaaaacaaaaactgaaataatagtttaaaaaaatattcccgtggggtttattttgtttctattaaccaacttttgaaaaacaagctgtgagaaaatatttattttctaacatacttatatcattacctctcagttgttttaatgcatgcaaacagtatcacagataatttataaaaagaataatataaaatccatttaaagatgataaaacaataaatattaaagttgtatttgatccagaggtgtatcactagtaatttataatgatccagaaagttcagcaaattcaagtttccttcttttccttcttgaaagttttgcagtgacaaatgacaagtaaatgatccaatagcaaggagtgaatttaaaagactcctgagagacaaccagtgatcagtacatatttagtctaaaccactgtaccttcttagctttaacagtgtacagtgatcatcagaatccatagtgatgaatctcatacctctgaatcctcgaagaaagtttagatgcccttcactatcaatttaaagggagttatttatttgtttgtttgtttatttctaatgaatacttcacatactataagaggagttgaggcagtgtgtaataacagcccacgtgcagcaggccagtgaaagccaaagtcagagagagagatcagaaaccagagttcaaaatctttcttgggccataaaaccctttgaaaatctgaaaaaaaagggctatggaaaatttccccagaaaagtatacctgtgcaaataggcacattgttttgccaactaccttgaagcccatgcaagcatcttccccctgggtgtccttgaaccctagttcaataatccctcatatagagaaagtgaaatcctgaggtaagatagttattacacttaaacattgcatttagctctgagcttcctgtcaactgaagttaaaagattaaacacgctgggttagagttctcaacatctaaaaaaggaagcagatcagttcacaaaatcataagtgaaacatataattttaaaatggcaatgtttatacatttctctgagatgattgttttttaaagggtaatcaagaaaagtgaaaggatacagcgtattttgatgacattttttgaaaataagcaaattagaaataaaatagctatgctaattatattgaccagcatatgcgattggccacagcatttcatttttaaccgttctggaaaataaggaatttactgtacatgtctttctttaatggtagatttgcctacctaatattatttgattacagctgacagtaatataatatattcccatgagcactcggcagctaagcagaaagggaggcctaagggtataaagagaaattgacctatgattaaatatatgctattaataggtcataccatagaaaactggcatgtatataacagcaaataatcactttaggtgcctactacttccaaccagagcatttactttctcaaaggcaaataatagcacaattgttattgtcacaattataggcataggcagtatagggtagaggttaagaacacaatctggaatcagagactggtcttccaccacttattagctgtgcgaccttgggcaaagtcatttaacttcttttgtctcagtgtcttcatttgtaaaataagaagaaaagccttcatctcaggaccgcttctaggctgtgtagaggtctcttggaaatatttgttttgtggggctcctgtctatataaacaattcgagtcacctaaaaccagtatgtcagcagcatcattctagtagtccaatttcataggctaatgtgatggatagcagaagcaaacaatttgcctggctactctgctggaattaggacctggccatggtgccacaggacaaccctataggcatgagttctggagctccttgaagaatctggtccaccccaagcagaaggtggctgtagaatattggaagataccccaaaggcacaagactggagcaggggctgtgcttactaaggtctaagcaagatacaagtctatctcataggattactgggaagattgaatgaagtaatctatgtggagcacttaggacatgttggtgatgattactgctcacactattagtgtcaacaatgctcactgtatcttatacctcttctgattttctttcagtggatggctgcattgactggtcagtggatctcaagacatacatggctttggcaggtgaaccagtccgagtgaaatgtgcccttttctacagttatattcgtaccaactatagcacggcccagagcactgggctcaggcttatgtggtacaaaaacaaaggtgatttggaagagcccatcatcttttcagaggtcaggatgagcaaagaggaagattcaatatggtttcactcagctgaggcacaagacagtggattctacacttgtgttttaaggtgagtgttgtgtgaaaacattgcccaatcacatggctgatagtcttttgagtgggacttgagtacatgtaggtatgcctcatgttgtataatggatatgttcttgaaaggttgcagtacatgtggagcttcagtaaattccagttctaattatctatcagaactacatagcaaattcctattagattttcataaaataggattcccatttactgtgtgtgcttatttaatttagaaaattttgtgactcgggccgggcgcagtggctcacacctgtaatcccagcactttgggaggctgaggtgggtggatcgcctgaggtcaggagttcaagaccggcctgaccaatatggtgaaaccctgtctctactaaaaatacaaaaattagccaggcatggtggcaggtgcctgtagtcctagctcctcaggaggctgagacaggagaattgcttgaacctgggaggcagaggttgcagtgagccgagatcgcgccactgcactccagcctgggcaacagagcaagactccatctcaaaaaagaaaaaaagaaaataagaaaattttctgactcatttcttccctcactccacccctgccgcatggtcttatattaacaattagttttgcatacagctagttgactcaattatcttgatatctggccacgaaaatgatctaaaatatcattttggccatggtcttgcctttcttgttgatgaaaaatagtttcaaatgcgtctagatttctcagcaaatgtactactgctgaaatccttcatagaatttgcaatgcaaatttgagtccactgtgtctaaataatcaacatcgagctctgtaaatacacagtcatcctgagtttctgggtactatagtggaaagatatcacagacataattcttgcttgcaagaagtttacagtaaaaagcaatatgttttttcccttagggattctacagtatgttctcccttccccctctaccccagtgatagaatctaggatctagcatctagcatctcaaatagagactggattaggtattgaagtaggtagctgagacgacctttaggccacctttcaattctgcaattttgggagtctttggtcttgctcaccagggacctgcactctactatttgattttaactccttggaaatgcagacctttcctatttttgtgtcctgtgaactttgatgccaaagctatgtcacttcctcatcaaaagcacttggaagcccctggcgaggtctcattgttcaaaagcccaggagaacaaggtggtatataaatagagagccttctggatgctctaagaatcacttttatgtgtaggggaagaaaatggagtgatgggggagcaaatggtgagtttagtctctgtttgtggtaggcaagatcttcaggatcttgggagaacagcagtcattctgatcacacccttagtgttaagcggtattttctcctacttgggcagctcttggcaaaattgagaagcagatgtaattcagctttagtgactgacactatattccctagggtgctgctactctttccttgcttatctcctctccatcccacactgtcattaaaaacccaccaatcaaaattatctctcttctcctccccctgcaccatttgctttttgtttgttgttttcacaaatttaaagttttatttgcaaagcatcagtccactatgtacaagtgctaagcttacaatgaattattaaacaaattattgctacttccccaggcctgctaatgtcttcagtcttgttacctcccctcttttccattctccgctctaaccccattcctttactcctagcaataataacaacttagtgatccctacatgcatttcccctactgttttaattatacaaacatactgacatggctattttctcctcattgttttataaaatgaaaggagggttatagatttctctgcattttcttagcttagtaaaaatacatggtataaatctctccaagtcaactgatagctttttttttttacttttattttaggctcaagggtatatgtgcaggtttgttatacaggtaaactgcatgtcatgggggtttggtgtaaagattattttgtcacccaggtaataagcatagtacctgataggtagttttttgattctctccctcctcccactctccaccctcaaggaggccacagtttctgttgtttccttctttgtacctatgtgttctcattgtttagctcccacttgtaagtgagaatatgcaatatttggttttctgttccttattttactaaggataatggccatccacattggtacaaaggacattcttatttacagctgcatagtattccatggtgtatatatatgtaccacattttctttatccagtctaccgttgatgggcatttaggttaattccatgtttttgctattgtgaatagcactacgataaatacatatgtgcatgtgtctttatggtataatgatttacattcctttgggtatatacccaataatgagattgctgggttgaatggttaaatatataatattgtatgttgcttaatattttatgataacacaagtcagtcaatcatttccctattgatgagtatacactttgtttccagtattttgtccctacaaaaggcgctgtaataaaaatccactatttgcttttcaataaactttaagaagtcttcgatttacgtagttattgcaaagataatatagagttcctgtacactttatatccagctttcccattttattaacatcttacatgactatagtacatttgttacaattaatgaaccaatagtggtacattattattagctaaagtccatatattcttcacatttcttcagtttttccttaatgcctcttttctgtttcagtatccatctctggtagcgcattgtatttggttgtcatgtctccttaagcacttcttggctgcatcagttcctcagactttcctcatttttgatgaccttgacagtttgaggtgtactggtcagatagtttgtagaatggtcctcaactgagatttatctgatatttttctcatggttagactggggtaatatgttttgaggaggaagattacaaaggtagaataccatcctcatcacattgtatcaagggtataaagtatcaatatgactcataactgttgatgttgactttgatcacctggcttgaggtgatgtttataatttttcattgtaaagttactttttttttcttcctttccatactgtagtctttggaagaaagttgttattcacagtccacacttaagaagaaatatctacataaattatttcaaattcttctgcatggaaatttgtctctccctttccccacttacttatgtgttccatcatttatttgtatcagtatggactcatttttatttatattatacaccggcttgtaatgcaattctacttaattttcttgctcagattcttccacctttgcccgtgggaagctctttcagttggctcatttgtccctttgatataattctatcattgtggagtggtggttgtatttttttttttttttagcatttccttacattgtagaaagatgctccaggtttatcttatatattttgtgccccagttctagaattagccatttttccaaggagtcctgtttttttaatggataattgcattagaaacctagatttggttgctaggtatgctcattgctattggggtgttgttgcttctaagtcttctcagctaacagtctatttgcttttaaacaaagccatagattgtgaaggagtactttagggatagtggaacttcccaaggtccctgaagtcctttcctataggtggctctctctttcaagtacatttcagattggccttttttatgtctattttggataccatatgagtcagaggttctcaactcacatctagaccaatagaagataaaagaattccactaagattggaacataacttgtgactttttaacttttgtgcagcaagccttagggagctattgggactgatagagataggtggaactgttgaatattacctctcatgtgtgccttagtaaggaaaaaatgtttggaaatcactgttctaatagaatcaaccaggcttttatcaactcagagatacataaatctattccaggtatataagtgaaatagctagcatatgtctgtgaataatgaacctgtttttcatatctagtagtggccactgacttctactatgtgccaagtgagaaattccgtccatataggtgattttatgcaattgccaagagtgacatttattgtgaaaagggctcttaatttgacaatgtcagtattcacctaaaatctccagttagataccactttaaggtaattacgaatgacttttctatgttttattgatctcattaaaagttactctactgatgtcactgtgattaaaaatgaagatatgaaatatttagtaatattctccacccatgtgaatgacagcaagaaaaatttactgtttgtgacctttcagtggccacttggctaatgaataatttttaaatttttccttggccagactcaagagtgattagttgaatttcccagcataataatgggctggtaatatgagaatggtagaggattaaatcatattgtgagagacggtgccaatcgaagaatcacaccaatattttcaatggaggcatgaattaataggataaaaatgataaaggtaatcttatttgacaaaatctcacatatcattttctcaacaacttggaacaaggggtgacttaagctgtgaatgaagatagatatagtcatataatcctgcattgaattcacagatattgaaaagaatgattggccaggtgcggtggctcgtgcctataatcccagcactttgggaggctgaggcaggtggatcacatgaggccaggagttcaagcccagcctggccagtatggcgaaacccggtctctactaaaaatacaaaatttcgctgggcgtggtggtgcacatctgtaatcccagctactcgagaggctgaggtacgagaattgcttgaatcgggaggcagaggttgcagtaagccgagattgtgctactgcactccagtctgggtgacagagtgagactccgtttcacacccacacacacacacacacacacacaaaattaaatataattgaacatctgtaaaaacctaacatttagggataattatggctgagtgcagagaatcagttagaggttcaaaattattatgaccatttacctctgcaacgaggtaaacataacaaggagttcccttataaaatgggagcataatcccaatatttttggtctctaatagtcattgaaagaagtgaggttctcaaaatctgaatgcctcacaacatctttctgaacagttccttagtatatgtctagccaggaggcacaattgctttgatttcaaatgtgaataatcaattcacagttgaatgattattactccagcaaaacagcatcagaagaaaagttgagggagtggatacacttgaaacgaaaagcatagcatgttgctaatttttgaatctgtatggtgggtacatgaggattcatcatattgccctgtgtattttttatcatgtttgaaatagtccataacaaaaaaaagaagaaataaatgtaagtatacagtaattttacttgattttattgtcacttaaatgatcctggcctataaatacctaggtatcatatataagcgagtatttttatttcagtcaacaaacattcattgaatacatatcatgggactcactttatggcatattgcaagaagacctgtgtctttagaaaagaaagtgatgctctagtctacatcagacacaaagaaatggctcttagcaccttccactctcctaccctacttcccatcgcggttacctagagattttcaaggacagtgaacatatctcataattcaattccaacttaactattgatccgtgaaaagttaagtgtcaacaagtcggttacccaggtagcaatttccaggagagcaggtagtttcttgtcagaaaaatgaaagcctggatcttatagaattaattgacctcagaaaagatcaagaaagtgtagcaggatcttgagacagcaggaatttcattcccgaaatgaaatgtaattagttatttttctatctgtttttggttataagcaggggtctctgattccattatttttatggcaatttgataatctacttgttaataaaattatataggaaaatttttacatagcaaagaagtaaccattttactttattttcatttcattagcattaaattagatatgttgtaatgtttagaaatataaccatactattgtacattaactatgtaatttcaacttcattcagtttgtttactggaaggaagcagatgcttacagtttagtcagcaggagtacctgctttgtaagaattaataggttatatttgataaccacaaaagaagaattgatctcaaatagtcactgatgagttggttaacactgttatttatatatactttttagtttaatcccttgtataattacacaatcttaagtgacttggttttatggctatcttgctcagaatcaaggttttaacctaatgcagggttgtaaactcaaaatcttttcagaggtcaagaaggtaatgtaatgagtgtggcaggccacctgaaacattttggagtgttggaagttgtagcaatcccctccataatctcatttcatgcattctactctattgccactacctcctatttttctagctcatttttttctataccttacctccaataatctattgattccacccaaccatctttctcattgatctcacatgttttccactgtaccttgttctcttcccatctagcatagttccaattcagtggatcaatcattataatcactcccatatacaccctcttgattctcttaaccctttctcccttcatcttactcgcttgtgaaaaccacaacactgtttaaacctaactgtccatctatactatgcctgcatccttgcagctaaacttggctgaaggaaaatatataataatgttgactggtttcacattaaattcattgtcatggacctcaaattgacctttaatgctaccaggtagttttattttatattcttagaccattcagtctcccatctgcctagatgactattttatatcatctccactcctcagatctccaatatctcctcccccttgcttccagtttcacagagaaaaaaaatgtagtcaggaaaaaaacttccactacatctgcccacctactggcatctatacctacatattctgccttccagcctgttaccacagatgaactggccttgcttctatgtaaggcaagtcacttcatgtgtacaccagattctatccctatttgcttacccaagaacatcacctgagcaattctcctctctctctcccatatcatgaaattttctatttctactggatcatttccatcagcatgtatacagatcagtatttatgccatctaaaaaaaatcctctctactccactttcctgacagccactattcccggtttcttgctcccatttggaaaaagctactttaaagaattatctggttatggtatcatggttgtttatataagtccaaacccttcaaactgtacccattaaatatatgcagttatttgtgtatcaattatatctcaataaaactatttataaaaaaaagtgttgtctgcattcagttttgagttcctctccacttattctctagtaaacccattccaatcaaaattttaccttcaaactcttccaaacctgctcttataaaagtgtccaatgaccacaacaatactaaatccaatgggcatgccagttttcagttctcctattacttgacctgtaatgtcatgtggcatagttgatcactcccttctttttgataatgcattctttacctgacttccagagaatagtactctcttggctttcctcatactctatcagttactctttcataagttcttttcctggctcctggtattctttctgaccccttaatgttagaaggcactagggatataggcccaacattgccagtttttctgatgttttgaaagctgaataattgtgtgaaatttctcaatttttaaatttatgggatcctcctgcccaaaaaagcccatactcagattcaaccattgaactcagttctcatactctaaactaataggttctgactccaacattaacctagagagcgatggtatagtcatcttaaagtaggactgcagcaggttttatctgtatcaaagtgaagcaggaaaatcaacactccaatggcaagatagattaaaggaaacccgccactctccctagagtacatttgagcattcagtagtagagtcatatggtgtccctttatgtggcaactggcccaattccagcttaatcccttgtgtggctattggagtcttcaaaaaatgcactgatcagtataggggtccttattgctagctacggtgtactgaaataggtattctatcaagaggattctattgctataaagtgctgcttctcctccaccttccttcctgtcaatgatcaaacagcaactctttaaaagggcagaggactgaagatgtgcaataactctagtcccaggcatgaaaagtaacttcagtgaaaatatccattcaatgcttatatggactaatattgtgcctatcactatggcgaacccaagagaaaattatgacacagcatctgccttttagcagttactaaaggaggaattactaagagttactgaactagctaggactcttctatacctaacactgtggtgcaatcttctatattactattaatactactgtgtcctattaggagtatggtctctggagctggactgcttggagtcaaatctcagttttattacttacgaattgtgtgaccttgagcaatttatatgactactcaggttcaaccaggggactcacagtttgcaaactctgaactattggttctgactccaacattagcctagggagtgatggtatattatggctgtgtgacctttgccttgcttttcctcacatggaaaataaagacccatttggttattcaacttaaaatattttgaacacttgaattaggtgttgagtaaatgcattgaatgagagattaaagtaatggagcttccattctagagttgggaaaacatataaataatgcaatcacaagactacactgggtaatcgtaattctacagtggtgagagtgaagaagggtcatgttaggggagtgactgactgagaggccactttcagttaggtgatcaagaagggcttcacagagaaagtgacatacaaactgagacctgaatgacaagaaggagccagtcttgtgaaaatcttggggcagagtattccagtcaaagtgaatgccatgtgtaaaggtcatgaaatgggaacaggcttgattcgagaaagctaaagaaagggctgggtgcagtggctcacacctgtaatcccggcactttgggaggctgagacgggcagatcacctgaggtcagaagttcgagaccagcctggccaacgtggtgtaacccctgtctctactaaaactacaaaaattagccaggtgtggtagtgcacgcctacaatcccagctacttgggaagctgaagcaagagaatcgctggaacctgggaggtggaggttgcagtgagctgagactgcgccacggcactccagcctcggcgacagagcaagactctgttaaaaaaaaaaaaaaaaaaaaaaaaaaaaaaaaaaaaaagtgctaaagaagggcagtttggttggagtgtggtgagctggggaataatgctactagataaggctggaaaagcaggcagagaacagaggacagatgctgttgcatattgtggaccagaataaaaagttgatttttaaattagtaatcagagataaaatgagtatttatttttgttaaactggagagtaacatgatccaatttccatttaaaaaatgattactttggttgcctggcgagaatggactacagggggagaagcaagaagaccaagttgagaagcaattgtattagttgaggagagatgtgatggtagcttggattgtggtggtagctataaaaatagggagacatgaatgaatcccagatatatattgaaggatgagctgataggacgtactgatgtcctggatgtgagaaaaagctgaataaaggatgactcctgttgcttttgactgaagcaactgtgtgaatcatggtgctattaactgagagagaagacctggagatgaacaaagatcatagtacctacctcagagaatgttgatgagcacttatcaccaatactgacatagagtaagcactccatacattatctcttatttctacttttactaccaccaccactgctactactagctataattttttagcttttattatatgaaagtattgtgctaatccttagaataattcaggaggtaggtcatattattgaagatgataaaactgatacttagagaagtgaagaacttgcccaaggacacatgggtagtaaatgatggagctgggatttggaaaggtttgactccagagctcatacacattatcagttttctctactgtcttctcaattattatctgttttcactgttctttatagtaatctgtatttgtatattacaacaaatgagatatggttatttacattaattcttgcctatataaagttctgtgcttctgtgtgtttttagtttcatcagtgaacattattgtctggtgatgaggatagaattttattgattaaagatggataatagaaggcaatgaaatagagattccaagttcatgaaaagtgatgattaagttaaagcaagaattttcagagaactagtcttcttgttttaccaagtttaaaatcctttgtgatcacttttcagtttacatatgcagaagtgcttaaaagttgttttccaccaaagaatagagatgaattttgaagcatatatatccttaaatggctctttttgtctgtttactctgacttcaaaacctctaatatataagactcgtgatgaatcaattagagaaacatatacatcagtatatgacaaagtgctagaatgaatataatcaggtgtcataaatgtatggttatctttttcaaaaactcattgcatgacactacttccctccattcaccttaaagttgaaaatgttcatggtggaacacaaatgagatctcattccttcctaactacagttttgttttgtttttgtttgtttttaataaaagcgatgtttttcagccaatatccttttaggtctcaggtatttattattcattaaacaaatatttattgagtacctcctgtacagagggtactaaaaaaaaagcaaaagtgaatgatagggctcctgacttataacaaattaaaaggggaattaggacatgtatacaaatcacaatcaaacaagcataactcccatgtggttcatcattaaattgtatcctagaaaacatagtctagcaactaaacatattttttaaagtctgaggatagatttaacgtagtcccttgaaaaatatcaaaggtaagcccatttgtaacccacagcaacaaaaatcattgtttgacattactatcactcctagtatctcttgtatgtttcagctgcccagaaacctctctcattgctcctcttgttacctgctaaaaaactcttcctggaatgcatcccctataagtttcttctctttttgccctttctcatcctctagcacttttttcctttcaagaagctcttttttgccctttccaatgtaatttaattaaactagcagtgcttcttgcaattcttcagctctttctgcccattactcctattctgcacaataaaatctcaggaactaacctgccataccaaggatctttgtaaaagttgttgcatttaaaaagaccaatgcagtgaaaaagagaattatgtttagaaggcaagaagaagggaaaagctgcaaacacttaacttgatggcttttattccatcatacatgagggaaagtgatacgtgctataggaaagataaagtaatagtacagtaaaaagtaggaaaaatagcttttgtcttatagaatcgtgcttgcttcagatggctcttgaggatctaaacaggtggtgatagtagaggtcttcccaggcagataaaacaatgtcccagggcaaggaggtagtaaaacatgggccatgcacagggaaaaacagggaggtaaatttggtcggaacctggatttatcgaggcgtttttttctgagtatgaacctaacaataatacttgctttatgaaggtttcagatgtttttgaaacatgagattttagacattgagcaattcttagaaaagaagctaaaagactcaactaatgagcaccttaacttgcagtcaggtaataaggcacgttttttgcagatgatgtttccacagagaaaatgtatatttaaaggaggcaaattcccttctatgacctgaccttcattaaagaaaggcagtgctgctgactaaagcgttgttagtcttagcatgtactccaaccagttttctcacaggtgttgataaattcacatggaaccatccccactctctcaccacaccgaagagtgatccaccttggtaggatggctcattaatattcgatgggtatagtctgtatctataaatatgagacagagaaaagctaagtgagaggggtaatgtatatttccaccttggggccttgatcacattcaagcaagacccaagccaatacaaatctacacactcgtttccagaccagatctcactcttcaacactaaggcaatatacacttacctgagtatagagatatagtatatacatttttaattttttattcctgttaccctgatcccatcagtgccttccctttacttcctacaaggaaagtggcttgaccatgtttcatatttacattattatcttttactcttgagcaagagatctctcctccttttaagctcaatctaaagcttgccacttaagcaccatgcacactgtccacacacagggcagcctttccatacatactgattgttgacttattggctgaaaccctcagatcagtagggtccagacgttttcattttgctcacatgaatctttttttagtatattgttttaccaatagaaatagatgacaggaaggcaattttacgaggtgacagtccaaataataatattggcaacgccagtattttacagcagggtacaaagtcacagaaaattctgatttttaagcatttagggaagcttctatattaggtaatgtcactatatacacactctgctcaaattttgactttgatcccacatgacatgaaacaaagataaaaaaaatcactgctgtttctaaataaaatatagtttaattttactttccattattttagagacaggtatagccaagtttgacttcctggcatgtggatgggtgatcagaaaaaaagaggtcaatgaaggcttccctggtttttgcctttcaccacttcacttgttgttatctcaaatggcaagcccagagaggaccattacagcttttctagaggtaaaactcactgtttttgaccaaggcattggtccccatgaaatatccatccccttccctcacccatcagagctgggcctttctcccagcagcattgtttttaaagctgtcttcctctgtaactgcccatctcactaagcatgcttactcaagggctcaaaggtcaggtcagattgcttctgctgggtttgtagaggatattcagtgatggaagtagaattaatttttatgtattaaaacctttcctctggacttacagagaaaaaaactttaataggcataacacaggaaatcatgaaaatgttaatatctttccataatcctgccaaatataaaacccaaatccaagcaaactgatttaatgttttactgaaaaaaaaagttatgaaaacaatttgtacgaccagagagataagtgtctggttcccttcctggaattattcaccttcctttctagtgccccctcctagggtcccactgctctcccctttgattttctttcagttgggccctaccccaatcgtgttttttatgcagcttgatgatcctttcctccccctcctccagtctccaccccatcccctaagttattcctaaaggtaccactgtcccaccaccaccctgaccttataggtccttactaaccctcaggtgccttgtctaacagacacaaaggcaggaaaccccttgggttcccacccccttaccacacagtgtctgctctccttttcccttctgttccagaggaagaagtggcctttccaaacccatccacctagtaaattaacttctttatattgttttgtatttctgtgaacatttaattactttactgtcacaaaacacaagaatataaagaagtaaaggccctctatctcatgccccctactctacctcactccaccctataccctaatgtcccactgcctaccatcatttgacccctgagcctaccctccctaggttactcataatgattttgccctctagtggacattcggcaatatctggagagatttttcgttgtcacaatttgggtggggtgggaaatgtacactactactgggcatccagttagttgaggctagggattttgctaaacaacctacaatgcacaggatggcccccagaaataaaaaagcatatggccccaaatgtcaagcatgccaatattgggaaaccctgccctagaaggatatagacaagcccgagaacatttttgacgagtacaaactctttaataactagttagggaactggccccaagtcctgaatgactgtcatagattcaacaggaaacaaactaatgtcacatctagctgctgcagagatgtcccagggccatgacagcttcttagtcactaggtccacatgccccaggtgatgtccaaggctcctccatttgtgtctcaatctggttcaggtctaactcctctccatccttccacctgttagctaaaacatacatgtacccccgatcaacacagcttacagtcatcaaagggatagaaggagaccaacctgccacccaccttttgaccccacccactcctatcctcccccacctcacccctccctctgaaagttgatttcccactgggatatgtttctgttctgtttcacatttctaaattcactaagagctttgtagctagattttcctcctacatttatcatggtggtgggttggaagagaaattccctcaggatgatggcatcgtgcttttgcccatggtctaaaccaggaaaccctctgagcactatcagttgctgactcacctccttggcagtggcaggagttctctgttcaaatctgactgtccctggttctgctcacttgggattgaggaggattctgctgtcatgagagctgtagagtcatagcagtcctcgcctggagctggtgctggcatcctctgtatgtagccctgaaggattccctcaggagtagcaaagcactgccatgtcgatttgagtcaatcataaacctggggttaaccccaggcctgttttgattgtttgtcatgatataactcactcagatcatgaatgaactttctatccagttcattcctagagactcctggaatgcaggaatctccactactcaccataccctgatgcaactccccagctggttcgaacatattatttgatggtctcttatttgcaactgctctcctggtaccaatttctgacataaaaataatctgatggggaggcaccaagatgaccgaataggaacagctctggtccacagctcccagcgagaacaatgaagaaggcaggtgatttctgcatttctaactgaggtccccaattcatctcaacaggactggttaggcagtgggtccaacccatggagggtgagcagaggcagggtgaggcgtcacttcacccaggaagtgcaagaggccaggatctcactcgccaagccaagggaagctgtgagggacaatgctacccagctgggttactacgcttttcccacagtttttgtaatctgcagatcaggagatttcccttgtgtgcctacaccaccagagccctgggtttcaagcacaaaactgggcagctgtttgggcagacactgagctagctgcaggagtattttttcaaaccccagtggcacctggaacccaagcaagacagaaccgctcactcccctggaaagggggctgaagccagggagccaagtggtctcgctcagcaggtcccactcccacagagcccagcaagctaagaaccactggcttgaaattctcactgccagcacagcagtctgaagtcaacctgggatggtcaagctttgttggcggagtggtgttcgctgttactgaggctttagtaggcagttttcccctgacagtgctaaggaggctgggaggtatggactgggtgaattcaccacagtgtggcaaagcggctgtggccaggctgcttctctagattcctactcactgggcagggcatctctgagggaaaagtaaaagcccctgtcagggacttacagacaaaacccccatctccctgggacagagcacctcagggaaagggcggctgtgagtgcagcttcagtggacttaattgttcctgcctgcctgctctgaagagagcagctgatcctgacaagagggactctcccagcacagcacactagctctgctaaggaacagactgcctcttcaagtgggtcccggacccccatgccttctgactgggagaaacctcctaacaagggttgacagacacctcatacaggagagctccagctggcatcaggttggtacccttctgggatgaagcctccagaggaaggagcaggcagcaatttttgctgtcctgcagcctccactggtgatacccaggtgaaaagggtctggagtggacctccagcaaactgcagcagacctgcagaagagggacgtgactgttagaagaaaaactaacaaacagaaaccaacaacatcaacatcagtatcaaggagccccacacaaacaccccatccaaaagttatcaacctcaaagattaaacgtggataaatccacagagatgaggaaaaatcagtgcaaaaatgctgaaaattccaaaagccagaattcctcttctccaagtgattgccactcctctccagcaagggcacaaaactggatggagaatgagattgacaaattgacagaagcaggcttcaggaggtgggtaataacaaactcctctgagcaaaaggagcatgttctaacccaatgcaaataagctaagaacctgataaaaggttacagaaactgctaactagaataaccagtttagagaggaacataaatgacctgatggagctgaaaaacacagcacaagaactttgtgaagcatacacaagtatcaatagccaaactgatcaagcagaagaaaggatatgagagattgaacatcaacttactgaaataaggcatgaagacaagattagagaaaaaagaataaaaaggaatgaacaaagcctccaacaaatatgggactatgtgaaaagaccaaacctatgattgattggtgtacctgaaagtgacggggagaatggaaccaagttggaaaacacacttcaggacattatccaggagaacttccccaacctagcaagacaggccaacattcaagttcaggaaatatagagaacaccactaagatactcttcgagaagagtaaccacaagacacataatcgtcagattctccaaggttgaaacggaaaaaatattaagggcagccagagagaaaggtcaggttacctacaaagggaagcccatcagactaacagcagatctctctgcagaaaccctacaagccagaagagagtgggggccaatattcaacattcttaaagaaaagaattttcaacccagaatttcatatccagccaagctaagattcataagcaaaggagaaataaaatcctttatagacaagcaaatgctgagggattttgtcaccaccaggccctgccttacaagagatcctgaaggaagtactaaatatggaaaggaaaaaccggtaccagccactgcaaaaacacaccaaaatataaagacctctatgaataaactgcatcaactaatgtgcaaaataaccggccagcatcatgatgacaggatcaaattcacacataacaatactaaacttaaatgtaaatgggctaaatgccccaattaaaagacatagactggcaaactagataaaaagtcaagacccatcagtatgctgtattcaggaggcccatctcatgtgcaaagacacacataggctcaaaataaagggatggaggaatatttactaagcaaatggaaagcaaaaagaagcaagggttgcaatcctagtctctgataaaacagagtttaaaccaacaaagataaaaaaaaaaaagacaaagaagggcattacataatggtaaatggatcaatgcaacaagaagagctaactatcctaaatatatatgcacccaatataggagcacacagattcatgaaacaagttcttaaagacctgcaaagagacttagacttccacacagtaatagtgggagacattaacaccccactatcaatattagacagatcaatgagacagaaaattaacaaagatattcaggaactgaactcagctctgaaccaaatggacctaatagacatctacagaactgtccacctcaaatcaacagaatatacattcttctcagtgccacatagcacgtactctaaaattgaccacataattgctagtacaacactccctagcaaatgcaaaagaatggaaatcataacagtctctcggaccacagtgcaatcaaattagagctcaaggttaagaaactcactcaaaaccgcacaactacatggaaattgaacaatcttctcctgggtaaataacgaaattatggcagaaatgaagaagttctttgaaaccaatgagaacaaagagacaatgtaccagaatctctgggacacagctgaagcagtgttaagagggaaatgtatagcactaaatgctcacaacagaaagctggaaagatctgaaatcaacacactaacatcacaattaaaagaactagagaagcaagagcaaacaaattcaaaagctagcagaagacaagaaataactaagatcagagcagaactgaaggagatagagacacaaaaaacccttcaaagaatcaatgaatccaggagctgattttttgaaacgattaacaaaacagatggaccactagctggactaatgaagaagaaaagagaagaatcaagtagacacaataaaaaatgatacaggggatattaccactgaaaccacagaaatgcaaactaccaacagagaatactataaacacctctacgcaaataaactagaaaatctagaagaaatggataaattcctggacacatacaccctcccaagactaaaccaggaagaagtcgaatccctgaatagaccaataacaagttctgaaattgaggcagtaattaatagtctaccaaccaaaaaaagcccaggaccagacggattcacagccgaattctaccagaggtacaaagaggagctggtaccatttcttctgcaactattccaatgaatagaaaaagagggaatcctctctaactcattttatgagggcagcatcatcctgataccaaaacctggcagagacacaacaaaaagagaaaatttcaggccaatatccccgaagaacatcgatgtgaaaatcctcaagaaaatactggcaaacaaaatccagcagcacatcaaaaagcttatccaccacggatcaagtcagctttatccctgggatgcaagcctggttcaacatatgcaaatcaataaatgtaatccatcacataaacagaaccaatgacaaaaaccacatgattatcttaatatacacagaaaagtccttcaataaaattcaacacccctttatgataaaaactctcaataaactaggtggtgatggaacatatctcaaaataataagagctatttatgacaaacccataaccaatatcatactgaatgggcaaaagctggaagcattccctttgaaaactcacataagacaaggatgccctctcaccactcctattcaacacagtgttggaagttctggccagggcaatcaagcaagagaaagaaatgaagcgcattctaataggaagagaggaagtcaaattgtctctgtttgcagacgacatgattgtacatttagaaaaccccatcgtctcagcccaaaaaccccttaagctgataagcaacttcagcaaagtctcaggatacaaaagcaatgtgcaaaaatcacaagcgttcctatacaccaacaatagtcaagcagagagccaaatcatgagtgaactcccattcacaatgactacaaagagaataaaatacctaggaatacaacttacaaggggcgtcttcaaggagatctacaaaccactgctcaagagaataagagaagacacaaatggaaaaacattccatgctcatggataggaagaattaatattgtgaaagtggccatactgcccaaagtaatttatagattcagtgctattcccatcaagctaccagttactttcttcactgaattagaaaaaaaaaaactactttaaatttcatatggaaccaaaaaagggcccgcatagccaagacaatcctaagcaaaaagaacaaaactggaggcatcacactacctgacctcaaactatactacaaggctacagtaacaaaaacagcatggtactggtacctaaacagatatatagaccaatggaatggaacagagacctcagaaataacaccacacatctacaaccatctgatcttcgacaaacctcacaaaaacaagcaatggagaaagaattccctatttaataaatggtgctgggaaaactggatagccatatgcagaaaactgaaactggatcccttccttacaccttatacaaaaattaattcaagatggattaaagacttaaatgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaatctactcatctgacaaagggctaatatccagaatctacaatgaactccaacaaatttacaagaaaaaaacaaacaaccccatcaaaaagtgggtgaaggacatgaacagacacttctcaaaagaagacatttatgcagccaacacatgaaaaaatgctcatcatcactggccatcagggaaatgcaaatcaaaaccacaatgagataccacctcacaccagttagaatggcgatcattaaaaagtcaggaaacaacaggtgctggagaggatgtggagaaacaggaacacttttacactgttggtgggactgtaaactagttcaaccattgtggaagtcagtgtggcgattcctcagggatgtagaactagaaataccatttgacccaaccatcccattactgggtatatacccaaaggattataaaacatgctgccacaaagacacatgcacacatatgtttattgcggcactattcacaatagcaaagacttggaaccaacccaaatgtccaacaatgatagactggattaagaaaatgtggcacatatacaccatggaatactatgcagccataaaaagaatgagttcatgttctttgcagggacatggatgaagctggaagccatcattctcagcaaatacaggaacagaaaaccaaacactgcatattctcactcataagtgtgaggtgaaaaatgagaacacatggacatagggaggaggacatcacacactggggcctgtcaggggatggggtgtgaggagagggagagcattacgacaaatatctaacacatgcggagcttaaaacctagatgaagggttgataggtacagcaaaccaccatggcacgtgtatacctatgtaacaaacctacacgttctgcacatgtatcccagaacttaaaaaaaaaatctgtccacccactcaagttagctaaagaaaagaggttctgtgtaaaggggattttcatgtagcacaactgtaggaagtgaaaagtggttgtgctgctgctctctccatctctctggagtcacaggatgattcctctgtgcctgtctgctccctggaaccacgtactagtgactcccaaagacacttgcctctggaaagcacccagttctattcctccacagccagggccaagcctcagcagtggcctcagcaaccatggctccggtcctggccccaactccaagtggcctacagcttcattgctcaacatcatggaatcggcctctctgttcagagtgtctagcatgaaaaatccatttggctctggatgggccaaatatccactcctgctccaatcatctaaggcctagatgcgagtagagggtggggtgttatacacatggttgcctcttttaccagacactagggcagggagagagcgagcgagacatacacaaataaaagctgcagcacttctggggtattgagtgcaagtgctctggaatacaaagggggtcaccaaaacatgtctgtctccatgtgtctctctctccccaccccaatctatacctcccctggccaccaccccacttctacacctctttcacaacccctactttcctccccctcctccagtcaccacccctatctctgaagttattcgtaaaggtaccattgtctcacctccttcccccactcttcccagccttcttcccctaccaccccggcccccgccaccacaagcctgccctctgaaaattaattcgccatcgagatatacatgcttcggttctattttgcatttctgcactcaatgaggtttttgcagccagattcccttcccacagtcgaagcaagtatccctccgtgaaaaattcacagcgttacaccaagggcagtcccagtcccctggcctgcgatatactggaggtctttgctgatgaggttcggagtatctcctgtctcttgggtgctcctgatggtctattctgtggggccccccatcagaccacaggctagtatcaaaggcctcccagtcggaaggcagctgaggcggaactggtgctgtgactgttgcttgtggaggggatatagtgggtatgtctgagaaggaggaaaaagggcttgagtatgagtatgagtatgaggcagggagctggacaggaagaggttctgatgaggctctggaccaggggttcgtggttccagagaaataagatgtggctgtttcgaccgaccggagatctccctccttctgcccccaataggtgtacttttcctgatcagcatctccaaggagctgcaggaggattctctccagcttctctgtggtctccatggaggcagccctggcctccacgtgggggaactgggtctccatgggggcagccccagcctccacagggggagccatggcctccacaggggcagccacaacctccaacatcccctctgctcttcttctgctccttttcctccagcagcaccagcagcagccaccgccgcctcttcttcctcctcagctgctccttctgtgcaaacccctccggcagtggccaggcctggccaccctgccccctgctcccactcatggggagacaccagctcctggagagaagtgggcagggctgaggtgtgttctgggggcaaggcgggagcactaagcagggtaggacggagctaccaggtgggaagggcggggcagggcgaagccatggagcagggtggagaggggtgggaatggggcagggcagtggtactgggcagggaccagttgagggatcttactgcatggagcggcttccaactcaccttgtctctctctttctgcacctccacgaggctggtctgggccattcttagccgggaggccgcctccttgcgttccgtctcctgctgctccctgagcttcttcaggtctgatgccaaggcctgtgcggctgatttgtgcagtttggcgaagccgtgcagccaccgcaccctgtgcctttgtagctgtgcctgcctgtgggcaaagcgcactcccaaggccaggctgccccaggtgcaggcctctttgacctcactgggcacctcgctgtcctccagtatggccctcagcttgtcttccaccttctcccaggataaggatatattctcaagatagaactcggggcctttcgtgtgcctggccattttctcgttgatgaaggccaccacgttgctatgccggaacccgctactggggtcctcaggtctcaaggccatgatcgcctaggggtttaacggtttcactagccctgtgtggatggagcagccaataggttcctttcctcccccttagcccctcccctcatccatcttctcccgccctcttgtccccgccctacccgctctgacaagaccgtcctaatgaccccctgaccggcttgtcctaccctaggacacctcccaccaggcctcacctcttcagccagggccagaggaagtacaggccaaccccgctgtcttaacacgcccgaagagagaggaagatctctctccctcctaaggttccagggaaaggaagactcagggccaacgtcggcttttactctgggactgttccaatttccagagataccaggagtggaagggagtgagtgaggaaggcccctgccactccattgggatttaagggaacctgtcacatggttgggagcccttaaaggtcggaagaaacaggagtggtcagaaaagacttagaaccaagaaaattaagcccttataatcaagtcaaaaaagtcccatgtatccctccctcttgacaatggtttgtcccatgccaacggctagtagggacccccctagaggttgaagggggaataatgggtatgttctagaacacgaaaaagcccccaacccatgaaaattctgcagttcattttccagactcctaaatcctagtatacaggttagtgacctttttctgaaacgggcaagatagcaggcatttgaggctttgtgggcaaaagattatcccaactacttgtagcacaaaagcagccataaataatacctgaagaaatgaccatggccatgttctaataaaagttcatttataaaaccaggcagttggcatgatttggcctgtagatgtcaaactcccaatctagattcacatttcatacatgtcctacagacacatacaatcagaatgttcatgatatgactcccccttttccctgttaaaagaaaaacgttagacaacgttaacagtttgtttacacataaacaacaaccaaaaaaaaaaaaaaagaaaaacgagtcatgaatttgtcagtactcagaaccagaagagtttcagagagctattcccagcaacatgagaagtgaatttttataggctgagtttggacacaaaagagaaaaatcacctgattggctacagcaaggcatttgccttatttggacatggtcttgtcacttgactgcctgtaattagctggagcctggctagttgtgtttggctgaaattaggctgtcttttatacagcttatgttaagtttcagtctgtttacatgctaagttagtttgcggtttgttagataggaactcaaagtatggaaacagcttcaaactaatggcctcttgcttattttaatatatgcaggagatgattcccctcctaaattcctatgttgtccaatacagaaacctcaaaatcaaatttttaagttacctacccttcataccgacccttaaaaacaagtcaactaagagacaaaatcttgttgctgtgacctcagaaacttctaagacatccatgcccacttagggaatgtccatgtttcttctcaaataatcttcctgtctttaatttcttcataatccctaatcacttcctaatctttcctatgatcatgtttctcttaagcttaaaatcatttgatggatccttgtggcacactccttgtcctgacattagaatctcaccccaggataccattctaatttaactctctccacaatgttatccaccatcatttatgtacctaagggactaagccatacagggatacactgattttggcgttttaagttattttcccttctgaaaaatcagagcattcattttttattatatgggcattatgttctattctatgaactacatttaaaaagacaatatttcttctctaagggtcctatgtcagataattagagaggaaaaagacaataaatcaagcattaaaatattacctaagaaggtagttaaaccccagaggcataaagtcccaccatttaaatgctgtttttagatgctgttttgtgatttctttccttctcagcttgtatattttatttatcagccatcagtggaaagggttcatgttttggcttattctagagtgacttctacagaaagagcatccagaagataatgtagaaaagagaatggtgaggaaagggggagagactggagtcaggaagacccattagggagatgctaaagcaattcaagaagtaaactaaagcagtggaaatagggatggagagaagagtgtagagagccatttggtagatagaatgcatagggatgtcagggacaaggatgagggaatgctgaggataatgcccaggtttctggtataggggactaagtagatagccctgttattgactagttggagaatgaagaagaattttttgggatgagttcacctttagacatattaacattaaaatacctgttggggccatgtgtggtggctcacacctgtaatcctagcactttgggaggctgtggtgggtggatcacctgaggtcagtagatggagaccagcctagcaaacatggcaaaatcctgtgtctactaaaaatacaaaaattagctgggcgtaatggcgcacgcctgtagtcccagctacttgggaggctgaggcacaagaatagcttgtacctgggaggcagaggttgcagtgagccgagatcatgccactgcactccagcctgggcaacagagtgagattcagtctcaaaaaaaaaaaaaaaatacctgttgggcatcctggtggagatacttagtaggcagtttgatatatgagtctagaacttaggagagacatcagagctgaagatgtagtattgagaggtgaaagctgtatttacagcagcggttgaaataactcagggacagaatatggagcaagaagagtagagggctgaggacagcaccgtggcctgccttcatggatctcctcctttctacagctgtgtgctaccattggtgattttatagttgtcccccttactcctttgtgttcttgtctactaagttcagaacatcttttaccttatctcttttattccctctataatactttaaacatgaacttcagtttgtgattagttgtctctttatactgccattctcccacttccgcttataaacacttttaagaaattaaaagtaaattgtttcttttagcagcctggaggagggagaaagtgaagacagagaaacctgttaagaggttccttcaacagtgcagacaaaacatgattagggcttgaactgtggcaggacctcgatgagatgtcagataacaagagatttttgacatacagttagcatgacttgttaaccaattgtattaatatatgagaaataaatatgggtgttggagcggaaaatgattttgaggcatttgacttgagaaactaggttttgtgacaagtgatgcctcaaatcgtaatagatatgaggaaaaatagactatagagaggagataataaatgcagttttggattgacaaatgcctttgtgatagttatattgaattatagttgaatggctgtactgggctggaagttaggtgagaggacaaaactagagatatgtattataaatttgggtgttttcagtgctcagtttgtggctaagaccttgtgcttcaataaaattgctggagatgaaggttggaaggagagaataagcaggacaaaaaaacagaggaaggaatcccgaggtcttggaaagggtagcagatacctttagggataggataagggagaacaagcagtaggagtagtcagagaagtagacaatcaaaaaagggagatattttagacctaaggagaaatttggaaggtaaaaagagtgttattagtttcatataatgcacagaggttacataggatgagggtgaacaaaaggtcattagatttagctaataagatatccttagtgattcaagtgacgagaatcaatagaatggtgaggcaggtgccagatgataggagatcacagaatgaaattagaggaataagtagaaattttgaatactgactagtctttcaagatctctgacacagtagagaattctaccaccaggagtcagaaaatagatcatggaagcataggatatgacagcttatttggtgagacaactaagttatacaattttcaacacaaagacggggaaaataatctgatatttactgtatgaagaaaggtaatcatatgtaaagaaaactctgtgttttgcattgtgacccaggaaataaggccaaacctttgtgaattctatgatagtaactatgaaataacatattgacagatgcaaaaatatcagtgtaatctgatatttacagagaaagagtgaggaagtgagaaatagttattagagtcagtgaaattggttggggaaggatttctggaggagagttatgttcttgttcttaatagaaacatcagggttctccaaagatttatgaagacctttctgtttgtagcatgatgtgtctcagattaccattcttaaaattgtcttcatccaaacaagaaagcaggaatcactcatactatgatgtggacaatggtggtgtcagggaacctttcaaatttaccttcgttattaccttacctttatccacatcctcaatcattggtagtcagattttgaacaagctgcctgtacccttaggtggcatattgcaactgcctttcccttaggaatggtgacatgagctcaccactagaatgatccacaattcttagttatatgtaaatggattgctacatatatatgtactgtatacttttttcttgagtaggtttctaactttaatgtacagcctccaaataaattatagtttgctttgaattcaaggtgaagaatattttgatgacaaaaattttattttgagtgagtagtttttaaaatatacataatgtttactataaccttgtccacaagctacttttttaaaaaacaattacaagaagaagaaaacaaaacatctttgattcactttatgggttgggttgggaatcggtagatagcatgataatagtggtgataatgttaaaggaaattagtttttattgagtacttagtatatgccaggcactgtgctatgagctttaaatgaactatctcattgttaggagagaattctccatggggcttttgcattttttacatgtctgtgagcagagtatcctttgccctggattatcttttcaaaggtgtatgtatagaaaacatacttttattttattttattttattttattttatttttttttctgagacagagtctcctctgtcacccaggctggagtataatggcacgatcttggctcactgcaacctccgcctctcaggttcaagtgattctcccatctcagcctaccaagtagctgggattacaggcacccaccatcatacccggctaatttttgtagagacagggtttcaccatgttggccaggctggtcttgaactcctgacctcaggtgatctgcctgcctcggcctcccaaagtattgggattacaggcgtgagcccccgtgcctggccagagaatagccttagaagatagaaatagtgtctatctctagagcaaaaggcaggtttgcttatagccttggaaaatacagttagtatctgcctctggaacaaagggccgacatgcttatggcccattgtaagaaatttgtgtttcttaagcttggggttcttctgtaatacaacccaatacttctacaagtatcacctgatcctctttgtattatcctatgggaattgagtttgtgtaagcaacacaaatactgatactttggctactgtcattgctccaattaactgtttattatttctgacctaggattctggtgtcttctaccagcttccatgaaactggcaggctaaatttttagtgcataagtaaggtaaaatttcagaccctttgccattctttcttttcccttttttttttttttttttttttttttttttgagacagtgtctcactctgttgctcaggctggagtgcaatggtgtgatctcagctcactgcaacctccgcctcctgggttcaagtgattctcgtgcctcagcctcctaagtagctgggattacaagagcataccaccatgccagctatttttttgttttgtatttttagtagagacagagttttgttacgttggccaggctggtcttgaactcctgtccacaagtgatccacccgcttggccacccaaagtgctgggaatacaggtgtgagccactgggcccagcccccgttaccattcttaacacttgcataataaaacaaccctattaagttagctgcttttattattctcattccacgcataccaaaaactgagatttagtcacccatgcaaagatccatagataagacattatagagctgggatttgaacccaagtctaactctaaaagctgcattatcaagcagtaagctactcaagtccttggattaaccttttatctgactgcatcatgaactataagaaagttatgcttaaataattctgggttgcagattaccagtgtcctgtcaaaggctgaatgttcatgtcagcaggagataagaacagttaaaaaacacaggaaggggaacatcacactctggggactgttgtggggtggggggaggggggagggatagctttaggagatgtacctaatgctaaatgacgagttaatgggtgcagcacaccagcatggcacatgtatacatatgtaactaacctgcacattgtgcacatgtaccctaaaacttaaagtataataataataaaataaaaaaattatgatatgtttatgcccccacaaatccttgtttgtttaattaccaggtttacaccttacggaaaaaatgtacataaacttaaaacctattatattgacatatttacaggctagagatatcatctatgaatgatggcattctttgttctgttttgttttattttaaaaaaacaataaaacaaaaatcccggagctctttacaactgtacaagcctagaagtaagatgatttacttaaagactaaaagtgacaaaaatgagttcattcaatagatcctgtatccccaaacttcttcttattagcatagatatttttatccttatattaggtttacatctgcttttcaatgtatataaacagcatgacacatagcaggtgcccattaaatgtcatttgaatgattctaaagggttgtgggtcttcatagaataataatacacagttcagggctttggccatcttggtcttttaatgcattaacattgcaagtttgcagttttatgtaattatttatgcagacatctgaaagtcccctttccaatcaagcttaaaagatttttcaataaaactttcttttcttttttaatatttgcaatttaaacttttttaaataaggtaaaatatacatatgtaatttaccatccttaccattttaaatgtacagttcagctgtaataaatacatgtatattcttttttcccccttatccccctttactagaaaaccttatttttctaatgatttttgagaaatagaacttatcaaagggcttgagatcttgtttgtttattcatttgttttccttccttgaatttgctacagtatcagttgctagttcttatgttttaacgtcagtcttattcaatgactgtagatcgattaattgatgttatatgtagcaaatcaattcaccttataaaatttcagacagtaaagcttgttttagtttccttatcattagatggtctctgaaatttacaaggaaagtattttgaagtgaggataagacaatcgaataaatcagttaggaaagtttcaactatatcctgaggcattttatctagggcttttgattttaggtacaagaaagatccctaatttatttagattattttcaccagcttagtcctggtgatacgacaagttcacatatgctcaaactctaaaacaaaactttataatatgggcatgttttataaatgtgagttagaaaaggaatttggatgtttcatgtgtattttaaattatgagttttacttttctccccagagaacccaagattgatcaatattttcccttagaaatacatctgggtaaaaagttctaattatgacctaaacaagctaacattaaacctttggaatagaaagcaaggtttatttataaattttctaattctgtgctatgcaaattaacattattccttagatgttatgttacacatctgctcttctttctatcagcttcctcaagttggtacggataaccacaagttagtttgactgttgagcaatgttagcatcaagttctgagagtatccaggggctagcagccaataaaccttggttctgaactactgaccagctacgtcagcttgacaaagttctttgtcctctctgtgtctatgttttactcctgtaagggatacttaccctgcccattttccagggttattgggataattaagtaagataatacacatagaagtacttggaaagattactaacatgtgtaattgtaagttgttgctgcagtatcattgcaaaggccttttgcctacattgagcctgaatgtgttccttgtcttcctcaggatgtgaagtagggagagaaaaaataccatctccattcttgcacactcgtcagtctgcctcctcaacctcacatagctctaattgtacctaatgaaagtaacatttttaggtcccagttgcaggaaatattttaaatagaaccagcctggggcatttttcaaaataaaatctaaataatgcaagattgttagcacgaactgtgccagggctggattacacaactaataaaaatcaacctgagtttcagactgtcaggcagcattgattatacctcccccaggtcacctgaggtgatagcaggactcacatcagaccttgtctttaagttctagggacctcggtcatcctcaacgacttcatactaggacttgttcatgagttaacaaagcagtttgtcagcatctattcacatgtcagcatctattcacatgtcagtgaccacaatgagagtgtatacatactgggccctggcttaaagttgtttgtggctaaggattaggaaggacacacttcctccttcaactcatcagccatctccagggtggcttccttgcctttaacaccaccccaaatcaatacaaatgctgctgacaccatctacgttgtttatactttggagaggtcagggaacgaacacatgaatggctcttgtcttgtgcctggaaacctggctttgaggtctctgggctttgttatagaaggcatttgtctaagaagctcccagaagtaaattttttgtttgtttgtttgtttgtttttttgagacagagtctcactctgtcacccaggctggagtgcagtggcacgatctcagctcactgcaacctctgcctcctgggttcaagcgattttcctgcctcagcctctggagtagctgggaccacaggcgcgtgccaccacgcctggctaattttttgtatttttagtagagacggggtttcattgtgtcaggcaggctggtctcaatctcctgacctcgtgatccacccgcctaggcctcccaaagtgctgggattacaggcgtgagccaccatgcccggccagaagtaaacctttttaagtggagcttttactacctctttgacctccaaggttctagcctctgcctagtagttagtactcagagtgcctggaagttccttcctgccttagctgctttctcttgatacacttctttttgtgcctaagtcaatgtatctttttgatcctctcagacctacatggctctctggtattagaccttttgcccaactgacctcttccagactgtttcctgtcaagtagcacttctaacccagcagactgttttaacccactgctgccagtgtgttgtttttatattgctcatgattattatatcacatgtaaattataagtattatatattagatatgtatattatacatatatgcatattagttatatatgtatacatatatattaattatacatatatataattattatatatatcttttaatatatttaacaatgctggcaatacctacaattctaattagagatacaattgtttgaatacctactttttgatagatcctgtattaggtattttacatacattattttatttaatacttacagtgatctgaacaggtcaggtataaaaatgtaaacctgtttttactcatagttttataatgaaaggaaatccttcctcccaccttcaatggagccaccataaacagcttcttatcctcatgtttcaggtgaagaaactgagactcagagaggttaaacaatttgtccaaggtcacagaactagttgagtctagtgaggcttagtttaaagatgatgctttgttaagaaaccactatatcagattggtcctctactttagtctaccctattttctacccagggataaatacatctgggacagttagcttctttcagagcattgaacatttcacctgcttctattattgagatctctggtcaacacttctccttctgtggaggtataacataataattgaaaattttttaacaagtatgtctctttcacctgtatgagtgaacaccatggagcagatatgatcaaagtcagtaacatcaagaactgttcagaacactttggatatccagcagagatgattacctttcttctgtgttagatactttttaaataactgtgaccatttagcttccctctatcccctgcccctgccggtcattcttgtctttcagatgtagccaatatttttaattctttgccaatatgctgctgcacaaaacttggctaatcttcctcctagtggctatccacaaatacctgcaaattatccgggtcatacttatacaaggaatgtgatatttgacaagccatataccttcatctgaaggaatgtgatatttgacaagccatataccttcatctgaagaaagggggatatataccatatgggactgatacaaaaatggaaaaaaaataacatgtctctcaaatagataccttttgatgcccattcatttaatcaactaacgtttactaagcatctactatctattcatttagatcccagggatggtgtaattaacaagagcaacaaattccttgccctttttagtgcatactttaacaaataaacaaatattagaagatcagataagagcaagtacaaaggcctattgtttgaataggcttagtgtgttcaatgaacagagaaaatgccagtgtggctgcaccctaatgagtaaaggagagaatgttatgttgagctagatcatgtatggccttgtatcaagcaaggagacttggaaatatttaacactgaagtgtttaaaaaatggtgaaaaagagctcaattgattgagctaaattgatttacccttcttctctgagattactactgttgtggctttagcttcatggcatttaaagaggctgtccaatgtctgacaagaacataaatgtttctttcacttaatccccagtgggcatatcttatgacctttgtgttccaggaacccatgtagaggaagaaagaaaagcaaatcccacagtctacatagtgtgatggggttgcatctaaacatcagaattggagtgctttgatagtttccttctcagatgacacaggcctgggcatagtcaggggtgcttgccagaaattaactttaccagaagcctaagtaggagtcattcttattaacttagtttgtaaacccaagaggcatcgccatctggattcctgtgttttgcatgatgtcggggatataaaatttcaatgagtgactactaagcagtatgaacagtgccgatcatttggtactgtctgaaaattattggttggcatgctaatcccatctgttaggattgttattactcagttataaagcacttggtttgaattgccacccttggcaattttagttttgacagcacgtatcccttgatgtttaaaacagatatggtcctgaaatgtcttccataaagtaaaattgaatactccaagatttacagctgatcttcatagtgttatcaggctgcttctgatttcttcctcacacttttccattttcttttgtgtttgacatcttctggaatccagataaggtagggtagagaaaggtcatggattatacatagaaaaataaaggcagaatttgtatttatttatatttattgtagttagttagattaattaaatatgtttattgaactcacattattgagaaagtgttaaccaaagtacaagaagacagaatttttgttcaataaatacccttctgtaatgtgttagccaattaatgcccaatttctaaagtggccttatgataacattctgtgttgagaattctttataatgctagtgctggttgatacaattaatcccaactgaccagactctagtaggatttcttctttataaaagcccaaaattcaacacctggcacatcttagtgagtaccttaaaaagctgaatagttggccaggcgccgtggctcatgcctgtaatcactttgggaggccgaggcgggcggatcacgaagtcagcagatccagaccatcctggctaacagggtgaaaccccgtctctactaaaaatacaaaaaaattagccgggcgtggtggcgggtgcctgtagttccagctactcgggaagctgaggcaggagaatggcttgaacccgggaagcagagcttacagtgagcagagatagcgccactgcactccagcctgggcgacagagcgaggcgccgtctcaaaaaaaatctgaatagttaacaggtaaattaacctgtaagctaacagatatcctctgtatgttgatctggtttttagtatatattctgtatcaggaaatattggctgagaaaccaatagtaaaattaaactatccctgtagtaactgttaaaggactggccacagggacagagcaaaaatggctacagctccagttatagagagactttctcacaggtttttattatcagattttcaacatagcaatatttattgctgggaaagaagtcagactatcttacagtttggaagatgggtatagcttctctatgtagctctgtggctacctcatggccacaaatatccacattagcaattagtttcatatcttctagtcagttgcagcataaaactgctctgtgttgctttgatgtttttttctgatttctaggcaaggtcctaaatggaaaagccaatactcttgaaatatatagagcacaaacaaagttgtaaacacccaataaagccattttgttatttctctgttcctacagaaactcaacatattgcatgaaggtgtcaatgtccttgactgttgcagagaatgaatcaggcctgtgctacaacagcaggatccgctatttagaaaaatctgaagtcactaaaagaaaggagatctcctgtccagacatggatgactttaaaaagtccgatcaggagcctgatgttgtgtggtataaggtaactcagcatggtgtcaaattcatattttacctcagtcaatagcagtcttggggatgaggaaagggagatttttttactagtttttggtattagatatttcactgagaagaatcaacagatccataactaaataattcagagctgtgactcttatgtatcactggtttttaatgcaggtgttagaagcaatacgcctttctccaactgctaaaagtagaatctccctccagcctgacagcatataagaactaatgggaagaagggtaaacatttaaataacacttgaaagaaattatttgggggacacagaaatattatttactggtgggaacaaaggcctgccattacaagtagtagtacttataaagaataacaactatcataatggtctactctgtgaaagccacaacagtgaatgcagaggagagaaatgggcccagtacaggatgtataaacactgctaaggttaagtttagctggaaataaaccacactcaaaggttgaacagaagagaattgtggccaggtgcagtggctcatgcctgtaatcccagcattttgggaggctgaggcgggcagttcacctgaggtcaggagttcgagaccagcctggccaatatggtgaaacctcatctctactaaaatataaaaattagctgggcattgcagcacacacctgtaatcccagcaacttggaaggctgaggcaggagaaccacttgaacatgggaggcagaggttgcagtgagccgagatcatgtcactgtactccagcctgggcaacagagcgagactccatctaaaaaaaaaaaaaaaaagaagagagttgaatgaaaggattatttacaaaggtttgggcaggcttgaagaaatcaataaaggagcaagctgttgattatcacccctagacctgcagtgtcaaggggaaggagcagtgtcactggaacctggcaagagtggaggaagctgccaagagatacagccttaaaggaacatatgagggtggcagataggaagggagtgggtaggataaataccctaaccatttataactcctgctctctgtttatttgctagttgcttccctctcctgccaccctcattcaaactgaaacagaagccagggggcagaggcaggagatagaatcaatagtgttctgcttttctgagcatagagtagagcagacaagcgtggataattggatctaggggaagaagcagataataaccacacaaccttccagctatgatattctagcagctaacctggggcccacggtcttgtaacagaactaagtcaactctcttctgtcagctctgaaccacagcaattgacacactgaagttttatgatgtgatggtagatgaccaggaaggttttctgcacagatgctgtgtgtactgttggaaccaaacacacataaaaggtggagcaggttgtttctataggatctgacagaccctcagttcctagggaagcttaatccctaactcccacagctgtcatatgcctttacatttggaagcctctccattttcacacctagggaaacttaccaatagacaccaagaacatactctgtactagaacgtccaggtctcaatgggaattatcttaatgaagacaatattgtgacagataaaaaggaacataatgtttattatgcacaaacatatagactacaggtaatttggtgggtttatgccatcatcaacctcatttgtatttattaagcacttattgtgtgccattcattgtagctaaacttgatttcaacattatcttgtttaaatctcagtgcaactctgtgtgataggtgctattatcctaatttaatggagaacaaaaccactgaggctgagagagatgtgacctatccaaagttacacagtgaacaaagcctgattttctattcaaggcagtgtgactccagaattcattttcttaatcactaccctctccggcaatgggcctgggactaaacccagccttggtcatatcttgggaacttttgtaagatgccatgctggtgcagtggagcctggccaaagaaagaaaaagaaagttttattttaattttatggttgaggaagggaaggtgacctgcccaaagagttagcagctgggagtgaaatccagataatcaactttcccttataagagtaattctactatctcatcttactttctgctaacttctttcttctccttttctcatatctctagacatcactatcatccttacatactcaagcaatttactgcttggcaaatgccacttctcactcttccttagaaatggaccaacaatggtgaagcaacaggcctttccagctctgcctggataatatttaatatttctataatattttacagttgataaatgatcatcataatgttagctaacatttcctaagtacttactgtatggcaagctgtgttttaggtgcatgagatagattaatgcaattcttagaactaccatataaggtaatattatctctattttatagaagaagtgactggagactcagacaagctaagtgggttagcaaaagtcaacagtagtttgtgacttgcagtttggctactagccccactcttagcccctacagtatactaacggattaggataaaatactagaatcagaagttaaagagtacctgaagctcaggatgtattgctaactcttggttctcatacaaggtttcaagtaaatacctgaagaaaatgtaccaacatattaggaaaatatttctttttcagtcagtatttggatagtctgccttgcctactttatagcccatgtattttctttttttatttattttttaaattttattttttattattatactttaagttgtagggtacatgtgcacaatgtgcaggtttgttacatatgtatacatgtgccatgttggtgtgctgcacccattaactcatcatttacattaggtgtatctcctaatgctatccctcccccatccccccaccgcacagcaggacccagtgtgtgatgtccaccttcctgtgtccaagtgttctcattgttcaattcccacctatgagtgagaacatgcagtgtttggtttttttgtccttgcaatagtttgctgagaatgatggtttccagcttcatccatgtccctacaaaagacatgaactcatcattttttatggctgcatagtattccatggtgtatacccacattttcttaatccagtctatcattgttggacatttgggttggttccaggtcttttctattgtgaatagtgctgcaataaacatacggtgtgcatgtgtctttatagctgcatgatatataatcctttgggtatatacccagtaatgggatggctgggtcaaatggtatttctagttctagatccctgaggaatcgccacactgtcttccacaatgattgaaccagtttacagtcccaccaacagtgtaaaagtgttcctttttctccacattctctccagcacctgttgtttcctgactttttaatgattgccattctaactggtgtgagatggtatctcattgtggttttgatttgcatttctctgatggccagtgatgatgagcattttttcatgtcttttggctgcataaatgtcttcttttgagaagtgtgtgttcatatccttcgcccacttgttgatggggttgtttttttcgtgtaaatttgtttgagttctttgtagattctagatattagccctttgtcagataagtggattgcaaaaattttctcccattctgtaggttgcctgttgactctgatggtggtttcttttgctgtgcagaagctgtattttctaccaggctgagcaagttttgctctgtctatagcaatataaagaagaggatacatttgtccagagtttattctggtgctcattcaaagttagaaatgtccagtgtgttaaaagaaaaatttcagccaaattaaatttaaaagattaattgagcaaagagtgattcacaaatcaggcagtcttctgagccagagtaagctcagagactccagtgcagccaagtggtagaagaatatttatggacagaaaaaggaaagtgatgtacagaaaatggaagtgaggaacacaaacagctggattggttatagctctgtgccttatttgaacacggttcaaacagttggccacatttgattggtcaaaacttagtaattggcacaagagtaggctatggtctatttacacctccacttgttatagttgacagtgtacagagaaacctttaggcctaacttaaaatatgtaagaaagcagctttaggctaaacatgatttaacaatttcccccttttattcatcctctcattttgagagattgaccaaaactttagtcattgatgtcactatcaccatcataaatgtacttatttggccttgaaacccactgaaaaatagcagaacagtgggttgtgtaaggtgtgaacaaggacttcaggtcattttttttttttgtaagggttagagtagaggataacttcttagtctggaacatcctgtttacaggagaaaaagacaaaacccagtctgttctaggatatatgtgtttccttaaagtcttagtttgattatgttacatttagcacaagtgagtcccttttggttttgtctggtctgttggggcctagtgcatgacatgagctgagtccaaaacaatggcctcccataattttgtttaaaaattcccccctttttgtcaggttctcacttaggtgagagtgtgccactctcagttaccgtcattttgggtttccaggtctcagcaattcattcataggttatgatgccctcatggtcacacatttccttcagctattggcattccaattgaatagacaacatttgccattcttgagatggctgaatgcaaacgtttaaaacttttgagagaatacagtacaccaaggggactactattatgattgtcaggaggataataccaagagtttggagtatgccccttacctagggtcaccaggaaccaaaccaactaaaatcaaatagatcaaagaatgagctaaagagtctactcactttaactaagcagtctcttcattaatctcctacactgaatctctataatacctgatgggatatatttctccacaggccacaagcaccagcagttgcacagatacttctgatacttctctgtttagccagtaagtaatctagagcaattctattatttagcataattttcacaagagaatttaaaatctgttgtgtaaccatagcctttacagtagaatcagttatagagcctatcataagggatacatttctaattattccatcttttactccacaccatggaaaaaagcacttaacaaatgatgcctttctagaagaatgaaggactcccggcaatgttgtctttaacccatgatgtagattaaaaggagtgaaccaacattctgtttctgactatcaggcaacgtatgtaccattaaagttattcacctacattgggccttcatttttcatctatcaaggcatacggttatccatgtataaggctggttatccatgtataaggctggccatttttttttctggggagaaacttccctgggtagctttaccttaagggttctaacgggtgtatagttccataagtgtggagcaaccctccctcagttgtgagattataagcccaaggttcaatgtcccttagctttgctgcagtgtggatggcaaaggaagtccttctctgatgttctcggaagatccagtctttgagttctagattgtgaaggggttgattgtcttcagttagtgaaccgtaaaaatcttttattcctggtgaaaatacattgtgacgtaataatctgttataacatcacccttctcgcaaggaaaagctttgatacaaccagaaaacatacattgaaaatgacaattgaatgaaatccctctataaatgtttaaatgacccatcaggtagctgaatgtatctgaagatttgagtgtcttcccaggaatacgggtttgacaaattaaacattggttataaactattttagcaatgtacaagtcaccacaacaatatatatttaatttggattattttatctttttcatgagtcatggaatgcagaacttttaataacaaaaactttaaggactcaggaaggacaaggcagctgccctggttctccatgagtccatacttaacattggtcttatgtcctcttgaataccaattgtttctccaatttaggtgcgtagcactgataactgatgggttatcataggtcatttgacttagaccatggagttcattcaaattgtgtatctatacaattttggtattggctgatttagcatgataatctggcaaagtgtcttcttggtattcaattaatttttgttctacttgggttagcagttatataaaccagtcttttcattgaagttccaggaattcttacccagtccaaatgatatgactctaaagttatgagaaacccgtattcaagagtgcttttcagggtcctttccaaccttctaaaagacaccatatttctaggattttgcatgcttgtgaatttttcagaaactgcatcagaattaagcaattaactagcaatgacttcaagtaaagacacagttgacaaggaaatttggttatttctgtggtctacaataaattaacataataaccataattataattgatatcatatactcagacagtagaattttagaaatcccataacattttggaacatatattaatgaaattcattaaaatataacctaaagaaggttaatgattatttctggctgggcgtggtagctaacgcctgtcatcccaacactttgggaggctgaggcaggcggatcttttgaggtcaggagttttagaccagaggctgaggcatgagaatggcttgaacacaaggggagggtggggaaaggttgcagtgagtgagctgagagcgcaccactgcactacgctccagcctgggtgacagagtgagactgtctcaaaacaaacaaataaacaaacaaaaatttcttattttgacggtgcttcccatgtaacttaatatatcaaataatcctgtttacctctcttttggatgcttcaggggccctctgtagcatcctaaagttagtggtcaaaagagacttaatttcgaaattggaatttgacttggggaagcctgtcaaatatgttaaatgtttaaaacatttgatattatgaaatagaattccatgtcaccataaatcattcattttgccaaaataatgactcaaaaattttaaagatgtaaaaacctttactcattgatagaggaaagacttagctttccaaacaatctgtctcttgtctttcccttctttctcctgtagtttattcaaaaggcaaacaaaaatctttcattattctttaatattacatgaaaatctcattcaagaaagaaagccaaatttcatccttgcattagtatactgttaatgtcaaccccaatttttaataaaacctagtagacaaatctatctaatcttaatcagttttaccataaggtgagattcacataaatcttttataacccattacaaattttcattaaatagtagatcagtgctctaagaaaacccttttgtgcttttatttcaatgttcaatttacaaaaaaactgaacaataccccctttaaatttagccaatatgttcacatgtagaatttctcttacaagtttaatttttcacaatcttccacaacttgctcaactttcagctttatcctatctaacctaaatcgtcatttaaccctttaatctaggcacaaaaatccacattcccatgccttcttataatcttttaccaaaagcctacttcactttcctcacacattttgcatgtaaaactctttcttcagtagtctcaattacatgttagaatctcaactcttagcaatttttatttttagtgaaaaacccggtaaggaagtgattttaattatgtactaggtgtggggcctaggacaacagactgaagtgcaggtaaagtccaactctttccatcatagctaggggcatggttaactccatgtgtccctaggccttatctagaatctaatggctctaaagcaggtaagtctaacaattttcaaaagtcaaaggagcagtttatgacatcaaagcatttagcaaacctaatatccgacctgcctaatttagaccaaatgtctttattttaccaataatcttataaaactgtgtttatttcccaaagattactaaagtcatgtgaactaaaagacattacagtttttatttttctgacaaaatatttgatttaagcacttattccttttaaaccaattaatcagagctttttcgtataaacatcactcacacaacacatacagacagaagaaaatccattacttgtaagaattttcatttgtcagttttaaaatagcttttctttctcccgttcagtctatcaatcttccaattactggtttcactgaactaagcaattgttgactaggcaacaaatttgtatttctaaagggacaactgttaggtggaaccacaaaaaataaaaatttatatctcataagcagagagcaagattttggtctaaaaattatattattgtttgctcaaaccaggggcaaaacaaaaacaaaaacaaagacaaaaacaaaacaaaaaaaacagtgctctcatgaaagttccatcaagagaagatggccagaaaagcatctcaaccaaaagtatgatttattatgtaaatttaaaggaatgggccgggtgctcaagcctataatctcagcactttgggagaccaaggcgggcggatcacatgaggtcaggagttcgagaccagcctggccaacatgtgaaactccgtctctactaaaaatacaaaaattagctgggcgtgatggtgcatgcctgtaatctcagctacttgggaggctgaggcaggaggatcacttgaacctgggaggcagaggttgcagtgagctgagattgtgccactgcattccagtctgggtgacagagggagacttcatctcaaaaaaaaaataataatggtgatatgatttggctctgtatccccacccaaatctcatcaggaattgtaatccccacatgtcaagggagggacctggtggaaggtgattgaatcatggagatggtttccctcatggtattctcatgatagtgagtgagttctcacaagagctgatggttttaaagtgtggcacttccttgctctctctctctctttcctgttaccttgtgaagacgtgccttgtttccccttcatcttctgccgtgattataagtttcctggggcctccccagccatccagaactgtgaatcaattaaacctactttctttataaattacccagtctcaggtatttatggcagtgtgaaaacagactaatacaaatggtaagtttctaatgtacataagcagatatccctacaaatggagatttcatatatatatgtgtgtatatatatatatatgtgtgtatatatatatatatatgtgtatatatatatatatatattttttttttacaaaagagttttaagatagtcaattaaattccagaaagatgtattttagttcaatagggttttctttttaacatagctactgtttcttagctaaaattactgagttcagggtaatgggtggagcccactaaagaatagggccaacaaagcatgcattgtatgcctagactcagcatggatagatctgtaaaaagaagcatgcctattttacctgagggcctaacttttataaacatcttatctaggataactttctttccaccttttgggtgggaaaataactaagccaaaaggttagcagacttaatttttaaaaatcagttagttgcttaagatttgtatttgccttttataaagtctttagataaaaatattgaaatatttttagaagcttctgcatgtcaataggcatccctaggtgagactaatttgggagccctcaatcaaatgcacttcagtgcattgccattcatttggaacgttccactctaacttatctttagtgagattttgcgatttcaataagactttgctgcttgaggggcctcatacttgtgcgtgtataagccagaaggaactcagttcttcagaaattaaggatcccatttttacctcaaatattgtcttttttctcagattcccttgatcaacttagccagtgtttgttttttcctacttaagcatgcaagaaaaataaaacaaaggggtagaacacaaaaatctctgtgaatttccaaaagccaaattttataccccctgcaatattgccatttactactaggttctttctgacccaatcagatataagaggcctctaactggatccaagccagttaattaccagatccaatctgatcctggacctagtccgctttctgccatgacttccaaacctagtttggatcagaaatttgctcaaagaaactcagagagctcaaaacagaaaaccatggagctttggaatccaagagagaacttaaccacgatccccagttgttccaagagagtaatggacacagtgggtctggtgggtacctcacttggtcattcaatactccttggggtcattagaagctctactttggatcccacttctggtgccatctgttaaaagaaaatcttcagctgaattaaatttaaaatactttaattgagcaaagaatgatttgcaaatcagtcagcctcttgagccagagtaggttcagagactccagtgcagccgtgtgttagaagaagatttatggacagaaaaagtaaagtgatgaacagaaaatggaagtgaggtccagaaacagctggattggttacagctcagcatttgtcttatttgaacacattttgaagttggccacatttgattggtcaaaacccagtgattggcacaagagtatgctatggcctgtttacaccaccacttgttatacttgaagatgtacagagaaacctttaggtcatacttaaaatatgtaaggaggcagtttaggctaaacttgatttaactaacgtcttaactccagggctttaatggtgaaaactattgctttgcatgatccgttttccaggtgtcttttcaaatatacagaatctttaaattcctttcgtttccatcagtctctgtgttttacttaattaactaattatattgtatcactctcatagtccgttttgagtttcctgggctgtttgaaatatgctatggtaggcctttaaggactatcattctgtgcctgcacgtaatcacagctggatgggaagctagaggtgaatcaggtggtactggaggcatgttcataaagatgcctgagtaagccaatccagcctgtctgaggaatacaaaggatatgtgtaagaggactgtatattctctatctgaactgcatcagttatcaaattgagataaggagaggggctacacttttagaaggttcttctgacactatataaataggatttagacattagagcagaatattcaataatgttagtgtttttaaaacgttttacaaatgagagataaggattcttttttaaattgaaccaagaagaacactaaacctacttaattattcactgagcaccctgttgtcacagaaatgtggagtcattttatcccatttctaaatgtcctaattttgataggatattggcaagaaaaatgcaaatacacactttggagtgaaacactcatctatgtgattagttacctcagttggtaaaagtctggtgttaataaggtcaaggctatcactttgaattctcctttttcttgtcacaactatctcaattttagatgtttgacattggttataaatggaattggttgggaatgatggatggttcagtacaaacttatttgtacaactgatcattcattcagcacatatgtattgggtgcctacctgtgcaaggcactatgctaggaactgggaatactgaactgaccaaaataaacacatttctcttttctcatgaagggagatagatgagtaaatagctctttctcaacactccaggaaggaactacatcaattgaaatatctaaaagaacagctcctacttgtaatcaatagtgtctttgtcttgagtaaagggcagcagacatacctgtttttaatcacagacatgaatctctgcaaaggaaaattacaaaactaaataagatcagctaatattttcatggtacataatagtcaggagcaatcttttgttacctaaacatcaagggtttactttcagtcctgcagcttgctgcacagaaagccaatcactgagacaatgagtattgccagggaagaaggctttaattgggtgttgcagctgaggaaatgggaaatcaatatcaaatccatctccctgatggactaaaatcaggggtttatatagcagggaacaaatgtaactaaatgcaagtaaacagaaattagggagaggtaaggaataggagttggctaacaggaagcaggtagttgcttagacaatcatgatggataaggggttgaatttctccttgtctggatgtagtgatatgttaagttttggttccttgatatcatttgggagtcctgatggttggtttcctgagaaaagaactcagataagacaaatgtgactttctcaagttttaagactaagggggcagtttctacatttattcaaaagaaaccataaacatcagttatataggacaactgggtcgatttaaattttacaaatctttttatgtaacagcacacatagaaagtgataatatggcacatcaaagtgagtggaagactggccttgagagcttcaggtgctctcagccctcctgactgatttggggctgaacaacacaaaatcaatgtgcccatatactggtagccctcacatagcactccagagtgctgtgacccactggtttggaagctctggtttaccttttcataaaatgtaatatatatattttttatctaaagatgactgagtaatttaatcttgattgtcctgggaatgcaagggatatgtgggagagagttgtatctcctctatctgaactctatctgttagcaaaaggaggtgagtctgcttattggtggttgttatcttctttttacagatgaggaaactgaaataactcacagagggtcacttatccaacatgtggccaattagattcaaacgctgaaattctgacatctagtgttctcataatctcactatgattgctccactacatgaatatgttatgcacttaatcactcacatcactgatataaacagaattctctatcaaaattgttactccagaaacaaatcctgtaatgctttctaaggactctttaatgactctgagtgttgaaagggactcaaatgaggaaactgaagcccaaagaggttaagtgacttgcttaagtctaatgaaacccatgtctttctttttttacattcattaaattttacaaaaagagaccactaaatagaatagaagtgtgtgtgtatatatatatatgtgtgtgtgtgtgtgtgtgtgtgtgtgtgtgtgtgtgtgtctgtatttaaaagctgattgttttgacaaatcgaacagtgaagaggtatattaatataaagttagtttcatcctctcttccattccatttcagccaccaaaataactaatgctaactgttaaatacttcctcactttcctctatgctaacattttcttcctctctctctccccaccttctctctttgtgtgtatatatgtgtatgtgtgcatacatatataaaacacattatttacttactttcatatatacacatatatgcaaatattttcccttctctaatttttttttataaaaaagagaacatgctatgcatatcatgcttcagctttccccatcacacacaaccgtatgagaaacatccttccacgtcttctacaggtctaattcattttgctgcataatagttgacaggacagaactaccttattttattcaatcagttcttctactaatggatatttatgcattttttttctatttttgtttttaataaccacagtgttggaacatccttgtaaacatacatgcttccttacatccatgacatacaagatggaaatgctctctgtcactattatagttttgtaggttctagctgatgcaataagaaaatgaaatgaaatatgctatataaatattggaaaagaagagacaaaataatcttaattttcagattatatgattgcatacctagaaaacccaaaggatgcaactacgacaacaacaaaaaatagaactaatgagaaacttcagtatggtagcttcctaaaaatgtacaaaaattcaacagcttttgtttttgcaaacaataaccagttagacatgtaaaggtgaaaaatgaagtgatcttgtttaaacaatgacactataaaacacattagaatacatttaacaaggatgcaaaggggcttatatgaaaataagattagcatttgcaaaccatcaatcggacaagggattaatcaccagaatatataaggatctcaaataattttgtaggaaaaaaacctaatctaatttgaaaaatgagcaaaatatttaaatagacatttctcaaaagaagacatacagatgggaaacagacatatgaaaaggtgctcaatatcattgatcatcagagaaatgcaaatcaaaactacaatgagatatcatttcactccagttacagtgacttatatccaaaatgcagacaataacaaacgctactgaggattcgaagaaaagggaacccttgtacactgttggtaggaatgtaaattactacaacccctatggagaacagtttggaggttcctcaaaaaactagaaattgagctaccatatgatctagcaatcccacagctgggtatatacccaaaagaaagtaaatcagtatatcaaagatatatctgaacttccatgtttattgcagcactatgcacaatagccacaatttggaagcaacctaagtgtccatcaacagatgaatggataaagaaaatgtggtacatatacacaatggaatactattcagccataaaaaaagagattctgtcatttgcaacaacatggatggaaccagaggtcattatgttaaatgaaataggccaggtactgaaagacaaacaccacatattctcacttatttgtgggatctaaaaatcaaaacaatggaactcctagacacagatagcagaaggattgttaccagaggctgggaagggtatggaggggttgcagagaggtggggatggttaatggatacaaaaaaatagttaggaaaaatgaataatacttagtatttgctagcacaacagtgagtctatagtcaaaaataatttaattttccattttaaaataaaaagtacagttggattgtttgtaacacaaaagatagatgcttgagggaatggaaaccccattttctatgatgtgattattacacattggatgtctgtatcaaaataactcatgtcatcataaatatataacctactatatacccatgaaaataaaataccattgaggtactattatgtaatagaaaagctaaaatcgaaaacacagatgacacccaatgctaacaaggatgtgtagcaacaggaagaattattcattgcaaatgggaatgcaaaacaatacagccacttttaaaaaacagtttggcagttcattacaaagttcaaagtaagcttaccataacatccaacaactgtgcttgtaggcagttaccaaaattagttgaaaagtttcatccacacaaaaacctacacacaaatgtttatagcatctttatttacagttgccaataattgtatgcaaccagcaagtccttcttcctttgtgaatggctaaacaaactgtggtacattcatataataaaatattattcagatatgagaaaaaatgatatatcaaatcataaaaagacatggagaaaccttaaatgtgaaaccataagtgaaataagccagtctgaaaagggtacgtactgtatgcttagaactatatgacattctggaaaaggtagtactatagagagaataaaaagatcagtggttgccaaggtgttgtggaggaaagatgaaggaaggaatcaatatatggatcacagaatatttttagggtgggaaacaatttttaggatggcaaacaattctgtatgatgctgtaatgatggatgtatgaaattattcatttgtcaaaaccaattggactgtacaaaacacagagtgcaccctcatgttaactgtggacctcctttaataacaatctataaatattcgttcatcaattagaccaaatttatcacattaatgcaaaatgttaataatatgtagaaaacttgatgtgagagtttggagggtatgtggaaaccctgtactttctgcacaattttttctataaacctaaaactaaaaataaagcctattaattaagaaaaaaaacaaaatttattataggacataaaatatgatccaaattaatgaagagacaacatgtttctgcatgggaagataccaaagaataaaagatacgcttttctgaaaatgtataagtaatgcaatttgatagaatataaattatttgaaactggacaacataattacacagttaatataaatgaatatgccagaattgccaagaaaatattggaaaaaagcattcatgagaggggacatattctatgagttgctatcatttactacaaaacaacatcaattgaaacagtaagctaaggaaaagataattgacctgtagaatagagaatccagaaacagataaaaatacttatgtatgagaatgtagaatataataaaggtaacatttcattttaatgtaggtggagggagaatgatggtttatttaaatatggtgtggacataattgaatatctacttagaaaaaaattagatctctgactcttgtaccctgtttaagaaaaattctaaatgaattgtaaagagttaatttcatctacaaaaatagtggtttaggaatgaccatttctaaatgctaccacttatttcaataagttaagtttttaaagaaaagagctttacattgatttatcttgttatacattctgactgtttttctaaaggtggaaaaaatgtcattagaaacctcataataccgcagcctgaatgatcaacacttgcttgctaaaaaaaaaaaaatggtttcccaaaatgcttggagattttgaatccctttaggaagtgtaataaaattaatctgtgccttctgtcataaccataaaattgtatgcaacccttgaatttttaatcttgtaacaagaattttcaaagacatatttatccagaaggaatgagttgcaaagctcatgaaggcttcagtttggtgtgccctgaaaccatagtcagcaatacaaaatttaagatccatttgtacttctttttgttcctagatatggcattagaagtggggaggtttttttttttttaactgtttgtaaattataaaataggtgggctaatacaataggaatgggtatttggcatgtataagaagcactgggctccatgtttgaggacttggattctgatcaccatactaccattaacatggataagtaattaaatatcactggacctcaatttccccacatataaaatatatgtaattaatagctgttatataccctagacatgttataaaagtttaatgattaaagtctttacttgagatttgctacaactatagaaatggaaaagttatgtggaagccagaaatatagttacctaagacatctcagattctaatttaaggctgaggtttttttaaaggtcaaattattatgtataatttacaaatagcaaaattcatcccttttacatgtacaatttgatttgatgtgttttgacaaatgtatacaccatagtcaagatatggaacagttctgtcactccaagttcttctgtgtccttttgtattcaatcctctcgtcccagccttagtctttggtaaaaattcctttgtttctattcctataattttccattttccagaatgtaatataaatggaataatatgatatgtagcttttttgtctgtcttcctttacttagtataatgcatttaagacccatctatgttatgacatatatcaataattcatttctttttatgctgagtagtattccactgtatagatgtaccactgtttaaccattcactaattgatgaccatttggattgttgccattttttgattaggaataaaactgttacaagcattgggttttgacgttatattttcttgctttatcaacatgatttgtttttgtcaactttgtaatcttttaacaggcatgcctttttaaaatttaacaagagattgctcttgatctttcccaaattgttctaagaatctaggcttagaaggtccttgagtatatctttaatggcatcccagggatacaaacagttcaaagcaaactaaagcttcttaagcaatgtctttcctacagtatatcttcaatgtatccagcagaatgatcttttagaaatacatatctgatcataggatgctacttcttagtgaactctaatgattctataaaatcatttagatgacagctcctttttactgagtgtttgcagggcctaacattgtgccaaatatgttcatgcattacatgactcaatcattagtgaagccttatgagataggctacacggtggcagagctgaatttgaaccctgacggtgtgcaaatatcttagaatggaatttaaggctctttacatttgaatccagccactctcaaaagagcaaaattatttggaacttttttgtctacttcaagtgttttcacatctgtgtgcttctacacatgttgttccttctgtcttctacaccctgcctgccttttatatgttgttcaaactcagctcagatgctcatagtagcccacctgcataccatccccttgcccagacccagtctgctccaatacatgaatgactcagcattgaaatttaaacatttcttctttttctttctctatttcttcttgttctagtattcccattatgcctattttacaccttttgtagttccacagttcttggatattctgttccactttttttccattcttctctctccttccttttcttgttgggaagtttctattgacattatattcaaactcattggttctttcctcagctatgtagtctattaataagcccatcagaggcattattttatttctgttgcagtgtgttgattcctagcatttccttgagattatttttaagagcttccatctctctgcttacattacccatctactcttacatgatgtctactttttccatcagaattattaacattttaatcatacttattttaagttcccaatctgggaaatataaaatttctgccatatctgagtctgtttttttttaacttttattttaggttcaggggtacatgtgaaggtttgttacataggtaaacacgtgtcacaggggtttgttttacagattatttcatcacctaggtattaagcccagtatccaatagttatcttttctgctcctctccttccaccttcaagtagaccccagtgtctgttgttttcttctttgtgttcatatgttcttatcagttagctaccacttataagtgagaacatgtggtatgtggttttcattccctgcattagtttgctaaggacaatagcctccagctccatccatgttcccataaaagacttgatgtcattcttttttatgtctgcatagtgttccatggtgatatgtaccacattttctttatccaatctgtcattgatgggcatttaggttgattccgtgtctttgctattgtgaatagtgctgcagtgaacatttgtatgtatgtgtctttatggtagaattaatgatttatattcctctgggtatatacccagtaatagtattgctgggtcaaatggtatttctgttttgctctttgaggaatcgccatactgctttccacaatggttgaactaatttacattcccaccaacagtgtataagtgttcctttttctccacaacctcaccagcatctgttattttttgactttttagtaatagctatccgactagtatgagatagtatttcattgtggctttgatttgcatttctctaatgatcagtgatgtcgagcatttttttcatatgtttattggccacatgtatgtcttcttttgaaaagtgtatgttcatgtcctttgcccactttttaatggggttgtttatttttctcttggagatttgtttaagttccttatagatgctggatattagacctttgtcatatgcataatttgcaaaatttttctcccattctgtagattgcctgtttatattgttgaaagtttcttttgctatgcagaagttcttaagtttaattagaccctacttgtcaatttttgcttttgttgtgattgcttttggtgtctttgtcatgaaagttttgcctgtgtctatgtcctgaatgctgttgcctaggttatcttccagagtttttatagtttggggttctacatttaattcattaaaccattttgagttaatttttgtatatgatgtaaggaaggggttcaccttcaatcttctgcatatgactagccagttgtcccagcatcatttattgaaaagggagtcttttccccattgcttgtttttggcagctttgtcgaagatcagatggttatagatgtgttgtcttatttctggctctctattcttttccattagtctatgtgcctgtttttgtgctagcaccctgctattttagttgctgtacccctgtagtatagtttcaagtcatttaacgtgatgcctacagttttgttctgtttgctcagaattgccttgtctatttgggctgggctcttttttggttccttatgaatttcaagtcctgtgaagaatatcattggtaatttgataggaatagcattgaatctataaattgctttgggtagtagggctataataatattgattcttcctatccataagcatgggatgtttttccatttttttgcatcttctctgatttatttgaggagtgttttgtaattcttattgtaaagatctttcacctctctggttagctatacacctaggtattttattatttttgtgacaattgttaatgggactgcttttacaatttggctctcagtttgcctgttgttggtgtatgtgaatgctggtgattttatacattgatttaacatttttctcatattttcaactttttgatgtctgccttaatttcataccattcaacccagcaatcccattactgggtatattccagaggaatataaaagtgtataaatcaaactttgctgaaactttgctgaagttgtttatcagctgaaggagcttttgggctgagacaatggggttttctagatatagaatcatgttgtctgcaaacagagatagtttgacttcttctcttcctatttggatgccctttatttctttatcttgcctgattgccctggccagaacttccaatactacattgaataggagtggtgacagagagcatccttgtcttgtgccagttttcaagggggatgcttccagctttttcccattcagtatgatgttggctgtgggtttgccgtagatggttcttattattttcagatatgttcttcaatacatggggtattgatagtttttaacatgaaggggtgttgaattttaccaaaagcctttgctttgtctattgagataatcatgtggtttttgtctttagttctgtttatgtgatgaatcacatttattgatttgcatatgttgaaccaaccttgcatctcagggatgaagcctacttgatcatggtatattaactttagatgtgctgctggattttgtttgcaagtattttgttgaggatttctgcattgaagtacatcaaggatatcagcctgaagtttgttgttgtgtctctgtcaggttttattattagaacaatgctggtttcatagaatgagttggggaggagtccctcctcctcaattttttggaatagtttctgtaggaatggtaccagctcttattggtatgtctggtagaatttcgctatgaatccatcaagtcctgggcctttgtttttctttttggtggataggctatttattattgacacaattttttttcttttttttttttgagacggagtctctctcagtcacccaggctggagagcaatggtgtgatctcagctcgcttcaacctccgcctcctggattcaagcaattctcctatctcagcctccagggtagctgggattacaggtgcctgccaccgcacccagctaattttttgtattttagtagagatggggcttcaccatgttgcccagactgttctcgaactcctgagctcaggcaatccacctgcctcagcctcccaaagtgctaggattacaggcgtgagcgaccgtgcctggcctattgattcaatttcaaagcttattattagtttgtccagggattcaatttcttcctggctcagtcatggaaggttgtatgtgtctaggaagttacccatcacttctaggttttctaatttgtgtacatataggtgtttctagtagtttctgatgggggtttttatttctgtggggtcagcagtaacatttccttcatccaattgtgtttatttggatcttctctcttcttctttattagtctagctagtgggctatctatcttattaatgttttcaaaaaacttttgaatggttttttgtgtctcaatttccttcagttcagctgtaatttttgttatttcttgtcttctgctagtgttggagttgatttgttcttgcttctcactttcagttttgatgttaggttgttaatttgaaatctttctaactatttgatgtaggcattgagtgctgtgaatctccccttaacactgctctagctgtgtcccagagattctggtatattgtatctttgttctcattattttcaaggaacttgttaatttctgcctttatttcataaattacccacgagtcattccagagcatgttgtttaatttccatgtaattgcatggttttaagtgatttttcatagtcttaacttctatttttattacactgatctgagagtgtgtttggtatgattttggttcttttacatttgttgaggattgttttatgtccaattatgtggttggctttagagtatgtgccatgtaccaatgagaagaatatatattctgttgttttcaggtggagaggtctgtaaaggtctatgagatccatttggtccaatgttaagttcgggtcttgaatatctttgttaattttctgcttcgatgatctgtctaatactcagtggggtgttgaagtctcccactattattgtgttggagtctatgtatctttgtaggtctctaagaacttgctttatgaatctgggttcccccgtggtgggcgcatatatatttaggatagttaggtcttgttaaattaaacccatcatcattatgtaatacccttttctatattttaatctttgttggtttgaaatctgctttgtctgaaattagaattgcaacccctgctttttttctgttttccatttgcttggtagattttccttcacctttattttgagcctatgaatatcattacatgtgagatgggtcttttgaagacagcatacaattgggtcttgcgtttttatccagcttgccactctgtgccttttaagtaaggcatttagctcttctacattcaagattagtattaatacgtttggatttgatcccgtcattgtgctgttggctggttattatgttggcttgtttatctggttgctttacagtgacactggtctgtgtgtttaagtgtgtttttgtattagctggcagtggtcttttctttctatatttattgttattttcaagatctcctgtaaggcagttctggtggtaatgaattccctaaacatttgcttatctgaaaaggatcttatttctccttcatttaggaagcttcatttggttgggtatgaaattcttggttgaagattttttttctttaagaatgttgaatataggcccccaatctcttctggcttgtagagtttcagctgggaggtctgctgttagcctgatggtgttccctttgtaggtgacctgccctttctctctagctgcctttaacattctttctttcactttgaccttggaaaatctgacaattatgtatcttggggatgatcttcttgtgtagaatcttgcaagagttttctgtatttcctgaatttgattcttggcctctttagcaaagttggggaagttttcatgaacgatatcctgaaatacgttttccaagttgtttgctttctcctctcttctttcagggatgccagtgattcatagatttggcctctttacataatcccatatttcttgcatgttttgttcattcctttttattctctttatttttgtctgactgtcttaattcagagaatcagtcttcaagttctgagattctttcctcagcttgctttattctgctattaatacttgtgattacattatgaaattcttgtattgtgttatttagctctctcatacctgttaggttcattcttataccagctattttgtccttcagctcctgtatcgttttattgtgattttttcccttggattgggttttttcatcctcctcaatctcaatgatctttgttcctatccatattctgaattctatttctgtcattcctgccagttcagcctggttaagaactcttatgggagaactcatgcatttgtttgtaggacatacaacactctgaccatttgagttactggagttcttgcgttggttctttctcatctctgcctgtggatgttcctttaactgcagtgtagattgagtacagtcaataggtgtttctggatgttttcactgggctgaggctttgtgcatggtctttatttgaagcttacttcctgtctctggtttcagagggggggtatgttaatgaagtatttttaatgttgaagatttagggtgtgatccagcaggtggcacataggcttattggtcagttggtacactcttgctcagttgtgtggctttcctatgtttcctcacatttggagccctgttccctctcaatgctctgaaggtgtggcttcctctctcctttgagtgctggctgtagattgcaacttggcactactgggcttctcatagtagctctggggtgatctcagtgttttatgttttttccccaacttggaagcagcagaggaagggaccttagtagtggttgtggccaaggatcatttgcttgtctcctgggagctccactcgagagaggtgcaggtcagcaatggcttagtgcaatcagcccaggatgaagggcctgtgctgtgggtccaagccaagacttccatgtctggtgacaagttgtaggggatgtgtgggacctgtgggagatggactggcctcctctccttgggtcaactgcagcttgctggtggtgtggttaaggtacttaggatatttcctccgtagtctgagggtagcaagggccgttccactacagaggtagtggcacagaggttttcagttgtccttggagactctgtccaggaagttgctaagttgcctggaggacctgcccggtaaggagatatgggaataggcacccacataacagtctggtcagtttttcttagggctgctgtagtatgctggaggcctgctttagtcagtagtcaccttgaattttctagtacctggaggtatcactagtggaggctacaaaacagcaaagatggcagcctgcctctccctccgggagcttcatccccgggagatatggacctgttgctagcccaaagtcacctgaaggaggtgggtggagaccctggttggaaggtcccactcagtgaggaggaatgggattggggacctgcttaaaaaagaagactggctacattttggtagagcagctctgctgtgctgggggtctgttctagcccctggttgccttgggcactccaaagccccaaagttggaacagctaagtttcccaaacagcaaggatgacggcccagccctccttctgagagcttcatcccagggaggttaaaaatctctgttagccagagaacaccaacaggggtggctggaggcccagtttgggaggtcccgcccagtgagtaggaaagggattggggactcactgaaagaagcagtctcgccacattttagtagagcagctgttttttgctggggaatcccttctgcccctggtcagctcagactctccaaagcctgaaggttgaaatggctaggtcacccaaacagcaacgatggtggcccacccctccctcttggatctccttcctgggaaagttacaaatctctgttggttggaaaataccagcaggggtggctgcaggcccagtctgggaggtcccgtccagtgaggaggagtaggatcggggatccacttaaagaagcagtctagccacgttttggtagagcagctgtgctgtgctgggagatcccttccaccactggtcagcttagactctccaaagcctgaaggctggaatggctaagtcacccaaacagcaaagattccccctgcccccggccctgggagctcctttttagggaggtgcaatgcccctaccggtggctagctggaattccaagtcttgttctgttaggtgctgtggacatggggcctgaaggctattgctgctcagccccctgggttcagcctctttcctaggggtatgtttggaggtctaaccttccactttgccagagctgcagctaccctttctggaaagcccaagtatataagactccagggtctcctcacatgcttgagtggctgctctgccaaggctccacatagctctgtctgttagactgaaggccctggtggagtgggttcatatggagatctgctgatctgagggttgcaaagatccgtgggagaaggtggtttcctgtggtcacacattcactcaccacttctctgcacaggggaggttctcctggctccatgttgcttccaggtgggccgtcatcctgtcttgcttttcttcattctccacaggtcaagttgttttcttgattagtcccaatgtgagtacctggatgtttcagttgaaggtattgtatttactcgccccttcttttcctctatgggccacacatgctagctgcttctagtcagccatcctggccacttcatatcttagtctatttctgatgcttgctctctcttcaggctgtttttttgtttgtttgtttgtttgtttgtttgttttgttttttgagttggtgtaccttgtaatttttcgttgaaacccagacatgatgtactgactgggtaaaaaggaactgagataaataggcctttagtgtgaggtttttagatttttctggctaagagtaaggctgtttttactgttttctataactgttggtgttagaggctacagttctttctggtgtccttgtttttcactcttctattgtctttgggtttccctagagacttcttaaataagatgtgagttgtgcagttctttaaactgtgatgccctattattagacaggagtcctaattgatgtgttggtaagatacagggtgagagtaagtgctatataatattatgactaggtctcagtgttttagtgaaccttgtctctgaactgtgaccacaagtgcttctcagcttctctcccacccactacttgagacaggaaggctagaagggctagagctggctttttttcttcttccacttcaaaggctaaaaggagctagagttggatagtttccttctccatgtcaaaagctagaaaagggtaaagagttcataccagttgctggctcgtgcagctgcttctgctcccagtgagctgtgattctctatattctcctgtctctccagtttttggggtagtagttttctttgtgacctcagttatctgatggatctgaaaatggttattgatgttcagtttgtttggcttttttcttgttgtgaggatagtattgatgacttctaagccctttacatgtcagactagaaaccagaagttaatctcagccttagaatgataactttaggttaaagtgttgtctctagactgctatagaaaattgagtcacattaactcctgatgatcattaatatatcataacacatgtataacctgaaagcaaagtactaaaagtaataaaaataatagactaatagttaatatttattgagtagttttagcatgtgatgccctatattacagggcatttacatatatcacctcagttaatctttataatcaccccaattggtaaatattatcaccacctgttttttttaaataggtgaagcaactgaagcttagattgatttagtagcatgctcaaaaacatactacttggaattctaatcaaagtgtttagtctagaacttatattcttaaccactgtgggctaccaatatcaacattaatactgtgaagatagaaagttggagaaacagagcttggaagggaagggctccttgtagttggttatcctaggcctttggagtagagataggctgaaaaggacaaggttcatacctaatttgcaatcgtactcctaattgtctcttccatctttaaactgcagacagttcagtttccctaaagatttttttttttcttttgagatggagtttcgctcttgttgcccaggctggagtgcaatggtgcaatcttggctcattgcaacctctgcctcctgggttcaagcgattctcctgcctcagcctcccgagtagctgggtttacaggcatgcaccaccacgcccaggtaattttgtatttttagtagagacggtgtttctccatgttgatcaggctggtctcgaactcctgacctcatgtgatccacccgcctcggcctcccaaagtgctaggattacaggcatgagtcactgcgcctggccccctaaagatttttaagcagatgtttagatgccctgtgggagaatacagtctccaggggaaaggagaaaagttgcctaaggggtggatgttgggtattcaaacaaaggtgtttgaggactagaggttacatggttagtttatggtcgcatagctgctttgtgcttaaacctcagaatcagaagaaatattgaaatcaatcttcctgatgttcttgccatgaagaatgaatcatgtgctctgaatggcactaaagtaaccacaaccaccaaatcaaatggatttaaaaaacacctgtaggtatgatgatgatatctcagaagtagactatgaatacagtggtaaatatttcaggttggaaactccaagatccaaatgtagctggcaacaggttactttagggttcttagtaaacagatatctcagttgtgcattctgggctttcaacccagcaactactggcacgggacatttgccacctaggaaggtggggagggagaggaaaaaagctgggctttaagtgttgacattatgttgactgggtaaggatgtcctgcaacaaactactctatgaggggatagcaaggccacaaaacggatctgattgttgaacttaagcaactctagcaagacgggctctcagcaaaattttcaagttgttcaggtttaatagtcccagggacaataaatagtagggggattacacagtgagttcagtattagggaactgctcaaatttgagcctttggtggtttgtcctggcctcagacaaccatcttgagacttgacctatgcacttcaaattctttgcctagtatgttgctataattaaacacagctggagcagtggggtatggtgatattctttggctgtgtctgtactcagatctcatcttgaattgtagttcccataatccccatgtgtcatgggagggaccaggtggagataattgaatcatggggatggtttcccccatcctgttctcatgatagtgagtgagttctcaggagatctgatggttttataaggggcttctccttttgctgggcactcattctctctcctgccaccctgtgaagaggtgccttcctccatgattgtaagtttcctgaagcatccccagccatgcagaactgtgagtcaattaagcctcttttctttattaattacccagtcttgggtatttcttcatagcagcatgagaacagactaatacatatggcaatactgtctgttcattaggaagttagtgagcaggagagaagtaatgacagcagtaagcctagcagccagcagcttactgggagaaagagtgccaataatggaaccaagagcctggaagacttctgagagtctatataggcatccagactgaggtagaatagccaacaaagtaactttgcaaaaggcgtattagtggaggcaggatgggaacctttagaaattgtctgtgttgtatgaccactccttatggtgctgcccaacaagaatgtaatgaataaacctgcaagcctctggattctggctgctcacatggtagtgaatattattcccataagcaaatttgctgaagatgacagaacttgggggagccccacattttaacctagagatgtcttaccctaaagccagtttgccttttcatctacactacattgtctctagagggatgttggtgacctgaagacaacattttcttatgccacagttaaaaaaaaataaagatcctctattggatacaaagaaccttttataaggctagatggcagcttggaaaacacatagggctatctcgatcattcccaaagaacatataaagattccaagctgttcttcatcaggagttattttataattcctatacactctttagtttttacttcctggggaaaaaaagcaaaacagtgagcagagaaaatgaaaattgttagaattaattgcatatggactttccctaaaatgacataagaaaatgacaccatttgtctttgaatgagtgtgtgggcttatttgcccacccccaccactgttgtgtgaaagcgcagcagctcagttttcattttcctttcctctcaaaatgcccagagggaccatatttttgtttaatgaccttcagaatgattctttagaaatctgaggctatcagagttggaaacaatgcgaaaataattgtggattattattgtatgacggcagtggcagctgggctgtttctttttctctgtgttcagactttcttcttcattttcccagaaaccttatatcccaaggtttaactcagaagcaaatctcagataggtgataaaccttgccagacatggtatgtaatataatttcagacaggcccttaactgttcttcaggaagaccctagggagtgaagcagccttatatctacatgctctcaatagtattacttttatttactctctgacaatgtgtgtgggtagttgtattgaacataaagcaagcatatctcttaaatattatacttgtgaattaaagcaccagtttgtgtgttttgttgtcaaaattcctgctaacatgaaagaaaaaaaatgttatgaaaaaaatgggtactcgctgtctcagatcacttacacacacacacacgtacacacacatacacatgaacacaaacacacaagcactcacagctggggattgagagtcagcacagattctaactttacatgaatgtttaagatatgcgtatggaggcaggggtgaggagtggtagatgcagatgttgtatacaccatagtggggaaagtaaaaagtgctctcaactattgttcacatcatctacctcaaaatcaatttatttattgccttaactgacagaatttacatgataaaatactttttttttttttgagacagagtctcattcttgtcacccagaatagagtgcagtggcgtgatctcggctcactgcaaactctgcctcctggattcaagagattcttctgcctcagcctctcaagtagctgggattacaggcacatgacaccacgcccagctaatttttgtatttttagtagagacagggttttaccatgttggccaggctggtctcaaactcctgacctcaagtgatccgcctgcctcagcctcccaaagtgctgggattacaggcgtgagccaccgtgcctggcaataaaatattttttgccttgaatattcagcactccctaacagctatcccctacgccttgactgatgtttgtacagcattcggctaccactttggtagaacatttgaggcgaatgatagccagaatggggcaatatctaataagtagtctgaaaaaaaattcctaaaagacaaagataattgcctgaatattcttacatacttggatattgttatatccttgtcactttctggaaaagtattaaacattcctttctagagaagtccaatcttggtagcaagattccctcacattcctatcaggagagtaagataattggcttcaaaacccaaaacttgttctgtggttatatatcactgaactcagaaagtaagtggatgatttctccaggctgttactataacaaagcgtgtcctcattttacctagctatgtttctagagaagtccttaattttttatattccttccctctctacccccacatggatttcttgattacaagaagggagattctggagtactagtattagtttttataataaggagtaattaatgaaacaattgtaaacttcattgccaatataaaatcctattatgaaagattaataatgcctaagactcccctggagtatactaagtggctaagtgaaccatgtcctcttaggactcttaggaaatatccttgtcaaatagaaggaaccaggacattataataatatttagtgactgttaaggttctgctatacctctcttgtaattggggagcctctatgctattctatttatttttttcagaatgcctctaaagacttcttgctcttggggtcaggcctttgaagtggtttgtagtgcagtagttgtgatattagaattggatacaataggacacatttgtgatttttcttggtcattgacttaactccttagttacatattttgaaaacgaaagagaataatacaaaaaagtaaaagtactaacttgctggtactgagatgtagtctgtgaaattctattttttgcttacttgcaaatattttatctgcaggaatgcaagccaaaaatgtggagaagcataataatacagaaaggaaatgctcttctgatccaagaagttcaagaagaagatggaggaaattacacatgtgaacttaaatatgaaggaaaacttgtaagacgaacaactgaattgaaagttacaggtaggaatcagttctacaaaattacggcaaatgagattttaagtataatttggtttgggaagcaagagttttgttcaaagagtcaactttctgtgaatttagaattgcctgcaaatcaaatagttgagaaacttgctattaataagttgtactgagtaaaagcaatatatggaatatgaaaaaagagtttagagaacaagggcctagttgctgtgtgtctgttctctgtctttatgaaaggttctgaactcttcaaggtatcattattactaaacatctcagaaaatatatagtggagccaatctagaatgttgacttaacccatttgtggaatctccttgtaggtgaaggctgattttagaatgagaatctgttagatttttggaatgaaatcttcttagactgcatccaaaatatcatttatacaaaattctccataagtgagtgatgttattgtgagcttctagtgattcttagagcaactccaaatgaagaacatgcatgtgtgttttaaatctgaagtacaaacaaaatgtaaactagtggaaggataaactcagaatattcttacttgttagagaattttaggaagtaattttcagagacataagacagaatctaataccaaaaagatatcccttacaatgaatgtgatggaacctgagaaactgtatgacaaaaaaatctacttactattgctcacaaacaaatcttgactaattttcctattattatatctgtcatgtgtattttaatctcatatatggaacctaaaaaaaagttgaatgtgttgcaaaagagagtagaaaaatggatacgggacagagagtggggaataaggagtgtaggtcaaaaggtgcatacaaagttgcagttatataggatgaataagtctagtgatttaatgtacagcatgtagttaataatgttgtatgctgaggccagcgcagtggttcatgcctgtaatcaatcccagcactttgggaggccaaggcaggtggatcacttgaggtcaggagtttgagaccagcctgaccaacatggggaaaccctgtctctactaaaaaaaaaaaaaaaattagccaggcgtggtggcatgtgccgataatcccagctactagggaggctgagacaggagagttgcttgacacaggaggcagagtttgcagtgagctgaaatcacgccacttcactccagcctaggcaacagagcaagactctgtctcaaaaatgaaaaataaatataatattgcatgttgaaaatttgctaagagataaattttaggtgctcttaccacaaaaataaacatatgaggagattgatatgctaatttgtttggactgtggtaatcagtttgctatgtatatgtataaacaaaaaacatcttgttgtataaccttaaatataaacaattaaaaaagtatgtgtgtgtgtgtttgtatgtatacacatacatatttctattgtggataatatccaagccatgataaacttcaaaattacctagacaattgcaatattgattgcattaattgacttatgattaatgtacttgggcattacttgtttaaccatctaatgccaacatcagccagttggttaatttataacatactctttctaatgttagcaatacattttttcttctattttatttttgtttaaaaaggttcaaaaaggtctggatgacctttttgagatagtgttaaaatcagtcaactaattaatacttgctgagttaagttgattgctacaacccatatatttaatttggtttttgatccttgagattcattgtttttgtctttttcaaaattctaaatgttagcacagggaacacaaaatatatatttttaataaactaatatataatatacatatatattacttcactctctgtactaataaatgatagttttacttcttagtttgattttgtagagtgccttctatgaaagtttaaaaattcttttgattagaattgcatgttcttttccctatgagctttcaaaataactaccatattgggccaattccaaatagcaaagatctgcttttgattagtttctgatttcttcaacatgaactagacttccctgcctcatttatggcagaaaattcaatcatgggcagttgtacattattaataagtgacctgaccatgcacaaagcgtcgcagcatcatcactttggccacagtcactaatccttatgagaggcttgcagagcacttccattttggatcatttgctgaatcttgtaacattatagtatttggcttgagtttcaagttgaaccagaataaagtaaatacgaaacctccttttcactcacatcaaatgggttctgttgacaacgcatttgcttctttcatttcattttagattctggaaaagagagctagagctacttattttgtatattttataagatgttagtttacttgttttaactacagatctaaaatttcacttgaatacctcgcagaggatctcaaaatttaatgtgcatcagaatcatgtaaagggacccagataggatgaagatgaagatctctaaatacagatcctcagatttctcccttagattctaatttagtacatcagtaagactaggaatttacctttttgtccaggtgattctgttttatgctttccaaggatcatgtttttgagagacactagagaagagaatggtgctaacaagtcaaagtcataggtttgattattttgtgagtatgttagttcacacatgcacacacacacactgatttttataggccccaatttgtttcctttaaatttctaggaactgccatgaaaatagagatcatggtaaccaaggaaaatgtgtcaaggtagtgtgtgggtaaaagcgacttcaactagggaaagcaatcatttattcacttaccacttaaataaatatttactgagtacatgttacatgccaggcaacaagctaggagctggaaaagataattcagaatttgtttatgattatccttgggtcagtggtcgtcattcatataagaaagtatcatatttgtgtatttattcacacagttcaaatgttatgcttgatgtagaaacaaaatggctacttggtatggaagttcaagagtttgctctgtgaaggtttattcttttttggaacattatataacttataccatgctttgtatgctcaataatatgaaaacaattaacaagcagattgtcttctcataattcaaaatataaggctaggattatttaaagagtaaccactcatacttgttttgggtttagcatgggataagaatttcaatatgacatgaatagaggtggttaattacaaaattatgtaaatagaggttctttaaatggtgtatttcccttatgcaaattttgaaagattgtcaaatttctaaagcttattttctgactattctttttaaatttatgattctgagaaatataacttcagtaaaacaagtgtttcttaaaggtacataggtgctatttgctttaagaaggtcaaatataaaaagatccagatattcaaaactgataaactagaaggttatcatttgctttaatgaaataatttctccatatatgtcatagtatttctttagatagttagctttctttctgcattaaaacaggatttgatttaaatgcaacttttctggaacacttttattatataaatcgtagcagacttttgttatattattgtggaaatttctttttattccttcaaaggctgcagatgcatagggaagggtttaacaacaaatagacgtgcacagtagcatgtttaggtcatttgctaatgatgcctacagcgacagttttatttcccacagcatattttaggtgactatatgctattttaaagtttttttctttattctcatgttgaatttgtgcggagggttaattgaagtgaaaaagtaagacaggagagttggttataagaaggtgagaactgtagtacaggtgataatggaaaaagaagaggagtaggagagagtgagcaacataatgggatagagtctctagggataagaagagaaagtctgccttaagaaggtcaaaggcagtatggccattttcacgatattgattcttcctacccatgagcatggaatgttcttccatttgtttgtatcctcttttatttcctcgagcagtggtttgtagttctccttgaagaggtccttcacatcccttgtaagttggattcctaggtattttattccctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggatgaaattggaaatcatcattctcagtaaactatcgcaagaacaaaaaaccaaacaccgcatattctcactcataggtgggaattgaacaatgagatcacatggacacaggaaggggaatatcacactctggggactgtggtggggtggggggaggggggactgatagcattgggagatatacctaatgctagatgacgagttagtgggtgcagcgcaccagcatggcacatgtatacatatgtaactaacctgcacaatgtgcacatgtaccctaaaacttaaagtataataaaaaaaaaagaaggtcaaaggcagacattacttatagggattcttcaaaatggacacaagaaggaagccagaactaattatctttatttggaaggcaattcaccattcacctggcaaatcattcagaaatacatgcttttatgcagctttttagacatgagcattagctacttagaagaaaccactaacctgtttcctggtgaatatgcaaacaacacctctcctcctgattattgtagacagctctagagtccctggttggagacttttcacacattaggggtaatctcttaacccattggcatttgaatatgatggcaagaaggatttattccttgaaaatacttcaaagatttgctgctagattactattcagcaatagtagcaaagcaatctggatataaagcttggggtaaaactaccaagtaggatttgggatcagtctttggtgaatatgttcaaacgcatggctttagcaaatgcttttaattccactttgcaaagtttaattgtagtgccttgttgcaggtgtcatttagattacatagcttgttagaaaaactttcctctggtgtggaaaatggcagctatttacacacagaggaagcaatttcacattcaggctggaaaacacactttttgtggtcctggctcttagtttatttatccttctactgttaatgctgagattttgcaggggagggtgagtttagaaaaaaacagtggaacatagcaatatggtggagagttggtgaaataaatagtagcggggattttgactgaataaagataatataacagatgtaatctctaagccagcaactccataataatcataaaaagggctcccagagagcttttatctattgagagctcactgtgcaacatacattgcgtttagagattttcattcattttctcatttagtcctcacaaccaacatatgagggtggtgttggggctcagaaaacaatacttcaaaatgaaggactcataagcaagtttgtctttgaccttttcctgccctcctgtctctcagtcccattctccccaccctccccggaggctagccatagaaactggaatccctcttccccaaagcaggtcatagaaaccagaacccctttcctgcaaagccagccataaaacctaaaaatattactctaactttctctccacttctctgtgtgaaaactggccacaaagaagttatttgacctaccttgtttaactataggtcataaggtccccattccagagagggtcctggaaggaatgtgtgctcagagaagcccagaagaatctagacagacaggccttgctggttttccccactcagctcattagcattagatcatagtctttttatcaaatcatatgcctacatggctgtccattctttgctgaacctaagcataaaaatgggcaattttccctgtatctttgggtcttcattctgaaggctcctgtgtatacagtgtatacatgttagataaatgtatatgcttttctccaattattctgcttttgtgagttgatttttcagcaaatcttcagagggccaaggggaattttctgcctgggcccctatggtggttactattattgtcccaatttatagagaaataaactaaaacttaggtgaaatgatgtacccaaagtcacatactcaggaaatggcagaacacagatataaacctaggtctttccaattctcagatgtagctttttaatcaccaccaggcaaaaaactgcatgatttcactcaccaaatgtgtattgcatacctagagaacataaaccaaaatattggacacgatgtctatcattccactataatatcctttttggacattcacaatttggtcttcaataattccctattagaatttagatatccataaaaaaagcacacttggcattttgaacttagtccttagctcttagcactttagttaagatcgttaggagtagggccaataattgaatctgcatgtggtatggtgccaggaaaaaagcaaggaaaagtgaggctccagaaaaattaagaatgcatgaaacatggtaaattgttactgaattttgtgttttgatgccatatggccctactagtatgataatttatattgagaatattccaatgatgttcattgcagttatgactatgatttcaagctagtggaagtgaagcaatggatgaatgtctagttaaacaatgttggctcagttggtaaagatcaatcaacacataaatcagtgcctactgtgtacagtaagaagttcaggatccaagtttgtaatgttgttctgaaagcagacaggtagggacagaagtgtgttctcctttggaacctgtgaaaagagagttattcactagaatagtgcttctcaaattgtattttgtggaaccctgattctaagaaatgttaagagagagatttccaagagagaaagaagaggaaaggagaggagaggaagaaaggagaggaagagagaagagtggggaagggagaagagagtttctgtagttatttgtgtatctgccaggtcaaagttaaacagtcatcttttttgcagggtatctcagggcaccttagtgcccataatatctaatgtgtactctaattttctaaaagggggttggagcccaggtgtggtggctcatgccagtaatcctagaactttgagaggctgaggtgggtggattgcttgaggtcaggagttcaagactagcctgaccaacatgatgaaaccccatctctactaaaaatacaaaaattagctggctgtggtggtgtgcacctgtagtcccagctacttgggaggcagaggcaagagaaaaacttgaactcgggaggtggaggttacagggaactgagatcaggccactgcactctagcctgggttacagagtgagactccatctcaaaaaaaaaaagcggtgggggaatgggatatatttttaggacatttcctaaacttgtatgaacacataatattcccagcccccaaagcatctgaggatgttaagtttccacagaacaaactttaggaaagctaagtgaataattgagtgagtatctggctctattggcctcctgctaatgcctataacatcaacagttgaaataaaatacttatttggcatttaggttatgattagtatcacttattttttccattgtttattttttcaaccatcctgtaagctccttaagggaatggatttgttgactaattaatatctacatctataagtgctgagtatatgataggtattcaaaaattatttgtagcttgctttggctgagtgcttatttgattggtaagtgttttgattgggtacaaataagacaactttgtgtttgtagagcatcttataatttcaaagcactttcacttctgggatctcattctgttacaagaactttatggaattgtcagcaaatgtagtattattattattaatcttggctgagagagtttaaaacaatgaccctaggatataagctggtgaattgcacagctaggactagaatccccatcttataagtcctagttacacttttcctactctgccccactgttactctgtttgctgtcccttaatcctgggtactaggccagaagaagagatgcaactcaaggaggattccaaagttggtgactccagagctcaggcctaagaatctctgaaataaccttttatttaaaatgttggtataccaatccattgttttgtcttttggaataactatttctgattctaaaaggaaaacgatttactactgatgtctgaaaccaaatcagcagaggtagccgctaacaatactcaaatgcggccaggcacggtggctcacgcctgtaatcccaccactttgggagaccgggatgggcggatcacctgaggttgggagtttgagaccagcctgaccaacatggagaaaccccatctctactaagaaaaatataaaattagccaggcgtggtggcgaatgcctgtggtcccagctacttgggaggctgaggcaggagaattgcttgaacctgggagttggaggttgtggtgagccgagattgtgccattgcactccagcctgggcaacaagagagtaactccaactcaaacaaaacaaaacaaaaataatactcaaatgcttccagcagccaggcaggtcatgtccacagtgtgaggtggaccaggtgtgtgaagcaacaactgaaggaaaaattggagagtactagctgtactgactcaaccctagctgattgctgccatgtgagattgagaatccaatattactaggccctctgatttataagagacacctgaagtctggatttttgtgtggaaatccgtaaattgtaaagcactctgtagaccaaataaaacagcctgtatgctaaattcaacatggggactgcatgtttgtggcttttgcctttgaagatttggttcagtaggacttttattaaacaagcgactgactgtgtgactgactcagactctgttccactatttccatctctagcagtgagtggaaaaaaatttaaagaaagaaaacctgaagtggcctggagagcagttaaaagacaaactgggaacagcattcagaagccatcctaatcacaccatccagtagactagtcgatccaacaagagtgaaaggggcacaatttatggatgtaatactatgggacgggtattgacaaatggatcaccttagaaaagtgagtgatttagatgatgaagcaagttggtgtccagtattacagataaaggaagagccctggggatgaagcacccgccttaaagctgccctgaagcggtgtgatgtgaagcactgaagggaacaaatcattggcatatgttctctctcctccatgttcactatgagcaggcagttaacatgatctgaatgtacgtgtcctgattatcacatgaacatgtacctcatttgtaccttttgtgtgacctaataaggaacaaccacagcagtcaatagttcttggatgcattaagggaacattcacatgactgactgtgcatttcataattgactgttcttttgcacagtgcagaaatctcatgaccagcttgcagcagtttctttgtctttcctcctaggctttattctccttttctggatgaccctggcctttcctagcctacccagcccaccctggatgacatctttgtctcttatctgcctcttttaaatgtttcaatgacctgttttctctgcagctcatctcctcagatccttgctttctcctggggttaatctaatgtctcaatgagctaaaaaattcatgactgataaagaccaaaaatgcttctcttctcagctaacatatttgcaatttaatagatatttcaattctgtaactcataggcataactaatggtgggaatttctggggactttgcagggcctgtggggggcatttcccagagtgtcacaatctaccctgcaggtggctgcttgttccttctagaaacaaggtcaacaatattcatgaccttggggaactagaagaaaaaaaatcctactgaggatcactgaaaaaaaaagggccttggatgtcagtccatagagtgacttttttccttcttctgcatttttattttgtctctcctttctttcccttatttccttcattctgcctcaacctatgacacagggctatctattaaccctattgatgacaaccatggagagattgccagtctttgtcccaggaaagtttttgtatcatgtttctatgccctacagggagatgaacaaatactattaactttcccataagaagaaagacagtcttatttttctgtagagtcaggggctgtgagagcattcattcctgtgggcttattttgcaagcaactgtgcaggagaccagtttggatagctggggttgaacaagttagagcacatgacagcagtatatggcaaacgtgtgcaatccaggccagttctactccaatggctctcgtccatcacctaaggtgaccattgactccttggctgccttctctgacaccaagttagtgctgggggaagggattcttaggaaggggttacactgtgactcctagctatgtagtttcctgagatccatgggagcagattttcctaggtccattatgtatattcttgggagtctcagttaccttgttctctcccagcctgaaagcagtggtttgagcaagctgagaatattctatcaaggcacccttccataggaatgaaaactaggagcttggtacagagggagaccagccatgaactagatccaatagagtagagcagatgctcagagaactatcatttattaggtcaaggattatactttataatcagtcaaagcttctcacaacctcaaaaggctggtgattatttcctatattttataagggaagaaatgaacagtcagagaagctaagttacttgttatgatcacacaccatagtaagtgatggagctaggatttgaatccacgtttatttcaaaacattactcttaaagcaccctgttacaaattacctgaatgggtcctgctcaatacatgtcactagttctattccttcctgcttgcctgcctgcttcatgctttttccactcctctttgctactacatgttttacatttccgtaatttcctcgtgaagccatcacagactaacctcatcttataatcgcctattttttctcctgaattccctcaataattttgcaaaagttttcaccacattgcctgatactaatttatagtaataatttatgagagatcttctttgtgtagatcttgtagcaccaattacattagggctcttcaagatctgctgctccctatacaaagctttgccttactatttagatacaacataaaattatggaactaggagctaggctctgtgtttcataaatatcatctcatttgatcagctcagaatcctgtaaggtatgtcattttagccctgctttatagatgtggaaattgaaatttggggaatttaagtaatttttttctcaatgttctacagcaactaaatgataatggtggaataaagcctcaggtggttgtttttccaaagcctgagcccctcccactagtaaatgcttataaaattatctgctgcacacattactatgatatggtttgactggaacaatttttttattattttttgtttgtttgttttgttttgtttgagatggagtgtcgctctgtcaccaggctggagtgcagtggtgcgatctcggctcactgcaacctccgcctcctgggttcaaaaaactctcctgcctcagcctcccgagtagctgggactacaggcgtgcaccaccatgcccagctaatttttgtatttttagtaaagatggggtttcaccatgttgaccaggatggtctcgatctcttgacctcctgatcctcccgccttggcctcccaaagtgctgggattacaggcgtgagccaccacgcctggcccatcttagttatttcttgtcttttgccatgctcatggataggaagaatcaatatcatgaaaatggccatactgcccgaagtaatttatagattcaaggctattcccatcaagctaccactgactttcttcaaggaattggaaaaaaactaatttaaacttcatgtggaaccaaaaaagagcctgcatagccaagacaatcctgggtgagaagaacaaagctggaggcatcatgctacctgacttcaaactctactacaaggctacagtaacaaaaacagcatggtactggtgccaaaacagatatatagaccaatggaacagaacggtggcctcagaaataacaccacacatctacaatcatctgatcattgacaaacctgatgcaaacaagcaatggggaaaagattccctatttaataaatggtgttgggaaaactgcctagccacatgcagaaaactgaaactggactccttccttacaccttatacaaaaatcaactcaagatggatcaaagacttaaatgtaagacctaggaccataaaagtcctagaagcaaacatgggcaataccattcaggacatagacatgggcaaagacttcatgtctaaaacaccaaaagcaattgcaacaaaagccaaaatagacaaatggaatctaattaaactaaagagcttctgcacagcaaaagaagctatcatcagagtgaacaggcaacctacggaatgggagaaaatttttgcaatctatccatctgacaaagggctaatatccagaatctacaaataacttaaacaaatttacaagaaaaaaaaaacgcatcaaaaagttggcaaaggatatgaacagacacttctcaaaagaagacacttatgcagccaacagacatatgaagaaatgttcatcgtcactggtcattagagaaatgcaaatcaaaaccacaatgagataccatctcacaccagttagaatggtgatcattaaaaagtcaggaaacaacagatgctggagaggatgcagagaaataggaatgcttttacactcttggtgggagtgtaaattagttcaaccattgtggaagacagtgtggtgattctgcaaggatctagaactagaaataccatttgacccagccatcccattactgggtatatacccaaaggattataaatcattctactataaaggcacatgcgcccatgtttattgcagcactcttcacaatagcaaatacttggaactaacccaaatgtccagcaatgatagactggataaagaaaatgtggcacatgtacaccatggaatactgtgcagccataaaaaaggatgagttcatgtcctttgcagggacatggatgaagctggaaaccatcattctcagcaaattatcacaagaatagaaaaccaaacaccgcatgttctcactcataagtgggagttgaacaatgagaacacatggacatagggaggggaacatcacacaccggggacttttggggagtaggggtctaggggagggatagcattaggagaaatacctaatgtaggtaacgggttgatgggtgtggcaaaccaccatgccaggtgtatacctatgtaacaaaactgcccgttctgcacatgtaccccagaacttaaagtataatcataaaaaaatacttagtatgatgattgagaaatagtaggtacttaatacatcatattaattgcagtcatgcatgcataatgatatttttgtcaatgatggactgtatataaaacggtggtcccataagattataatactgtatttttactgtaccttttctatgtttagttatatttagatacacaaatccttaccattgtgttacaattgtctgtagtattcagtacactaacatgctgtacaggtttgtagcctaggagcaataggctatatcatatagcctaagtgtgtaggaggctataccatctaggtttggtaaggacaatctatgatacttataccatgatgaaatcacctaatgacacatttctcaaaatgtattcccattgttaagcaattcatgactatattataattagtattattatcatcatcattattattacaggaaagttttcaaaggtgagttcatggccatttcatgacaagaaagcagtctgacaaatggtctaagacaaattgctgttgttaatagggtgcttcatttacagagcttgaatggaaaaaaaatagaaagttaactagggggctattaaaaagcaaagagccatataaataggtattaatatttcaggcagaaatattttattcaaggagatgcaatcatgtggaataatttgtcaattaaggtggtcagggcaagtattgttgtctgtataaatgagtttttgcagccagcaagaattttaagggatgtatgagccaagagcaaaagctgctaagacaaagctgaggtggaaatgagtccggaggacaagcatgttgaggaaactggacttttcctgtctagcatttccttatgtcattatgattaatccctggtggtttataaaggcagttaaatggcctcctttggcatcaaataggaaaataattcatcagttcaagtctgtaaatcatttcttggtactggaagtactttatatagttagaaatgtctccatgatttgtcactgggctccagtggggatcctgaagagcaactggcaaccaccagatgcagaggcctatgtgatgagtctcatgggcatgggtctgcagggaaagaagattggttcctttctggggtacattgccttgatcctctctgactggcctggaggaataaccacttctgtgtctgtcatatagtagtcacttagtatgtttgttgaatgaatgaatttacatattttgtgtgttttgagtcctttgcattggagctcatcttacagtgtctgataactctctctagctatattctgggaaaatgagatagaagggcagtaataatgatgttttgaagctactgggtcagtaccctagttatttgcttaatgttgatggtcaagacatcatagtctcaccataaactgtagcataatagttgaatgaaaaataattgtgctgtaattttttatgataaaaggcattttaaatcacagtttaattacccaatcccccttgctcttaaaatcaacattttttgattttgttatccttacattttgtgctagtaaaattatcttcatgatgctatttaatttacctcctggcgagcatatgaggtgaaaggtaaaaaggacattttgggacaagtgaaaaaatatctaatgaagtggaaaccgttattcaccctcactccacatgtaatacatttgatattcttttaacattcatcaaatactcattgttctgggtaaatagataaactaaaaaaggtatgatgtctgtcctgagtgagcttgaagtataatgagaggggggagaatagacagagattaagtgaataaacatatggatacatgtataattatatattgcaatatatcattataaggaaaataacaaagactaattgagattggggatggcctacttgaacaaaataaagttgaggctggaccctgatggttaagaaaaagccatctagatgaagagcgggtgaaaaatattttagagggaacagcatgtgtcagctataaaagaaagatgatggtggcttgggtcagaagggtagtaatagaggtagtaaaaagtagacagatttaagagatattatagagatagaatgactatacttcctcatgatgattcctgggtttttggttttactaatagggtagacagtagtgctatttcctgaaatgaggaagactgagggaggtcagattttgtgaggggttacaaaagttctgttttggccatgttttagaaatacttattatatactctagaggggatgtagagtagacagttaaatatatgaatctggcattcagggaaaagtttgaactagatatataaaatttggagctgtctgtatggtatataggatgagctgcaataaagtactaaattgtgtggggcaattgatgattactataggagatcaatgcaaactgcagctcctaggccctatgttacatattttctccagaattgtgaacagtataagaaagctacttgtcatgattttttgaaacctcatcaaattgttaaatattaagcatgataattgtacctatattttttctgctatatggggatgatatcttgtatttagctgacatttgaatccttcagagctagaagaatataactaatgccacactaaatacagtcactatttatgatatgtgctgggtgccatattaatcattttacacacattattgctaatctttaccacagtactgaatagtacaggccccaatttatagataaaggaactcaaacttgagaagttacacaacttgcccaaggcaacaaagcaagttttggggggtcttttccccattccatttccacacattaggaaaagtgactctacatttccttttggattcttccaatttccaaagtctcttacaacccaaggaacagaaagaaatattgagatatgcacatttgctgctagatttccttgctattgaataaaagcctgtctgtaagtgtctggtgcacatgcacagcctgctgttgggatacccatcacttgttaactgcctgcctggactagcaactgtcttcaaaccctctgtataccatactgaattcttagttggaggtctgccaccaacaggagggcaactccctgtgtgtggtacaatgaagggagaataaagcctggtacatagttggctctcaataaatgatagctaatattattataattttctttatcttatgcaatgacgacttctcaaagtccctatgaaatatgtattattatcttactggtgaggaaatcaagactcagcaaggttaagtaacttgcccgggtcacacagctaatgaggaactgagttgggatttgaaggccactctctgattctgaaacttaagattcatgcatttctcaagtttaatgactgagtgaagccaggggtgtcattggagaatatcaagagataacgttagatagagaaagtaggtctaattactggagggccttgaatgtcaggaagaataattcatatacttagcctatttgggtatatgtgccacaaaagagctatgatttttcctcactgataaagaagttcgagtttttggacatcaggtacctgtttccaagctgaatgccctaacagctgtgagtaacacctgctccttgcacctgtgcaaactcagagacttaccttctctggtgctgattcgcataacattctttctcctattttctcattttaactcaactcaatgaagatcttctgagtatcttttctctgccaaggcactatgctagttgctgcttcactggttgttgggagcatgcagttaaatgtaatcacaccaactggcctgtataggtttgtgaggtggaaaagtctaggaagaaagatacttgagaaatagccaatgtctttttttggagcccctgcaagagaaagcataagtttatcctgtcctattaaccaaataatctctaatgattggagatgtctttttaaattaattaattaatttctacttgctgggaattctagctacacagacttttgatttagccagtaatattttcaaactataagtagcttaaaatgtggattagaactagaagggactttgaatagcatacagtctgattcccctcattctgtagatgaggtagcagaagcctggagagattaatttatgtgcccccaaagacacagcttggcagtaactaagttgatactttctccaatacaatggtgctttctgccactttctaatactccacagtgtctttctgacttagtcctgagccttgcctaggaggcttttttatgccaaatttaatcaatgttccattttaattgaaatatttaagtcagattaatgtaaagccttcagagagttctgctaatctggtttataaaagtcactcaggcaaaactgtgaaagtatataggatttctgacattttccagaagccattagcttatgttcttcaataactcttagaatatatgtcaaaggaggacaattttccaactaaccttggcacactccatatgtattcctttttggttggttcataaatcagttttctaattcaaagatgttttaatcctcaaaacatgcactcttccttaatgattgtatgcattacaatattaccccacaaactagtttatgaatattaaagtttattagtagggagataccaggaagcagaactgagaaaataactccagcagtctcccttgcttgaaaggaaatacgatggaatgaaaagggcacaggctttaaagtcagaaagacatggtttcaaattcttttcttaccatttaccccctggatgaccttggggagattattgaacccctttgagcctctacttcctcatctgtttgtatatctttgcttacagagctgttgggagaatttgagatgacagagtagatgatagctatttccactttgctattgtcattatgactgttatttactgttcctactactagtactattagaactactgctactactaccaccattaatctgctttgcagcctcaaaaaaaaaaaaacgaagatgctttatactactactatcaccattaatctactttgtatcctgcaaaaaaaatgagaatcagctgaagagcagaaaaaacttaagacagagtaagacaacgatagaacaaaacagccttttttttttttaaaaaaacaacttctattaacacattgccagccagaaagttcaaacaacctactgaataaagatagtaccttagtcaagttatggaaaatatatttttacaaatgaaattgttaagataataaccctttcattaaaccactctgtatattccatcaggacaggaatcatatctattttgcccttttgtattcctatcactttagtaaggtcttgacatagagttggagatgaaagaatatttgttgaatgaacaaataaaatccctaaaggtaaaaataagtattattcagctgctattgtttcttcattagtgtattcattaacctattgaaaaatatctgtgctcctattatatgataagcgttgtgctaagccctgggaatgaagtggtaaagaaaatcacgcacagttcttgtctttaagagcttaaaatctagtggagaaaacagcccttaaaccatcacacaaataagtatgaagttttaattgtgaaattgctatggcggaaagaaatgcatggactaaaataacatgtgttaggggaatttgacctaatcagtgagatcaggaaaggcttcttggaggaagtaaatcttaagcagagatataaagagtaagtgagcattaactaggaaagacagggaaggagaggcttttgggacaaaagggtcagcatgtgcaagcgtgccctgtagagggatcatggtgaataccaggagctaaaataaggccaactacagctggctggagtgaagtgaggaagcaagaaactagaataagcttaggctagaggggtaggtaagggacagacagtgcagagcctttgccacattcaagattttctcttcatcttaacagtaagaggaagacataaaagtgattttaaggaagggtgtgggtgtgacatcatcaaatagtttcagtgtggagaatgaattgaagagaagcctgaatagttatgcttgcactagtccaggctagaggtgatagtaacttggactagggtggaagttgtgactatagagaaaagtagatgcattttagggctagttagaaggtaaaatcaacaagacttggtgatggcttagatgtggagtatcagataaatagatgagtgtctcttaagtgatgattaggtttcttgcttgtctaattggaaggattgtggtaccttttagtgacaggtccgggtatgacaaggttcattcaatcacaaatctttatatgtgctactatgtatcaggcaccatgttaggtgttagaaattcaggaatttctaaattatggttcttatctacaagaagcccacagtctagtagggaagggagtacagaaaatcaacaagtagttacagtgcaacaatgagctagcttgatagaggaatgccaagagtgctatggaagcccagaggaggagaatcacctagcaaatgggcagagttgcagaactgtggggaaagccaaaaaagtggagttgggttattttggacttggtatgcaataatttgtcagacctgttcactagacattaaattttgaaagagaaagagtccttttttttccttcctcatctcctgcttagtgtaataagcaacctggttgtatattccatggctgagagtggagacaattcctgatgtcactggctgatttcaaaatctttgcagaactattcatatgttcctcttcctttacaagatataataggcttcagaaaagtggtgtgtaaatcatattggggtaaattaaatcctactttaaatgaactgagtcatttgctatctacttttgaaaaaaaaaaacagcattctctaattttttcacatatatttccatttaattcttcaagtttctttaaggcaataagggatccagtttcagctttctgcatatggctagccagttttctttaaggcagtgcccatttttttattgttttatttatataacttctaaatatattttacacatactttattttaaatcaactttattgaggtataatttacattcaataaaaatgtacccattaatgagttttgatgtataatatgtaccctaaaaatatgtgtagccctaaaaagttgcagtaaatctccttcaccccagtcccaggcaaccacctatctgctttttgacattaaatttgtcttggtggggctcacatttaatggcctccagtgaatattgtcgtgagcacatattaggggaaagccactttcttttatttcaattagaattcttatatcccaaccttaatgctataaagaaaatactgatcttatcatgcttgttttagtatgctttttggggttgttttggtggtggtttcacagagagaattcttgaaaagataatctgtgggggctacaaaattatgggccttgatttacaggcagtcagtcatttcctcactaactacgttaccattatgtattgatactctcttttttttgttaaaactgtcaatttttttaactttcgtaagtcagtgatagtatataggaatgggctcaggatttgccatgtagaccagagttcagactttaaggaacaaccaggaggctggagtggttggggcagagagagtagtggagagaaaattaggagatgaggtcagaaagatggtgatggtgggggatcagatcatgtagggctatgcaggccattgtaaagagtttggctttcactcttagatggaaagccattgaagggttttgaacagaggcttggcatggccaggtttattttacaaggagaactctggatattggatagaacatagactgaagggggcaaggactggagcagggagagcaatcaggaggctattgctatagtccagagggaagatgattatggcttaaaccagggtttagcagtgaaaggaattaaaagttgtagagttccagttatattttgaagatagaaccaacaagttttctgatatattgaacatggggtactagaataagtaataagtcacaggcaaatccagattttttggcctgtataactagaagtgtagagttgttgattaatgagatggggaagatggaatcaggagtttggttttggacatttgagatgcctcttagacatctaagtagaaatgttggatgggcagttggatatgtgagttcaagggagaagtctaccatggagaaataaatatgggagcgaacagcatgtaagttgtaagcaaatctatgatatcactgaagaatgtagatagaataggttcaagctctgagctgtgggtacatgccagcattagaggctggggagataagagagaaacagtaaggaagattgaggaggagtattcaatcaggcaaaggggaaaactaataggaagtaagtaaagatagtgctctcaagaggatgggagtgaaggactgtgttgaagctgttgattggtcatgttatttagaaacgtggtagttgctaattgacaggatcttgatctgacaggatccaatctgggttcctttcattatactgcattccttgttcaggttcttgtccttaagagtatctcttcactcctttacatagaatttactaacagcctgttgtgtgccaggcattgtcctagacactaaaacccaaagataaataagatatggtctctgcctttaggggatccatggtctagtagagagatgagatgcattaacaatgataatacagcatgtatagtgctatagtagagacacatacaaaatattatgggaacccagaactcatcttgggtgtaggtaggaggtggtgggagaaggcttttcaaaggagatgactggacagggatttcagtaatgagtaaaggtccactaaacaaaagtgcaacttatccagaaatactcacagagctgaaacatctgaacattatcttgaaaggtggattgtaatttatcaagtggacaagttgaagaaggactagagagaaagtcaagggccagataataattcagggtcttctgtattggaggagttgatggtgacaaattgggaagggggaagagaaaagaaggagtgaagcaaataacttctttattttctgcttggatgattgtgttggtagttatgctaaagtctcctaggttatcaaagttacagtattgagtctttcagaaggagtacaggtctcttcctcaaatttgttttgagttgagtgtcctgacactagacaggtgattactaaataactaggtgcctcacttacacttgatggagatagattttcttttaagtgaaccaagttcatggaatttcacttttctaataggaacatttctcttttgctaaggcaaaaatgggtcaagtgctgagacacatggctctgaagggccatcaaatgagatccacagctgggcccttagcccctcataaaggccatttctgcctatttaaagcctcctctaggcttgatcaaaatcaaaaccatttcaaaatgtaataaattattacattttgtgctgaattgctacttctcaaaatctcttacatagaacaggatgtttgagaattgagtttgttggaagttttgtaaaacattttgtgctttgtaaaacagaaatgaaaatattacaggacagatatattagagatatatctttttaatgacaaaagtcttttgtactgtctttaaatacttgtttactgttaatcaactatttgagagaaagggaggggaagcaaaagtgaaatttcagtgtgaaatttgtgtttcacaatttgtctcagaaactaaattgtaatgttttttaagcaatcataatggatttgtggcatttatgaaatgatcacaaaagtcatcaggaatatgataaccaattctcaaagtttgttattttgttcagagttaagtttttttgttttgttaagaattattgatgaagtcacttagctttattaaggaagtgaaaagaaaatttatgtcagtctttatttgtttttgaatatgtaatacccacacccagtagaagatccaaacaataaaaatatgtacattgaaaaaatctcctttctgcctccaactccttacctagatataatcatttttttcagtttcatggatatccttccataaatattctgttggatgtaatagtgattctaaaagtgtagcccaaggactcctagggcctcaaagaccttttcatgggttctacaagttcaaagctattttcctaataatacagttgaccctcaaaaaacacaattttgaactgcacaggtccaggtacatatggatttttttcaaccaaacatgaatagaaaatacagtattagtggaatatgaaactcacttatatggagcaccaacttttctaataagctggttcctcagggctaactgtgggacttgaatatgtgtggattttggcatatgcagggcgagataggggacagtcctggaatgaattccctgcatatactgagggacaactgtactaatgaaattaataatgatattaatatatatgatgttttgatattgaggtatcataaaatgtatcaacatttagaacatccatataactcaatgaagtagtattttccagataaccaatgtatgttgttatgaaattatgcatgtataaaagatccattcaaagagcaatatgggtcagtggattttaatgtagcaaggtatacaaagttaattgatatgatttcacacttggtcttagccaaaaggccaagatgcaataattgatatgatttcagattccacacttcagctaatccttaagaaactgccacttgttgtgtttggtatagtatcgaagaagatcatccacacttttttgaaaaggctgttaaaatacttccttattttccgactacttatctttgtgggactagattttcttcatatatttcaaataaaatgatatatcacaacaggttgaatgtagaatcagatatgataatttagttgtcttctgataagccaggcattaaacagattttcaaaaatataaaaacaataacactcttctcatggcctttttgcttttgcaaaatatagtttctgtgataaatatgttatgtaataaaatcatataattataattcattattttaagtaaattattaaatattttaaatccctcagttttaatttttaatatagtaaatacataacctatataaacaaaagcttcttagtattctctttaatttttaagagtgaaagcagtcctggccgggtgcagtggctcacacctgtaatcccagcactttgggaggccaaggcaggcggatcacaaggtcaggagttcaagaccagcctggccaatatggtgaaactccatctctactaaaaatacaaaaattatccgggcattgtggcaggcgcctgtagtcccagctactcgggagactgaggcaggagaatcgcttgaacccaggaggcggaggttgcagttgcagtaagccaagatcatgccactgcactccagcctaggcgacagagcacgactctgtccaaaaaaaaaaaaaaaaaaagagtgaaagcagtcctgagaccaaaatgttggccaactgctgatatattttaaaaagtgtacatttggttattttctctatcattctatttgtgtttatgtgtctatatttatttttatacacataggcagtgttcgtgcaactgtcctgtgacttggtttttgggatttaatattgtttgagcatcatttcatatcagtaatgatagatatttcacttttatgtgactgcatagtatcccatggtatacacatacagaattcctgaaaggagaattgctggatcaaaggttatatgctttttaaatttgataagactgccaatttgtcctacaatttatgctcccaccagcagtgactgagaatacccgtttccccaaatctttgtcagcagttttccctcaaatcttttgctgcttcctgagcatatagggaaaaaattatatctcattataggtttatttggtttatcttattatgattggtgttaagcatgttttcatataattcaatatggttatgttttacttttttgtaaaccatatgttttcacttctttaaagagaaccctcgcaccttggtacagataatctttcaatttctaaatataattctgaaaaaaaaataatgtgaaccttcaactttgaatggaatgaccttgagctaagtccctcaagctctaaggaccctttaagctgtgacattaagtctcaaaacaataacagatacatttgagctatacaagaagttagcttagcatgtttacaacatagtaattgaattgtttgtaatatgatttaactaaaagcagaaagttgagcaaaagcaatttgcaaacaatagatgataatgtaataagaaacatttatttctatatgtaaatgatgtgctgtttcctttacctgtcctttgtgaaaaacaatgaggaacgttatttctgtatctgtcaccatttcccacagttcagtggacaaagttcctcaagatcttccagtttccatttactagagctctgctttttttggagctgaggcaaggggaaatttccttatacttttatcaaaaaccttgaggttaataatcggagtgatttcagaaataagcctgttctgtaagagaatgggagtgtattagagttactatcatgcttaatataatgggacttcccattcaacatagatgtgaagattttataaaaatagccacagccacagaattgacatttgtgttttgagtcccttgttgcaatttagtcagcagagaaaaatacaacaaatgaaattttaagggtagaggaagagtcacagcaacacataagatggtcagggaagagcactgcctttcatggtctgtttgctgtggaacctcccataactaatttctgaaaagtaagccaaatgaaaaagtaaatggtttaacctttgtctctggttgacctgtttagctgactgtgtttgatgactgggaaaattttatttatttgaatacaatagtggagaagagtgaattgattaatcagtaaatcaatcagattttactaagtgcgtactatgtactcaaccctatgttagatgttgtataagatgtaatacctttttccagggaaagaacatgcagtggtaagtagttgttgagcacatttcaggcactattctaggtcctttacacatgttattgcatgtaatgttcacagtaaccttgtgaagaaggtgtagagtcagtactgttattcacacttaaggtcaaacaccctatagttctgtgtgtgggtgttgacatgattcagagtgaagccaagtaattagcagcagatacctcatggggtagatgggctagagtaggtatttttcgattggtgaagaaaaagaaaaattggtcaagacaaaggcaacaatatgagctcattatagaggaagggataagcagtatatgtttgtagaattaatctaacaagaacaagtgtgttaaggagttttggaaaatgagattggataggaagggtgaagctaagttatgaaggaccttgaaagccaggacatataatttgggcattttggactaggcagtacggaaccatgaaaggtttctgagcagaaaaggagtaacatatggaaaatgtttgtaggcagattactctggaagtggtaaatttggtggcagggtgactagacctgagattattgaaatagtttgatgtgaggtaggtgagtatctttttaaataaaagcatttaaaagaaacaggctactaaaagcatactttctctaggctttgaattatttgctttgggtcgaattgattagctcttggtagatgattagacaggtgtaaagtgaatcctgtgacctagacatcccaatcacttagactaaatctacggcaatatttttcaagccatgagttacatgacccattagtaggttataaatcagtgttgaaatttgcaaatagtgttttttaagtgaaatagaaaattgaatagagtagaaactttcaatgtgcctatagagtgataagaaaaagtgtgtttgtgaaaaattatttcagtcatttgtgttacatctgtgcatacatgcacattggctcatgatataaaatatatttattactatggcttgtggtaaaaaaaataagtctctgatctagagtatagcactgaattacttaatcctttttcctgccatgtaaattgtcaaagcttgcatgattgatttgaacattaagataaaaaccccaccacctagttcaggatgtctttacctttttcctggcccatttctaaccacccaaagtgatctgtttaccttcagtctttccataccaattcatcttatacccagctgccagatcagtctttctaagagtatttctcacatcatgtcattacctttgtccagaaaatacactggtcctcaatccatttatttaatattaatttagcaaatctcagttaagcacctaagaaatgaagtccacaatctttgtttagtcacatatgaaaattccttttaattcttacctcaaactgtatttccaactatgttagcaccacagagaccccatagatcagcttaattgtactacttactcttcctagaatatatgcatttttcactctactatacctttgttcatgctaatccccacttattgcccttgtcatcctttaaggccatgacttttataatcatctcagctggacataattagttcctcctctggacccacataatactttttgtcattcatgtgagactcatcacattctgtcttgcattatattagttgggtttattcccttttctagattataaactcttgagagtaagggtcacttcttgtttatgcctgcaatgttaacagtgctttgcaaaaggtagatggtcactatgcagctgccaaatcagtgaaaatgctgaattcatgacacagttctgtctttttctttcatttaagcagaatgacattatatagttcagcaaacaattttcccaatatttttcttagtatgactgacagcattagacagaatggaacagagcaaagagcactgggctaggaatcagaagacgttgacactagtcttggctctgtcaccaaaaaattctgtcacctttaatatgccatttgatctctctggttattttagcataaggcactcctcctttaaaaatacgggactgaaatgattaacttaaggttttttctaactctaaaaacattcatcttagattatttactgtgccagttgcattcactcagcagatacttattgagtccttactggggatatagcaatgatcaaaactaactatatgctttcatggacctgacattaaggtagtggagacaaataataaataaatgaaatgtaatatataatgtaaaatagtggtaagtgctaaaataaaaataaaacagggaaaagggatggagattggcaaggaaggtctctctgaagaggtgacatttgggcagagatctgtatgaggtgaaagatttggggagaagagcataccaggcagagggagctgctatgcaaaagccctgaggtcagaatgtgctttgcactttgggggaacaaataaaagtcagtgtgcttgagtcatagacagcaagaggttgagtaataaaagatgaggccagaaaagtagtaaaggactagatcatatgaaaccttttcaacggagtaaagagaatgttattctaagcacagtgaaaagccactggaagattttaagcggggtgttttagtccgttttcacactgctataaagatactaccaaggactgggtaatttataatgaaaagaggtttaattgactcagagttctgcatggctggggggtgcctcaggaaactacagtcatggcagggaggcgaaggggaggcaggcacctttcttcacaaagcagcaagagagcaagtgagagtggggagaagcgccagacacttatcaaacaaccagatctcatgagaactccttcactatcacaagaacagggtgggggaaactgccccaatgacccaattaccttccacctggttcctccctccacacctggggattataattccagatgagatttgggtaattacaattccaaatgagatttgggtagggacacagagccaaaccatatcatagggtagtgatatgatctacctactttgcatttaaaaatgatcgctctggctgttgtgtagagaatagatggcaagagtggaggccaggagactaattaggaagctgctaaaatattccctttaagagattatcattttctctatgtgtgtgtgtttctaaatagatttttgtcttttctttttaaaattttttaaaattttatttttaattgacaaaacttgtatgtatttttggtataaacatgtttatatatatgtgtgtgtatctacacacacacacatacattgtggaatgataaaatcaagccaattaacatatccatcacctcatatccttatcattttttgttatgagaacatttaaaatctattattttagcaattttcaagtatataatacattattactaactataaccaccatgctgtacgatagatctctggaacttagttctcttatctaactgaaactttgtaccctttaacgagcaaggagatgttgaatgattagactaaaatggtgacagtgaagatggagtgaagtgaatagattgggaatataatgtggagggagaatggacaagatttgttaatgaattgaatatggcagaggtgtaggaaaagcgggaattagagatgactcttatgtttgtcacctaatcaactgagggagatggtgataccatatactaagacggggagaatgaggaggaataagcttgagggttgaggctggagatttaaacaagagttcagtttgtgatataagtttaaaatgtctatttcagttttaaatgaagaaataaaagatatatatgaatatggagtttggagagaagtcaggagtggatatgcaatcttgagggcttttactatttaaatgacacttaaagccatgctactagatgagataacctcagaaatcattcaacattttcagactgggtaggaaaagagtcaacaaaagagaatgagaaagagtcgccaattaggtgaaagaaataccaggagtatgggtgtcactgaagccaaaagaagatactgttttgagttgaaggaagtgatcaactctagcaaatgctgctgagtttgaataagtggaagactaggaatagatcattgcatttggcaacatgtaggtcattgggcaccttgacacaagttaattttgatgtggtagaaaaaataggctaacagaagcaggttgtaaagagatggggaaaatgaggaaaaggggacaatgaatctataatgagaaatttttctgtgatggagaaatcgaggagttagctaaatgaagatatggggaatcaaataagcttttttgttgttataatacatataagatctctaaaaatatgttagatctgtttttaagctctactgaggtttaattgacatagaaaaaattgcatgtatttaatgtagacattttgatgagtttggacatatgcatgcttctactgtgatactgttcctataaccataatagttttattgcctgatgcacacagcaagtcagtacactgaaacatcaggttgtagcagagaaagaggtttcatcatagggtcactgaatggggaaatggaaaggaacctcaaattaatctccccaaggagtttggagctaggatttttaagtgtctcggagtgggctgaagtgtggagatcattgattggtcaaagagtacagggtgaagccatgggacagcaagatgaggaagctgtattctcatgctaatcttgttcctctgtgggggtcttcaaactggttgctggaatttgaggtttgaaaaacatcttaagccatcctcaaacaaaagccttaaaattctaatgtcagagatcctgtctataggaacaatggggatacaaatcaatttttaatttcctatgaccctaatgccagaaatcctacctataggaacaatggggtgcaaatggtcagttatctaatgctacatgacttttagcaacaaggaaatgagcaagagggcagcctgataaatgcttaactctaactatatttctgtttggaacgcggcatgcaattcttgtcaaccctgtaggaatgatttcagttctgctttgtcttgttaatcctctatcctgagctgtgatcaataaggagggaattgggtgatgacttctctggctgtgtcttgctgacaaggggcacagatagggaccataatcaggatttgaggaataaaactgctttgcagtggcctgtaaatggtcttgagtgccaagtctagagttttgactctgcatggcaaaaatgtcagttcttgttactagtccttgttgtctgtgggaaatagaaaagaaatacaacaataattataataaaaagaatttgtaaggaggcctgtattagggcattctcacattactataaagaaatacctgggggaaaaatacgtgagactagataatgtataaaaaaagttttaatttgctcatgattctgcaggctatacaggaagcataatgggttttgcttttgggaaggcctcaggaagcttccaatcatgtcagaaggcaaagtggagcaggtgtcttatatgacaggagcaggagcaagagagagggaggaggtgctacatatttctaaatagccagatcttgcaaaaactcactcactatcatgagaccagcacgaagaggatggtgctaaaccattcatgagaaattcaccccaatgatccaattacctcctaccaggccccaactccaacactggggattatatttcagtatgattttgggcagggacacagatctgaaccataaaagggaccaaaaccagtttcccattcccataagaagccagctaaaggatcattaagagggtttgtgacatacatctcttgccaaaatgccatatttgggggtataggtttctgagccccgacatcccctgtctgaaacttccctagaagtttcacacattaaaagctgagttggtggaaaaatttagtaagtagctgagtggcaaaggatcctagtaaaccagtctcccattcctggaataggccagttccattaaacagctgtatctcatttcaggagatggcattgcaggcaaactatagtttgtgtatcacaaagtatgcttgcagttactcaggaaaacagtagtagcaatttaattgagtataagtcagagaaatggaataaaaatttggtaatataagtttggagacatgcttagaaaagaattcaggattcaaactaaactgtagacaaataagaaaaactcaaaataatggacacagtatactaataaaaggtgtactgtagtttcttttgaaacataatttttctctcttcagtgcctcatttctaccaaataaaaatcagtaggaccaacttattggcaaaataagtttgagtcttattatatttggtttgattatttgcatagagtgcagcaagagtaattattggtgatgtaggctttttaaattatttttaatttttattttttgtaggtacatggtaggtatatacatttctgcagtatatgagatattttgacacaggcatgcaattcataataaccacatcatgggaaattgggtatccatcccttcaagcatttatcctttgtgttacaaacaatccagttatactatttttgttattttaaaatgtaaaattattgactacagtacccctgttgtgctgtcaatactaggtctgttaaccatccccatcttccccccgccctcccactatctttccaagactctagtaaccatccttctattctctatctccatgagttcagttgttttgaagtttagatcccaacaataaatgagaacatgccacattcgtctttctgtgcctggcttatttcacttaacatgatgacctcccgttccatccatgttgttgcaattgactagatctcattctttttttatggctgaatagtactccattgtgtatatgtaccacatttttaaaaatccattaatctgttgatggacacttggttgcttccaaatcttggctatcatgaatagcattgcagtaaacatcagagtgcagatatattttccataaacagatttcctttattttgggtagtgggattgctggatcatatggtagctctagatttgtcctttcaaggaacctctaaactgttctccgtagtggttgtactaatttacatttccaccaacagtggatgagggttctgttttctccacatccttgccagcatttgttattgcttgtcttttgaatataagccattttatctggggtgagatgatatctccttgtagttttgatctgcatttctctgatgatcagtgatgttgagtacctcttcatatgcttctttgccatttgtatgtcttcttttgagaaatgtctgttgagatcttttgcccattttaaaatcagattattaggtttttttctatagagttatttgtgttccttatatatcctggttattaatcccttgtcagatggatggtttgcaaatatcttctccgattctgtgggctagcttttcagtttgttgattatttcctttgctgtgcagacacttcttaacttaatgtgaacccatttgtccaaggcctgcagtgagtcttgcctggctaacactgctgattactcagggcccaaagactctttagtcagcaagtgatgaatcctgccaggacttggttcttcccttcaaggaagctgattctttcatggtgcacagtgtgtttagcaatgtcatctgtgtgctagggcatggaatgggggcctcaggactctgcctggtaccctgttctactgtgactgagctgatattcaagttgtaagacaaagtcatcttaatgtcccctctcttctgaagcagagggaagcagtccctcccagagctgcaagctatgctgtctgggtttggcagaggggtgacacaagcactcccttgggcgctctcactagattgtctcactaccttaagtaccttaagtccactggctgtaagctcagcacagaaccaggacttgcccaggaattgcagtccttgtggcctaaactggttttaaagtttattttgtaccccagagcactttagcccatggtgacagggcttgttgagacttagcttctgaccgctgggttggatgatttgcccctggctagggcttgtctaaatgccccttccatgggtactgagttctgccctatattgctttctgccgtgacagggcatcactgaattccaatgcaaagtccacaatcactgcactctcctccccaaaccacttgattctctctccatttgacatggttgctgccagggcatggaggagggttggtgattcaggactgtctttcataccctctttagtgccttttcccttaatatgatcttaaaaccaggtactgtaattgcgcccgcaaattaaaacctttcagaggagacaatgatttttactgtccattcaactggattccgcacaaaaagagaggccaggaggccaactgggaaggaattcttacccttttactggctttttgggttcctgaattccttcaactgcagcttccagaagagcagagttttgaccaccctgatcgctaattactaaggaaaaccattttcattattttcatgggttcataggtgaaagccactcaattttataagacacaagggatccaattaacattccccatatcagcagagacaaaattacaagatacacataacagagacacaaacacccgttattctactcagtttccaagttttagccaggcaaaacagacaaaacaccaaaatggttactcccagtcaggcctgctgatattctgctagtgattccttccagcttgcccacacacaaatggggcaagacaaaaacaaacacaaggcctcacaagtcaaaattctgaaaccagatttcagaactgtgaccagaagggtcctggcgtacttccctctaacagtgtgcctttcgttctccttccaattggggaaaatccccttaaacagggcccttcctataggttagggaaggtcaacaggatctccgaagaggtcacaagacctctgaagaggccaacagatcagaagaatggaaaggagatgtcagttgcacttggaagtactcaccagattcagaagacatctttcagattcagaaaccatttctctgctgcaagcaaatgtatgcaatgccctgccagcaagtgaggctccagggacagcccctggtttaaagaagccaggcatccacttgggctttcctctgggccacagaaatgggtgagggagcaccaagccacagccacataaccatgaggggtgtccctttgtggggttgccactaaatagcagccagaatatgttcattgcccaatgcacacagcaagtcaatacactgagacaccagattgcagcagagaaagagctttaattgtagggtcactgaatgaggagatgggagggaacctccaatccatctctccaaggagtttggagctaggattttttaagtgtccttggagtaagccaaagtgtggagatcattgattagctgaagagtgaagagtgaagtcatgggacagggaaatgaggaaattgcattctcatgttagtcctattactctgtggggatcttcaaactgctggaatttgaggtctgaaaaacatcttaagtaatagttaaacaaaagtcttaaaactcttgtgtcagattctgtctataggaacaatggggatacaaatcagttcctaaacagtcttatgaccctaatgtcagaaatcctacctatagaaacaagggcaatacaaatgatcagtgtccagtgctacatgacttttagcagcaatgaagtgggccagaaggcagcctggtaaatgcttaattataactatatttctgtccagaacgtgacatgcaattcttgtcaaccttatggggagggtttcattaccacatcaaggtactaaatatatccattacctacaaaaatgtacttgttttgctcaatggatattgtgttagtctgttgttacactgctataaagaaatacttgagactgagtaatctataaagtaaagcagtttaattggctcacggttctgctggctgtacaggaagcatgatggcttctggggaggcctcaggaaactttcgatcatggcagaaggggaagcagatatgtcttacatggccagagcaggaggaaagggggagggaaggtgctacacacttttaaatgaccagatctcatgaaaactttatcaggagaacagcagtagaaagatggtgttaaaccattagaagccacccccatgttccaatcacctccttccaggcccacctctagcattgagtattacatcttaacatgagatttcagtggggactcaaatccaaaccatatcaggtataaagtctgggttatgtgagatgaataagttctagagatctgcagtacaacacagtactcatagttaacagtacagtattgtgcactttgaaatatgctaagaggatagatctcatcttaggtgttcttcacacacatacacacacacacgcacggatctatttttcaatatactttatgccttaagcattgtcaatgacactttcatctttaaaatatcttttttcatttttcttttccttttttctctctatgtcccttcattcctcttcctccccactcctttctctgtctccccatctctctcttccttccctcccccaactttctctctttcgctctacagtagaaaagccaaaattcccatttgaaaagtttttgctatttttttcgaatgcttagcattccctcctgaaggggaattcttcccaaatatttgtgaaggcaccaaatttatgagaaaacacaaactgtaaactactcttgctggataataaggttgagcctttactatgtctaatattccacactggagggtaaataatttaatttataaaatttagaaatattttataagagcttaggatacaaaattaaatggtggacctgtaagggacatctgctcggggcagagaactattctttttcccctttctccccgtcattattgtatttatcaagaacgatgggaaaataatttttcaaaatccagggttttttaaaattttaaatatttttccatttatgtctaaggaattggatgatattccttattattatgcaggttcaattcttatacttcattttataactacttcattttgtgttgaaaggtttaaagcatgatacaagaaacacctaaataccattcatgaagattcacaaattttattgcagaggttcacaattttaaaaaatattttgccctatttgcttttttatttacctattttagatagataggtatagatagacatctaatttgtaacatatatattaataacatatactacataatgtgtatttttttcagaaaaatcttaaagttggagatatcatgcccctttcatcatatagacttcagtgtgtatttcccaagaaaaggagagtattctcatacaaagactccagtatagtttacaaaatctaaagatttaacagtgatatgttactttcaactaatctgaagtctttttaaatttgtgtaattttcttaatcatgtcttttatagatagtttttatctcagtaaaggataaaatttagtatcacacatttcttaggtaccatgtctctttagttttctttaatctggaatggtttttgagactgtgttccttgatattgaaatttttggaaagtatagatcaactattttatagaatgtccttcaatttgattgcctcatgtttcctcctaattagattcaggtcatacatctttgagagtaacacaatttaaacgaagattgtgttctaaaaagtgcatcttattaagaggcatatataaagtgggtttgtctgaacgttggtgtggttagattgggtgtggtggctcacacctgtaatcctagtgctttaggaggctgaagtgggaggatcatttgaggctagacattgtagaccaggctggacaactctattagttcattttcacgctgctataaagaaatttttgacactggttaacttataaaggaaagtagtttaattaactcacagttccgcatggctgggaacgcctcaggaaacttacaataatgtcagaagcggaagcaggcacatcttacacggtggcaggcgtgcgtgcacatgcaagagagagagggtgagcgcgagtgtgagtgtaagtgtgcagaaaaaaaactacaatttataaaaccatcagatctcatgagaattcattcactatcacaagaacagcatgggagaaactgtccccataatccaatcacttccctccctcaacacgtgaggattacaattgtcaatgagatttgggtcgggacacagaatcaaactgcattggcaacatagtgagaccacatctctcccaaaaaaaaaatttttttttaaattagctaggcatggttacacatgcctatagtcccaactacttgggaagctgaggagggaggattgcttgagtccaggagttcaaggctgcaatgagccacaactgcaccactgtactccagcctggatgatccaggatgaccctctctctaaatatgtgtatatatattttatattatatatattatatataatatatatattttatattatatatattatatataatatatatattttatattatatatattatatataatatatattttctattatatatattatatataatatatattttctattatatatattatatataatatatattttctattatatatattatatataatatatattttctattatatatattatatacagtacacatatataatatatatgatattgtttgattacttgatgaaggtagtatccaccagtgtactgtaactcttttttattcagtgagttacaatcctttataatgcttttcttgatgtgcaaattatctcagaattggccaggacgaatgctgtcaaactggctcctgtgcccttttaacatgcctctattccttgagcacttctttactttatgatgcaacaagctgttcaaagctcattttatgctttctctgctctgaacatgaaatcagccatttcctcatggaacttttgttcatttcaataaggaatagtttagaaactaggatctgggcactagatgtctgcattccaacaagcttcatcatggtgactaggtcttctcagtgaacagggtgaaatttatctgttgatatattaaaaaccatgagtttatactcatacctccagtttcaatccaccaccactgaaaacattctagtctttcccctttccctttccatattcataacatttttcctaaaataggaaaacatggctcccattattctcaatacatttactcatttgtttaagactaaaatatgcagaaacctgttttagaattgctaatccattcctccatgataaggtagcccaatgagtagaattcaatatgtgtttacagtttatttttattgaggtaaaatgtacatgccttgaaattgttaaatcttaagtatacgactcaatgaattttgtcaaataaatatacctatgtaacccacacccctgttaaaatttagaacatttcaatcactccagaaagttctcttgtgtcatttccaagtcaatccttctctcctttccagaggcacacattattctgaatttttccccacggattgtttttgcctattctagaagttaataaaatggaataatatactatgtttttgtttgtgtgtctgtgagatccattcatgttattgcatgtgtcattctcctttattactaaagatccgtcgtcctgttgatgaacatttagattgtttctaattttggataattatgagtaaagctgctataaacactcttgcacaagtctttttatgaaaatatattttcctttctcttgaataaataccaagacattgaattgttgggacaaaaagtaggtgcatgtgtaacttaaactgtcaaatattttgccaaaggttcttgtattattttatatcccaccagcaatgtatgagagttccagtcactctatatcattcccacattgggtgttcttagtctttcccatccatctattttacattctagtgggggaaagagggtatctcattctgttttaatttaattaaattaattaattaattaattaatttttgagatggagttttgcccttgtcgcccaggctggagtgcagtggcacaatctctgctcactgcaacctccgcctctcgggttcaagtgattctcttgcctcagcctcccaagtagctaggatcataagtatgcaccaccacgcctggttaatttttttgtatttctagtagagatggggtttcaccatgttggccaggctggtctcaaactcctgacctcaagtaatctgcctgccttggcctcccaaagtgctaggattacaggcatgagccatcgtgcctggccacattatgtttttaatttatatttccctgataactagtaatattaaatgttttatgcttactggttattcatagatcttcttttgtgaatatcttttaaaattttctggttttggctgggcgtggtggctcacgtctgtaattccagcactttgggaggccaaggtgggcagattacctgaggtcaggagtttgagaccagcctggccaacatggtgaaaccccatctctactaaaaatacaaaaattagttgggcgtggtggcacacgcctgtaatcccagctactcgggaggctgaggcaggagaattgcttgagcctgggaggtggatgtttcagtgagctgagatcctgccactgcactccagcctggccaacagggcgagactctgtctcaaaaaaaaaaaaaatctgtttttaaaattttgggggtttgtatattattggattgcaagaaatctaaaaaatatacattctaggtaaaagtctatatctaggtcagaaatattatgcaaatattttctgttttcaagtatacatatgtgtatgtgtgcatatttatatataaaggccttttgcatctctattaatgagccatatgatttgtagttttctgctagtatctttaactagtttgagtatcatgattatgatggttttacaagacaagttaggaagtgatccctccaactcttttatctgaaacattgctattacttcttaagacatttgatgaaactcacagtgaaaccatctgggcctggatatacttttttatgagcaggtttttggagaggaattgaattttttttatagatttagggctagtcagagtttctatttcatattgttgcagtttcagtgactattttttaaatcatttattttatctaagttttcaaactggcacaaagttgtttataatattgccttaatattcttattatatctataggatttatagtgctatcctgtctttctttctggtattggtaatttgtgtttttacatctttcttttttgagataagtcttgctacagcattatcaattttaatgatcttttcggatagtcaactgctggactgaattgatttttcctagtgtttgcctacctgcaattttatttatgtatgctcttgtctttattacttccttttttctgcctactttgggtttaatttacttgtcttttaaaatcttcttaaggttagaaacttatataatctattttaaacattttttagcataaacatttgtattatacaattttttccaactcccttagccacatcccacaaatttttatgtgctgtattttcatcattatttagttgaaataattttccagttaccattacgatttattatttggtatatggtatatttagaaatgtgttaatttccatatgttagtgctttttaaacataatttattgttgttcatttctaacttaattccactgtgatcaaagaacatgcatactctgtaacagctcacattgtgtaatttattgggacatattttatgtcttatttttaatctaatcattctaccaatgcagaaaaaggaatgtaaaaatctctgacttctcacttttattatggcttagtgtatttctttgttctgtcagggtttgcttatgtattttgaagattttttattaggtgtagatacatttatagttgtttatgtctcctggatgaattgacccctttgccattacaaaatgtccttctttatctttgggaatactctttgttttatagtctgttctgttaatagagcaactccatctttctttcttagctttttccattcttttattctcaacctgtgttttgtatttaaaaatgtatctcttatagacaacatatagatgttccttgctttttatccaatttgacaattgtagccttttaattgaactatttattccctttacattcaatatatatatgatatgcttaagtttatgccttctatttgctgtgtattttcaatttgtcccatctggtttttttttctgctctgtttttcccttcatgctttcttctgggttaatcaaatattttttagtccttcattttaatctctttatggtcatttaagtactgtacattcattttaggggtgttattagggattataatatgtatatttattccaatctacttagagttagtttttctacttataaaatatggaaactttgctttgcaacagtttgttttcatttatcccccatcactctttgtggatgattatacatacatacacacacacacacacacacacacacacacatatatatatatatatacacacagacacacatatatataatttatatacattgtatttatacttatttgtatttatattttatttttatccatggtagtcccaaaacaatgttataatgtttaaactttaaaaaagtaagaccaggaggcagctccaagtgagtgtagaggcatcattaaaaaatgatgactaataaacttaggtgaaaaatgtgttccttgctaatttaataattcatgagttgctgtcagtgtatgcatatatgtacaagcacatttatatagagacagtatttgtgttcagattcatttgtgtgacattgtttacaagaaaattggcgaaaggagttaccaattcagacatctcttccacttgtggtgatggttaagttaggtaagtgacctcttttttgaacacatcatttaaatgactttctagtaaaatgactacctgaatcttagttattcccttaatacctgggcagagtgtgaaacaaaagcagtatttcaggttaggataagaaaatttgacccaacatggaaaggatggattatggaatggatggaaagaaaggattatgatactccctctaataaaacatgaaataaaaatccacaattagctgaagcagcaagatgcagcctattctcttttattggaagtgtacatcatctaattcagtatctagaggctttagagtcagttaaagatacctgtgaattatttgttgttacggcagtaatgtcaattcctcaaaatagttccattatggaaacaggcctttaattttcaatcccaagtgatacagtcagataacttatgtcctaccattgttcctgagacaacttgctcttttttctttttgttgggaaatctgtttagatacagaaatagttggtatgacatttttcctgaagttgtatagcaatatacatgaggaaagctcaggaattatatggaatctttgcattttttaaaaggatatttaggactttaagacttgtacatatactgtcatacttttatatacattgtaaatagttaagataaaagtcaactttgcataaccttatatagtttttttttgtggtgagaacacttaaaatctctgtaaggtaatgcacatgttaattagcttgggttaggaattctactatgtatatacattttgaaacatcatgttgtacatgatagatatatataactttatttgtcaatttaaaaaaatgaaacacttttaaaaaggcaactttggacatttgttctttctccatatgcccaagatatttttcatagatttaaaccacagttaattcccaattaaatgaacaagaggtataaaataatgggaaagtagaatgctgagagaccaccacatccaacaaactactcaactttgaaatttgtgttcattcaaatacactgacattgtcagaatttatgctgtgggcattccaaaagttcagcatacagtgatacaattccccattccgacccagtacacagtactcctgggaatggaatagctcattctttctctttttttgctatctcccaaaaccagcctatagtgatgtgcctgaactcaaatgggaagatttcaaagatcttgcttagaatttgtaaaagttagggttattactgatgtgaaattttaacagataaagtaattgaacagagtacagtaggtattctctgtcaataattgtgaaacctagtgatcagaaatgattttaggtcacagaatgacttcaacagaaacagggacaaacatcaggactcgatcctttccatcttttagccacatttcttctcctagtagaaagcagagaaaaattagagttgtaaggtctattgatgcatcttggtaagaacatttgcagttaaaccattgagctcctaaagagatgcatctcactgttacactttgtgcccccctccatttgtttattcttccatgtcatgcacagggcaactagaggtacctaccagtaatattacattttggttaactattctttacacacaaaaaagatctttcacaatagtctcaataacctccttttgcagtgatttttttacagattttgtttaggacatgtgaatgtagatgatttactgtacagtttaataacataactgctttgttactcaccaaagtttaggtaaataaatttatggcatgagggagtgcgggaatggaggggtggggaaacacagagctcaccatacactcacatttttaatgccatacttcttatcaaagagaggttactttagaaaaccctatggcagtggacttttgttcttatggcatcagcaaggattatgtagcaattcatttgcagatgtagattttagcccaagtaaattataatcaaaatctatctgacacattgtgcttcctttatctaaattgccctgttaatgagttttctgaatacactaaatcataatcttttatgaatcatttcagtttaaaagccttcagaatctcaattagattatcttagatgaagagaaaagtaaatgttacaatgaatgtctctaactgtggcaaagtggaatgttatctcttaaaccactgtctcctttagtggcttcttccaagaccaggacctacaatttgttcccatttgcttgaaaaaaaaaaatcactaatattggtggtatttggtagtgaacttaccctctagtcgatcttgctgttttcaaggatgatgctcagcatgacatactctgggcttttaaaagagcctttctttgtatgtatcaacacggtagtttctgtagctgcggacaatcaagcagaccaaacaggctaagccagactgtgtcggatcacaccacaaattagaggcagatgcacttttttcaatctggcgttctcctttgacttactatatcattctccattttttccttctattatgttataccacacctaatttcccaaaaggctgagtcattttatgaaaatacataaaatatgtggaaatgggtgaaaaggaaactaagggtgagtaagctaagatggagccaggataaggtcagtaagccaatgcaaatcatgctgctatatgattcagctgcaggtacagaagagcctctttaaacatagcctgtagcaactggggtcaggatggagtgagatgggagggcatgaaagtatctaatgtttacaacatttcagtggccatcttattctagttctctagggaagaatatcagtccctctggaaaagggagggaaaggatgagaagctgaaagactgcaatcattttttaaattgtcaaatgagtccatttgttggaacagaaataatttagtagaaaataggcaatcaagttgaagttttcttctcctcactatttaatcttgatatattgagaggctcttaacatattaaaaatggacaatgaccaaaatgagaattggaatttcagccaaaagtatatgtgctttcatccacttgtggaaatacaagttctaaatgataattaatgttagtcccccatccagagtgatatccttattctgtgtagctttggccgtacaaaccagcctggtccatcaacagggaacaacttgacctctgatgaggaacacttttaccctgacagaaagtggtaatgttttcttagcttctgtagtctgacttaatgtcaggcaaaggcaactttgaagagacagtccttcaaataatactattggcacataatatttattacctttttttaaaaaaaaatgagatgaaagtcacataatttagaattaatcattttaaagtgtatgattcagtggcctttagtacattcacaatattgtgcaactataacccgtatctaattccaaaacattttcatcatcacaaaagaaaaccccatacctgttttattagtcagggttccctagagggacagaactaatggatgtatatatatatatatatatatatggttttattaagtattaacttacaagatcacaaggtcccacagtaggctgtctgcaagcttgaggagcaaggagagccagcccgagtctcaaaattgaagaatttggagtctgatgtttgagggcaggaagcatccagcatgagagaaagatgtaggctgggaggctatgccagtctctccttttcactaatttgtgattgaaggatgcaaagttaagcagttactctccatctccctctctccctagcccctggcaaccattaatttgttttctgttgtgcattccttgttgactatatgctttttgatgaggctggtgaaaaacagatggaactaacactgggcaaattagtctgctgtaataagaagggtattaaaaaataaatataggccaggcgcagtggctcacacctgtaatcccagcacttttggaggccaaggacggcggatcacctgaggtcaggagttcaagaccagcctggccaacatggtgaaaccccatctctactaaaaatacaaaaattagccaggtgtgatggtgcatgcctgtaatctcagctgctcaggagactgaggcaagagaatcacttgaacctggaaggcagaggttgcagtgagctgagatcaagtcactgaactccagcctgggtgacagagcaagactccgtctcaaaaaataaaaataaataaattgataaataaatatagctggtgatgggccattataaaaaaatctgcttgctaatcaatgaaaaaaggcatgaaatgagtgatggccaagactgtgtactcgttagttatctagatttaaccagaaaaatgaagcaacaatatatgaacaatttagttaaaataaagacattgcaaaaacagttattgatgaaaccaggcagagaaagagcagggtcaggaaatttgagtacatgtgtaggctttccatcttaaggagaaaaaaaattggataccatctggtacaagcactactctcccatgtaacatgaaaacttgatgaaaacaaaatcaaataaaccttgaatgaagaatcttactcataagaaagttcaacttcatccatgtgcaaatgtttgggcatgttgggaggcagagattaataggagtgacaatgggtataaactgaaggagctgttaaatccaattttgccttcactgtgtaatgacacaattcaccttctaccattcagtgcctcctgaaaccagatgcacttgaaatactgatggggagcgggggaacattgtttaaacattcagttttaacccatgactcaaggttgaaggtctccagtaattttttttttttgaggtaaaaagcccaatatctgtaaagccaaacttgagatagctaaattaggaatcactaaaggccctaatccagggttcagtagtaatcactttggtgaccttaggctagtaatttacccattctaatcctattttctcatctcactctgcctagctcataataatttttttaaagtagaactaggctgtatgtttaaaaacactttgaaatagaactcagcaactttttagtttgaatatttacaaatatctgtttattggacctgtaaaaataagggaaaaaccctttctgtgtgacacaaatatttattaagggcttaatcactagcattgaattcctctataaagtatagtcactaatacttcacactggtttttgatgaggtttgcaaatatgaaacagtgttgacagtgatgatccatttgcatggggttttcgctttttctcctctcagcttcttagtttatcttaaagccctcagaagcttcttgtatttcttcaacctaaaccacaatattttatctgtatgtcttgagattttggaggaaccaaggcattttcgaggaattataagtcatttcttgttgttgaaattcacacttgggagaagagtgtccttataaaagattattctggagagctaaacataatccagatcatgaaggatcgttcatgatagatatgaaccaggttaagaagctccttttttagacccttatttaaggtcagaaatcctgtttggtggccagtcagtcttcaacagccttctttactgaacaaagactcaaagactctctgaagtggcatttttcttttttcccccctgagaacaaaaagcattaatataacttaggtggaaaaagtgaaatatgagaacaggacagagctacttctgtgaggtagctaccattatttccacttcacaaatgaggaaactgaggcttagtacagttaaataatttgcctatattcacacaggtagcattagagttgggattcaaagttcatacattttaccactaagaagtaattattttctttctttcttcttcttttttttttttttaaagacgaagtctcgctctgtcgcccaggctggagtgcagtggcgcgatctcggctcactgcaagctccgcctcccgggttcacgccattctcctgcctcagcctcccgagtagctgggactacaggcgcccgccaccacgcctggctaattttttctattttttagtagagacggggtttcaccacgttagccaggatggtctggatctgctgacctcgtgatccgcccacctcggcctcccaaagtggtgggattacaggcgtgagccaccgcgccaggcagaagtaagtattttctaaattactgtgtgctgagaacacttaggcactcctctaggagttttatgttagagaactatgcaagatcgtgtagaagcaagggccaagttatatggtacatccaataggtgctatagaaataaataaaaggaagacattactgggatttgttcagtcagagaaaaaaaatttttttggaggagttggaacctgagctagctctcagagaaaaatataagaagtagatcaattaaagttggaggcaggagcatgggttattccaaacagagacaagaataaggtgaaggcacagagagagaaatgaacagagtgtgtattgaaaggactctgacttggtacaatactagagtcatggtggggagtagtgaagtgaagcctggtgtggcagggtaagctatgtagaaggccttgaatgccaaccacagggctttctctctgccttagaactgtttattgaataagcaaatttctgcctgtctcaggtactctcactattgttatccatcaagcagaacatgagttgcatttgctttccaaagtgctgttatattttatgtttatgaggagaaatgtgacaatacaggtccaggtgtccaaagggaattatagctatcgccttcaatgcaatacaaaactccatggctgctgggattttcatgcccactggcagcccagagatacattatttatttcaaattataccttttcccctaatgggcctgtgtttctttcaatgttctgctagttctagcagcttcagctgttgctgtcatacttaataaggactttgtggagcttagatattgtgcggctgcactatctttcccacagcccagtaaaggagctttgagatgagctttttctttctgtgttggctatgtttagatttcaacctgaaaaatattccaggttgacccacagcttattctgctatcagtgagagggtaggaatcagtaagattagcttcctctaatgccacagcaaggtcacccacgaagcccgtagcttgtcgaattgcatgaagtgatccaagctagttcaaaactcccaatgtattaaatgtcggtgcccacttttgcaaattcaggcatccaaattgtgcctggtatgaagcattaggcagtgggtctaggaaattgagctcaagggcaggaacatcataactttggaattattggcgttgacatggctattttcactcattgtgataggaatatgttcctgaaagaagcaagatgattctaaaaagtaccgtgcaattataaaatagtgggaaattaaagaagggtgcttttgtgcttgctttcttgccactgattttgcattccctattttacttcatggtagtctatatgtcactcaaatcaaatataattggtgctgtttagtatttggtaattttactgctgcttgtacaacatacgcaaatattctaaaatgtgttaatgatgtcagtacatcacaaataaaatgcacgtgaaatggaaataacgctgtgcacactcatacacccacaagtgcatgggagtctgatcttgatagattcagaagaacccttagctggcagttttaataggcgatcatagaaaagaatgccagcaaaaatgacagagctcatatttctactgacaaaataccaaaatgacttacgagttattttctcaaaaatggaagggggcagaactgaagagtcagtgtgtgtgtgtatatgtgtgtgtgtgtgtgtatgtgtgtacagacttatataaggtcagtggtagattggcgagatagactaatatgtgagtaaagttatggagtttaataacataatcatggttaactaacaggatctgaaactgtaaaaaatatagggaagcatcagtatttgatgaggaagattgggggtactgggctgggcagctacgatagaactgggaacagaactcttacattgaactgacatttagcccttgactttatgaatgtgtgttgaggttgcaactacaaagtaactacatttcttaagtgtcagaatagtgaattctaaccacttggcaaccacgtttcagagggaggattgtagttacttcactaactgggtctaggggcaataaggagaagaaatggctgcctactaggcaactgcacacattcagtaaggtggggggaggaggaagactattggtaacactcacagaaaagtggggcctgcctgcccagagacagagaattacagttgagaaaggcctgtctgcctggaagtgtgtgtgagtatattgtgtgagtatatgtgtacgtgtatatgtgcaggtatgtgtatgtgtgtttgtgtgtgtgaggatatgtgagtgtgggtatgtgtacatgtgaatgtgtgtatgtgtatgcatatgtgtgagcatgttgtataagtgtgtatgtgtttatgtgtgagtgtatatatttgagtgtcttatgcatgtgtgtatgtgtgaatgtgtagatgtatgagtgtataagcctgtgagtgaagtttacactgatgcagaagagggctggagcccatggagagaggtgatcagtttgaaccaggcctgatttgaaccctgccccatgcctggtgagcccatgctctgcaccagtgtttcatccctagctttgcacataaacaccatctctctctggaaaatctttccagtctctgactgggtaatgtaatgtagccccatccctcaaggaccagctcaggtgcagcctcctccatgaagccttccatgatttcatttcccctatctccaacagatgtgacctctcctgtggctatgggtttggggtggggcatctgtgctggggtgtagaggagtgttggaacactgagatgggagcaaactgacaggaagaatcagaggtatacatttagaatttgtagtttgtattaataacaagcacccttggtgatcctcattatcaggtaagtttgggaaacactggcccagtcttatcccctcattttttagaagagacaactgaagctcagagaggggaaatttactggcctaggatcacacaatcctttagtgacagaaccaagaccagcatgcagatatcccactatctttccagtccagttatgtttccctttgtattatattaccgtaacaagactggctacataatttgcatggcccagtgtaaaattaaaatgcaaggctctttgttcaaaaattattagaaatgtcaagacagcaaaagcagagcattaaaccaagcacagggcccttttacatgcagagccctgtgcatctgcacagatcatacacctgtgaagctgacgctgtcccacaaagagtgtttactatatcttgcatgtggtaggtcgttctataaatacttgtcggatgaatttatggattgaattaacacctcccatttgccaggaatctatgaaagtgagacactagataaatatgttttgatggaagtgtaggaaagaagagaagaaaaataggtctggaacatgatacatagggttactgacatttgtgtttggattttttatgtgagtttttgcacacaaattgagattgctacaaaggctatccagtataagcaattgctgagtaaccaacacagggtctctgactggtaataacaatggattttaaacacttagcaaccatgactggggaggaggctttgcagccctagcaggccaaggggctgggaggaaaagaaaaataaaattggctgcctactggacaactgtgcatatttaacaagaaatagtttggggtgcaaataaatcatctgagttgattaaatccagtctgtttagggaattggtatgtagcttgctcccttggtgaaggtttgacctaaggaataatcaaagcttttctgaaatgtctgtaatcactatttggaatccttatgttgccataagacttctaaaagccacatctgctatacaatattgtctggtgatccatataaactctttaggccacaggtttttaatttgtttgtattagttttctattgctgtgtaattcattgccacaaacttaatggctattaagccatttatttattttcccagtttctttaggtcagaagtgcaggtacagtgtagctggtttctctgatcagggtgtcacatagttgaaatcaagttgttgtttgggttgtgttcccatctggagcttgggatccttttccaaactcatttagattcttggcagaattgagtcctttgtggttatgaggtatccatttacttgctgtcacctggaggtcattctcaactcctagaggatgctctcatgtcccagttacatgtctctctccatcagcagctcctaacataatcatttgctttcctccaagtcaacagaatagcatctctgccacttagaatctttctgacttctccagttttttaaggtttcgcctcattgggtcaggctaaacttgggtagtctctttttttggtaacttaaagtcaactgattaggaaccttaatttcatctgcaaaattctttcacctttgcagtatagcataacttaattacaggagtgagaacctatcagattcacagaagggattatacaaggtatgtatgtacaacagtggtcaagattattggaggccatcttaaaattctgcctaccataatattaatgaatgaactttagggacatattcaaaactctaacattttatgcaaaaatttttgtgactgttcattttttccgggagccagttggcagcattcatcaagagaggtctgtgacccaaatcctattaagaaccactgatggaccagataatacacactggcaagaagtgatctagaaccaaatacttatttctgaaagaatttaaccagtgtcttttcaaggaactaaagaaatctcatgtggtgtttattgagatgaggtggctcaagttttattcaaaatatatcttttagtgtgtgattttcttttaaatcaatgaataattggtatttccaaacagattttgttatcaaagtgttcgtttctttttaaatttaccattgttactttatttttcacatttgtgtaactgtgcctccaccgtccttccccatctggctgcctataacatttccaccaatggcaaggagcggttaagtcagataaaatttggatattagttggggacagacaatcatcagtgctgtgcgcattatattccatacaggaatataattaaattttggaccttctggctaggttgtaagcaacttgagagacaggaatcagatcttgtgttatattctatatagcactatattgggtcaaaaataagctctcagccaggcgcggtggctcatgcctataatcccagcactttgggaggccaaggggtagatcacctgaagtcaggaggttgagaccagcctggtgtcaaccaggtgaaactctgtctctactaaaaatacaaaaattagctgggcgtggtggtgggtacctgtaatcccagctactcaggaggctgaggcaggagaatcacttgcgctcaggaggtggaggttgcagcgagctgagattgcaccactgcactccagtctgggcaacagagtgagactctgtcacacacacacacacacacacacagacacacacacacacacacagccctcaataaatattgggtgaattcactttgattcagaaaataatttttagagggtattgtgtgtaggaactgtaacaaaaaataggacaaaattctgtgcctcaagtttacaatctaaggattatcagataatcacaacccaaagattgtaacgtgatacaaagttaggagaatgccaaatgagaggtatgagcagtgtggtcagatcagattacatgtagcatctaatgggagtgtgggtggggctgggcaaggtaatgagtcagagaagagcacagcagaggagttgaaatttgcagtgtgtgaatagaaatggagtacagagggaggaaggctttaggatgtcagaagtggtaaggaagcaagaaagccatacttcaggtaaatagatgtactgcacattctccatgtgtggtccagccttcccctgctttttctgattggattcccttaacctattgactcaaatgcaaatatctgtcatggcccagtttaaatgtcagcatccccatgaaacctttttgttcactcagaccaaaaagaatctctcgttcctctgaaatcctgtagcatgctatctacatgtctcacaagtcactttctgttgtttagcatagttatatatatatatgcatgttttttcttctctatcaccactgatttaaaaattcccttactttatattgtaatttctgtttaaaaagcaatttcacatacattgttctagtgttctcttggttgcagatgaaaagaccaaggctcacaaagccccaagctttactgctagtaagtaacaaagaaagggcctgagtctaggttttcagaattcacacctaatacatcttttttattttgttttcaccagattattgtttgtgtgtataggtacgtaaaatgtctgtgaaggtgacagaaataaaatctgctgatatttaaaatgttactagtcttggccacttcacttcagatgtccagtgaaaatgctgtttagcttatctgatagatcaacctgtgtaaataatctttctcataagtaaattatgggaaaatgtgagtctgagtttcatatccctatatttcttctaacatggatgtttgatgcacgtttttaacagctttattgctatatgattcaaataccataacatttgtttcaagtgtacagttcagtgggtttttgtaaattttgtaaatttacaaagttatggaactgttattaccacagcccaattttagcatatttccttcatcccaaaaagatccctcatatccatttgcagtaactcacattttttcagccccaggctaccactaatctcttttctgtctctatacattagccttttctggaaattttatataaaaggaatcatacaatatgagttcttttgtgcctggcttcttttactttgtacagtgttttcaaggttcatctatgctgtagcatgtatcggtattgcatttttattgcaaagtatagatatactatattttattttcccattcaccaattgatggacatttgcattatttacactttagggctcttataaataatattgctgtgaacattcgtgtataagttcttgaataaacatgttttcattttatctctcttggttttatatatatatatatatatatatatatatatatatacacatatgtatatatgtatgtggaaatgctaggtaatatgacagctctatgttcaactttttgaggaactgtcagactgtttccaaagtgactgcaccattttacatttgcactaacaatgtatgagggttcctgtttctccatatcatcaccagcatttgtcattatgtctttttaattataaccattctagtaattgtggagaggtatctcattgtgcttttgatttgcatttccctgatgactaaatgatgttgggcatcttttcatatgcttattggccatttgaatgtcttctctgaagaaatgactgttcaggtcctttgaccattttttaaaatcaggttatttgtctttttattatttgagttatgactttttatatatttaaggtgaatgttttttaccgaatgtatgatttggaaatattttctcccagtctgtgattcatgttaattttccttattttatgttttattttattagttttttagatacaggatctcactctgttgcccaggctggagtacagtggtgcagtcatagctcactgcagcctccaactcttgggctcaaacaattctcccacctcagcctgcagatagctgggactacaggtgtgcaccaccacatctggctaatttttaaaatttttttttgatagagacagagtctcactatgttgtccaggctagtctggaacttctggcctcaagcaatcctcctgcctctgactcccaaaatggtgagattataggcatgagccatggtacttggcctgtcttctttttttttaatggtaactttcgaagcacaacaatttttgaaaattttttacgaagtccaattgacctaatttttatcttgttgcttgcgtgttgttgtcttacctacaaaatctttgtctaacccaatattacaaagatttgctccaatgttttctactaagagttttacacttttagctcttacatgtaggtctttggtccattttgagtaaagacttgtgtatggtatcaggtagaagttagaattaatctttttgcattgttctagcaccatctaaaaactattttttatcccattgaaatgcctttgtacctatgtaaaaaatattaataataaatgtagggttttttttattccattgatctatacgtctatccttatgccaatacaagactgtcttaattactgtaactttatagtactttttgaacttggcaagtgtaagttctttgttctttaccaagattgttctggctgttcttgaacatttgccttctcatacagattttaggagtagcttgtcaatttttgccaaaaaaagcctactaagattttgataggcgaatgtctgtgtgagaaaaaatggaaaaggatctagaaaagactgtgagagtcatcataacataaagccaatctgacaccaagtgagagagatgaaagggaagttgggtagaattgtcctagacttccatcagtctaaagaaggtttaacaggagagtttggctgataatctttaagccaaagtcaaccaacaaattgttttctgtttcccaagaatggacctgcctttgtgtccctgccatgctcagtcattggctgggggaagcctgtgggacacacgggctcaataccagtgtggtgatggattttagtgcacagaagctagagcctttcgtcagttacattccttgtagttggaggtctgtgagttggattctcatagttgctacaatacatgaccaagaaacattcttctttctccaggagaacttcagaagaaggatctgatcattctggcccagaatcaattttccttgaagttcagtcttataatgtctgtaatactatgcaatatagattctcctacattcagactgtcactgtgttcatgtgcttggctgaatcatggttgtttctagaggaagtagccaagatgatgtgacttgacctcaacaatactgattatttaaattctagcagtaagttctgctatggaactatccatgtatattttgtataagattccttctagatatctgtgtgcatcctcctttcataccatgggagtttactgagtgggaagtccataggggctggtaggaaggcttcatttcagatatggactttgtacccattgagatgaatgtcatagaaagggttagtttaaagaagtagatgagaaacattaccttggaaacagcatgtaggtagagtagggggctactgaaaagatgtattccctatataggcacttcagtggcattttaccttttttatgtaagtagtaattatacatttaaatcagcaaaccttgggagagcatactttctcagcaatgttttcattttttcatatctctaaaaattaatcttctgttgggagtgacttaccaatgatccccacgctatcatgtgatttcagcattctttccattatgatgtcttttcagcctccagcagaggtaagagataagttgtgaagtagaaagttcttaaatcaggaaaatgaaaaaaggaaatcaatgttacaactatgaaagaagcaagagtactttccagggcaaagaatttggtgtaatctagatagtatatctgatccctttgtcaaattcttttctgaacctaggaggaagttgtaacagtcctcacattgccttgtaccctccaagaaagtcattaacatttcaaaaatattatcagttttttttgaaagccatgggagaaccttaccattttaaagtaaaattatgctttgctttgtatgatttcaactgctctgattccattttagttaagggtagcttaattctcatggctctaacccatcccagtatatttgcctgaagctctattaagtagattgtattaagtaaaattttaccaacttgaaattaagaagaggttttaacctgttaaggttttgccatgagaatggatgtagtcatagtagtcataccttctatgccttcttggtttctatctgcttgcttcattttggctttggcattgcgtttacctgcagcaaaaccctacagaattcacctgaggggttagacactaattatgatagatttacagtcatgtgctgcataacaacattttggacaaggatggactacgtgtatgatggtggtcccataagattataatacgatatttttactggacttcttctatgtttagatacacaaatatttaccactgtgtttcattttcccacagtattcaacatagtaacatgctgtataggtttgtagcctaggagtagtaataggctatgccatgtagtctaattatgtagtaggctatgcagtctaggtttgtgtaagtacactatatgttgtttacacaatgacagaatttcctgacacatttcttagaatgtatcctcattgttaagcaatgcatggctgtgctgactggtgtttatcacaactctatatctggcaggtcactgctgccatagcaaaggctatttatttttctttgttgatttaatatagtttcagtcattagaaaatatttttctgtggattctgattcaaagttcattaatcaacagaactgatacattgttgagatgacccaggacctggaagtgtagggatgtgcccatttgttacatgaagtgttgacttgtaattagaatgtactcatgatgcatagtgttaaatacaaatgagtagaacatgagaattgggagaaatcttagagattatctggtccaaccccctacattttactatggaggaaactttgtgtggcccaagtcacataacaaataaatagaggcagaactcttttgggcctgaatttgtatctctagattcctattccagtgattattctatttcctgttctgtttcttaagtgtcttagtctaaagtgaatttatcatatattgggtagcttacatggaaattaaaagtaaacattgagctaagcaactgtttaatttcatattgaaaactaagaacaattggctatgaacaggtgggataaaaactttcaaatgcattgtgaagaattaaggtctatttttatgaggatgacagtgatcattgattcaagacatctaatgcagaactatctgggcttgcactgtactgcatatacggcttttaagcacttgaaatgtgcctagtccaaactgagatagatgttgtaagtgtaaactagacactgtatttcaaagagttagtaccaaaaaagaatgtaaaatatttcactaatactgtaaatattatacataatgaaattatgttatttggatatattgggttaattatatacatattattaaattagttttaccaatttatttttactttttaatgtgactactagaaaatttaaaattacaggtgtggctcacattgtatttctattgaatagcacctgtccagagtgttgctaccaaatgtatggtccatgaaccagcagcattggcatctcctgagtgcttgaaattaatgcagaattttatgactcaagctaaactgactgaatctgaatctgcattttaacaagattcccagggtaatttacatggacattaaagtttgatatatactgagcaagcatgtgcacaccttgttcagatacttcctagttctccacacagaacttgttggatcccttctgattgatatgtgacatttagagccaggtcaacccacgacattctggctttaagctttggtagatttttaaactgcttttatgtgcagtggttttctgatctcaaaaagctctaccctcctcgtataccaacatgtttttactaataaatcagacagcagtgatgaaggtgggaactccagtaggccaaatatgaaagttacaaatgctgttaataccccaatctcccttctgctcagatatctctcctggttctacatcagtacagccaactgtctgttttatatttacctctgttattctactagaatctcaatgcaaagtgtccagaacaaaattcaccatgttacctaaaaaatatgattatttttatatttcatgtcctgatgggtatcagtaccatctacctatacatccaagtgtgacctggaagttataattaataatccttctttcacgtcttcacacaaacctgaaatccaattagccccttaagtagtcaactctgcctcacatctctctctggaatatattcttactttccacttatactgctctaattctgagttttcattaaatctttcctgaattattatagtagcctcctatctagtcttctataccctgtactatctcccctttctaaacattcttccacattgcaaccagaaatacctttctcaaatacaaatctgatcacgcctaaaatcctttggtggcttctgagtagctcagtctccttgttaaatggggctaataatagcacctatgtcaaaggctttttgtaataattaaataaattaatgtatataaagtgtttagaatagtgcctggtacaatgtaagtgatatgtaggtattagcttatattatgtttattattcaaggctctttacagcatgtgacctcaacctattttgttagtgaaaccaatgtcctatcaatttcttacaacacacagaacattttatggcttatgcatggtctgtcacactgtttgtgctgcctagaatactctttatttttgtgccagaaaaaaaccccacttcacatttttccccaagttggttcctggccttcatggctcctttttgatggcaaaaatttacctatattccatgcttgcttattaaaatacattcctaaactatgattatctaatgctggaagcttacatattccatttggtaaatggatgatgctgcccaaatggaatgtatggcaacatttcagatttcgttaccatgaacatttaaaccaaagtaaccaaagctttcccagatggtgaaatgaacagctaatttttgtaaacagaacagcaggtggtctcctaatttatctaaactcaaaggaaaaaaaacttgtttgtgaccttcagacagatactgactactggggaaaaatgatttttgtcagcttgtttatataaagttttaaatcactggtgcttggtgttttcctcctgttttaattgaaataattaattccaattagaataacaggcataactgtctttataaaatatttccattctagaagagatatagttcaacagcatttcttcaaataaaatactaccaaaatgtcattggacaaagtaggaatttatagaaatctgatagtgaattctactaggatatcacctcctaacttaaggtttccttaagtgtgcattctgaaaagctgcatcagcttcccttgctggaacctatcacacttccaaatttcttgccgctgtctcttcaagaagtgacaatggcaagatagacaggcagaagaaccagcacaagtgacaacaagtaggcaggaaggatcaatgcgtattcacagaatcaccagaacaatccaaatgaataatagcagaaggttcctgttggggaccagaagcaaatgcaggtatcgcagacatataaaacagaatctcagggaataggtccaaaaaaaattttttaacaagtaccctgccaccccaaataatacagatgctcataaatatttcaaaaccactgggctaagtcttcaatttggttcacctgcatttgttgctggtccccaacagggaccttctgctataattcatttggattgctatggtgattctgtgaacatgcattgctccttcctgtctacttgtcacttgtgcttggttcttttgcctatcttgctgttgtctcttcttttcatctttcattattttatttgcttctcaaatgttctgtactcaatgatacttttctgaaggatgccaactttcaccactgttactcaacatagtactggaagtcctagctagagcaatcagacaagagaaacatataaagggcatccaaactggaaaggaagaagtaaaactctccctgtttgcagatgatataatcttatatttggaaaaacctaaagacaccaccaaaaactattagaactaataaacaaattcagttaagttgagggatacaaaatcaacacacaaaaatcagtagcatttctaatgtcaacagtttacaaactggaaaataaattttaaaaagtagtagtccaatttacaatagccattaataaaatcaaatacctaggaattaaccaaataagtagaagttctccgtaatgaaaactgcaaaacgctgatgaaagaaattgaagaggacaccaaaaattggacaaatattccatgttcatggattagaagaatcaatattgttagaatgtccatactactcaaagcaatctacagattcaatgtaatcctatcaaaataccaatgatattcttcacagaaatagaaaaaaagtaccctaaaatttatatggaaccacaaaagacccagaatatccaaagctatcttaagcaaaaacaacaaaactggaggattcacactacctgacttcaaattatactacagcgctatagtaaccaaaatggcatggtactggcataagaacagatacataggccaatggaacagaataaagaacccagaaacaattccacacgcctacagtgaacttattttcaacaaaactgtcaagaacatagactggggaaagaccatcttttcaataaatggtgctgggaaaactggatatccatatgcagaagaatgaaacaagacccctatctcttgccatacataaaatcaaatcaaaatagattaagaggttaaatctaagacctcaaaattgtaaactactacaagaaaacgttgggaaaactctccaggacatcagcctgggcaaagattttctgagtaataccccacaagcacaggcaaccaatgcaaaaatggacaaatggaatcatatcaagttaaaaagtttctgcatggcaaaggaaacaaccaacaaagtgaagagacaacccacagaatgggaggaaatatttgcaaacaagccatttgacaaggggttaataaccagaatatataacaagttcaaacaactctaaaggaaaaaatctactcatctgattaaaaaatgggcaaaaatattggaatagacatttctcaaaaaaagacatacaaatgggaaacagacatgaaaaggtgctcaacatcattgatcaacagaggaatgcaactcaaaactataatgagatatcctctcaccccagttaaaatggcaaatggctttcatccaaaagacaggcaatagcaaatgctggaaagaatatagagcaaagggaaccctcgtccactgttggtaggaatgtaaattagtacaaccactatggagtccaatttggaagctcctataaaaaactaaaaattgagctaccatatgatccagcaatcccactgctggtatatatccaaaagaaaggaaatcagtatatcaaagagatatctacactccagtgtttgttgcagcactgttcacaatacctaagaattagaaacagtatctatcaacagatgaatggataaagaaaatttagtacatatacaaaatggagtacaattcagccataaacaagaatgaaatcctattatttgcagccacatagatggaacaggaggacactcagtaaaataagccaggcacaaaaagacagcattgcatgttctcacttatctgtgggatctaaaaatcaaaacagttgaattcatggacatagagagtagaaggatggttaccagaggcttggaatggtagtggggtgtggaggcagggatggttaatgggtacaaaaatatagttataaggaatgaataaggcctagtatttgataacacaacagggagactatagtcaataataatttaattgtacattttaagataactaagagtataattggattgtaacacaaaagataaacgcttgaaaggatggatatcccatgctccatgatgtgattattatgcattgtatacctgtgtcaaaatatctcatgtatcccatgaatatatacacctactatgtacccacaaacattaaaaataaaaatttaaaaaatgctctcctggaccctgtttttgggagaaatctctctctcttactaaactgtgttttcacacatattgaattgggagctttgtatgcaaattatcatcttagtcttctctcttctaggatgaatctcggtgttttactcactactgaaatcctgtacgtacttgtgtgcacaacatataccatccttcacacataaaaaacatgcaacaaaacttgaaaactagttatttggaagaaataaatatatattttatatagaggtttttttttaaaggaaagtattggcatatttcagcaaggtaacttgatgtgctaagatgaattcttgagacaaagatatgacttggtacagcttggtagagtaaagcctaaaggtacaatcttctaaacctgtgactgctcaggcttcccttctgctcagacccttttttctctacctcccatattccaaggacttctatgtggctgccctcattttggttaccttatattgatgtctttgccatgaatttggcccttgatgcccttgtcctttatcttggcttttaactcttacccagattaggtacaccatagctgttcagtgggtagggccagataccttcccttaacacatatacattcgtatgtaagagggtactttctgccaactgatgattaagttaactcagtgctaactggtgccataatatagcatagagctgtgtcacatagacccagtcctcagtgggtctctctgatgcaaaggaaaaagtgagtcctcggttcagatgacttttttcttctcctagcagccacaatattgctttagctcctagctcttggcctactcatttcaaacttagaaaaaaagctatggtattgaactgggacatagttcaggcccaggacagagattttaaattaatgtctggggtatccaagcatgtgaaggcatagacacatacatatgaaacccatttatactggatacaaaaacttagctgaaaatctttccagtcgaccacctcaaatagttggatccatttttaataaaagtaaggctgatttggtgcaactacctttcagttaggatcagaaggggtagatggtggtgaaagggctgaaaatagaggattccacctagaaagcacaaactaagctttaatattgtctttcttgagtaaattttacattgtgaattctggtctcactacccaacaaaaaccatgggtgagagaaattaatgtccttagctttcctctggagacatctttttgttctaacacagagaaatgtttgccaataaaaattcatacccaaatgagtacagttattggttaagatgaaatgtttctcatttgaaactttcatggttgttataaagaaaatttctgcatcccttcataaacgttgagactgactgaaactgactgagttaagttatagtatcaatgaatagccacacattttctactttaaaaatataagtgatcagagagccattcggctcaaaagaagatgattgtcatccagtcaggaggtttgttgaaccttatagaatacataagataaagttataaaatgatagcatcacttacacactgaagagttataattgagatgcccagttgctgatggtagctaagatgtttgtgtttttctgaaaaggactcaatgtggcctaatgttcttgccttctatgctatgaatccttcaaagcatcactcatgcattcaataaaactttattgtatgcctactatgtgccaagcactttgataggctctcaagtttgtgctattccttaaaactttttcctgctttgtgtcttaagacattgcatttccctcgttctgctccttagtcatagatgtagcctttgctttctcttatttacctctaaaatgtaggtgtttcccaggactttgtccatgttttcttctcttattctgtactccccctgggtagcatctctcagcacaatctctacatttatgtctcctaatttctacctctggcttctctcctgaattcaaaatacaaacttccagatgctctgctggcaaagtcatcatggctattctgttgataccttcttcatgatccaagtgatacataataccttctgcctaatcgccaactccaccttcaaacctgctccttcttccttatatcatttattggtaaatgtcactactgtattacctgtcctccatgttagaaacctaggcatctctgatgccttttttccttcctatcacatatattgagtctgctttcatagcctactaattctgcctttcctgtgagctctcttttttccatttccacctccaataccttattttagaccagtaattacaaactgacagcctgcaggccatatgtgtttctttcaacagcagtgtttatttttaaaaatgtaacatcctctaaaatgaacatatactctcgagttcaccatgtttctgctgtatcttcaatggtgctaagccagtaccttttatataatagatagttaggcagtatcttgaattgagtgacttgtcctcggaaagcttataacctggctggaaaacatgaaatatgtatatgtaaaatgatttagtaacaacccaaggcagactataagaagaatgtaaaagaaaagtggagcagacaattagtttttcatgtgatgagagaagggagagatcattttgggagtaaccagagaataattcacagaggaaaaggcatttgatcagagctttaaagagtggatagagattatgaaatattaaataaagttgctttattttgatgtttacatcctaagtaaggactttgttgcaaatactgtggattaatgagggagaatgggtacttatttccctcaaactccaaaccatgggacaaatgaaggggggagggcccgtgatgattgaaaagagtaaatataaaactgataggctgggtgcagtggctcacgcctgtaatcccagcactttgggaggctgaggcgggcggatcacaaggtcaggagatagagaccatcctggctaacatggtgaaaccctgtctctactaaaaatacaaaaaattagccaggtgtggtggcgggcgcctgtagtcccagctactcgggaggctaaggcaggagaatggtgtgaacccaggaggcagagcttgcagtgagccgagatcgcgccactgcactccagactgggagagagagtgagactccatctcacacacacacacacacacacacacaaacttgataaatggaggtgttactctaaagggtaagaagtacatttccaaaagtatcaatagcttcagatatatttagaactttcaacaaactcatttgataaatttatgaatggcaagacatgggttttaagagaaaccacaaagtttgggaaaagatgcttggaaagtaatcatgccttcctattatttgcttctttgttatctatttaaagattaaatatagggctgggctgtccatgctacaggcaggcccagaagccctgttttgatgttttcattacctacattctctcctacagtacagtgatatatattagaggactttgccttagttgatgttactgtcaggattgtaactagaattactcatatactctttgctgatgaagaggtaagcctgtaaacagcttagcaggaaagaccatgccttactttttttattagacacagcacctagaataatgcaacaaacatagaggctgttcctaaattccttttgatttcctctggctgaatctaaaggcaatatttgtttcttggagcctgaatcttcatctagcctcagacacaggttatacctacttcctgcctatccctcttccactattctctcctcctcagagcctgttgtactctgttatttttgaaagtccttgcaattccattatcatagcattgcatataggctagttctatggtgaggccaaggggagttaaattgcaattaccctactccagctgggcctagcaatactgcatttgaaaagagtcaggcttttgaaggatgacctttttcatcctttttttcttctccttcagcatcttttgctgccaccacctcctcctacaactgaccatctgaagcagtttaaatatctgctcatttaaaacagcagcacaggctgggtgcgatagctcatgactataatctcagcacttttggaggctgaggtggatggatcacctgaggtcaggagttcgagaccagcctggccaacgtggtgaaaccctgtgtcttctaaaaatacaaaaaaaattagcaagatgtggtggtgtgcgcctgtaatcccagctactcgggaggctgaggcaagagaatcacttgaacccaggaggcagaggttgcagtgagccaatatggcaccactgcacatcagcctgggtgacagagcaagactccatctcaaacaaacaaacaaataaataaataaatacaaacaaaacagcagtacagcaaactgacatgtggccccaaactgggatgttgtgctagtatctagcccatcactgtcaaacccaggagtctagtgttgtttttgatggtttctcttggatgctgtactttgttatatgccatgtaggttcctttttggaaagtctaggatttccccaaaacatatagggaatcgtgtatgaagtctccaaattaatagctcatctcagattttagttgttggaattctctcagcagatatattttcagaatctcatagttaataatatatggagcatttggaaagaaactaaagacagggagatgatggagaagttgggaagatatatgaaacatatgggtaggaggataaggggagatacattttaaactaaaacattaaaatgaaggatcaattttaaaaaatcaaaacccctgatttttctaatcacaatctaatgttatccttaggaggcccttatgcttataccaggctaagcacagagcagatatatcatctcagaaactacctgtctgctcaaaagcgtaaaggaaacttagtgagggaggcttctaattagaattaagagaaactgaggcagatgatgatcagatgtaatcagggtagacaatatacatagaacgaaagccaggttacttaattatattttaaactagattatgcaacatataatcagtggcatactaaggctggagccacggaagcagtccactccgggcacaggaaataaaggagtgcattgtctgtagagatataaaagcagtaataaatgtgattaataatcagtttgacttggtgtgcacattattatcactttggagtgcccaggcttaatccttggatttacctttcttttctgtctatatttactctttaagtaacttctatatgctgatgactctcaaattaaaatatctgtatctatccaactagtaactccacatctacatagtggaagtctaataaacacctcaaatgtaacatttccaaaattgaattcctagtatctccataaaacctgcagtcttccccatctcagttgatggggtcttcatccttctgattgctcacaccaaaattcttggagtcatccttgactcattcttcttttctcccacagcacaaccaatctatcaggaaatcatcttggctctaactttgaaatatttccagaatctgaggactcctcaccactctctctgttatcatcctggtctgagccatcatcatcatcatgacttgcctgatttactgcaaaaatctccaggctggtctccctgctaaactgagaataaaagcttaggctcctttagtggcccacaaggccatatatatctggtacttggataccactgtgacttcgtctcctgttcctctctccttcactcccttcacttcagccacattggccaccttgatgttccttaaacacacctgagcatcctggggaagtttcttctgcctgtgatgctcttccaccctgataactgcatgctttgtactccctcgtctctaggtctttgatccaatatcaccttcccagtgaggtttatcctgccctgcctgtttaatatgcaacttgtccccactccactcccacctccccatactctcaatccaccttactctgatctaggcttttctttgatgcatatcatttgttactttctaatttttcatgaaatttgcttattaattttgcttactgtttattgtctgtcttccctcactggaatgtaagtgtatatttttgctcacacattcccagtgtctcaatagttcctgcttggcatatagtatgtattcaataaattattgttgaatgaatacatgaattgtatttaactatatatatctattaattatggaagtaatttaactgactgaaattagagaaaccaggcatggggcacatctacacatcacaaccaggcacttcaacacagacttttttgttccctgaagcatttgtggatgtttgtgtattgtttcctttagattacaacctaatccttgacagaaattgtaagtgcttgttcatacatacttgcaattgcttactttctgccagtctaaatcaagaatatattataagaatttccctggtttgatgaatgtcacttactgcaattccttcttacacatttgcacatttactttttattgtttgtattttcttttcttttcttttttttttactgaagattgtttagaaagttctatataatatagaacttttaaaaataagcatgattgtttacctaccctctcatccatctagatatttccagtgagaaaaaaaggaaggcaaaaaagagaaatcacctggaaggttaccagaattaactcttaactggcatttaaaacctttaatctctaactgccctgtaaacaagatagtactttcatacttaactttctgtataaatcaagcaccttttttatacaaccttatgagaactgctagccatgtgacaaatattaagaattgatggccaggtgcagtggctcatgcctgtaatcccagcactttgggaggccgaggcaggcggatcacgaggtcaggagatcgagactatcctggctaacacggtgaaaccctgtctctactagaaatacaaaaaattagccgagcatgggggcgggagcctgtaatcccagctactccggaggctgacccaggagaatggcatgaacctgggaggcggagtttgctgtgagcggaaagatctcaccactgcactccagcctgggtgacaaagtgagactctgtgtcaaaaaagaaaatgtggcacatatacaccatggaatactatgcagccataaaaaatgatgagttcatgtcctttgcagggacatggatgaagctggaaaccatcattctcggtaaactatcgcaaggacaaaaaaccaaacaccacatgttctaactcataggtgggaattgaacaacgagatcacatggacacaggagggggaacatcacacactggggactgttgtggggtggggggaggggggaggcatagcattaggagatatacctaatgctaaatgatgagttaatgggtacagcacagcaacgtggcacatgtatacatatgtaacaaacctgcacgttgtgcacatgtaccctaaaacttaaagtataataataataaaagaaaagaaaaaattattatctgtatcttacaggcagggaacataatttagtaatttcatagaaaggtctatactgaactattacaaatgtttttaagtacctgatttttccccatcattaactgtggttttctcttcaaatttctttttcaactttcaacaagaacatcctgctgaagcttgtggccacatctagtacaattgtcctcaaaggcttgtgctgagaagaatggaagatcgctagatagcttcctagggcagtgtaggattgaagggaagagagaacctcagagcaaactcagttaattctgatttaatcattaatgaaccagacaacaggctatatttacgaaactgttaatcaaaacagacaggatgtaaatttctgggacaaaatgttgaaaatatcaattctgtagcaaggttaaacctgtttattatttatttaatctcaagacacagcagaccatttattgattaatgagaaataagaagcatgttgcaattaaatttaacttgtaagtcaggaggccctggcaatttggtctgatactatatgactttgggggatgaattttgaaaattcctactccaggataaggaagacctcatttatttctttccaaggtctcatatatcatgttttatcttaaaaggaaaacagggaaggacagcaattggctgcattctgaaatccaggcaatagatctaacatagctattctattaaaaaaaaaatgaggaatcctcgaacatagaaaacattctacacaaggttggtcaggtagctatgttgaagaggcaaagtccttggaaggcccatttgtcctcagaaaatcattagacacagctagtgaaattctgactctccatcaagcaaggcaaggctaactttgtatgtaggtaatatgttctttgcagtatttctttattttatgtcttttaaatgaaaaacaattaggaaagctacattgtaaatatttgtaaaaatagaatgagttttaaaagatttaccccactgctaccattcctataaaacttttattaatattttgatgtatttcatttcagtctttttttctatccataaaagttacatagttgtaatcatactgtccttacaattttgtatggtgctttttaaaacttaatattatatcataagcttttccaaactgttgtgaaattctcttaatcatgattttaatgtctgtaaaatgatccattgaatataccatgatggacatttaaattatttccaacttgaaccatagtaaataactatttggtggcatgtacccccatagttatttctccataactggatttttttctttaatgcagagacccacaaataaaatcattgggtcaaagaacatagctcttttagcgaattatattacagtttgattttgtttttacaaaaagtatagtgtgtgcctggaaagatacataggtacttaaaatttaacagtgattatttctgctgctgggtctacaaataaatactaacgaatagttgcttttctttcttttttacttttcgttattgtcaaagttttctttttttttttttctttctttttttcatgagatggagtctcactcactctgtttcccaggctggagagcagtggtgtgatcttggctcactgtaatctccatctcccaggttcaagtgattcccctgcctcagccccctgaatagctgggattacaagtgcatgccaccacacctggctaatttttctattttcagtagagacggggttttgccatgttggccaggctggtcttgaacccctggcctcaagtgatctacccacctcagcctcccaaagtgctgggattacacatgtgagccaccgctcctggcctttattgtcaaaaatttctacagtgaatatgtattcctttttaagttgagaaattataataggacaaagacagagtaaagtgtaatgacttaaactcgggctttagaggcagactcctgggtttgaatttctgcttagctagttactagctctgtgatcttaggcaagtaacctctttgggactcagctttcctgtctgtaaattaggataatgatggtacataagctgttgacctcatgtctgtgttgaggattaataaattaatccacatgaagtgctgaaaacaatgtctggtatataataaacaccccataaatgttcaatatcattgttatttgggactggacagcaattcaaaattcctatccctcatacagatcatgccaccctctctgaaattctaatgttggcaattcaatccagtatagttcattcataggacaagtatacttgactttacttaagaattgaagtgattagaagagggagcatctgaaactcagatccttctgccgtcttatatgtatacgttattctctgtgctctccagaatagtctaattgaagaaaaaaatgaggatatgctgagagccctggttatatgccataaatagctctggtttgaatgagagggaaatacaaggcagacttttaaagacagtaccttacaattttatctgtgacaggcactgaacttaaatattatgccatgaagtatgactatgaacatttatagaagtagatatgtcttggtacaaatctctgtcattcaaagatggctttcccctcgaagcaaaattgattgttttgcttcattgaacattgcaaaattggatatcttgtttactcttccatataccaaagatttataaggtacaatctattagtaaatataaaaatgagaaccgagtttcatttttaaaatacttttagacgactaatctacctagagacctacatttaattctggagaataatctataaattcttgaatagatatgtcaatgccctttatcataatcaccctagtttaaaaatcatttatcagatgcctactcaattatctacgtcgtatctttttatttcccagtataaacaaatacgcatactagggaagctcactgtgtgggatcaccagagaaattagttcatgcagtgaataattattattttttccatcggatagttaagctcaggattttcatctgtgtaacttataatgtatttctactatataacatagatgaggtcgtgttaatatgaagccctcctgcccttctgagacccaggacagtgtttggcagccttctgatgctttaatactttgaagaaaagaagtaaatattcatctaattatctggaaagttttttttttcatttcagagactcaatagcctatgtaaaatggacaccaaatcattatttcccaattaaacttttcttgctctgagcatgatagtggcatttttttaggccatccaccaaacaaagtgttgttcctcgttcctccagatgttaccatcttcttttcatgcccagggatatacaacggaatgtgtcctcaggaggtagttagaaattttgtttgcctacacttctaagtctcaaattaaaagacatcaactactggtgtatgccagtcattgcataagcacaggaatagacttaagctatttgtctaaatttccattccagggagcaacaagaaaatcataccaacagtataataaaaaggcatttgaagctcagggcatatctattgtctcctttatggcaggcttgagagaggaagatattatttggacgaggagtttacctaatatctgcgacatcactcaagcctactctaagcttttcttaaactgtcctttacttatgtagtgctgtaaagtaaaaataattaaaaaaaaacaagcattgtcttaagtggataccactgagcgtaaagcctacaaggtgtttgaatgggctgtctctcacttaagcctaataaactctgattgtattaggaaatgtagtttaataactcctgtaaaccgggagtcaacaattctgtgtcccagaaaaataaaatgaaataaaagagttggaaattattgagagctttgaacacacaatgtagtggatgaacacaggcatttcacttttgatttctatgagcagtaatttttttgttataaaaacaagaaaaaagaaaactactgtcatactcagatactcacttccctgtactagtataactcatgaggaaacaaaagctctccctatgagtaagctccagaatctatcagaaaataaatcaccttaattttcattgttattggaaagccttctgccaaatggggaagtagatgttgtactgactgaagcttcattttgtgacaacagcaacatagggtctgacttggaaggccttgaagaaggctgtaaggcctttgtaatacaggtttgcggggacaggactaacatcagtagacaagctagctgagatagagctggctttgactgatcggggctattatatttccaagatgcagcctagcctctgagtatcagaagcagcttaagtattaagggggtggtggtgctactgtagtttaaaagcagatttttaaaaaaagactttattgtgtaataatttagcattgagaaaaatagtaaatgtagctatttttttctccaggtagaactgttgaaagggacaattttaaacagccttcttcacttttagcagatataacacatagattgtccttggtgagaaaaaaggcttgatgtcaagtccagaagaaatgtgaatgtggaattgagtttgaaataaactgattcccaatgctcccattcataaaactgcatacagacctgtgtgttgagtgatgtacaatctttttgaaaattcactgatttatatcagtcattttattcctcaaactcttcttcatagcaccttccccatgcacccatacctccaggtacctggaaagggtttgtctttgtgtccatttcttgcttctgactcttgaaccaactgtataccctaagccaattgcacacatactatagagtataatggtctctggagtcaggcagaattgggcgtgatgcctgattggatcacttacagttatgtgatcctgaacaatgtaattaactttctgaacctagttttccacatatgtaaagtggagctaataatagcacctacccttgaggattattttttgcctggaggattaagcaaggtaatgtaataaagagctttgcacagtgcctagtaaacactcaaaaatagtggattctgctttcattttttgttggagtattgtaatttattcctcctcccgctcttccctctcttcctccatcatcatcatcatcatcatcatcatcatcatcatcatcatcagccaacatcacctatagaggctacctgggctacctggttacggttggtcatagactcatacctctaggccacagtttctcaaatagcagcactcttgacattttgagccggatagttcttggttggagtgggaagaggttagcctgtgccttgtaggatacttactgtaggatgctcatttaacagcatccctaccttctacatactggatgccagtagcacacatactccacacctttgtcgtcaagctatgcaaccaaaaatgtctccagacaatgtaaaatgtcctctggggagcaaaattgctcccagtcgaggaccactactctaggtattctttggcttaaaaatatccatgaaaagtatctaccattcatgtatctattactcttcattagtttgactcatttcatccagtaatcttggtctttatcttaaattctcctttagattttcagagttctctggtttttatcttgatttttgaaactaaatcttatttctctattttccttactacaaaccagcaattctttgatagccggttctgggccttaatatatctctgaactaacaacttactgttttttgctttgagctaccagcacttatctgcacacccctagtgctaggtcactggtatctagctagagcctttcctttaaatgtttttataaaaggcagttgaaatgaggactctagagccagatatcctgggttggaatcctggctcttccaattaatagcttagtgactttaacctctccattttcctccatttaagaaatgaatacattaacagtcactatttcatagagctgttgtgggacttggtggtttaaataaataaaaatttacttagaacactgtctggcatatggtaaataccatgtaagtgtaaactattattattactattctcataaagactcccatgtgtctttactagcataacataaactaaactgcaagccccatcttagtatgttatgaaacgccaggggttcagtgtagctcccattgctcacttcacagagagccaatcactgagacaatgtgtattgccagggaggaaaggctttattcaggtgctgcagcaaaggagacaggaaataaatctcaaatccgtgtctccaacaaactaaaagtgggggtttatatagcagggaaggagtgcagctatgtgcaagagaacaagaattaggagaaaggaagcaatcacgatgggtgaggggtctagtgtcttattgtttgaatgtggtgatctggtaagtttcagttccttgatagtatcagggaggcctgaagattggtttcctgaggaaggaactcagataagacaaatgtgagattcaagatttaagactgtgagggtcaatttctgtgtttattcaaaaagactataaacatcagttcttttggacaattggaccagtttcaagtgctctggaagactaccaatgttttcacctcatggtacatattgaaaattttaaatatgtattcagcaaattggagttaatcgtggtggctctgaccacttgaggactgaggtgatcaatatcttagccatgtgtaactgacttgtgacatgcagttgtccacagcactgtggtttgaaaactttgcaccaggctcatcaaaattaaaggggaaaggttttaaattgtaatccagttagaaattgtgatttcctttttggatgtgtaagatcccagcatcttctaggtccacaggccttgtaaggtctatagctgccctttagttttcttccttgaacaagctaaaataaaacaaaggcaatttctggggaatatcatgaggttttaaacatgtgtacatgtttctctctaatagttcagaatctagtaattcccacaagtataatggtatgagaatttaacccaacaatgttagagaacagcagctcttcattcaaatttcacatgatgacccactcattctattttgtaattttcttttgaaaggtttggggcagaaatagctcagatattttaaaaagagctattttctctgtttttctgtttgagtcctgtggctttcattttatggcatgagaggactgtttttcatttgtaacctctccaagtactgattttaagcaactcattaacatatgcttcctcttcataatccatcacattcaaacatttgattggtctcttcagcacaatatgaataataaactatcttcctcccagagacattcaaaattgtggtttagatatgatgaaccagaaaaaaatgttgttttttagtccactttttgaaaagtctcttagatgaaaggatactacaaatgaactttctaaggtaaatcagggctttggctaaaaaaagccaaacatttcagtcaaggtctgacttacaaagcatgctgtcagccctaccagaatatgtggcactggacacaatatacttcaatttttaatttctattgtcaatgccttcgtttatgcctttattagtttatgcctcaactttggtgatagctacatattggactgctttttctcttccaggacctcccatatgagttcttgaaacgtagctttgatagtatcatttcactccaccaaaaccttcaatggctccctaatgattgatgaataaattcctgggaatcatagaaatgctagaatgtcagtgttggaatgaatcctgaagtataattcaccagttgccaaactatggtctctggaccactgccagaagtttgcactagtcctcagtggaaagagaaaaataaggacaatgaagtcagtgttccataaaatgaaatttacttattttaaaaattatttaaaagtatcttgaggttgggcatggtggctcacgcccgtaatcccagcactttgggaggtcgaggcgggtggatcgtctgaggttggaagttcaagagcagcctgaccaacatagagaaaacccgtctccactaaaattacaaaattagccgggcatggtggtacacgcctataatcccagctaactggggaggctgaggcaggagaatcgcttgaacccaggaggcagaggttgcagtgatccaagatcatgccctcgcactccagcctgggcaacaagagcaaaactcttgtctcatgactaaaacaccaaaagcaatggcaacaaaagccaaaattgacaaatgggatctaattaaactaaagaacttctgcagaggaaaagaaactatcctcagagtgaacaggcaaactacagaatgggagaacatgttttgcaatctatccatctgacaaagggctaatatccagaatctacaaagaacttaaacaaatttaaatgaaaaaaaacaaccccatcaaaaagttgccgaaggatatgaacaggcacttctcaaaagaagacatttatgcagccaacaaacatatgaaaaaagctcatcatcactggtcattagagaaatgcaaatcaaaaccaaaatgagataccatcccacgccagttagaatggtcatcattaaaaagtcaggaaacaacacatgctagagaggatgtggagaaacaggaacacttttacactgttggtgggagtgtaaattacttcgaacattgtggaagacagtgtggcaattcctcaaggacctagaaccagaaatccagaaatacgatttgacccagcaatctcattactgggtatatatccaaaggaatataaatcattctactataaagacacatgcacacatatatttattgtgacactattcacaatagcaaagactcggaaccaacccaaatgcccatagtgatagactggataaagaaaatgtggcacatatacaccatgcaatgctatgcagctgtataaaaggatgagttcatgtcctttgcagggacatggatgaagctggaaaccatcattctcagcaaactaacacaagaacagaaaaccaaacaccacatgttctcactcttaagtgggagttgaaaaatgagaacacatggacacagggaggggaacatcacacactggggcctgtcagtgggtggggggctaggggagggatagcattaagagaaatatgtaatgtagatgacgggttgatgggtgcagcaaaccaccatggcgcatgtatacctatgtaacaaacctgcacattctgcacttgtaccccagaacttaaagtataataataataaaaaaaatcttgaactttgttttgaaatatcttttattttatatagtgacagcattaatagataataatttatttgtttattgtttttaatgtccatacttggcaaaatgaagttggcaaccatttgttgcttcacgtcccccatcccccactttttatttttattttttattttttctgagacagggtctggctctgttgtccaggctggactgcagtggcatgaactcagctcactgcaaccttcttcctcagcctcccaagtcacttggactacaggctcatgccaccacatccagctaatttaaaaaacaatttttttttctagagacagggttttgccatgttgcccaagctggtctcaaaatcctgacctcaagagatctgcctgcctcagccttacaaagtactgggattacaggcgtgagccatggcacctagctgccaccccgaactttttaaattttacaaatccatgaaatccaaaatctgaaagctactcatttcataaatgagaaaatttaaaaaagaaagattaaatgacttacctaaggccatacttatactgggaatgctgtattacaaatgttaatattagcttcaagtctttaccataaatttcaaagtcctctgtacttaaatcccagtatgcatttgcgtctctattatcagcatatcttaaaagaaaacctagttctagatccctgaggaatcaccacactgacttccacaatggttgaactagtttacagtcccaccaacagtgtaaaagtgttcctatttctccacatcctctccagcacctgttgtttcctgactttttaatgatcgccattctaactggtgtgaggtggtatctcattgtggttttgatttgcatttctctgatggccagtggtgatgagcattttttcatgtgtcttttggctgcataaatgtcttcttttgagaagtgtctgttcatatccttcgcccacttgttgatggggttgtttgtttctttcttgtaaatttgtttgagttcattgtagattctggatattagccctttgtcagatgagtagattgcaaaaattttctcccattctgtaggttgcctgttcactctgatggtagtttcttttgctgtgcagaagctctttagtttaattagatcccatttgtcaattttggcttttgttgccattgcttttggtgtttttgtcatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctacatgtggctagccagttttcaagcaccatttattaaatagggaatcctttccccatttcttgtttttgtcaggtttgtcaaagatcagatagttgtagatacgcggcattatttctgagggctctgttctgttccattggtctatatatctgtttaggtaccagtaccatgctgttttggttactgtaggcttgtagtatagtttgaagtcaggtagtgtgatgcctccagctttgttcttttggcttagaattgacttggcaacgcgggctcttttttggttccatatgaactttaaagtagtttttttccaattctgtgaagaaagtcattggaagcttgatggggatagcattgaatctataaattaccttgggcagtatggccattttcacgatattgcttcttcctatccatgagcatggaatgttcttccatttgtttgtatcctcttttatttcattgagcagtggtttgtggatctccttgaagaggtccttcacatcccttgtaagctggattcctaggtattttattctctttgaagcaattgtgaatgggagttcactcatgatttggctctgtgtttgtctgttattggtgtataagaatgcttgtgatttttgcacattgattttgtatcctaagactttactgaagttgcctatcagcttaaggagattttgggctgaggcgatggggttttctagatacacaatcatgtcatctgcaaacagggacaatttgacttcctcttttcctaattgaatactctttatttccttctcctgcctgattgccctggccagaacttccaacactatgttgaataggagtggtgagagaggacatccctgtcttgtgccagttttcaaagggaatgcttccagtttttgcccattcagtatgatattggctgtgggtttgtcatagatagctcttattattttgaggtatgtcccatcaatacctaaaaataccatttgacccagccatcccattactgggtatatacccaaaggattataaatcatgctgctataaagacacatgcacacgtatgtttattgcagcagtattcacaatagcaaagacttggaaccaacccaaatgtccaacaatgatagactggattaagaaaatgtggcacatatacaccatggaatactatgcagccataaaaaatgatgagttcatgtcctttgtagggacatggatgaagctggaaaccatcattctcagcaaactatcccaaggacaaaaaaccaaacactgcatgttctcactcataggtgggaattgaacagtgagaacacatggacacaggaaggggaacatcacacaccagtgcctgttgtggggtggggggagggggaaggatagcattaggagatatagctaatgttaaatgacgagttgatgggtgcagcacaccaacacggcacatgtgtacatatgtaacaaacctgcacattgtgcacatgtaccctaaaacttaaagtataatacaaaaaaagaaaacctatattctaaacagtcatgatcattttccattccttaaatgtgccttgcagttgttctttaccctacctattctcctaaaatcccacccagctcaagtgctgactctattaccatacctcaatgtcagaagggatcctttgcttttctgtgcttccatatgtggatgctacttatcagcatattatgtcttgttcaacctgtcatcgtctgtggactattccccctcctatgctctccatttcagtaaatgacattaccctctacccaattgctcaagctggaggccttgaagtcattcctttctgttccctataccaatattgagttaatcacaaagccctgtcatctttagctccccaatttatcctgtatatgtccactttaattcttccactgaactgctacacagatcaccctgtgtctccttgttccaccatgcaatccattttttacctaccggccgcttttagatctggtactgctccttgtaaaatcctttggtggttttccatagccctcagattaaagcctagaatgtcaacatgttaatacaagatatgtggtacccatgcccacttctccagcctcatctcttcctactttttaatttgcgtcctttgctttagctgtactggatttcagttccttgaatgcatctgtctcactattgcatgcttttgcttgccgattttaattgcctctcacttctctggatcttcacacatgctatggagtgaagcctacactgcctgcaatactcttccttctaggaaacataccttaaggctctaagtttcagtttgggtgcgccgtagcagagtacctttcctttaccatagcactcaccacattatattgcaatttcttgtttaactgatttcctttctaactagactatatgaaccatgaggccatggatcatctttatgttgctcaccattgcattcaaactgtcagctctggcacatagtaggtactcaataaatgtaatctgtatgaatcaaaatatcatactacatttcctcttatactgttgagactttcatatttgtggtatttccttgattctattacaaattcctataagtggaaggcagtcttttataattactaccattttatagcaccacacacataggctgctggtaaatatttgataaatagatgaataatctatttttttcttacagggtcgcgggtaagaattagagtgcatatttgtaataaacatagaatgcagcacaacaaaataggctatacaatctaagaagtttggactaatactagtattgattgtttatagcctaaaaggtgccccccaccaccgtaaaatacctgctttaaattgggaaatactctatggtttcatcaaggttaaatacgattttacaaatagggattctgatacatttcaagggtaataaaaaatgtaaaaatcttaaaatgacttgtgatgccttgactgctgtggggtgtgtgtgtatgtgtgtgtgtatgtgtgtgtgtgtgtgtgtgtggtttgtttcttgggggctgaactcagctggagtttccatgaagttatgggtagggtgatagatttacattgaaatatttcactttatccaaaagttagttcagtttttcttaatgggagattttttcaattgagaatatatttttgcacttcatgtttattgattctctttccaacatccagaacatacagcaatatcatcagtcatagatagttcatattgcacataatgggctctaatatcagtctgtttgtatatatcataatacctgaattgttcaacaaaatatctcataaggcaggaagcttcttttctgttttctgtttttgatagactcaacctaaatggataatgttctttgtaaaaggtgagcaaaacatcagcactggtgatatttattttacaggatgtgccacaagcctggctcactcctcttacttagaagggcattacctgctgagaccatttggatttgttgagtccagtgcaaactgaaacagtgacctatgtgaatgacagccaggtaaatgtcagaggacaatgccaaaaagacatattaagttcaggagttgaaattgtggtaagcattagtgcccatcctcaaagaagtcttctctgactttcctgtgcaaggcagtttcctcgctccccaatttatgatgctatatcaaactcaacaaaccttggtaatggattgaatgatgtgggtgaaggaacagaaggaagaatcaagaatgtcttggccctaggattattatctggctcacggtaagctctaaataaatatctgttgaaagaaaaaatagctgggaataatacacattttgtcaccctcagccacactatgcagactataaaattgatgcttgtttacatcattaggtggccatatttacattaaaaccacagttttaagagccaaaaaatcctgggttcaaatcctgacttcaccatttgagctatgagacattaggagagttacttaactgagtctttctttctcttcttataaaaaggaaatcatctcataccaccctcacaagatgatggtgaagattagatgagataatacatttatcgtacttagaagaatacctggcagaaagtattcgtagagggtagttatcattgttgtcagaatgtaatgtacttaagtgtcttgaaaatagtaaatattcaataattgttatctaaaagtattataattatcactaccataatagttttatagtaaattattttcagtagaatgcttatggtgacaaaaattacactttttcatattattgcacacaaatttttagtcttaatttcagtaattgttatttcttaaaatatttggtatagacatgggatatctttttatttaaatcaataaagggaatggttgttgctcttataatttatgcaaattgttcataaatgaataaattaaagcatttatttgtactaactctggtagtttgctaaaaaaaaaatcaggacaggctaaaagaagatatggatataacggctgcattgtttttgctttttttgataaaccatatttcaaattcattcacagacattttcgctttcatgaatccaagatatcttctctagtttctaaaagtatatatacacatatacacacacaaggtatacatatactcacacattcacaatattaaaatgtttgggctaggtgtggtggctcatacctgtaattccagtaatttgggaggccaaggcatgaggagctagaggaggctgagttgataggattgcttgagcccaagagtttgaggctgcagtgagctatgattgcaccactgcactccagcacctggatgacagagcaatatcctatttctaaaaaaaaaaaaaaaaaaaaaaaaaaaaagtttgctgcctgctgctgcctaggaccacaatggagaatggagaatagttgaagaaagtgcagtacagaagtttaggcaagtggtaattgttgttggtatccatagattgagccaatgcaaatttgcaggctttagaaagatacctctgctgttctccagatttattttctaatttcaccttatatgttttttttcctacacgtttttcttttactgtctcataaattttatgtcagtatgctatgactggatatttaggaggaaacaaaattgcattgttaaaaagttcagtctttttttttttttttcttgaaaatgagctgctaactgggcacagtggctcacgcctgtaatcccagcactctggaaggccgaggcaggcaggtcacttgagctcaggagttcaagaccagcatggtgaacatagtaaaaccttatctctacaaaaaatacaaaaattagcttggcattttcccacatgcctgtagtcacagctactcaagacgatgaggtggaaggactgcttgagctgggtggtcgaggctgcagtgagctgtgttcacaccactgcactccagcctgggcaatagagtgagaccctgtctcaaaaaaaaaaaacacaacaacaaacaaaaaaaaaaaaagaaaaagaaaatgggttgctttttaatgctatggttagtggttagcaaaccaatagcatcaatccagaatcttcatcgaataactatggtgtgtcgcattctaagggagtaaatggagtaagtatgagactttggctctgtaaggaagtaagaaaagtgaaagacaaaattgagcagaagtagaagctgaccgataatgtagttgctacggcctcagcagatcttacagggagatctggagttaggatgggtctctggatgattatcccaaattgaaacaagggggctaggcttttgaattccttcatcaggcagtctttggccatacgccactccctgctaaggtgttacctttgggcatacagctccttatagccaaggacaattcccattgttgtggctctagctgcaaggattggtaacttgatattctcaacagttgtgggataggtgcattggcccctaaagaacctacccttgaccaagcaccagagcatttactataaggcattgcaacttgaactgccctttaaaggctggatagaatttaagtagatgtagaggagaattgacatatatgcattcctgggtggggaatggtatgggaaaggacaggctgtactggagacagcaaataaatcagattttaattcagcttatatttattgaattactactttgtaaaggtactatgttgtgctgggaattttcataatgtggtacctcatttaattgttataaccctttgatttaaatattatttccattttatatatgaggaaaatgtatctcagcatggttatgaattgcccaaagtcacccatgaaaacagtattagagctggcactcaaatccaagtttcctagctctaaagactctgctttttctgctacaccatgttcatatgtctaaaaatggaaaattacacttacaaatggtggcagtagattatggagagtctataggatacattctggttcttggtcccatactttattgttttggtctctagttgtctcagaaattaactgtaatttaataataataataatacatttagtaatagtagttttaattaccattggttatcgttcaccaatactatgttaaatttactcactctttctctgtggattattgcattgagtctttactgtaaatctgaaaaaggtagtattgtttttattttatgtatgaggtaactgaaacttagaaattgtccacgatcacatagcaagaatgtgacagagctgacattagaacccaggtctctctgactcctaaagtccatgattttaagcactacattttaagcctacctctttgtatgttttatagtcctttatacatcaccgagcacatggttttgtgctattactatacttaactattacttatcaccttagcaacttgggataagtaattttgtctgtctgcttcagtgtctaaaatttttactcaagtgaagcaatacctacccatggctaatgggaatactatatgagaccagagagtgaagcagtgaactcaaaaaaatgggcttatacctgatttctttcaggctctaggcctatgtcaattggattgattttattcattgtttcatgcctactcttcatccatcctttattacaacaaatatttattgagtcttactgtgtgcctgtcactgttctagatggtgaaaaaaaggcaaagtcctgtcctcatagagtgtacgttctagagagtgagacagttgattcactactaaatatataaataaataataactcaagatagtaataggtgctctggaaaaaaattaaagcctggaagagaatgggaagtggcatagggtggggaagggggctgataatttagatagggtggtcaggagaggctttttgataagatgatataaaagtagagacctgtgggaagaaaagtaagccatacagatattttgaggaatagtgttataggcagagaaagtgaataacaagtgtgaaagcccaggggtaggagcttgactggcatgtttgagagccaccaagatccaattaatgatatgttattataatattttgccaaatgactcaccagtgatataaaagatttaaaagccgtttccaaagtatttccctgtagagcagatttggaatgtgatgaaagagggaacaggaccaatgggaaaatattaaagtgtttgaagccaactcatcaggatgaaataaatgagatgggctatttaatgattatctatagcagttccatataaggtttttataaagaagcagtggaatagccttctaaagactaagctcttccctttctcttaggaggtaggtacgaattagaaaattaatcaagagagaatgtggcctctgatgacatgagagttgtttgaaggtggcaggaggcaggagggtggttgcattcagtcaatagttgagcaatttacaaaaataaatagaattgagcaaattcagaacagatttaatctccattttattttcaagctaaacaaaagatgctgatataagggggaaattactccaaaaatccagctttactgacatattttgagtcatttgcatgaataaaatggtcctagagacaagtgcgaacttgactttaaagtgaataggcctggaagtgttttctgacggagaattagtttggtgcattcattcaatatttattgatataatatttatattcatgttattccaaaaaagagttgaagcagattgcaaagctatgtatataatccacaatacaaaaactaagagatgaaatcaggaggaaataataagaataggagaaataagataaggtcaagtttgggtaaaataaatgtctaaactgtatgtcgtagttagagacaggccacacacatttagctctgagatttctagaaacaactgaaagagtcctggaaactgagataatagacttgtattgtgttaagccactaaactctctttcaaaccattccttagttctcaagggaagacatgaggatgggataaacctccaggggaattggggtactaactttcataaagatttttacttcttgaagaggacttaatttcaagtctatgtagaagcagaataaatgggttatgtgattgtttaaggttgctgaaagatctttccttatatgtagaaacctgtattggcttttgagctacttgaatgtagcaaactaaatattctggaataggatctgtcatcctctacatgggacgctcttttgtatgatacccatccactcttttgcactttgaacatttcaggcctttactgagtatgtaattactgactgctaaacaattatgtcatttgctgaattcctttatcaccagacacataatcatcagttcaaaaacaattaggcaagattctcattgatcttcagaatgtccttaaagcttttcaacttataattaacacatatacttgtcttctttcctttagcacacgtgaaacagaatagtgttcctgctgtaggattttcatcatttgccaatcttcactgtaatccttgaaaatgtgaaggtggatggatgcattttactttacaattcagtgtgataaaacccacagctgctgttcaaagttctatttaatttagaagggaaaggactacttttatcgtgcaggagattgattgaattatataattctctcaaataaggtagataataaaattttaagatatattttacaatttcactattatatactacctagaaggctagctatttttattccttcacagcctgagggggtaggaagttttataaactccacgcccgccccccaaagactacaggttctatcctcaacaataaaggaccctacagtgttatcagtgagagaaattattctgactaagcaggtctgttatttcactaaaatatcgcttatgccttctaatctcaacattccagaaaatgtatttaaaaaacaggcaggctatcagtaaaaaagaaaaccaaaaataaatctaaatattttgttcagttaatgatcagtgtgatttatttatttttattgtatatatttgtagggaataatgtgatattttgatctatgtgtatattgtagaaagagtctatcaagttaacatatccattttatgtttttgtggtgagaatgttaacaatctattgttttagtaactttagaatatacattattattaactgtggttatcatgcagtgcaatagatcaataaaacttatctttccagtctaacagaaactttgtaccctttgagcaacatctccctttgtcttatcccttttcctcccctctcctttaccctctggtaaccacctttctattctctgtttctatgagattagcttttttagatttcacatatgagtgagggcatgcagtatttgtctttttgtgtctggcttatttcacttagaataataccctccagattaatctatgttgtcacaaatgacagaatatcctcattttttaaggctgtatagtattgcattatgtatatgtgtgtataaatgttatatacatgtgtttatatatatgtgtgtatatatatataatatatatatatatatataatatatatatatatatatatattcttcattcattcattgatgaacacttaggttgcttccatatcattgctattataaataatgcagcaatgaacaagggaatgcagatatcgctttgacatactgattacaattttttttggaggtatgcccagaagtgagattgttgtatcatatggtaattctagtttagttttttgaggaacctctatgctactttccaaaatggctgtaataatttacattcccaccaacagtataaaagggttcttttttctccatatctttgccaacacttgttagcattcatctttttgataatagccattctaacagttgtgaagtgatacctcattatgaatttaatttttatttctctgataattagaaattttgagcatattttttatatatctcttggccattcatatctcttcttttaagaaatatatatttagatcctttgcccaattttttaaacctggtgatttgtttccttgctattgagttatttgggttccttatatgtttttgatattagccccttatcagatgtattgtttgcaaatattttctcccaatccatgggttatcacttcactctgtttcttttgctgtgcaaattctttttagtttgatgcaatctaatatatttttgctcttgttgcctatgcttttgtagttctattcaagaaatcattggagcttttccctgtgttttcttatagcggctttacagttacaggtcttacgtttaagtcttttatccattttgatttgatttttgtttatgatggaagataggggtccaatttcgttcttctacctgtggctattcagttttcccaacacaatttattgaagagactattcttccccgttgtatgttcttggcacctatatcaaaaattaattcactataaatacttgattttatttctgtgctttctgtccttttccattggtcaatgtatctctttttatgccagtacaatgctgttttgattacaatagctttatagtatattttgaaatcaggcagcatgatgcctccagattttttctttatgctagagattgctttggctctttggggtttttttctggttccatatgaattttaggattgttttttctatttttgtgaaaaaatgatgttagaaatttgatagggattacactgaatctttagatcactttgggtattacaggtgttttaataatattccttcaatctgtacagggtatatttttccatttatttgtgtctccctcaattttttaatcaatgttttacaattttcagtgtgcagatacttcacctccttggataaatttactcctaattacttttttgatgttcttgtaaatgacgttttaaaaaaaatcagatagctcattgttaatgtacagaaatgctacttattttgtatgttgatttggttatgtgcaactttactgaatttctttattgattctaatagttttttgtggaatctttagggtttttctacgtataacatcatgtcatcagcaaacagagacagtttcactttttccttacctatatggatgcattttatttctttttcttgcctaattgctttagctaggacttccagtactatgtagaatataaaaggcaagagtgtacatccttgtcttgttcctgctcatcaaagaaaagattttaacctttcttgttgagtatgatgttagctataggcttgacatatatggcctttattgtgttgaggtacattccttctataccaatttttctgagggtttttattatgaacagatgttgagtgttattgcaggctttttctgcatctattgagatgatcatgtggtttttgtccttcattttgttaatataatatatcacatttattgatttacatatgttgatgtatccttgcattcttaggatagatcctgcttgatcatggtgagtggtctttttaatgtgctgttcagttcaatttgctactacattgttcaggctttttgcttctatgttcattaggaatattggcctgtagttttgttttcttgtgtccttgtctggctttgaaatcagggtgatggtgttcttataaaataactttgggagtattccctcctcttaaatttttttgggggagagtttgagaaagattggtattagttatctaaatatttggtagaattcagcagcaaaaccaacagactcttggcttttctttaatgggagattttttattagtgattcaatatccgtactcagtaatgatctttttagatattctgtttcttcttgatatggtcttagcagggtacatgattctaggaaatcatccagtctttttaggttatctaatttgttgatgtatagtttgtcatagtagtttattatcttcctttttattttgtggtatcaattgtaatgtctcctcttttatttaggattttgtttgtattttctcttttttaattcttttttgagacagtattgctctgtcacccaggctggagtgcagtggcatgatcttgactcattgcagtctctgcctcctgggttcaagcgattctcgtgcttcagcctcttgagtagctgggactacaggtgcacaccaccagacctggctaatttctttctttttttttttttgaaacagagtttcactcttgttgcccaggctggagtgcaatggcacagtctcgcctcactgcaacctccacctcctgggttcaagcaatccgcctgcctcagcttcctaagtaactgggattacaggcgcctgccatcacgcctggctaatttttgtatttttagtgagatggggttttataatattgtccaggctggtctcgaactcctaacctcaagtgatctgcccacctcagcctcctaaagtacagggattacgggcatgagtcagtgtgcccggcctgtgtcttctcttttttctttgttagtctagctaaagttatgtcagttttgtttatcttttcaaaaacacaacttttagtattgttggtctctttttctagtttcttattttttttccttctctgatctttattattttcttctttctgctaagtttgggcttagtgtatgattttttctaatttcataggttgtttatttaaaatttttatttttttaagtcaggtttttgtcactttgaacttccctcttaaaactgcttttgctgcattccataaagcttgctgtgttgttttcattttctttatctcaagatattttttatttttatttttatttcttcttcaacccattggttgttcagaagtatgttgtctaatttccacatatgtgtgcattttctaagattcatccttttattgatttctagttttatgccattgtagtcggaaaagatactcaatatgatttcagtcttcttaaatttgttaaaatttgttttatggcctaacagattatctgtcctggaatgcttcgtgtgtacttgagaggaatgtgtattttgttcctgttgggtgaactagtctgtaaatatctattaggtgtttttgtctaaagtctagttcaaatccaatgttttcttattgattatctgtctagatgatctgtccaaaattgaaactggggtgcttaagtcttctgctattattgaattataatttatctctccatttagttctatatttgcttgattagttgccctgatgttggacatatatatacttgcaattgttatgacttcttgatgaatttacccctttattattatttaatgaccttctttatctctttttacagattttgacttaacatccacattatctaatataaatatagttaccctgctcccctttgctttttatttctatggaatatcttttcagtaccttcactttgagtctatatgtgtctttagagataaagtgagtgtcttgtaggcagcatgtagttagttcttgttttttatatccattcagtcacatagtgtcttttgattggagaatttaattcatttaaacttaagtccttacctatcaataattacctattactatttacttacctattggcatttgttaattgttttcttgttaatttgcagatcctttgttctttttttcctctcttgatatcttcctttgtggtttaatgattttctttaatggtttaccttgaatcatttctttttgcattttgtgtatctactaagaatttttcattatggctaacatggggcttatataaataatcttaaaacatgttatactaataacagaatattttaagctggtgacaacttaactttgaacacttgcacacactctacgttttatgccttcccacactttgtttttcatgacacattttgtatcttttatagtttatatcccttaacaaatgattgtatctatggttgtttataatagttttatcttttaactttcatagtagatataattgattttcacaccatcatttcagtataagaatgttcttagtttgactatgtatttacttttaccagtcagttttattttttcatatattttcatgttgctacttagcaacattttccattggcttgaaggaattcttttagtatttcttatgaggtggtctagtggtgataaattatcttagcttttgattgtctgagaaagtttttttttaatctccccttcatttttgaaggacaagattgcagggtgctatggtttgagtttgtctcctctgaaacttgtgttgaaatttgatccctaatgtgttggtgttgagaaataaggcccagtgggaggtttttgggtcgtggggacacatccctcttaaataaattaatgtccttctctggcaggaatttctcactctcataggagtagattagttcctaagagagaaggttatttaaaaaaatctggcttccttggtttctctctcttgcatcctgtcttgccatatgatctctttgcatgtgtctattttatttctgctttctgccataagtggaagcagcctgaggcccttaccaaattcaacaacccaattctggacttcctaagcaccaaaattgtgaaccaaataaacttactttcttcataaattacccagtctcaggttatagcaacactaaatagattaagacactgggtatagtattgttagttggcatattttttctttcagctttatgaatatatcattctattccctctggcctgcaggggttctgttgaaaaaatctgctggtaatcttagagaagtttctctgtatataacaattcactttttctttgcagctttcaatattctacctttgtctttaacctttgacagtttaattattaagtgttttggtgtgagtttctttgaattcatcctattatagatgactgttaagcttactgaatctgaatttctattttcttcctcacacttgggaagttttctgccatgatttctttgaatatatttttctgttcctttctctcctccttcgggtacactgaaaatgtgtatcatattctgtatgatggtgtcccataaatcccttgggctgtctttaatcttttttattcttttccctttttgcttctcagattggatatttaccagtgacctgtcttcctgtcttcttctgcttgatcaagtctgatgttgaacctcttgttggattgtttcatttagttaatatattcttttgctcaattattcatgtttgatactttttaatattttctgtcactttgttaaagttctcaatttgatcatgcattgctctccttaattcagtgagcatctttatgatgatccttttgattttcctgtcaggtaaatcacatatctccatttcattaaggtctacttttggagatatatcttgttcattaatttgaaaaacatctctctatttcttcattttacttgactctctgatactttctgtgaattagataaaaattctcctctctcagtcttattagactggtctcatggaggagatatttctcaccaatcagcccacccagagattcttagtgcctctaaattccttgtgcttgtccaacctgctgttattcttcttattggattcccccaaattagacagtgtcaagtcatgttattgccttgagtaaggtgagattgaagccagtcctttgagatacagctggagaggttggggtgttagatgtgtgttccagcttttcctttccttgcagagaagctgggggctagattttatctcacatttattctgccgtaaccaaagtggagggtctgagacatatgactgtattcttgatcagactgctcattttgaacctggggagatagctgctgaatgtttgtaattttaaaagtcatctttttgttttctgtagtttaggagactcaggactgcacagacccaacaacttctagagctatttgatttaggagtgagttgctggtaagggctataaaagttgagatgctctatctgtgccaaatctacttccatggagagtctgaaaacctggatttattgctggagcaagccagggaagaatgtgtggggcatgaccactctcctgttagagcaagcagaatattcatttcaaaagtggtaaactgaccatatacaggtccatatatctattctgttttaaaattttcactagttgccatcatttaagcagctaagactaacataaaaatctgtttagcttcactttaattcccttataccaataacatctagaactgagtagcaaccatgccttttcaaaagggaatatattttccaggttatgcaagtcactactcttccctattttcttacaccttggcccattcatttaattatattgccagcctgacttctatagcagataagttggggaactcttgttattttgcaagagataaatatttattttatcttattttttagacttttaggttcaggggtgcacatgcaaatttgttacataggcaaattgcatatcatgggggtttggtgtacagattattttgtcacccaggttatgagcatagtacccaatacgtactttttctatcctaaccctcctcccaccctccaccatcaaataggccctggtgtctattgttccctttttttgtgtccatgtgtacaaatttttagctccatcttgtaagtgagaacatgtggtatttggttttcttttcttgtattaatttacttaggataatggcctccagccccatccatgttcctgcaaatgacatgatataattcttttttcatgggtgcgtagtattctatggtgtatatgtaacacattttctttacctagtctaccattgataggtacttaggttgattccatgtctttgctcttgtgaacagtgctgcaatgaacatatacatgcatgtgtctttatggcagaatgatttatatttctttaggtatatacccaataatgggattgctgggtcaaatggtagttctcttttaagttatttgagaaatcaccaaactgctttccacatggctgaacatggctttccacgtgggatttacattcccaccagcagagtataagtgttccctcttcactgcagccttgcaagcacctgttgttttttgactttttaataatagtcattctgactggtgtgagatgttatcttattgtggttttgatgtacatttatctaatgactagtgatattgatcatcttttatgtttgttggctgcatgtatgtcttcttttgaaaaatgtctgttcatgtcttttgcccactttttaatgggcttgttttttgttaatttattcaagttctttatagattctggacattagacctttgtcagatgcacagtttgcaaatacttcctcccattatgtaggttgtctctttattgtattgacaatttcttttgctgtgaagaagttctttagtttagttaagtcccatttgtcaaattttatcttcattgcaattgcttttgatgtcttcatcatgaaatctttgcaagggctgatgtccagaatggtatttcctaggttttcttctatagtttttatagttttatgatgttacatttaaatctttaatccatctcgagttgatttttatatatcgtaaaaggaatgggtccagtttcaatccactgcataaggctagccagttatccctattttgaaaaaattagaagacaaaagtaaggaacaaaaaattaccatctatagacctaccactcagagtcagccaaacttcatatttggtatatatttttcagttcattctttcagatagatcagtaggtaggtatgtaaacagccagccaaccagatatgtttagaatatttttatgctaatgatgatagatcaatattatttattatttttcttatttcaatgaagacagattgttcagagaatgaggttttaagttacttttatagtaaactgagagatgaacacaaacaccatttgttttaatgctttgcatggaaagatccttcaaatatgccattataatttttggtgcaataaaccagtgatgaagattcaagtagactagtctagactaggatatttaaaatccttatggtccttgatatctgagatgatatcccgttcagggaatggaagtagttgaggaaggtataatagattggtactgaattcaggatgacccctaaatcttgaagcttcacataaattcatttctcttcatgcctcctgagctggaattctctccatagcatcattttcacaggtttttaagttcatacttgaatgcctctaacaacagaagacttattacctcttaagctacaacctgtcctttttaaccaactattaaaaaggtcttttaggttaggcacagtggctcacgactgtaatcccagcactttgggaggccgaggtgggcagatcacttgagtccaggagtttgggaccagcctggccaacgtggtgaaaccccatctctactaaaaatataaaaattagccaggcatggtggtgcatgcctgtaatcccagctactttagagaccgaggcaggagaattgcttgaacccaggaggcggaggttgcagtgagccaagattgcaccactgcactccagcctaggcgacagagtgagaccctatctcaaaaaaaaaaaaaaagtcttttaatcagcttaaatgtgggttcctaaaactttttaatgtttaagttcaggggtacatgtgcagttttgttaataggtaaacttgtgtcatggggtttgttgtacggattatttcttcacccaggtattaagcctaatatccattggtcatttttcctgatcctttccatgctcccaacctccaccctccggtaggccccagcatctgttgttcccctccacatgtccatgtattctcattatttagctcccacttataagtgagaacatgtggtatttggttttcagttcctgcattagtttgctaaggataatggcctccagctccatccatgttcctgtaaagcatgatttcattcttttttatggctgcatagtattccatgatatatatgtaccataatatggctgcatagtattccatgatatatatgtaccacatttgctttatcccttctaccattgatgggcatttaggtttattccatttctgtgctattgcaaatagtgctgcaattaacatatgtttgcatgtgtctttatgatagaacaatttatattcctttgggtatatacccagtaatgggattgctgcgatgaatggtagttctgtttttaggtctttgagtaagtgtcacactgttttccacaacagctaaactaatttacattcccaccaatggtgtataagcattcctttttcttcataatcttgccagcatctgttattttttgactttttaatagtagacattctaactggtatgagatgaaatcacattgtggttttgacctgcatttctctaatgatcagtgatactgagcttttttttcatacagttgttggctgcatgtatgtctttggagaagtgtctgtccatgtcctttgcccactttttaatggggttgcttgtttttttcttgcagatttgtttaagttccttatagatgctggatattagccttttctttgatacacagtttgcaaaaattttctcccattccttaggttgtctgtttactctgttgatagtttctttcactgtgaagaagctctttagtttaattagatctcatttgtcaattttttcttttggtgcaattacttttggcatctttgtcatgaaatctttgctcgtttctgtgtccagaatggtattgcctaagttgtcttccatggttttcatagttttaggttttctatttaagtctttaacccatcttgagttgatttttgtatatagtataaggaaggggtccagttttaatattctgcatatggcttgccggttatcccagcaccatttgtcaacaataaatgagtagggagtcctttccccattgcttgcttttgtcagctttgttaaagaacagatggctggtctgggcgcagtggctcactcctataatcccagcacattgggaggctgaggtgggcagatcacttgaggccaggagttcaagaccagcctggccatcctggtgaaaccccgtctctactaaaaatagaaaaattagccaggcatagtagcacacacctgtaatcccagctacttgggaggctgaggtatgagaattgcttgaacccaggaggcagaggttgcagttaaccaagatcacaccactgcactttagactgggcaacaagagcaagactgtcaaaaaaaaaaaaaaaaaaaaagaaagaaagagcagatggctgtaggtgtgtggcctctattctgtttcactggtctatgtgtctcgttttgtactagtaccatgctgttttggttactgtagtcctgtagtatagtttgaagtcaagtagtgtgatgtctccagctttgttctttttgtttaggatttccttggctattcgggcccttttttggtttcgtatgagttttaaaatagtttttttattctaattctgtgaagaatatcattggtagtttgatagaaatagcattgactctgtagattgctttgggcaggatggccattttaatgatattgattcttcctatccgtgaacatggaatgttttccattttttttgtgtcatccctgatttgtttgagtagtattttgcagttctcattatagagatcttacacctccctggatagctgtatccctaggtattttattcttttgaggcaattgtcaatgagattgtattcctgatttggcttttggcttggttgttgttggagtataagaattctaggccaggcacggtggcttatgcctgtaatgccagcactttgggaggccaaggcgggtggatcacgaggtcaggagatcgagaccatcctggctaacacggtgaaaccctgtctctactaaaaatacaaaaaattagccgggcgcggtggtgggcacctgtagtcccagctacttgggaggctgaggcaggagaatggcgtgaacccggtagacggagcttgcagcgagcctagatggcgccactgcactccagcctgggtgacagcgagactccatctcaaaaaaaaaaaaaaaaaaaaagaattctagtgattttttaccctgagacttcactgaagttatcagcctaaggagcttttgggctaagtgtataaggttttctagatataaaatcataccacctgcaaacagggagagttcaacttcctctcttcctatttggatgctctttatttctttctcttgcctaattgctctgccctataaaagtactccatcttgacagagtcagagtccctaggccagtcagacttttgccaggtatcctaaagaacaacaatctgagctgggcatggtggctcatacctgtaatcccagcactttgggaggctgaggcagctggatcacgaggtcaggagatcaagaccagcctggccaacatggtgaaaccccgtctctactaaaaacacaaaaaattagctggacgtggtggcacgtgcctgtagtcccagctgctcaggaggctgaggcaggagaatcacttgaatctgggaggcggaggttgcagtgagccgagattgcgccactgcactccagcatgggcgacagagcgagacctgtctcaaaaacaaacaaacaaacaatcaacaacaacaaaaaaaccctgtacctgctatatttttcaggctgtttcagaaaaaggcaaaagtaataattcattacttgaaactagacttgactttctgggaattggttaacttgtttgaagaaaatatattaaacatttattgcctcattgcttgctttcaagatatttttctatgccttcatttatgagaagctggctcagtttgttgaaatccatcaatgatttgaactataacattcataatgttctttataacccagaacttgattacataatggtatttattgttctctagttttttcatgtgcacaagtcttgtcctgccaactgtttcgtaagtttttcaaaaccaaagctcatgtcttctacttatttcatggttttcctttcctcacaatatctagtacagtaagcacttaataattatttcttaacaaaacaagatctgcatgtgggctgtgtagcttggctcaattcttacattccagtttgtgccattaaccccaactagctttctaggaagacttgtcacatggggcctgggcaacgaagattagatgattaagaaaagccaggcttcattgctgcacagaaaaactgaaggtcctatgctactgctcagatgtgagtatctcagttcatacagatgatatacttattgaggctagttggtcccagtaaatttagagttctgcatgtatccttaacatgctctttgtgaaccattgacaaggcattcacaaattaggccaagtgctcccccaagtcatggtttacatgtttgctttgagagatttacttttccttctggcaagtattcttccctcttcctcctgtaagaaatatgaaacttgtctctggtcatgaaggttttatattaacctattttttaatacttactggggaaaatccctttttctgctgctgctgctttgattggctgaaaaatggcagctaccttactctggagcttctaagtctgcttctcagcatttctcaaatatctgagactttgttgttcttcatagtaaaagataaacccttagactctttttttatttttcagaaattatcactattctaaaagagccactgagttcctagtctggatattttaaataaatatgtatttctgttattcttttccaagtcatgtcagcataataggagtaggtgtatgcaaggaaaactagttattgattaaagaggattttgaagtggtctaattgtcctttttaatgatatcaacctataggaaattcctaaagtgaaatttgaagtaattttgtcttattgaacaatctgtatgttgattgtcaatcagtggacaaaattaccaaatcagctatgccattcatcatttgacacattaatttattacttttttcagttaaacagctttataaattcaaaaacaaatgcatatatacagtgaataaaatgtttgagcagcataaacattgcaggtaacaaaagtaattccatcttctgccccacactgtcagtcctgctttgagaggcaaccactcttaacagattttttgtataaactttccccaaatttctatagttacacaagcttagaggatgtgtctgtgttgtctatacattttttcttttacacaaatgggggcaaacttgatattaagttctacattttgtgttttctcctcttcgtaatgtgttttagagatttcatattagcatagattgatctaatcatttcttcaaattgctgcctgtaatttcattacatgggtattccataatttatttttgtcagacccttccccaaattgatgaatatttaggggtatgtgtgcatgtgtgtgtgtctgtgtgtgtgtgtgtgtgtgtgtgtatgtgtgtgtgtgagagagagagagagatgaatactgagataatcttaagtatttaattgctctatacctaaatttgccaaacagactggatttcctgtttgttaatctgatctttttcttggtatttgaaagtcatgctagttagaaaaaaaatcagtaattttaattctgtacatatttatgaaggtttatgctgcatccagcactttgctagatactattggatataagaaagttataagacaaagtttctgcccatacatatttttctctgtagtttagaagaccaggtttactcatgtaaaataattagtgaatcatatgagatagagtaccatgaaaaagaaactccaatgtgaacttacttaggtactcattataaataggcaggctcccatcatagcagtaaactgtgtgtgtaggccagttgaagaataccacacttggaaaatagactgctttggggagatatttgaggtttaacctaaactcaaacttgaagaccatttgaagactatgaaaacgctttcctcccagataaatgactataaaaagtaagcaaatctggaattaaaatcttacaaattgaaataatatttctctataacaaggccattttgccatcaaaaaatggaataacagtctctccaaagtgtgcatatatgagcttatctacactgtatagatacagtagcataactactctaattagttttcaaaaggacattctccttgtttcatggaaactattggatgataacaaatagtctgtacttcagagaagcaaaggagaaaaaaatagcagaataggctgatgtcagttaattgttaatatatgaggtttgaggtagaaggtagattcttgaagtttgaaatattttacatgaaaactgagagggtaaaagtttgagagacatagatcaccattttcactttatgaagaatgctgtcttttatttacgcctttcagcttatatttctaagctagcaatttaaggacttatgaaagatggaagaggtatagattagaatccaatattttggtgggtcataggcttgtatgattcttccttgtgctaatacaatcatttaagcagaatgatatggtgataaaagctaataaaatacatttagggaaaagcatgctgtgttggatattcagaatttgaggaaatgtgttgtgataacagaatgagtgagcagctttcatagagtacatgcagttaagatgaaagcagggattgagaaaaaaatgttttttctgaaacagattttgtacctaaactgaaaaacatttagtgacgtacacttttccttccaaataaatatttcagtcagccatttaccttctattctctgtaacatgttcactaactaggagcatgttctctcacatttaataaagtaaaaaatgcatcagcttttcaatgttttccccaactttctattctatttaacaaatatttcttgaatagctactatgtgcggagcatcacaatagacattgtatgggatgcaaagtcaagagtgaggccactggtcttagaatcaggaaacttgccttctaatcctatttttgccagttacttgtatgacctagagattcacttctcattttagagccaaagtcctggatttaatgatgtctgaggtctttttcagctatattgtaatccaacctaatgagtaaaaccatttgtttcccctaaaactttacagtattctatggggggtcgaaactattacagaaataactatgaaagaaagcagaatgttatcggtaatttcaagagagagttacaaagtgatgtaggccattaatagcttcatggagggagtgaccttgagggattaggttttgataggcagaaataggggtcataagaacaactctgttcctattgtgggctttctccatcctggatattactcagaatttgtcagtggcaaaacaaaagtagtagaaagttagcctttgaaggatttttatcagtctgtttccgaactagccaatgagtgtagattggagctgtaagcaatgaagtaaaagtaaaagagatgaacatgaaacatagggaggggtcatagaaatggaatttcttcacaaatgctaatagcaactatcccttacatttgtataatggttaaaaatccaggatatgagggtatgacagagctgttaagagcatggccgaatatgctcctaacatggactaaaccagacctgggtttctatccctgctctgacatttaccagtggtagaaccttgtacagtcacttagcctgttgcacctcagtttcatcatttgtaaagtggagataacaactactccatgagatggctgtaagattaaaataagattgtgtatttaaagcagttatcaaaaggactgacacatagaacttactcaaaaagggtagctaggaggtagtatgtcaggtattgttctttcctttcaacagaaagtcaaaactggggctctgagattctgaatcatttattagaatccagtattctttctattacaagagtgactcctaacctgagttttctgcccacaccctatccctggggggcatctgtgaaggtaataatgagaatctatgagttattttcaatatttgaaagaagcctaacagagagcattaatttactcgtgataaattacacaacctgactaatatgtcaagtttctttgcttttgcctgaaattatatcaactcattttggtaatactggctatctcatgctgatgggaaactgattggcagctatatatgcctttgatgaatagaaatgaggaaaacgaattttatatcataaatgcagttgatctgggagatattcttttcagcttgggagaacatagagaaaaataaaatgctcctttgttgctgaaactattgagaagcactgtattttacaccatgctttctgattcaagggaaaagggggtttaaggggcttagaaagataggcagttgtggtcagagagaatttcagactttgagagcttatgggtaaattgttttcatataacatacctgattgaaaggaggatatgacgtgtttttcttctgtgagaaagagatgaggcaactgaggcctaaagagggataatgaatcagccaagttaaaaaagcagcttgtaacagaaccaatatttcaacccagtcttgtgactctgttccatagctctctctactctgaatcaaagaaatatagtcatcttgtcttgattttgccacaatgtccaaaaaaacattttctcaggtctgattttaatattgactttttctagtgaaagagagaaaacactgttagaagatgaatgaaaatgaagttagggacttacagacagctgacatacaaaggtctcctttgtattgattggcttctttattgatttgacaatatagatcaatatctcttcctctgaggctgtagtgttatagtgtgaattctctgggttccatttcactctgcagaattgatacaaatacaacaggtgcagaggtaatagggggatgaattatcatattagctattatttactatgtgcccactatggccaggaatgttattcaggcatctatatttattgagtgcttgctgtgggcgaaatgctagtctaggaagtgacagagtaatgaacaagacagagaaaagtccctacccccatagagctcatattttatcattctaagtatttttgtatggattaccttacaacaaccctgtaagtttggtactgttagtactctcaatttacaaatgagaaagtggagacagagttagtaagttacttgcacagggtcacacagctaggaatattaaatttggaagttgatgtaagatctgtctgactcctaaatgtacatttttctattattcttttcaagttttattccccactgtgctacttcatcagacagcttctttctgccattcttctcaacactctcttcctctcgtatctatctttccttttggttataatgctgaaaacatgcagttattaaaccaaagacagagaggcaaaatacattcatgtggataaagtaaaatgtacgtaggcttgctcacacactaaacagagagggcactatgcagaagctgtttgctttggggagattagataggagatgttatacgataatagacaaaatttattgactgcttattatgtgttagccagtatactttttcatatttaatttgtatgtgtatataatagctgtacatatttatggggtataagtgatattttgatacaagtgtgtaatgatcaaatcagaggaattgggatatacatcatctcaaatacttatcatttctttgtattgggaacattccaaatccattcttctgattattttgaaatatacaacaatatattgttaactatagttaccgcatatctacaaccatctgatctttgacaaacctgacaaaaacaagaaatggggaaaggattccctatttaataaatggtgctgggaaaactggctagccacatgtagaaagctgaaactggatcccttccttacaccttatacaaaaattaattcaagatggattaaagacttaaatgttagacctaaaaccataaaaaccctagaagaaaacttaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaatctactcatctgacaaagggctaatatccagaatctacaatgaactcaaacaaatttacaagaaagaaacaaacaaccccatcaacaagtgggcgaaggatatgaacagacacttctcaaaagaagacatttatgcagccaaaagacacgtgaaaaaatgctcatcatcactggccatcagagaaatgcaaatcaaaaccacaatgagataccacttcacaccagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctgctataaagacacatgcacacatatgtttattgcggcactattcacaatagcaaagacttggaaccaacccaaatgtccaacaatgatagactggattaagaaaatgtgcacataaacaccatggaatactatgcagccataaaaaatgatgagttcatgtcctttgtagggacatggatgaagctggaaaccatcattctcagcaaactatcgtaagaacaaaaaaccaaacaccgcatgttctcactcataggtgggaattgaacaatgagaacacatgggcacagaaaggggaacatcacacactggggcctgttgtggggtggggggaggggggagggatagcatttgaagatacacctaatgttaaatgaagagttcctgggtgcagcacacgaacatggcacatgtatacatatgtaacaaacctgcacgttgtgcacatgtacccttaaacttaaagtataataaaaaaaaagaaaatcacatgaacgcaaaaataaaaaaaaaaactatagttactctatttttgtaccaaacactagatcttattcctactatctaactatatttttgtacccattaaccaacccctctttattctcccctcccactacccttctgagcctctggtaaccatcattctattctctatctacatgaaatcatgttttaacctccatatatgagtgagaacgtacaatatttgtctttcttttcctggcttatttcacttcacataatgtcttccagttctattcattttgttacaaatgacagaatctcattcattttatagttgaataatattccattttgaatatataccacattatctactcatcttctattcatctgttgatagacacttaggttgattccatagcttggctattgagaaaagtgctgcaataaacatgggaatatacaggtatttctttgatatgctgatgtcctttcttttgaatatctgcccagtaatgagattgctagatcatatggtagctctatttttagtttttgcaggaactgccgtactgttttccataatggctgaactaatttacattcctaccaacagtatagaagcgttgccctttctccacattctcaccagcatctattattgtcttttttataaagcccattttaactgcagtgagatcatatctcattgtggttttaatttgcatttatctaatgattggtgatgtggaaaatttttttcatatacccactggccatttatatgtcttcttttgaaatatgtctattaggatttttttgcccatttatagattggattatttgtgttttttgctattgagttgctcgagtcctttatatagtctgattattaattcctattcagttgaatagtttacattttttttccattttgtaggttgtctctttacattgtcaattgtttcttttgctgtgcagaagcttcttagtgtaatataatctcattcatccattttttgctttggttgcctgtgtttttgaggtcttactcaggaattcctttcccagaccaatgtcctgaagcatttccccaaagttttcttctagcagttgtatagtttcaggtcccacatttgtctttaatttgtttttgatttggtttttgtatttggctagagatagggacctagttttattattttgcatatggatatccagttttgccagcaccattttttgagtagacgatcctttccccaatgtctatttttggtgcctttgtttgaaataagttgcctgtagctgtgtcaatttatttctggtttccctattctgttattttagtctatgtgtctatttttatgccagtagcatgctgttttggttactatagttttgtagtataatttgaagtcaaggactatgatacctctagctttgctcattttactcaggactgctttgactattctgggtcttttgtggttccatataaattttaggatttttttttctatttctgtgaagaatatcattggtaatttgatagagattatattgaatctgtagactgctttgggtagtatggacactttaacacattcattcctctaatccatgaacatggggtagctgtccattttttgtgtgtgctttttaaattttttatcaatttttcatagctttcattgtaaagatctttcacttctttggttaaatttattcttaggtaattattttgtagctattgtaaataggattgcttccttggtttatttttcagattgtttactgttggcatacagaaatgctactgaatttgtatgttgattttgtttcccacaactttactgaatttgtttatcagttctaatagattttttggtagagtctttagggattttttttaatataaggtcatataatttaaaaacaagaataatttgacttcttcctttcaaatgtgaatgtcctttatttctttctattttctaattggtctggcttggacttctatagctatgttgaataaaagtggtaaaagtctgcatccttatcgtattccaaatcttaaagggaaggcactcagttttcccccatttagtatgatttagttagctgtgggtttgttgtatatggcctgtatcatgtagtcagtatactctttacgcattcaattcttagaacaaccttataagataggcactgttattattattgtcttcattatttatatgggagaaactagggtacagagtggttaattaacttgccaagaatcctctgtttataaggggcagaactgagattaaagttcaggcagacagtatccagagtttgttgtcataatcaccaggacagtacttacaacatagtacatcataccataagtaattgattatttttaaaaatccaggtatgagaaaataaatgtataaactatagtagtaacaatgagaacagaaaaaaggctatgaatgcaataggcattttagagaaaggggcaacaacatttactaaatctcagatttgaatgacaaggaaagtgattatagcagtgacattaaaaaaaatctaaagagatcaaagtcttgggaggggaaatagtttggtttctgacattctgatattaagttgatggtaagatgtccaagtagaggaactattaagtaagtgaaatatgggactgaactcaaatttgaagacaaatcccttcagactctttgtccagagtctgcaggccatagagaggtatgaagagagaggatagaacgtagaaggagcaaaggctttcaccacgtagacatttcctcctttctttttccagtaatattattattgaaatacaattcaaccttagttttaactttttccaggctaggatgtttctttgcttcctcatacttttctccaccaacatcaaaatataataggatgcagtccattcagaaaagaaaccagttaacaaattatgccttcaaaggaagaaaatttcctgtgatccccgattgtggtctaaattatgtttattatacgttttataaaattctgaacaggtattgaactattttaaatttcttggatttattgcttttatacaaaaacaaacttacaaatgaaatataaataaaaccacaaaactaataaatctaaaattaattttaattatatttgtcttactgaaaaaaatcactgtttggaatgtgactatgtactactgaaaagtgcaggtttgtttgagttgtacatggctggatttctgtgtgctacgaggtgcttttaagtctccaccacttagattgcagtgtgctatgatgtatttttgttctcatgtgacatgaaggcatcatttatatacatttatatgtatacatttatatacagtactactttgtgacaatataatcataaacgaatatgtaaaagctggcacttaaataatgcaatagtatcatcatgaggtgatcacctagaatacccaaaatctattttcttaatttattttaattcaaacataaagtttgaaacatatacacacaaaaatattatagaaaagtcctaccctcccgaaactctagtttgaaaaatattaatctgaaggcaggagataaatatactgtcttgttgtggctttataaatttgtacattttcctagcatgactaaatttaatcctgcctatgtgttcatataatgaatgtgggatttaggagacatgagatctcaaactggctctgccattattctattatagaatctcaaggaaagtgttttacctccctggacctcatttttctcgtgtataaaatggaaattggagaggaagaaacaggatgaaccacatgatctctaattaggactccttgtgattttcaagtcaaccatacatttgaatttcagaatggatgatacacatttcactatatatgtatatgcacttatgtgcacttactgatataatgtttacttaacaccatggatattagttcatttgccaaggaagagtgttactcaaaattcatgataaagaatttttttttttttgctgctcttttggacctgtaataagatattgttaacctacatgtacttcataaaaactttccctatgtgcattttctttttttttttttttgagacggagtcttactctgttgcctaggctggagtgcagtggtgcaatctcgactcactgcaacctccacctccctggttcaagtgattctcctgcctcagcctcctgagtagctgggattacaggtgcacaccaccacgcccggctaatttttgtatttttagtagagacggggtttcaccatgttggtcaggctggtctcgaactcttgacctggtgatccacccgcctcggcctcccaaagtgctgggattacaggcatgagccaccgcgcctggcctccctatgtgcattttctaaaaaatgtatctaacttaatgattatgagtagacagttctgttgaattttatttatgcaatcacatgaccatttctttactatgaaacatataaaattgtactgtaagtgaaacaagtagttccattgtgtaattgtttcatcattacatataatttaataaatacttcttttcaaattagggaataacagacttggcatttatatactttaaacacttaagactccttcagcttctaaagaatttaggttaatttacaaaacagaaagtgattggcttacattatgctttgcgtctgtagaaaatgggtaattgggccgggcgcagtggctcacacctgtaatcccagcactttgggagaccgaggcgggtggatcacctgaggtcaggagttcgagaccagcgtgaccaacatggagaaacaccgtctctactaaaaatacaaaattagctgggcatggtggcacatgcctgtgatcccaactactagggaggctgaggcaggagaattgcttgaacccagaaggcagaggttgcagtgagcagagatctcgccattgcactccagcctgggcaacaagagcgaaactccatctcaaaaaaaaaaaaaaaaaaaaaaaaaaaaaaaaaaaaaaaaggataattgaataaaataaaccgttctatgaaagtgtgaattagtaactctgactatgtcggcagccacaattttgcctccctaagcaaagcatatagagtatacatgatcacattaagaaatacagcaagatgttttgggtcaaaccaaatattttaccaaagcagatttttttttttttttttttttttttttttactaatgatgattcaacactaataccatgaacaagacaaaatgaattgttgtgagcacaaattttctgcaaacattattttaaaacttggcatatttatgcctattagtgaatacatctttataatttacagcttaacctcttcaggtttataagaacaagccagtttgaccattggaaaagaaaaaggagagacagagcaataaccacagtctgtgaagaggcctactcagtaacggtctagtttatgcttaaaaatactggaaggcttgcatccctcaatctctcagtcaattactttagttctttgaaatcaccccattaattaggacaaatcctgcgttttcttatgtctagatttatcaggggttttttgcatctctctcttatccacagtttagttttatataatacaacctgatagcatcttgttatcattttgccttgatttgctttgtgtcttattacataaaaggggtactaatctttgggaattcactccttattagagtcaattgagatttgtaacttgagatgcaagcttatatttttattataaataattgcctacaaaggaattcctagcatgatatgttatcagcataaattactatgttttaattgtaatgtattttttaaatatgcccacaggaaaggtttttctcctacttagttttgtagaagattattttgtgtcttcccacttcattcctagtatggattccaaatatatcacttgcttgatggtagtataattttataattatattgttattggcaattcagaaaatgatttctatagtttctttgacataaagtggataaccagaatgagttgattttcatttatctttgaagccaattataattttagtaccaaccaacagttggcacttaatttgcctggtctacagataaccaagaaaagatattgccattcattggtctcctcactctcttctataaccagaagctaggctgtaaattgccattttctgtaaaagttggcccatttgactccctctcttaattaccgaacgctactggttgtgatggttttaacttgattatgtacagttgttaggcaaatgccagttaggagttgtgaatgttttagaaacatttcctcagaataattgtgctcagtttttaaggataggaactggaggctagtcagatatacatttgataaacaaccaattactcatctcatgttgttctttactgggggtatttctggttttctagggtggaataaatacagaggatggttcactttgctctgtctggatgagaagctttgatctccaggatagttcttttttaaatgagatgaatgaattttcacctttaagtagggtgcttatataatttattattcaaatgagaaaacttttgagaacaaaagaggttattgctaactgttatgctgggagaactggcatgaattggggatttatgccaggcaaactgtattacatggtctgtcactttgggacaacatggagatttgcctccccaccacttctcccaaccctgtccctctccatccactcacaccccagcctaagaaaatgttctgtgagacatatatagctcaggggatctttgaacatactgatgtgtgttcctctgcagggattacttaaaaaataaaaatccccctactcatctatcttcaaatcagtcaaaacaaggtttttcattatgtttccatgtctccctcctctgctgttgtatccctttaacagtcagactctcagacaaaagataagataccatgctctttctaaaatgtaaatctaatcatatcactctactctgtaacacacttcagtgggtttccattactatggactttgtgatccagcccctgcctcaaatcccaccattctctacctccctcctattgccaatcgagaatctctttctgttcacaaagtagcattccaaagacatagaaatattcatattgttatatcctagctagtaagaaatgtacctacacatgaaaattgccccatcatctagcacggtgcctgacgtataattggcatttaataaatgttgaataaaggaatgaatgaagagttaaatgccctgagagaaattttatttaaggcaatctatttaaaatatgaatgagtatatagcagcaattatcctcttgatctgcttagttaagagttaactatattgttgggctcttttttttttaggcaaagcatagagatattgctttataacataacattccccccactgtcttaaggacctttaatatgcttaagggaagttaatgtattaataatagccatttcctagggcctaattagccatatttcaatctttgtaattccgtatgagaaaaatatcctcacagagttcaagtatctgcggcatacgttttggcctcttatatatctagggtgaaaagctaacctggtaaatatgcattccagatggctttcatcagataaatctagtgaataagaggcccactgataaaaatggaagttataaaaattaataagaaaatggatgttggaataaagacctgggataaccatcacagatctcacaatgatgctttacattatagcatgcaaaacacttttacagacattttcttcatttaattcttggaattgtggggagagactctgtaaagtaggtaaggcaaggtagttgtttttatccatgtttcgcatatgatgaaactagcttatgatattttgttcgtttatttcagccagtgtaactaggcttcacttatttatgagacttcagaatgaataataatcatgttatagggtgcctgaagaaattaatgatatctaaggaatcgcagtccttagcataactttggtttatttaaaatgtgctgatctgtaaaaccaaaccactagggtttgaagaagactggctgtatctaaagattagcaagataaagatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaatgccatttgacccagcaatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaacacatggacacaggaaggggaacatcacactctggggactgttgtggggtggggggagggggaagggatagctttaggagatatacctaatgctaaatgacgagttaatgggtgcagcacaccagcatagcacatgtatacatatgtaactaacctgcatgttgtgcacatgtaccctaaaacttaaagtataataataataaaataaaaaaataaaaaataaaaaaaaaagattagccaggtcctgttggcaacttattctgaatacttaataggctcaattggaagctagtgaagttttaatcagttgtccatttaggacccctcatcagcaccagttcatagggcctgtctgaaatattcttaggtagcagaggttgtacagaaagatctttgtgttactcttccctcctaagcacaaaacaccaaaatgaataaatgaataaatcaataaattatacactctaatcttgacctcagtgcataaaagttaagtcgagctctagaccaggtataatcacctggcacttcaacagtatttgaattactgaattgtcaccaaaatatatatcaagtattttttcacgtttaagacattgtacaacatgccatagagctcaggagaagatgaggaactttgacagtgacatttttttaaggtgcaagtggcatatttgtgagttatgagccttattctctgtagtcctaataatacatttatccctcatagaaaaagggtttcataaatcagccatggcaatgtgcaatattctcaaattcaggtatggagatatatgtataaatttagtattctcactggttgtgctgaagtgttgttgaatgtgtgagtgtgtatgtgtgttttctccagattctgactttgatacaaacattcaaaatctttaatagacccccttttcagggttagcaaatcttagtaaatgtctgttggctctactctttaagtctatgattcttttttgcatccattttaaaattgggataactgctagaaaataattagaactaatgtactagcgtaatcaaccaatgagttctttctgcctgctgcacagacaaaatcaattcactaggactgcagcaatgcagtaaagaaagtttaattgacacaaggctggccacacgggagaagaagttcttgctcaaatcagtccccctgaaggctcagaggttaaggtttttcaaggataatttggtgggcagggagctagggaatgggtgctgctgattggttgggaatgcaatcataggagtgtggaaaatggtcctcatgcactgagtcgtcttctgggtgggaggccacaaaaacagttgagtcctgagtcatgattctacctctgggtgggatcagtcatttgccagaatgcaaaagtctgaaaaatatttcagaagacccatgataggttctacaaaagtgatattatctacaggagtaattggggaagttacaaatcttgtgaccttcagaacaatggcttgttgttgtttaaccacacctatatcttagcagaattcaggtccctcttataagcctaacctgtggccttttgttagttttacaaaggtggtttagttttgggaagggctgttatcatccttgctttaaggttaatctataaactaaattactttcaaagttagcttcatctacacccaggaataaccaaaagcagcttggacattagaagcaagattgagtaaactatgtcatatttctcttactgtcataattttgtaaagatggtttccctagttaagagaaattttctaagattctggtgatcccatgaagacctcaaatcaataaatacttttgagtgtaaaaaaatacatattactatgctaggcactttgacatatctcttctcatttaatgtacatgactacactccgagggcattatcagcctccctatttcataagtgaggaaactgaggcacagataattaaaatgacctatcttaatcaaaggtctttaacaagtcattgaataattttcttctttcctagaaagtaagtataaccagattcacagttgatcattttagcaattgagatgatgtttgtgaaatggctttggatactctgaactgtcatgagaagtttgtttgttgtctagttttaccagtagtgctggattgcctaatgggcaggctaatcatgcatttatggcattagcaatgcagcatatctataagtcttggtgaatctttttaaagcatgaaagtagccattagaaaaagatctttttggatttgctaaaacttattttatattttagagttgtgtttactttgaattacctgtttgggcatatgatcttttcagaactgaaggcctctaaatgtcttaatctggctccttattgcattttgaatgtttgagaactcatttattcattcaatcatttaccatttctaaaatctacaaagaactgacttttcctttcttctcatattcttagagaatcagtcacccttctttgagagtcaactggcattatattagtttaggccctcattatctcttacttgggccattgtagcagcctagtaactactctcccatgttcagtctttctcttcttctaacctatttaattgctacttataaatttaccttaccaaaactctccttctttcatcaggaacctgtaaaggatctctattgtttaccatatcaagaccaacccctctgcagtattttcaagatcttcaaatactgactcctatccacctatttagtctctttttcactgtgtccctagtcttctgttctgcttaacctgattttctcattgttttctacagaagctatgctcattcctacatccaagattttgctcttggtattgctctgacatgtgatgttttttctccttttctccatgtatccaaattttcaccaaccaccaacattcagctcaagttctgaatcctctgtgaagtcctctctgctacttcaggtgatgctcaactctccttcctctggttaccctattataattgtggcatatattttagtaactaattgccttctaattattttatatgtgttggttttacctctgtaaccaaactgtaactccccagaaagtatagcagaatactacctagtaaatactaaataaataaatatttttattggtttattagccaagtagtatagagactctatgaattttaaattacctaatgtgactaaatggaattaggaatagtgattagaatgctttgtgtctttttaaaattcataaatatatatataggctttattcaaacactcagagtttgaaaccggaaaccacttctcaaaccagtctgccccctctgaggctgaaagggttctcacatatatcctcatggagccatcataaagaaaaagagatattcttaattttttttaattaaaaaaaaagaaaagaagagatattcttaaactcattttagagatgagtagaggctgagaagagtataatgaggaagagatgatttatttcgtaagaaagaaaggtgagaaacaaagacattccagatgtatagagccctggaaaagagacatcatatatcttcagtacattcagtgttgtataaatagtacaatatggctggaacctcaagttgattcaaggcaagtgaatgtagggaaataaaagatgtggtttgaaaaaaatctcagtgtgtccgaaattgagctcatcacatttgtcatccccttcccaaatatttttatcttccttctcagtgattgttccaccacccacccagttttttaagtcaaaaattcagatgtcatccttgactttctcttttttcttctcttctctatacagccaaatgctaggttctgctaagtatgcatctaaattaacctgggaaattgttagaaatgcaaattctaaagttcaacaccagctactaaatcagaagccctggggttgatgcccagctctctgttttatcaagtcctccaggggatttttttgcatgagaaagtttgaaagccattgctgctggcaatgaggagtcattgagaggcttgaagcaggaaaatgacctagtagaatatgcattttagaaaggtcattctggtatttgtatggaagatagatggtaagggagcaaaattaaaggtaacagaactagttagtagaatacaaaaaataagataataaaagacatagaggaaaagataaatttgtgaggtattaaagagctaaaattgatcaatttatgttaccattcggatgcacagggtaaagaagagggagtgataggtgtctggtcttgcacactaagtaaatataatgatcagggtttggggaacaatcatcaatgccccttccctccttcctttttttaataaagttgagatgactttacggtaatcaggtataaatatttttttaaacagttgtctccttgagtctggaccttgggagagaggtcaggcttatcgataaggattttggagtcaacagtatactagctggtaatagctactgtctgaatggattaaataacgtaaaagacaaatcttttcctctatgtcttttatgttatttaatccattcagacagtagctattaccagctagtatactgttgactccaaaatccttatctacaggcctgacctctctcccaaggaaggaagcatttcagggtgagaagagaaccaaggatgaagtccttgataagaccaatacttaagggaggtctccagggaatcctgagtaatggttaaagagtaagggagagaaccagaaaattgatatcatgctggtagaggaggatagaatttcaatgagactaatagtgttgaatgccgtagataggtcaagtaagatagctaattagttatattagttagtacataagttccaaacccctgggtcatgtaccagtatcagaaccaggccacacaacaggaggtgagtgacaggtgagtgagcgaagcttcatctgtatttacagctgctccccatcactcatgttactgcctgaactctgcctcctgtcagatcagcagcagcattagattttcgtagcagcacaaaccctattgtgaactgtacatgtgagggatctaggttgcatgctccttatgagaatctaatgcctgatgatctgtcactgtctcccatcacccccagatgggaccatctacttgcaggaaaataagctcagggattccactgattctacattatgatgggttgtgtaattatttcattacatattataatgtaataataatagaaataaactacctaataaatgtaatacacttgagtcattctgaaacctgccacctccccagtccatagaaaaactggcttccatgaaaccagttccttgtgccaaaaaggttggggtcattgagttaggggatcactgtctttagcaattacaacttcaaggaagttttgagaacagaaggtggcagtacattaaggagtaaattggaataaataaatggaatttttagctattactagtttatgaaaggaaggaaagaaagagggagtgacagctagattgagacaaaacatcaatggaattttcttttattgaccaagataattgtgtatgtttacaatctgaaagaaaaagtgaattgggaagaaaaatttgaagatacatagagaaacagagaacttgatggaataagatctcaaagaataagtgaggggataagatccacagcagagtaggaggtatttgctttaaatattgtatttttattgtctcttaatgcattggcctctcccaagtaaattgagaacccctcaaatgaatagacacagtctttttcagtccctagtttagggctcaaaaaattttttgctgaatgaattaagatcatttcttgatttactttgatgcttcttctctcccccacttactctttttttttccccaattttccatccttagctctcttctcttgtcactgtattcagttgctccaggagatctcaaaaatgcctaaagtttctttttctgagacaggagaggttgagatgtgactagaccttttatactcagagtaatgctgaatcattaattataccgtcccttcctgtttgccttcccatggagccacactaagtagaattggattggatttgagggttgttttccaacatgctgcagacacttgatatacaaccttttatttttttatttttatttttggcaggccccttcttaaccctacaacctcagaaactttccatttttgtacctgctcagttcttccagtagaaagtaacccttgatgcatagcttcttggactgggaaggtcattagagttttttgatgatgattccaaatgcaacagagtagcttgcctgtttcaatagattttcctttgttttgactttgttgacctatcatttgctgaatgatataagcagcttcacaataaaagagggtatattatacacaggttgaagcagggtaagtatttttgtcctgagagaaaaatccgatctaaagatatatttgatttttttgtgtgtgtgtgtatgtaattaggaatgaccatttgaagtagaagcagagatgtctgagagcccaattttcaaagtaataatttgctatatttatttcaaagtaaggctctatggctaattttaggaaaggccttggaaatgaaccaacatgctttaggaagattcagatgtttagttttaaacctttccatacatgctttaaaacattctaatagttatctgtgaaagaaatgcattttaaatataagaaaaaaatgctatttccttttcagtgcctttctacagcaactgaaagttaaattagaatgccagctgttataaggagcatgttaatcttcctctagggcaagactgttcttctgatcttctcctgttttctctacagtgcccaacacagtgcagagaaaccagcggaaacttagtccatacttgttgacttgacagtttacagaaacattttgtcctctacaacctccttcagactatccctgtcgaccctatatttagaaaatgggttcttgtctaagtctggagacaaggttatatctgtggaacagatgctcattatagttcacatgcatattgaacaaaaattcagaaaagcaatgaggtgaattttataatcttcagaaatccccttgaaagggccacaagaataggaagctggtgcatatcatcctcataatttgtctgctctctaattggcaccaccaatgttttgggttccaattcattgacccatttttttattcctctgctttttcaaaaaagtatataaactttaaaagacactctgttactatttactaatgccacttgactggttactttttgtacttgtccttataagcagtgtataggtcaaaatcaatgtaaacattacctatacctctcaagcagtctctccccttaccatccctatccttcttagaggtcgcttccttaatactccaaacatatgcttctctctatcatagaactgatcaccctatattgtaattgcctattatgtttgtctgtgtcccccatattgaaccacaggcagaaactatcttccatttttgtatctcctgtacctgacacaaagtctggcatataataaaatattcaatatatatttgttggatgaatgaatgtatgatgctccaatataggcaaatttgccagtctacttttaaggccttcattaatctgatgctattttaatttttcaacttcatttatttatgagcacctattatgttccaagcactgtagatataatggtaaaaaaatagaaattatccctacttctataaaactaatagttcagtggaggaggcagacatattatcacacaaataagtataaaattacacctgtggtgtcttgaatgagaggtacacagtgctgtaaaggctaataatggggcagggtgggaagttttcctaatttaggaggaagtgatacttaatctgggatctgaaagacaattagcattagttaagtagaaatcaaaagaaaatattctgggaagtgagaacagtctcctgtgcagtagaatcccaggcagcagaagggagagatgaagctggagaagtaagcaggtgctaaatcgtgtattaccttacaaaccatgttaatgagcttttgtctttattctaaaagcaacagaaaacatatcctacaacattcttggtctttctgttctttttcaaaaccacaaatcttagtctttgtacttctaatcatactatcctctacttgtattatagtcaccacccttttccactgattcaaatcttgttttttgttcaggtatagttcaagtcttatgtccttcaagatgactcctttattagttcagtctagacagaataacctttcatattgtatagcacaaatttatactgtttatatacttattgtgcgggctcttatatcatcctaccttatacttttatgatgatttcatacatggcttttcactcaagagactgtgtaatatttgttttctgaatccctcttaaatatccatagcccagtacttgattcacactggattcccaagatatactgagccatgaaacttgatataaaccaaatcttagaatatattaagggaaatactttgatcctaatgctgttggtgatgacacaagtgcatgcatttgaaaaataaaaaatgcagttatattacctggttttattggctacatcatagcaactacttcactaagttaacttgtcttttcactgcacttatcaatctgcattttactcattcaataaaaatatactgaatgtagattttgaagcagctaccgtgtaagtaaggactgggaattaaaaactgaatacaatatggtcttgactattatcttactctgttttgtgctgctataacagaatatctgagactgggcaatttataatgaacagaaatgtattggctcacaattctggaggctggaaatctgatactgaggtaccaccaggtttggtaattctgattccaacatggtgccttcagcactgtgtcctccagaggggaggaacaattaatattcacatggcagaaggcagaagatcaaagagataagaagaggacaaactcattcctttataatggcgttaatctcactcatgagggtgaaaccttcatagcctaatcacatcttgaaggtcccacactttcatattgttaaaattgtaattacattccagtatgagttttggaggggctgaacattcaaaatatagcaatcatcacagagctaaaaatatggtgtccaaagctattaaaaatcacatttctattgccaaaaggttatatgagattggttgacactcaggatccttaagcagagtacaaatgatatatttcattttcacaggaaatgtagcctcaccataagtttatggatacaaagtctggatattgtggaatgtgctcagcattaaagtaatacaacaaaaataatttcctctgtgagtattatagtctttgatattgaacctttaggcactgtacaggtaatgctctgtgaaaagcagagttttatagggataacaattcatctatacttttcagtaaggctaggtaaaatttcttccaactgggaggcagtccagagctaggactcccttaggttggtgattttctttatgaagccattaagaagttatgaaggtatctagagatagagatcatcaatcagtgattgattattagcttttttaaaagaaagactttggccaagtatatgaaattctgattatttactctaattcttatgaaatcttagggtaactgttaatataaagtaattgacattaaaacattaatataaattcttaataatttagttaactctttgagttaaccaaaacctgactaaaatctttgtcctattagaggagacacagaaaactacttattctattaattagcatacattttaaagtatcctgaaggtaactagcaaagtttaggtgcttgaaaaaaattgtcactttcctaatctgccatttgaagaaaaatgctcctaaaattaaactattactatgttttgttcatgggacatgttacatcaggggatgtttcctaaaggtttcatagaggagtagtcaatacaactttcaaaaatgaaaataaaatttaaaaataacctaatattaattttgactccttttttaaaatcttcagttatttcatctgaagtaatacagagttgcaaggcattatcactcaatcataaggatctttcaaaaattataccaccctgctatgaaagactcaatttcaaaatattaatgattacaagccagagcttctgtaaacatacatctcaactttgaatactggcaacactttcagcaagataaggatgacaagaaaatgtactttcctagcctgttttcaaagcacatacacatttttaaaaggtcaaggggagggactttgtaagaatgtattattatagctttttactgaactgatttgttttaggtatctttttgttcatatcttttatgtctccatcatagtaattgtattcttatatgatgaaaataggatgaaacaaaaccactgagaatacacacactgtctttgttcctgaaggacaaacggtgacccaagtcatgggctgctttggctttgattaaaattaaaatcttgtacagattccagttctgaacatatgtctcatactctatgtgctcacattagggtgcgttaaaaatattttatgctaacagattacagtaggtaacagtatgcctttgtttcctacaaaagaatgagtcagtaaattgttctacttaatggataaaagactagctcaagatgcaaatatatcccaatagctctaaatcccactgtaattcttcctaatttaaggcatttattaactcataacagaggctcaagctattcatatttctagcttattttatttatctttctcttattacctgttctactctaagctttgcaaatcttgaaaatcctaaaaatgtcaaaggagagacttcaccaattaaagtgtgctgcaacatagtggagagaatggaaccattgtgtggttcatattgaactgcatgatttatatgagttttctttccttcccatgatttgttgtagcaaccaacttcacatagtcatgtaaaaattagagggttctaagttcttccaattggctctgtatttcaaagtacctgttgaactaggcaaacagaatagcatcattttttttaataatcagtgatttggtgaaacaggtggaagatacatttttgtttccaaatgctttctaagaatgactataaatgcacagtttattaaagagattcaacaatgccatttccctggtgcttctctaccaagtaaatgacattttgaaatattattttttttctaaagtataaaagacccacccagccattatataaaatgagggaacacttcttgttgtgttaacatcttgaatctagtctcagggaagctgttttatgagatttactggtgcaatttggttgcagatgctcatgatttatagaaaagctcatggaaacagacagaatctgtataaagaaccaaaataaaaacaaaaacattaggtaactcacatgaggtggatgtcacattaatcatgtttttgtcattttggtttaatgttcatgtcttggggagtatttgagagtgatgctatgtgaccttcagatccctgtagagtggttcaggttcaaactcctggaaggctcacatgtgataaggtttgggctactacctttctcagcctgtgaaatttgagactttccccacattttcccctaaccaatttatccaaacctccacacctccaaacggccattaaattttgaactcctactgctcttattctctttcttccctcttttgttaacgtaataatttatcaaccagtttttctttaggaaacaaaaatgtattgctgcctactctgatgtttgcacagtgttttagaaggcaaacttcttatagatggtatacagcctggtgcttctcccttccaaagtgccttatacagtgctagttataaagttgatgttcatcattggcttattaattgattgatccttgtgtcctgtccctcaactagtcttagacattgtgtttagaagataaatagagcagggaatttttcatctggcctcattgttcctccaaccacagagatgtgagcccacctagtgacaaagtactagaaaagagagcaaactgtcagcttcatccttgtctgtcagagcatgagactggtttagatgactttgcctagttgatgttaagcacattctcatttcccatgttaagccttacagatcaactagactagagtagtgctgtgatatgttctcacctcttttcccagcccctaggttacctcatcacaccaccatggattagactgttagtatttgttgcttttattacagatgatttctaatatgtaattcattttcattaaaggatgatgctttattcttccttgaaattttctgttctccctcccctttttttcctattctgttcagggacaggagggatgaggcacatttattcccaaaaaggagagcagatgtagtggttggtagggatggcaggttctcctgaacttacaattccatattttgcatatttatattcaaatggttcaacaaatatataggaaaggatcctgcaggaccctacagtttccagaactgatgatttgtcatctgaaaaggtatttttcttcatagcttgagaagaagttaaagcaaggctcttagtatacattcaatctaaaattcaacaaaagattcttctcatttacagaatgaaataaatgcatattatttcgccatactttcacaagattttatttgctactacatagacacctaggttatatgctaccctaaccaataaatattctatgaccaagtttatgtatttcctatacaggcagattttttgtatgttttgaaacattctaagacagtagtgtttattctcacatatggttatatacatatatatagagagagagacttgtttttgataagtgatgtatggttcatgtaagtgtctttacaatgtattatatttaaggtttgattttgtagacatgtttagtttgatttttggagtttcaaagcttatgaaaatcattttggttcagaataataaaataagttagataatgaaatttatatgcattttcatatgtctgtacagaacttgatataaatactcaaacattcttcctttatatacctttaggtttaactttgatttgatttggtaacataagattaacagtgatataaattttggttcctctagagaaagaaatacttgagaccactaaaattaaaaatcttgcattaacatcctataattgtatgaaaatttaataagcttcagaaaatataatatatttggagccttttataacatagtgtagcatttgcttggaacatggaatgaaaattaagagtgaatcccaggttttagccaagggcaggaaggtggcaaagggaggcgaatccgagtgggtggagggaggggaagggcgagaggagaaaaaggtgggaggaggaccaggtgggagggtggcggctccctcaggacccagcgggggcagcgcgatgaggcgggtgaccctgttcctgaaaggcagccctaagaacggaaagagtaagagacttaaatgaatatgactgattgtcacacaaaagtgtgtcctacttcaacactcagcattcaagaaatatttatcaaagacctgctgtaagccaggtggttgctgtatatggaactttatctgatttgctttctgtggccagcagtaaactcggcataaaagccaccagtgtgtataatgggaaaggtggactgattgatgatattgctttgatcagggatgatgatgttttgtttgtttgtgaaggagaatcatttattgatcctcagacagattctaagcctcctgagggattgttaggattccacacagactggctgacattaaatgttggagggcggtactttacaactacacgcattactcctaccaggttgtagcatgcatctttttgagagagcagctgggatcgagtatactcttgacttaaatgtgtttgtttataaagacaaatggagaaatcaatttgtttccctgaattctaaggagcactttagtgaataaagaacctgacagtatgctggcccacatgtttaaggacaaaagtgtctggggaaataagcaatatcatagaggcgctttcttaattgaccgaagtcctgagtactttgaacccattttgaactccttgcgtcatggacagctcattgtaaatgatggcattaatttattgggtgtgttagaagaagcaagattttttggtattgtctcattgatctaacacctggaagtggcaataaagaattctcaaccaccggaggatcattcaccaatatcccgaaaggaatttgtccgattttttgctagcaactccaaccaagtcagaactgcgatgccaggatttgaacttcagtggtgctgatctttctcgtttggaccttcgatacattaacttcaaaatggccaatttaagccgctgtaatcttgcacaggcaaatctttgctgtgcaaatcttgaatgagctgatctctggatcagtacttaactgtgcaaatctccagggagtcaagatgctctgttctaatgcagaaggagcatccctgaaactgtgtaattttgaggatccttctggtcttaaagccaatttagaaggtgctaatctgaaaggtgtggatatggaaggaagtcagatgacaggaattaacctgagagtggctaccttaaaagatgcaaagttgaagaactgtaacctcagaggagcaactctggcaggaactgatttagagaattgtgatctatctgggtgcgatcttcaagaagccaacctgagagggtccaacgtgaagggagctgtgtttgaagagatgctgacaccactacacatgtcacaaagtgtcagatgagaattttagaggctggaggaagatgtacaagatgaaaatgttttccttatcacttttctttctccactcactcagttgtctagaagaaataacactgtaaggaaattaaaaaaaaaaaaacacatttagaggattatgcttgttctgagcggtgcataagggaaaaaactgactttttttccatattctgatttttaacagaaaagcactcatttaatagatgtagggaaactagatattgctgccttttgaacggggtaggggggtttacctggttttatgaccaggaatagtatctattatatttgcttttaaataggaatgatgtggaaataccatcttggtttgagatgcatttgaggattttaatttatggaaagtacaacatatgcaattatatttattgaatacctagatgcagtatggatatttaaattgttaaaactttatgaaaacttggaaaaggttgttcaggtttataaatagctttagtgacgcctcccctctttaaatacctgtcataccatatgaatatggtgagattagactccctaagactcttttcaggttcatttttataatgtttactttttaggttaggacaaaacagtagctaaattaaagtaatatccagttcttactgattgagacagagtggaaagaaagacatcgttgtacttcactgtcattccaaaggtacagtggaactccggatggaggaataacttacctatcactacaacacttataaatgagaatttctcagaatttcattctaggcaagttccactcaacaccagaccaagcaattctatctatttacactattagcttagttttctcatacaatcatcacaagcataggaagatacttcaaaaccaaaaaaccaaggtgcatcattaatattcatttaattcaaataccaaatagtttacatagggccagcttagaaatagatactaaatccagagctactgcaatcaaagcttatatgagtgaatatggtagagttgcctgctaaaaggcaatgtaatataattgcagctagaaccctacagtggagaatgaggaattttaaacacacattttattatagccaccaaaaaacagatgtaaagtaaaaataaaggcatttggctggtccaagatgtaataccaatcagtcagcacctgtgattcttttacttatattttttgtgtttttttaaacaaattttagcccaattttcttgagtcattatctctctgcagcagcagaggaagggcctgtacctccctaccaatgacctggtgtccttattttctaccccaagagcagggatattagctgtgtccaaatgggttctgaattctacagactcatcaacatgaggcaaggaatcattgaaaaccacctgtgtctcctttgggagaatgacatatctttagtatttacgtagcttattcttctatatctacatatgcaaagctttccttaacagtaaagggtacatatgcatagtgggaggagatcagacctttacaagtgaaggaaagcaacttcagaaatgaattattttctttgctttgttatttttaccaagacagagaagtattgtattgagagataatctattttcataatcaatatatgcctaaattatatttaaatcatttcactctgtactatattttcaggaattatagaatgtgttattcattcacttaaaggtacctctgtagaaataacctaaaactgcagaaggatctgaaagatctaaacatggtgtgcttagaaactgcagattttagatctaatgtatacagcattaataaatgatataaagtgttgaaaaaaaaaaaagagtgaaacccaggttttagatatacctctaccagttacttgctatatgattttgggaaaactatttttttgtctctgagctttaatgccattatctgtaaaatgcagtgttacaatagatcattgtaagttatagccaatatcaaaatttttcttatggctgataggaggtttatttcccaaatctctctctttagaaatgcttaggtatgtctacaagcatatagcttaatatttcaaacaaaacattgatgtttacctttattaaattttttcacagctttaatttttgagtacctatgcctccaaaccagtcaaatcaatttttccaaacctatgcctccaaaccagtcaaaataacttctatatattgaagtttttgaaagcacatgtaaaattcaggataaattaccattgccatgaaaaatgctataggttaggtgttctttaaaaaaattatatacatctaacaattatttattggagacactactatgttctaggcattgtcttagaagcaggtgatacaaaagtgacagatagcatctctgctctcacaaagattatactcttttgggagagagaaagtgaagaagaaaacaaaacatacaaaaattatcagctagtggtaagtgccacccagatgaacaacatatgtgatgtggtagaaattgaggagatggaatggaccaggtagtaagggaaagcagagatctgaatgccatgaaggagccaaccacatgaagatgagtggggaaaaaattccaggctcatattatgtgaaggcccaaagcaaaaatgaactcagcatgtttaagaaattgaaagattagtgagactgaagcttagtgggagaagtagagaatggtaggaaatgaggtcagaaaggtaggcagggaccaaattggctttgatttatagatagatagatagatagatagatagatagatagatagacagacagacagacagacagatagatagagtgtggggggggggttggaaaacatattttaaacaaacagtatagatttggggtatgcttaagatttagagtcaacagcacctgttagtgagatgaatatgaacagtaaaggaaagagaaattggaaaaacacctagaggtttggtttgagcacctggataaatggaggtgccattaattaagatagcggaagacttgagggaaaatcaagtgtagggtgcaaagaagtaaacatcaacaactctatttagtcttattaagtttgatatattaattagccatccatataaagatgttaggtagatagttacatagagaagcctgagtttctgggtagaagtcaaggcagtagatccatatatgggagtcatcagtatctatatgttatataaagtcatgaagcagaggaggagaagttagcaaatagaagtattggttggtgaggtaggaaaaaaataaagagagactataggaggaggcaacaccaagagaaagagagcatttaaagtgggagggattagtaaactatgccaaatgttactgagaagataatgaggatgagagctgagaaatggctatcagactgcgcaaagtggagactattgagtggtggtaaaggaagcctaattaatgttgattgagaagaggatatagagtgaggaaatgaaatttcttcacactatttcccctcctgggataggcttggtacttataggccaggagagaattggaagagatactcaaagtacttaaagaaaaaataaatcagccaagaatactatatccagcaaagtaagttatccttcagaaatgaagtaggaataaaaaccccctgagagaaggaaagactgagaaaattaaccaccacaatactggctttgcaagaaatgcttaagggattcatacatctggaagtgaaaggatgacatctaccaatgtgaaaacatgtgaaagtataaaacccatcagtatagataattccaaaatcacactcagaataccccagtgctgtaatgttgctatgtaagtatttcagtcctctagtatgaaagtttaaagttaaaagtgtcaaaagcatcaacagctataattagtggctaaggtagaaacaaagataaagttataaattaaggcaataaaatacaaattatgtgggaggagagaaaaatctagagcatttttatgcaaccaaagttaagttgttatcagcttaaaatagtctattgtaattctaagattcattatgttagttccatgataaccacaaacaaagaaatcacagcagatgcagaaataataaagagaaagaaaacaaaacttaacaccacagaaaaccaccaaaccataaaggtaaacaacaagagaggaagaaaggagcaaatgatctataaaacaaccagaaaacaataaactggcagaagtaagttcgtacctatcaataataaccttgaatgtaaatagattaaattccttagtgaaagatatagagtagatgaatgcattaaagaaaaccacaaaacccaactatgtgctgcctacaaaaggctcacctcactattaaagacaaacatagactgaaagtgaaagaatggaaaacaatattccatgcaaatggaaaccaaaagtaagccggaatagccatactcatatcagataaaatagactgtaagtcaaaaacagtaaaaagagaccaaaagattattgtataatgataaagggatcaattcaacaagatgatataacaattgtaaatatatatgcacccagcaccagagcacccaaatacgtaaagaaaatattattagatctaaagggaaagatagactgcaaaacaataatagtaggggacttcaacaccccactttcaacaatagaaagaaagtcaacaaagaaacgttgaacttaaactatatcgtagaccaaatgtatctaacaaacatttacagaacattccaataaacaactgcagaatacacattcttctcaatttcacatggaacatcctccaggatagatcatgtgttaggccacaaaacaaatattgacaaatttaggaagaaaaagagcacatcaagtatctcttcttatcaaaatgctataaaactagaaatcaataaaaagaaaaactttggcaatcttacaaatacatgggaattaaacaacatagtcctaagtaaccagtgagtcaatgaagaaattaaaaagaaaacttaaaaattcattgggacaaatgacaatggaaaacacatcatacaaaaacctgtgggacacaacaaaagcagttctaagagggaagttcatagtaataaatgcctacatcaaaaaagaagaagtatctgactccaatatttattgtagcactatttacaatagccaagatatagaatcaacccacatgtccaacgcagatgagtgataagaaaaatgtagtatatatatatatatatatatatatatatatatacaatggaatactattcagccataaaaaagaatgaaatcctgtcatttacagcaacttggttggacctgggggacactatgttaagtgaagccagccagactcagaaagacacataccataccatctcactcatatgtggtatctaaaaaaagaaagttgatatcatagaagagtagagtagaacaacggtaataagggaaacagagactgaggcagaggtgggagaaagaaggaaggatgtggcgaagttggtcaatgcatgctaagatacaattagaaggaagaagttctggtgacaatgcttatcagtaaggtatagtgtattacaaaagagctaggagagagcttttgaatgttctcactgcaaagaattataaacacatgatgtgatgaatatgctaagactatgatttgattattatacaacatttatgcatctaaacattgatttgtactccataagtatgtacaactacaatatgtcaataaaaaataaaaattattctgatgaagaaaaatatatttggagtttagcaatttcttctaattgactttgatttttgttaaattcaaggaaaattactgaaagtaatgcatttattcaaaatataatatggaatgttaccctattttttaaaattatttttctttccaattttctatctatatctctacatagatggctggaatgatgtttaataaatgttaataatgaatgtttcagtgtggtaagattctgtattacagtatatgtaatttattttctgtgcttttctatattttatgaatttctgtcataagaacgtattgtttttataaaatatcaaattgattattttaaaacattgtgctaatgtcgataacatgggtttttttccccatgtggtaaacagaataatgtccccctcaaaaatattcacattataatcactggaacatatcagtatgttatgttatatggaaatgggaggagtaaggctattaattagctgaccttgagatagggtgattatcctatactatccaggtgggcccagtgtaatcagaaaggtccttataagaagaagaaggcagaaatgacagaatcagagagatgacagcaggagagggagtcagtccagctctactggctttgaagatggagccatgggaccatgagccatggaatgtgggtagcttctagaagctggaaaaggcaaaggaatggattttttcctagagtctccagaaggaatgcaaccttacttacaatttcatttttagctcatcaggactcatgctggaattctaatctatagaactgtaggaatacattcttgttattttaaatcattacgtttgtggtaatttgttaagtagtcataggaaacaaatacactcacttccacttaactattatctaatttattctctactcagcagccacaacaaacgttataggcctgcattgtccagtataatagccattagccacatgtgctaaatgagcacataaaatgtggctggtctgaaatgagatgtgctgtatatgtaaaatacacactggattttgaagacttagtatgataaatgtaaaatagctcattaataatttttaatattgacttcatgccaaagtgataatatttgggctatgtttggttaaataaaatacaatactaaaatttattttccctgtttcatgttacttttaaaatatttgtctacaggaaagcttaaagctacttatatggcttacattgtatttctattacacagtgctgatatagaaggcaaataagacactatcattttcttttttttttgagacagagtctcgctgtgtcacctaggctggagtgcagtggcgcgatctcggctcactgcaaccgccacctcccggattgaagcgattcttctgcctcagcctcccgagtagccgggactataggtgcccaccaccatgcccagctaatgtttgtatttttagtagagacggggtttcaccatataggcccggctggtctcacactcctgaccttgtgatctgcctgcctcagcctcccaaagtgctgggattacaggcatgagccactgcgccaggccaacactatcattttcttattaaaggccttcaatgtcttcccactatacatgcaatattcttcaaactccttaacttgaatttataagatcttgcatcatctggcttctggtacctgtttagcctcatcttttgcctcttatactccattctagtgggccaagcttgtttctgcacaggggctttccatgtgaggttcagtagacccaggaaactcttcatttcactattcatttgattgaaaagctctcatccttccctctcagctcaagtgtcactcaggtataccttctctggaatcccaatgtaggtacattttgctgcctcattcatagcatgctgttatttttgttaatggcacttttcacaacatgtaatgataaagtttttgtttatttctaaaattctctttgaaaatgataagctcagtgtatgctttatgtattaggcaaagcacagatgctcagtaaatattaaattaatgtagaataatcaaataagataatgtttatgtgaacacattataagctataatttactgtacagatgtaataatagtaatagtcatagaaagagaaggaggaagataagggggaggaagaaggtaagaaattaaagtctttgctttgcatcaatttttaatagatttttttccagtctcttatgtctttaaacatttgggaataagtaacacaataagtagctatattccattgctttaaaataaaagatctattttcaaagacatatcccaatttcttcttaaaggaagttttctaaattgtttgctggtgactcgggttcccttctctaaggcataatatgtatatccacagtagtgaacacaatgggaatggagtgtggtggagtaggtgttggagaaagcaaagcaaaaccagcattaggatggttatatataataggaatggttatcatataataggaagtcagactgtgcaaatatttgttactgctatacctactctcttaaatatgggagtagcattatttgtgttctaggtgaagctgtccagagctatatgtctatttgagattgttagtttttgcaacaggaacatgaaatttgtgtccctaattgtaatgctcaacagtcttgctataaataagtataattgcactgtactttctttatatttttttctaattagaaatttatttttccctgtcaaagtcagagcttaagcacggcctttcttaaatgatcttaaagtaaattttcctacttatgtgccttttctacaatcatttctgacttaaagttaaccttataattagcattttaatagcccaaaagccttccttgtacttagtagcacattacgatctgcattgaaataggaatgttataaaagaacaaaataaaaaaattacttatgttagaaaagttgtttttctaggttttgtttttgtgttttccttatggcatatcctctctatatattagacaaagattaaaacatctctttttgaagttactgaatttattattggggaaagttatcaaaaccaatcctctacctttaataaaaatgccttaatgtgatattttaaaaataatacccaggaaatgatgctttcaaaattaagattgatctactcatttccaatttggagaaccaaaggcaaactaaaaccttttggcttatatttgttagttatagatagatatggatatggatgtaggtatagatatagataaaatcagacttgagacagcattgaaaaattgaagtgtgccattattataagataccatttaataagccacaataaaaaaaatcttattacgtgattcctgtatatgtgacactgtttgccttagatacatctctatcttttgctgctatttccccatccactcatacacacatacttattttatcaatgtctcaacacctgaagtactcccacttctgcctctgtgccttgtctaatcatcgcatctccaatcagattgcctgagttcaaatgttcttttcacgacattatttgctgtgtagccttggtaagttacctaacgtctctgtccttcagtatttgtatctgtaaagcaggaaaaatgatggtacttcttcatagaattgttatgaaaatgaaaagtaatgcatgtaaagtattttggcataatcttggcaataaatgtaaactattatttttactcctttaaattatacgattaatactactgctactattttctctactgccagccctctatatactctatatttattaaatcagttcttaaataatccttctctccgtagccttcctgtattaaagaggaaagataagagctcttttctcaccccacctttgcttctgtttcgcttgcttctcattgtcttaagaaagagacttgcggggttaacagcagcatctctggctgatgtaatccaaacctcaaaagcaacatattaaaaataaagcagaacatcaaagctggttctttaataagtcctctgtttccttcgggtcccacacctaggcgacagtattttttcatactttgttcttgtcccctattccatgtcttgcagatctagctcagttttgtaaattgcaaccttttctcctttcttctgtagttagttcatttcatttgaaataaagcatttaatgatcatctagccctgtgctagggagtcaggatatgagggagagttcttaaagaaacaaaatcgtgagatactgcctcttctttcaccaaacaggaaattagatttgtataagatttatatgaagtaggccgggcgcagtggctcccgcctgtaatcccagcattttgggaggccaaggcaggtggattacctgaagtcaggagttcaagacagcctggccgacatggtgaaaccccatctctactaaaaatacaaaaattagctgggtgtggtggcgtgtgcctgtaatcccagctacttgggaggctgaggcaggagaatcacttcaactagggaggcagaggttgcagcgagccaagatcacactgttgcacttcagcctgggcaacagaacgagccttcgtctcaaaaaataaattatgtgatttatatgaaattattagaaaatcctgaaagaaagagtattcatttggtcagcattcatcacatgtactaaaattatttgtttttacatttttctccattaccatagtatgagttcccttggggaaaagtcagtgcctcagtaatactgtttatctgctcaagttcctgtcttgtaggaggcattgaagatattttttgaatgagtaaatggcaggatgaaaagatgagacctagatcttatcctcaagaagcttctagtctgttagaaaggatcacttgtgtacataagtagtagtaatccttattctagcctacatttatagactcttctctcctctacttcccaatgtacccagtccatagagaatatgacacgtatgcttacacctctctttcataatttcttctgctgagaataccctttcctctttttccacttatgaacttgtattcatttatcaaggtacaactcttaatagtatcttatcagtaaagtcttctctgagtcttttccccatgtagaacaaatccctctctcctctgcccacttacagcatttttcatatacctcgcttagctcttagtacattaaatcataattacttatcattttttcagctttaatgtgaactccaaaaagagtgagaccttatctaattgatctttgtaattctagggcctacaaccgtgtctggcttatagttagtgctcaacacatagttgactgaaaaaaaaaatgaatgaatggatcaatgactcaatgaataattgtgacaaataccctaaaagaagtgggaaaaaaactgatatatgattgttattttgtatagtagggtcccaagagccaaattcaaattccccctttttggttaaagctctccctgcctcagtctcactccttttttttcagttcctataccttctgtctgttcttgactttgccataaccgttgcctgttatgacagattccgtgagcatccagcacagatgtatgtataaaaacaagtaagattaaccataggtgagattttgtcacttgaaacataataatatcatgtataactaattgttgcatgttctaattaattgcatattttgattaattctttggcagggaataatcctggactaattttcacagaattagaaggcagtaaaatatactcaccactgcaattatactaaacatagttgaatggagaagattggtttgaatctacactaatcccaagatgtacatgggaatttgttctttaaaaaaatacccagcatacttgtcatttatcatattgttataaaactcaagaagagaaaagaccccaattacttttgctttccagttgtttggagatctgataaaaggaggtattttgaaaatggctcaacaacaactgacaaaagtccctaatggatcatatgctttgtcatcctcagtagcatcactggtttactctgcaaacattagcagtttccttaatctccacagtcattggcttgagagtgaaaacactgcatcacctagttagaaccacaaaaactagattggttttatatttaagtgctttgaaaatttagaataacacctggtaacttataacaattgtccagggaacatctataacgtgcaattgctcagggagtgtttcggtaaaatttatcctgaaacaagttggccagcagccacatcttgaaaacatctatgttataaagaaaaatttcatcatactggtacatttttccatagagtttggcatgtattatcaatccactattactttagaagtataatcttaataatattttttgaaaccacaaggtttacatttatattttcctgattttctaggaaaattagatggacctgtgatagaagtagcattcggtataataagtatattttacagtcaccacatacacagttactttgaatatctgtcttcattctatatctaccaaggattccacgtctcactatttccagaaggctttttcaaagcacgaattctactgaattgagaatggggatgttgtttgttgttttccagaaatagacttgcatgctactatattttgagcaaatgatcacaaacacatccgcatgagaaggcaacagatgtaaagaaaaaacttctatatttattacaaaccaagggagcaatgcaagtatcacagcaaatttgtaccaacaattatatatattcttttgctgacagcttggtctgcaaagctgctagagtgcagaatcagcaagtctaacccagaggcaactccaatctgatggataatatttgattcagtaaatgaagtcaagtaggagtttaaaaaccagttacatcttctttcatcagacattgcttcatcttgtcagtctttttttgtagactgtaaattgaataatacaaaatgttatctgcaaaaaatttttcagcttgttataaagtgagaccatttgtgaaaggatgaaatagttacaaatgcgtatttgttactgataaatgatggcatgtatgatccagtgttttgaactttcctccacattaaaaaaaaatgttggagataagaaaactaacccaggtttttttttttcttctgagtacaacagataaaaggaaaagttagcctgggagggatttttgaagttctttggttcactgattttctaacctgctttcacattataaagcacctaaagtactttttgaaaatatagtgttaggctccactctgaaattttgattcaggaaatctgaaactacctactaagtactgtcaccacaacaagtctatgcacttattcagaactactgatctaattcaactccttactcaatgcggaatcctctttacaaaaaccttaaaatgtggctgttcactgactcaaggcagcatagtccattgttggacaattctagttcagagaaagtttttatgtattaaccccaaatcctagaaacttctccccaatattgtgtgtccagcaacttcacatgacccttccatggtcacacatgtgcttggttcatcagggactccttattttgcttagccaattctgtctcagggcctaaggagtgtgcgtatcaaaaaacaaaattgcattaaaagttacatttatattgatgaaacaaaatatccacaggtttatgtccctcaattagtagctatgctggattgagctgttcactcagaaatggcttctaataacttaaatgttggctgagtatttaagattaagatttgccacttaaatgacagcaacacttcattcagtattgggaagtgtgagaaatttgactgacaagccccactagcctatttacaggtatcagggttacagttgaatttaaccttacactcaggcttctccagaccaaaagagccccatcttctgaacttcctcaaaaagcgaaagacagatctgagaaacctgtgccaagacaatcacatcactgggaataagaatagtactgtgaaccccagaaatctaagacaggtctcagttaatttagaaagtttattttgccaaggttgagaatgcacacctgtgacacagccttagcgtgtcctgatgacatgtgcccatggtggtcagagcacagtttggttttatacattttagagacatgtgagacatcaatcaacatatgcaagatgaacattggttcggttcagaaaggtgggggacaactagaagcaaagacaggacaactcaaagtggggagtgggcttccaggtcaaaggtagataagggacaaaagatttcattcttttgagtttctgattttcctctccaaatgaggcaatcagatatgcatttgtctcagtgagcagaggggtaactgaatcaaacaggacgcagatttgccctaagcagttcccagtttgacttttccctttagcttagtgattttggggccccaatatttattttcctgtcacacattcccccttctcattttaaaaatcttttggagaaagcattttagaagaaaataagtctatgatctcaggtttcgtctgatagatcatggctagaatggtttattcctagatgggtaggtcctgagttattaggaaagttcatttttagcaaattgtgaagtctcatgtttatgaagagaaaatagggggaagaggggagaaaaacaacaacaaaccaaaggatgagtctttactcatcctggaaaatcaatataaggcacattactctgaagtccatacatcagtaggcagctatgaaaatggtttatgtaggtaaataggttgctgttattttcttctgaagtttaagttgtctagcttcagttcacagggctttacaaaagcacagcttagttttcagtgactccaagttagaaaaatgtggggaaagagaaggagaaataactgaaaacattattttgaagacttacagccaagaaaaattagaattcattccaaactatagaaaataataaaaattgaaaaacattaggcaagactagaatctaacaacacgtttactacagttttttaaacatattttttctctctccagttttccatttttactaaagacaaattatggtaggactgatttgttttattatacttggcctgattatttgtatacagtgcagcaagaataacattttttacagaagcttttaaattggctttgatggaattttgtttcataggagtctcagataagacttttaaagctgagcccagccttggatttataccatcaaatgcctatgatttgggtgaattcctcttctcttgaggttccaagataaacctgggggctcctggtcctgtcagaaagtgacattctttacttaccccgggttaggacccctgtacagggaatgtgtagacaaggtataaagtcagttttcccaaggggcttttattggctccacaattcaagtttgattccttaaaggaaagcacaccattccagtcaaagccttagtaaaataaccagtttctccaattgcgtcctgttatagaggaaaacagattgttatttcacttgtgcaaataacaaatattaagaatactcataaatagcttccaaatactggagaattcaggtagagagaaacaaatatattctaaattttgttcatagaagtataataaattgttaaaagctgccaatagctcaaaagaaaagtttccttgactctggaaaaacagaacaaaggatcagcaacgttttaagcaaaaagtcaaaaagattacttccgtcttctactagttcagtccatgtagttaattcctgttctgcttgatattcatgaacatttcagttctccatgagttctaaaagttttacttctgttctgatgttacaatcttcaaagttatcagaaacttgtattcaagagcacctgtgggagttttatagctgattataaaaccaccttctaaagaggaccaaaacaagacaacaattgtctgcagatgacaaaaagttttagggcagccagagtcaaggacacaattgacaaggaaatttgttgcctttgttgcacacaaaaaattatgttaataatttaacataacaattataattattactgataatgtccactaagtcatatcagaattataggagtttcccattattttggaacacatagcaataacatatgtatacaaacacggtgcaaagaaaactaaaagccatttcatatttgacagtgttttctgtataattttcataccgaataaaccaaattgtcatttttggacttcaggaaacctaatatcttaaaggattaattaggtcagaaaaagacataatttataatttgattttggtaagtttgtcaaatatccaaaagttagaacacatgatatcacaggtcattgtaaaataagtcattcatttggccaaagtgataactcaaggatttcaaacaaaaagtgagaaccttcactctttgagagatttctttttcctttctcttttgcagctgtgaggaattttggccatattagagagactttgttacccataatttggaattctcactcagatttgacccagtcaggtagagttggtcaaatctgatgggagaaagaatggaacaaacaacaacaacaacaaaaacccaacaatatgatcactgagcactctaatggtaaggagaaattaagacaagttagttgttaaactttagccaaggcaaaaccccaattcagctacttacctagggatggttctcaggctgaagatggctttctaccattctagaagcaggagaaaaaatcctcaaactcatcttccctactgggagcgaactcaaactccataaaggagttacctaccttccatcatcatggaaacaggaaatcttgccttccttgttggaaacaagtaaaaaaaaaaaaaagggtgttgacagcaaaataaactttagatcttgaccaaatttggggagatcagggattatctggagggggtgctcctagacctaagcaaattttcctattggtttgagccataaagttagttcatacttgtaccaagcaccagtaggagatttgtcaaaaggaaggggcatctttattcagaatcccttcatggttaccaaaatgtgaaccccaaaaatctgaaacaggcctcagttaatttagaaagtttattttgccaaggttgaggatgcacacccgtgacacagcttcaggaggtcctgatgacatgtgcctaaggtggtcagaacacagtttggttttatacattttagagagacatgagacataaatcaacatatgtaagatgaaaattggttcggtctggaaaggcaggacaactcaaagtggagaatggtcttccaggtcataggtagataagagagaaatggtggcattcttttgagtttctgattagcctctccaaaggaggcaatcagatatccatttatctcggtgagcagaggggtgactttgaatagaatgggaggcagatttgccctaagtagttcccagcttgacttttctctttagcttagtgattttggggccccaagatttattttcctttcgcagtactcaaatggagcaggaagtggaatgatacagaggacgtacattgaatctggggatgggggtactgtggagaagctagttaaacagtaaacagtcccagctactctggaggctgaggcaggagaatcgcctgaacccgggaggaggaggttgcagtgagtggagatcattccattgcactccagcctgggtgacaagagtgaaactatgtctcaaaaaaataaatgaataaaataaaaaataaaaattaaaaaaaaacagtgaacaaagggattaagtgtgtactgataatccttttctttccaccttgtcttccttcttggtggtaagcttagctcttgcttagctcagttcacacctctgccatgccttgtaattctgtgggacatcacccgggggagtcctattttggttgccagctgggcttggaagtacaggctctttactctgggtctccatccaactgagccaccagagcagggtcagacttgaaagaaatccagggcagctactgtcctgacagataacccagcatctttcattccagagaacagtcaaattagaggagagagatttaaatcttaccttgctgagaagaggctgtcacaacccagaccgctcactgagaacagcattctgactaaaccttggaagggtatggacatagtaaaggagattacttgggtttgaggtcaacaactctctgcactgaatgcaatgagggtgccaaatgtcatcttctaaattaaggacctggccaacttaatgcaaagacaggcaggggaagaaaaagaaaaatacggaggaggaaacaaagacgatgagagtaaagtcaggaaaagggaaattgagtatacaggaaaaaggaaaggaatttgattaaggtgaatgggaacatctccttccccacccccacctcaggaattgttaggactgcagctgctcttttaactttttttttttcctgaagtcaatttttatgcataggactcaggaagtttaaaattaaatgacacttgccagttttttgactcagtgtaacttccctctcatgttatcctttttttttcctttgctgattcgtgtaagcaaacccattatctgaacaaaggggagctgacagagtgtcctgaccttatcttttccaactcctaattattttcacaaggtactgaaatgaagttttggatttattttttaagttggggaactagaaaataaaggagtgaaattgtgctatctctgatgacaccaacaattttccagatttaatttagtttattttaaaaaaatgctacaaaaaaccccatcctaacaccaacaaaaagaacatcaacaaaccagcctgactaagcccagacccctgtcaggaaatgaaattgattaaaggtgccccctcttcctgttactgtctgtaacacttgtctatttctgccaaaacatgtatcaaaatctgtaattttcttgtttattttttctgtttttttttttttttatgttttgcctgtctccctcccagtagaatgtcagatccattagggcagggattgattaattaattgttttgctccctaccatatatatttctgaactaggaaagtacccagacatagcaggcactcaataaacattgattgattgattgaatgaatgaatgaatggtgaggctcactgaacagacagaacaagcctttaggagagatccaaaccactagtctgtaaagtactatgtcatctgacccctgcctaccacagcaacttcataatttactctccctctgacctttgaactcctctcacacactatattctacctacctcagggtgtgatacatgagatttcatttacctgggattttgggatgctcttactggcttggcaacttctcatctttctgatctcattataaaggcacctacatgaaaacttcttggccatcccaagtagccaagtagcctctccttagcccctattctactccttgttattctctctcattttacattgttcctttccttcaagggattattttttgtaatttataattctatatttatttacttctttattgcctgccccctcccattgttatattcataacgactgggattatgttttttttttcttaactctgtatccccaacatctaatacaatcattggtacagagtagataattaaatatttgctgattaaatgagtaagtaaatgaataaatgaattgctaatgttccttctcccacacctcattgtgcagacatgccatcctgaggtctggtgtttttatacttttggcatggccatgtaccctcagaccccaccagagaaaaccttgggctaggaaagcctggatagtcccaattacacttcaatgatttgaaattaaggttatatgaataatttattttgaaaggaagaaatataaagaagggaaacatttttgttttcatttcttatgctcaaagtggtttgggttcaaagttggatttttgttgtaaatacaccacacttgcagcaatacaatataccatgttatttttgtcacaaacagcagatttcctaatgggagctagagagtcctttgggaacttggccaaccaggcctagtaagccattttgatcatgtcatcttggattaattgctatttgggctccatgctttctttgcctggattaggggacagggcttgtgcaagctcctgatcaggcctcctgctgccagcacaatactgtctcccactctcctcaaattctttatcttcacctgttctggaactctctaacaccctatgacttcagcagctgttgtctctgcccctgaatcagacatgtgttcaatagaggggtttatataactaggccctgagaaggatttttccaaatggaactaccccatatattttatttactttaggatatattgcttctgtctctgtatccttcctagtaaatatcatgtctcttaactttctggagtcatgtttataaatgcagcagatttgtgtactatgtacagaccttgctgatttgcagctcctagcaccaatccttgtgtttagtagacattcagtaattattgtttaatcaaattggatcaaatctgaaagcgtattgatgccattagaggaagaagaatccaaaaagactgtcttcctaggaaggaaacttcttcatctctttgacattttgagaactccttgtgtgagggcaacatgtgtagatgagatttagattatggtttaagactaactactaactgctggcctctatcagtaacaggaagggacagttagcaaaatggtgattgagtttctgattcagtttctattgaaaggatctaaaataatatgtatacaattcattgtaactagatgttggaggtttgaaatattccgaaaaggattctaatttaaaatattgaaaaatatgctttgaatatatacaaattcaaaacactatatgggaaaaatgaaaataaaatagaaattgtgaataaaatatattaatgttacaaaagaaagtaaaattgaatcatatagtaacatctagctttattttcagaaagtattatcaaatgaagaaaacactaatatctaaaacaaaaaactacaaaatatttgatgcaccaaataaattgaactatcaagtatttccaaaggcctaagatttcttacatatagacagtactaatataaaatttgtgtgagttgtaaaaactgcccagttccagactccaagggatacaaacaaatatagtagctttctttttctctgttgaaactaaattttactaactcctggacttattctcatttccaggtcaagattttgttaactcagactttatacttcgtccaaatgacatttgcattgacaatctcagaaaccatttttgtcagagttcccgacaacatccaactctgtctgagattccccctaaatctctaggggtcatctgagcccaccttcaccctgcatctcctgctccttttattcacttctgcgaaaagagggagttgtgttcaccttctttttgcatttagcaaatgaaaacaatcaatggtatttacaatttccaacatacataattaagagacaaggcagaaaagatttaaagcagactttcaagatttagtcaatactaaacctgtggtacatttgtatagtttgctgatctggatgctttgaggatataatgtccctcctatagaactaatcattcatgctgcttagccctcatttattttctgactcctaagagcaccatgctttacgtaaaatgagtgcacaaaggtcaggtggcttgagaatttgtatttagttcagagacttgaaaatttggtaggctatgcttgtatttttttcccctaaatctgaaaaacctgtgattttcctttccccagaggcagtctgctggattagatggagacacgttctgccccaaagacagaaactaaataatatccggaaatatcttgatctgaagcaaaagccatgccaaacgttactgaagaaagctttgaaatataaaaataagattagaataagaatcccagtgtcctacactaaatattttaacaaagaaatcgttcaccacttagcactttgtgtaatactgtacagattctaaataaaaatgggattacataattagtacattgatcaaaaattgtgaaaattagcttcaagttcttaataagtcatagctgaacctcagcatgggcaaactgctgaatgttcaagggatgaaaaatagaatttctgttatgtagctctaggagcatcatgaaaatattcaatcaatctggcagattaaagatactgcaggcatcctttattgtcagagatttgattcataatctatacttatcaaatttggtgacattaaacagtggttttcaaaatttaatatgcttcagaatcaactgtcatgcttgattaaatgcagattctttggctaatacaaaaaacagtctcattcaatggattggtgttgacccaagaatctgcactttaacaaacaaggcaggtaattataaaactagttgaccacagactatgtttggcaaacaatgctctagtaacccaggggtcagcggacattttctgtaaagggtcagatagtaaaatattttctgctttgtgaaccaaatgatctgtcacagctactcaactctgcccttgtagcatgaaaacaacaatagacaatatgtaaacgaatgggagtgactgtattccaatcacattttatatgcaaaaagaagccttagcttgagtttaacccgtgggctatagatagcatacttttcagaaccttggtataaagaattaactcttgttacacacctaataccttcaatctcaggtttttctttttgtatctggtttatagtagagaggagcatctgttggtcaactgtgattttagagtctggctccatttgctattgtaaataccaaataaaatagagaacaaaattttttgagctgtctacacaaaataaagggaaattctcatgacctattttccagaaaatcttcttggattaaccaagccctgtctgtagttaaccaacacattctcctgctcatgttttctctacaattcgcattaatgattcttaaccccagtatgacaataatatggggcaggaagattgagcaagctcttttgatagaacaaggacaaaacatacctggcatttgtgctgccatttcaattcacaacacccatagtagacattgccaatcaccggtagtactctttccttctgagtgcctatatggccacaaagtatttctcaagaattccaggtactcattaccatcagactagagttgtcatgtgagataaaaattatgtgtcatcccttaataagctagccttactatatagaatttttattatctggggttattctatttggaggcacatagtattatttctactatatcttaatccatataattatgagccttgcttaatagagttacataatacacattttaattggttgtcattttctgttagaatattagtatcaaatttgaggactgtgactagtttatcatgttataccctgagatcattcgagaaacacttgttgccaggtttgtatatcatcttttctcattaaaatttctatattcatcatgtctatattcatcatgactatgatagtatactgaaaacttctgctaatagttacctaactaaagggcatttgaaaccatataaactgacattattggcaatctgtaaattgaattgacctatagtttcttttctggaaagatatcattgcaactatagcatatctttgaagtagcattttagatctatttgggttaatatttactgttaaagaattgtttggctgcataattaaaatgttcacttactaagcacaatgtagtttctagcattaaatggactctcttgcacagcatgctaccgactctgcaaactcatgaagtcatatgctagctatttcagtaaaacttatttagtaaaacttgaagaaaaattagcatttaatgaagcaaagcaattttcaaagcatttacaattccatcctggcacataaagttcatgtgtaatatgactttatctaaatatttactgaggtggtagcaagtgttttactgttggcaggattggttatgaaggatttgacctgaaactcaaattgaataggatgaaaagttaagtacagagagcgaatacggtctaactaggtggcttgccacaaagtttctagcataggcaagctggcatgtgatctgagaggccatctccattagacacccagcttttcacctagcaaatttgatagaaactcaaacaccaaaatgaagcagatggatagtggcaaccttctgtatctagtactggtgtttcagcaccataacctcccttataggtattctccaggcttttcctatagacttctgttatgccttggggaacatgatctgacctctgatatttccaaatctccataacaggatctgagtttgtttatttttaaccaagcttcttcccttaaaacattaaaaatctcttctagctgctcaacaaaactttcgacggctttaggcaaagagagagcatttgttagaggttctaggaagacccaactccagaaataatatgttccccatccttatagttctgatgtctgtctttgagacacataagaaactgtttactctagatattctctatacttgacatttatcaagaagatatgggaaataaagaggggttataagtgaatctatgagaatgaagcacatgcaactcgtgcaaatttcagagagagaagagagacagtggaacagaaatgttggtgcaaagggggccttgcaaaagaaagtggggttgagaaatctgtaatggacgctttgaatactgcaggaaatgagatccaggtgggttttggacatgttctggccaaaattgtgaccaggtttatcaactattgacaagcttagtttaccaaaccaagaaccttcttgttctaagatttcagtacacaggactaagcttccagaaaatttgggtagtagattcagtgtcttcaatttgcctttttttttttttttttttttttcacttttctcactctggaattttcccaccacaacaatcacatcttgtgcttaatatcctccctaggcattcagccactctctttggaatatcaaaacatctggaaaatgttgggtgagctcatttgctctaaggtgttaatgatgggtgaaaagcttaatatgttgcctttcccatgtgagtgtgtcttgggtccaaaaaatgactaatgagagctattctgaacattcttcagtatgggagaggtataggtgatatagaaggttttcttactgtcactgaaatcacagtcctgtaggccactgatcactcataaagtcttccctgtggttggctgtggaaatacagataggaaaaatgtggctggttctctcagtgtttgatctagaactatcattaagccccccctttttttgcttttgtttggttcaatttgcttttagttttttgaaatcaggctctgataagaatgctagaaaattctgaaagactcatctcaagactttctagacaaacaatgtatattttattttttgtacaaggttatttggggagtgggataagggagaattcagagagttcagggcaaaccctaggatacagataccaatttcagagtgccagccaggccttagaaaatctacttaccatacccagggaacccattgctaatttgaatgaccaatttgttgtttttaacccaaagttttctctcatcaagtcattgtctctatttaaacaattatttgccagtctgtataataattgatttttttgtcttggtggcagatgggaaactaacacttgtaatgttatagaccatgtctgagcatgaatctttagatcaacttgaattttaatatacaaggttatttttgtctttaataaatgacttgctcattggtatagaagatacacttttattatccttttattactttccatgtagttcaaagtttaatatgctagtctagctatgattggttaagaaattgacacacatggctattattgagcacaatatagtgactatcaatatgtgttttttcccggagtgggaaaaaaccccacatttctcacatttgtacactttgagagttggaaatcatcaaatatttagctagttccattgatcttagcttattaaaacttcttgtcaaatggtaggaattcttagtttattttactgaagcaaaataaacctaaatgaattaaatggttctgttagttgcggcatctataaaattaggaaattgggtgagatgaatataaggtgccatagctatgtcctctaatattccttcaagcaaacatctatgaatccatgtttagatttggctccataacaataatgccttatatgtgatagcactctctaatttacttatgtgagcttaattgacttgcaactaccctattcctttacatatttactaagttcctactaattgtccacagtgtcattaggctttgaaaatataaagctgaggtagacagtcccgtgattattgtccccattttagaaagaggggatcacagactcaaagatgtttagtgaccagagattacagttgtggagctgggacagaattccaagcaatttgacttaacctgttcatactcaccttctacctcttgtgtgcaagtagatggaccagacagaaatgcaaaagttaatgatatggatatgtcaccaaaagcatgatccataaaagaaaaaaaatgataaattacacttcatcaaatttaaaactttgctctgtgaaagacactggtctttcatgaaataaagaaagacaagtcacagactaggaggaaatatgtgcaaattgcagatctaacaaactcgaatttataatatttaaagaactcttagactcaataataagaaaaccaacaacacaatgaaaaatagattgaacagatagttgaccaaagaagatatacagatgctaaataagcgcatgaaaagatgttaaatatttctagtcattagagaaaagcaagttaagaccacaatgtgctaccattaacattcattaaaatagttaacattaaaaaatactgacaataccaagtgctgacaaggatgtgaagcaactagagccctcatacattcctggtagaaatgcaagatgatacagtgctctggaaaatggtttggcaggttcttataaagttaaacgtgtacttgtcatattgaccagcaatctcagaatgaaaactcacatttgcgtaaaaatatatacatgactgtttacggcagcagtattcataattgccaaaaactgggaacagactaaatgctgttcaacatgtgaatgaatttaaaaaattgtggtgcatccacacaatgaagtgccacttgacaatgaaaaggaagaaatctttgtccactttgtgatgggattgtttttttcttgtaaatttgtttaagttccttccaaattctggatattagacctttgtcagatgggtagattgcaaaaattttctcacattctgtaggttgcctgttcgctgtgatgatagtttcctttgctctgcagaagctctttagtttaattagatcccatttgtcaatttagcttttgttgcaattgcttttggtgattttatcataaaatctttgcccatgcctatgtcctgaatggtattgcctaggttttcttctagggtttttatggttttgggtttcacatttaagcctttaatccatcttgagttaatttttgtatgaggtgtaaggaaggggtccagtttcagttttctgcatatgactagccaattttcccagcaccatttattaaacgggtaatagttttcccattgcttatttttgtcaggtttgttgaagttcagatggttgtagatgtgtggtcttatttctgaggtctctattctgttccattgatctatatgtctgttttggttccaataccatgctgttttggttactgtagccttgtagtatagtttgaagttaggtagcatgatgctccagctttgttcttttggcttaggattgtcttggctatgtggacacttttatggttccatatgaaatttaaagtagttttttctaattctgtgcagaatgtcaatggtagtttggtgggaacaacaaacatatgaaaaaaagctcaacatcactgattgttagagaaatgcaaatcaaaaccacaatgagataccatctcatgccagtcagaatggtgattattaaaaagtcaagaaacaacagatgctggcaaggctgtggagaaataggaatgcttttacagtattggtgggaaagtaaattagttcagccattgtggcagatggtgtggtgattcctcaaggatctagaaccagcaatcccatttgacccagcaatcccattactgggtctatacacaaagggatataaatcattctattataaaaatacatgcacacatatgtttactgcagcattattcacaatagcaaagacctagaaccaacccaaatgtccatcaatgatagactggataaagaaaatgtggtacatatacaccagggaatactgtgcagccacaaaaaggaatgagatcatgtcctttgcagttacgtggatgaagctggaagccatcatcctcagcaaactaagacaggaacagaaaaccaaacactgcatgttctcactcataagtggcaattgaacaattagaatacgtggacacagggaggggaacaacacataccggggcctgtcagagtgggggcaagggcagagagagcatcaggacaaatagctaatgcatgcggggcttaatacctgggtaatgggttgataggtgcagcaaaccaccgtggcacatgtatacctatgtaacaaacctacacgtctgcacatgtatcccagaacttaaaataaaaataaataaataagaaaaggaacaaaccactgatacatgcaacagtatggatgaatctcaaatgcacaatgctgaatgaaaaaagccagacccaaaaagttacatactttattttttccactaagatgacattctggaaacagcaaaactatatggagagagaagagatcagtgattaccaaggggttaagggagagagactgacttcagaggccagcatgagggcaatcatgctggggtgttataactgtcctatatcctgtttgtggtgatcattgcagtcatctatgcatatgttaaaactcgtagaaatatatatccaaaaattgtaataaaataattattacacattaatcctgacagttaaaattggttctagccaaaatttaaaaataagtgaggtttgaatttagcaataaatgcttcctttacttttttgttattagagacacttttctatgtattgtctttcctcagttctttctctcagttttcaggatatgatttaataaccaattcacagaaaagtttaaatgactgataatagctacatgtgtttcctctagtagggccatattcatttgagcaggttaccaaaatcttaaattaaaataacgcatttccaacagtaggtgggatgccaagcaacagccaaaggataaaggagttggtagggataaagagtcagaacagcctccattacattactgaaatgaagatatatttgctttgaaattttaattttggaggttgtataagaatatcacttagtctatatggtactatagacaaatatatagaaatgtagataacactcccaaatactgatgaatgtgctcagaccaggaagggaaatcttacatggaacaataaaaataagtgtcttgaaatcttaacttcttaataaatcatttagttgattgatttttacatcaaaattctgaaactaaactcattgtaaaaatataaacgtatatatatatatatatatatataccatatttattgtcactttctgagagctgagcaactatagttgcatataaatcactttaaaacttatgtaatagtgagaattcatttgtaaattatagtatttttaaagcaaaatgtcacccagtactttatttttacctacatttacatgtcaggtttccttaaagtgaggtatacctgcacaagaatggggaagttttgagcactatagaatttgcttacttcttttttattcttattaatatcaaatacaggtaaaccagactttacaagcaatgctacaaacagtgtagaaagtgtctctacatctatcatataaattcatgtttattagatctcagtgagagtaataaagagtttcaaaataaattggagctgcagttcttttcaaagtgaccccggtaacaatgtgtctgaattggaatactttatctatattgatttttattttcatgtcaagtttgaaaaatatgtcaggtgtactttgaggatacataaagcatatattcctaattgtatttatttttttgctactgtctatgtcaggtgtactagaaacatagggattattaaaattaactaaaacatggcattattacccatttagaaacaggtgctaggaactctcaatcttgggttctatgtacccagtttcaatcttactggtcaattctgtttaaaagcaatccaaaccagaattttctctgaggagaacaacagtaaaatataaagtgttaccatgggttaaaaaaaatagttgagtggatgaatatttagtcacagccattaacctttaattttaatggttttgattgaggaagaagtttttgtttttagcatgacacttaagtaaatgaatggtttgatcaaaatttactgttataggctaaaagtatgagattaataatagaatatcagagatgccagtcaagccactgaagaaatggattcaacctaataaagagcataactcatcaaacttaaccatgacaagcctaaatattcccatttcatcaaaataaaatggctataattaagtgttttaaaattaatgttatcagctcttcattcatccagtcattctaggccctgcttcccaactctgaacaacttccacctctgcctgttccctctaactagggaaatgtatcagactgagtgaagatttgagcaatggcacagaggttgatgacgtgagaaataatgacctggttaagtaccagataatgggtatgtgccaaagattaaggggagcctttggctagaaacaaggggatgtttgaattagcctaacatataagatcccgaagcacccagctccagataaaaagaatcagggatattaaatcaggagggaaatagtagaaggaggtaaaagaccaaacttgataacccaaagtattataaaactctgttttggggttacattagaagatgacttagggatgtggtatatgaatacatcagggagtagtggcgtgttggacaaaaagaaccacggaaatatagaatctctttttgtgcccataatttagactaagctgacatcattgtggctttcgcttctgttagatgggctcgtctgtgatgaggcccaacagatttggctttacttaaaattgagttcttcaagacttcagagtggcaagattacagggtatttatgtggcatccctcctctcccattagtcttcacaacctcaaggagaagacaagtaactgagcataaggaattgatgcagtcctcaggttcatgtagaggtccctctttcctgttgattagtaacctgcttgtatgtttgacattgcttggctgtgtgtgcccacccaaatctcatgtggaattggaatcctcagctgtcagggagggacctggtggaaggttattcgatcatgggggcggtttcccccacgctgttttagtggtagtgagggagttctcacaatattgatggcttaaaagtggcagtttccctggcactccctctctctcctgctgccaggtaagacatgccttgcttccccttcaccttctgccatgattgtaagtttcctgaggcctttgcagccatgtggaactgtgagtcagttaaaccattttgtttataaattacccattgccatgtagtatctttatagcagtgtgaaaatggactaatatagtgttcctaccctgttgccatttgtgagcttgaactttatctcttctgactgtgatcttggcttggctgttggctcagctcttgtgtatttatgatttacttcctttttgctgcatgtgctttacttcagatcctgattgatcctgtatgtttgagcctaaaagtacaactacaagtccaaattgccccttgggcaaatgtttggcattttttttagactctactatgattcttgttaatcctactatattggctcaatcagaagtgcccaagaccgttccctttacaatataacttttgctgtacaaaaaaaaaaaaaaaaaaaaaatggggtaaggaaaaggatggaagaaaaaatgatactaaggagacattaagttaggagaacctccttaacattttgtctattctacaggaaccatcttctcttataaaatattttttggtacaggccagagaaaaacacattgcactgcatgggatggataatttctctggcccagagcgatgttttgtatgtgtatgtctggaaaggagccaggctcaataaggacagaaaatatcaatgagaatgggataggaagttgaatttgaagattatttcgggtaatgaaaaacatctgatgaccttggccgactactaaattaaatctgagttaaaagatagtttggggctttaggaacaagagtccgcaggtatatttctctgttgataactatttgtgatggaagaaatgaggtgaggaatgcctaggtgaatgtctttcacagctaaattgaaacatacagactcagacagaaatggtcatggaggtttacttttaaaaataaattcatataccagctcagaaaacatcccacaaaatgacagtatgtgaagggttatcctcttggaaaaggaattcaattttgaattatccatactacagaccttgggagtctttagtcacttcatccaatgaaaaatggagatgtttgacttagtgacagatgatctgctcaacaatgttttctttcttctattgctgcttcaattgtatatttagtgaattagttgtgattgatgatagcattttaagcacttgatatttttttctggtgaaaagatggcataatttaactatattaatagttttaggtttaagtgaagcacaatatatttttataatccttcaatagtgaagtcacaatttatacaagtggattcattctgtctttagaccacggaactctgacaaaaggatgtcatttaaagtaatgttgctcatccttcagagatgcaaaactgaaggctacattgctctgatatgaaataactttggagttttgaatgcctggcaaaatttgtatatgccactaacagtaacttaagtggtttgtacagctggagccaaatatgctctgcagagaaaaatatcaccaactgctgtaattttcacataagtaataggactaaagaaacagttttgttcagaaacaacaccttctctaaaatctgggcatgaaatgttcaatcggtgatatggattgtctgtgtctccaccaaaatttcaccttgaattataataattcccacatgtcaagggtggggccaggtggagataattgaatcatggggggtggtttcccccatactgttcttgtggtagtgaataagtctcagcagatctgatggttttataaatgggagttcccctgcacaagctctcttgtctaccaccatgtaagatgtgtctggcttcccctttgccttctgccatgattgtgaggcctccccagccatgtggaactgtgagtccattaaacctctttttctttagaaattactcagtctagggtatttctttattagcggcatgagaacagactaatacaatcagtgtcaatgtttattattaataacataattatggacaacgtaaagtgctagtaattacaacagattagagagctgctattttacctcaggtggtattatttggagtctggtatatatcagatttagggtgattaccttaaaaccttagaagaaatgatattaactaaatgttattttctacttagtctgttacttcctgcagaataatagtttatgctcttacttagtaaatgtcacagtaggggagaaaatataagagcatgcccatatacccacacagtctcctttggtgtaactaccacatcacagtatcttagtgctacctgaatgccaatagctaagttttgtaaatggagatgaaagagaactagggaaattaattgatgtgattatctttcagtagtgctgtataatgacgtatttacctaagcttgtaggcctttaagtggactctcaacatttctaatattgaatgaacccagacctctcttaaaacatgccagttcatacatattatgcttataagattcaaacgttctctcatactgatagccttcaactgagatatatttagattatcaatgtcaaattaagacatgacaagttcccaaagacatataaacatgaccctgacaaatgaatgtgctggaagctggatcttatgtagaagtaatagcttccattctgttccagatctggggtgtatgtgtatgtgtgaagttgactgtataaatgtaaaaatttatccaaatctttggtatgagtttctgtgggacctttggatggtacctcatcataccatgtctgaatggtatgtcaggaacataccgttctgacataggtttgaagactagtcttaatactaaagcatttccccacgaataattttatttatagtattcataagtaataactacaaaaaggctcattattatgaattgggttcttctttattttttattttattttattttattttttttggagtctcactctgttgcccaggctggagtgcagtggtgcgatctcggctcactgcaagctctgcctcctgggttcacgccattctcccgcctcagcctcccaagtagctgggactacaggtgcccaccaccatgcccagctaatttcgtttttgtatttttagtagagacggggtttcactgtgttagctaggatggtcttggctagtcttgatctcctgaactcgtgatccacccgcctcagcctcccaaagtgctgggattacaggtgtgagccaccgtgcccggccatgaattgggttcttattacctaccaggggtataaaaatgtgcagtcttctgatcctagctctaggcaaacaaattcataaggtgcaaacattgtgtaatcccttcaatactgctctctgtcactattcacaaatgttagctccctattatccccaaactttgtggcacgtttttaaaatcagtccctagcctgtaaaggccccaaatgataccaacctcccatctcttgcatgcttatattttatacttctgacagaggacatgtaaagctctgcctacatttctattatttacacccgaatctttgtagcatttcataccccaagccccttaataatgtgcagtagaagctctgtgcccaaactgtattggcatatgccacatgctggatcccttctactttgagtgaggacaaagagtcttcatacaggctgggcatggtggctcacacctgtaacctcagcactttgggaggctgaggccggcagatcacttgaggacgggagttcaagaccagcctgaccaacatggtgaaaccccatctctactaaaaatacaaaaagtagcccagcgtggtggtgggcacctgtaatcccagctactcaggaggctgaggcaggagaactgcttgaatccaggaggcagaggttgcagtgaggtgaaattgcaccactgcactccagcctgggcaacagagcaagactccatctcaaatcaattaatcaataaaataaaaacagtcttcatacaaagggtagattataacctatggtactttattggtagtgtcttcattggattgataatttaagtttcaattgatttctttttaaaatgttttaatttttaattattgtgggtacatagtagctgtatatacttatgggtacatgagatatttaggtatagacaagcaatttgttataatcacatcatggaaaattggatatccacccctccagcatttactatttgtgttacaaacaatccagttatactttttttagttattttaagatgtacaattaaattattattgactatagtttctgtgttgtgctatcaaatactaggtcttattcatcctttctatttcttttatacccattaattttccccacctctcccacaatcccccactacctttcctagcctctcgtaaccatactttattctctatcaccacgaatttaaatgttttgatttttagatcccacaaatgagtggaacatatggtgtttgtgtttctctatctggtttatttgacttaacataatgatctcaaattccatccatgtttttgcgaatgacagtgtctcaatcattttatggctgaatagtactccattgtgtataagtacatttatccattcatctgctgatggacacttaggttgtttccaaatcttggcaattgtaaacagtgctgcacaagcataggagtgtagatgtctccttcatatactgatttcctttttggggggtatgtacacagcagtgggatcgctggatcatatggtaattctatttttagttttttgaggaaactccaaactgttctccatatttgttgtactaatttacatttccaccaacagtgaacaagggttcccttttctccacgtccttgccagcatttggtattgcctgtcttttggatgaaagccattttaactggggtgagagtatatcttattgtagttttgatttgcatatctctgatgatcagtgatattaagcaacttttcgtatgcctgtttgccatttgtatgtcttcttttgagaaatgtctattcaaatctttggccaacttttaatcagattcttagatttttttcctatagagctgttgaacaccttatatattctggttatgaatcccttgtcagatgggtaatttgcaaatattttctcccatcctgtggattgtcttttcaccttgttgattttttcctttgctgtgcagaagctttttaacttgatgtgatgacatttgttcatttttgcgttggttcctgtgcttgtggggtgttactcaggaaacttttgcccagaccaatgtcctggagactttccccaatgttttcttatagttgcttcatagtctgaggttttagacataaatctttaattcattttgatttgatttttgtatatggtgagaggcatcatgtttcattcttctgcatattttttaataatgccaaaagtataattcattattaatatataataattacaaatatctgtaggtaaaataatattgttttatttatatgtatttattttttaattttaagttacaggatacaagtgcagaatgtgtaggtttgttacataggtatacctgtgccatggtggtttgctgcacctatcaacccatcatctaggttttaagcccagcatgcattagctattggtcctaatgctctcccaccctgttgaggatttttgcatcaatatttatcatatatattggcctgcaggtttttttattctcatgtgtctttgtctggttttggtgtcacagtaaaactaaccttatagaatgagtttgaaagtattcccttatcctctattatttggaatagtttcagaaagattggtattagttcttcaaatgtttggtagaatacagcagtgaagccatcagttcccaggcttttcttttctgggagactttctattatggctttgaccttgttacttattcttggtctgttcaggttttggatttcttcatggttcaatcttgatagtttgtatgtgtcgaggaatttatcagattattctagattttccaattaattggcataacttactcatagtagccactaatgattatttgaatttctgcagtatcagttataatgtctttttttatctgttatttatttgggtcttctctcttttcttcttagttgggccaaagacttgtcgactttatctttacaaaaaaacaaatttttgtttccttgatcgtttttatttccttgatcgtttttattattttcttcatttcagattcatttatttctgctctggtctttattatttcttttcctctactaatattgagtttggtttgctctcacttttgtagttcttttagatgtatcattgggctatgtatttgaagtttttctttttttgatgtagggacttacaaatttttctcataatactgcttttgctatatcccataggttttgtatgttgtgttttcattatcatgtgttttaagagcatttccaattttcttcttaatttcttcattgaccctctgcttattcaggagaatattctttaatttccatggattttacagtttccaagattcttcttgtttattgacttctagttttattgcaattgtagtcagagaagatgcttgatattattccagtttttttgaatgttttaagacttattttgtggcccagcagcatatggtcttctttggtttatccatgtgctgaggaaaataatgtgtatttttcaggtgttagatgaattattctacaaatttctattagatcagtttggtctctagtgcagattaagtctgatgtttctttgttgattttctgtctggaagctatgtccagtgctgaaagtgaagtgtgtaattcccctgctattattatattaggatttatctctctcattagctgtaatactatttgctttatatatctgggtgctccaatgtcaagtgcttatatatttaaaattgttatatccttttgcagaattgccccctttatcattgtataatgaccttctctgcctcttcttacactttttgtgttaaaatctattttgtctgatattggtgtagctattcctactcttttctggtttccattgccgtgggatatctttttccatccctttattttcagcctacatgtatctttctaggcaaagtgtgtttttgtaggtaacagatcatagagtcttatttttccatctattcagctactctacatcttttgattggagagtttaatccacctacatacaatgttattattgacacataaggacttattcctcccattttggtattggtttctggttgttttgtgtcctcctcttccttttttccttccttcatgtcttccttttagcaaaggtgattttctctgctggtataatttaatttcttgatttttgttttttgtgtatctgttgtatgtttttaaatttgagattacgatgaggcctgcaaacactatcttataacccattattttaaactgatgacaacttaacactgattgcataaacaaagaaaccagcatgcaggaaaattaataagaaatccacactttaactttgtctctccattgtttctctttatgtcttattgttctatatatttgaaagttgttgtagttattatttttgattcgttcatcatttagtctttctacttaagtgaagagtagttcacacaccaccaattaccatgttatactattctgtgtttttctgtgcatttactatcaccagtgagttttgtaccttcaggtaatttcttcttgctcatcaatgtccttttccctcagattgaggaactccctttaacatttattatagggtagggctggtgttgatgaaatcctttaccttttatttgtctgcgaaggtcttcatttctccgtcatgcttcatacatgcttagaatagtatatctggttaaaattatatatatatatatatatatatatatatatatatataaatatattatacatataaatatataaatatatataaatatattatacatataaatatataaatatatataaatatattatacatataaatatataaatatatataaatatgttaaaaatataaatatataaatatattaaaatatgttaaaaatataaatatatataaatatattaaaaatataaatatataaatatataattttaaccagatatactattctacggtaaaaggttttttttcttcagcactttaaatatgtcatttcaaatgtctcctggcttgtgtggtttccactgaaaagtctgctgccatatatattgaagatccattatatgttatttgcttcttttctcttattgtttttaggatccttttatcctttacttttgggagtttaattattaaattcctgaggtagacatctttgggttaagtgtgctgggtgttctataaccttcttgtacttgaatgctgatattttcctctaggttttggaggttctctgatattatccctttgaataaactttctctccatatctctttgtctacctcctctttaaggccaataacttttttttttttttgatacgttgttttgctcttgttgcccagctagagtgcgatggtgcaatcttgccttactgcaatctccgcctcccgggttcaggtgatccccctgcctcagcctcctcagtagctgacattacaggtgcccaccaccatgcccggctaatttttgtatttttagtagagacggggtttcaccatgttggccaggctggtctcaaactgctgaccttaggtgatccaccctccttggcctcccaatgtgctgggattacaggtgtgagccttcatgcccggcctaaggtcaataactcttatatttgccctttccaggcttttttctctagatcctgtaggtgtgcttctttgtttttttcttttgtctcatcggattgtgtattttcaaatagcctgtcttcaagctcaccagttctttcttctgcttgatcagtcctgctattaaaagattctgatgcattcttcagcatgccaattttattttcatctctagaaattctgcttcattttaaaaaattatttcaatttctttgttaaatttatctgatagaattctgaattccttatctgtgttatatttaatttctttgagtttcctctaaacagctattttgagttctctgtctgaaaggtcacatatttctgtttcttcaggattggtccctggtgtcttatttagtttatttggtgaggtcatgttttcctggatggtgttaatgcttgtaaatgtttgtaagtgtctgggcaatgaagattaagtatttattgtaatcttcacagtctgggctttttttgtgtctgtcttgggaaggctttctaggtattcaaagggtcctgggccccaagctcaatggcactgtggtttgtgcagacttacagaggtactgctttggtggtcttggataagatccagatgtatggctgggtgcggtggctcacgcctgtaatctcagccctttgggaggctgaggtgggcagatcacgatgtcaggagatcgagaccatcctggctaacacggtgaaaccccgcctctactaaaaatacaaaaaattagccgggcatggtggcgggctcctgtagtcccagctactcgggaggctgaggcaggagaatggcgtgaacccgggaggcggagcttgcagtgagccgagatcgcgccactgcactccagcctgggcaacagagagagactccgtctcaaaaaaaaaaaaaattagctgggcgtggtggtgtgcacctgtagtcccagctactcaggaggctgaggcaggagaatcgcttgaaccagagagtcagaggttgcagtgagccaagattgcgccactgcactccagcttggtgacagagtgagattccgtcaaaaaaaaaacaaaaaacaaaaaacagaagtattctctggattactgggcagagactcgttccttttccttactttatcccaaacaaatggtgtctttctctctgtgctgagctccctagaattgagagtgtggtgctgcaagcacccctatggccatcaccactgggattgcaatgggtcagatctgaagccagcagagcactgggcctcatccaaggcccttccctttagtgcagtgagttccccaaggacctaggcatgtccagagatgctatttgggagccagagatttggagtcaaaaaccttagcagttcacctgatgttctattctactgtttcatccattgggatgggcgattcccctctggctatgggtagtccaaatgctccctccattcacagtcactggctaagcccaacatggctttattcttcatggtgacagggcagcgctgagttcaatgtaaagtccccaagtcactgcactcgccctctgggagatgggggagtggtggcataggcaaatcgagattaccttttctgccctcctcaatacctcttttggtgatattaagttaccaccaggtactgtgattgtccacctgatttttggttcttgtgacagtgcttctctgtgtgcagatagtagttaaaatttcatgtttcagcattggggaggaatggtgtaggcttctattctgtcatcttgctctgccatccttgattgtttctaattcagtctaacagccaatcaacaactatttaaatccattaaaccagtaataaatttagactttgcttgtctgaggctagcctcagcctctcagttgtcctcattgagcatgtaataaatagttccagtgaagaactctgggaggaaggagtacaactatttgtattgaagtcttcagtatgtatttctggggatttttcaagagttgatgtttgcaagaaaatcaactttgagtaatatagaataataatctctttcattttagtaaatctctacagagaacattgacacatactggtggatttgatttctacaacaactttgcgaggaaagtagatgttactatttctattttccaaatgaagaaacttaatgaactttgtcaacagagatgtaaataacgaagaccacaactcagtcttaggtccgagtgtgtgtgtgtgtgtgtgtgtgtgtgtgtgtgtggtttactgctctgttagaattatgattgttagtgttgatatgagggttttttcccccagtgagatggattaattaatggcattgctaatttatatctccttatagtttcacagtatactctcatgtccagaatgttctctcccttttctcctaggcttatctcctccatgaaaaactctgatattttctatggatatcttctctctcagaacttctagagcacttctagtttattctctaaaatacagcacttatttctcttatattttgtttatagtgaactgttagaatgaaatagaaactgctctcattgtacgagtggctttaaacatcgctatctcttgacctctccttttattcccatggacttttctaatggcctgcttagacttatccctcctccaagaaagtgtcagatttatatttcttttagttttcttgtctgccagttggagataataattactatttcaaaggactgtgaggattgaatgataattacttcagaagtgcctggcattgtttctggtacacaataaatggtagcttttgtgtataagacagatattaaagtgttaaagagaatgagaaaaaggaaagatagagttgtaagtatctcttagccttcttagtaattccccttggctttaggcatgcctcaagtttcaccatttcttccatgaacatctgtgctttgattacataaacattcttgtttcccagattagtctatccataataacatctgtgaaaagatgaggtatgtgtgcaagcataatatctataaagagaagttaaaatcacttctgcatacatattgtttgcaggtatccatgtcattaagtactaattaatgctgccttttgcatgtgtgctgaatggaagatacaaagaaatttggtgaattacccattaaccacattcaacagagagagaggtagagttttttccctacttataattatgaacttatagacactatctcccgattgccctttgaaaagtcctccaatatataattactaatataaatatagtcacgtggcctaaaaaaccctctataacacttttaaatgcttcctacatttccaattgtacctctttctataggagatactaaaaaactgcttcatccctggcaaaatctccagtgttgagtcctctcttttattgtaaatattaccattgaaaaagttttgcatcatctagtgatgatctaaacttatgtgcacattaaaatgaagggtggaaaaacctgttcatatacaaaagaagaaacccctgcaattttgaccaattttagaaccaaataaaactatgtattatttttgagaccgtttatcttttttaacttctttttttctagtgatgaggtaaaaacagaatacagttatcagaaataataactgcagattcaagaaagtttcagaggtgatcctatctgttttcctgcccaaactagtgaataaaattgcacaactaataatttaggaacactgcctatggaagccatagtgaagtcatagtaaaaacatgaattttcagcaattgacatttcatataacaaatcatattttgaccttttgtatgccagtcataaaaagatacttgtgggaatgacctggtattgttgatgtatctgaaatattttttgtacttttattgggctctatctttgttgctgctgggagagtgagaactctctttttcacttacatccaatagataaaaggggggggacattgattgtcttaaagattcttattattatgaataataatcttaagctctcaaagaaccagaattctcaattaaagatttttctatattcaactctacctgtcatgtgtagcttgcatgtaccagttgcccatcccacaaaagaatgaaaaatgagaatcctgacagatttggtgttggattttagactttaatgcctttagccctgcaatgggcattttactggcattttgaagatatttctttttaatctgcaaaataaagatttgaagtgacttgacaatgatagtaagatgattagtggtgcacattcactataaaaatacaatttgaccattgtagaaagtctttaaatggtattgatacttgcctttcaggagtaacactgagatattcaatgtaccctacctccactgggaagtgaaactggaaaataatttaagtgtgtgtttagaatctctccaccccactccccgtatctatttttggtgaacgtccatcaatcaaaggtcttataccttcacattgacacaacagcacacacagaatcttccacatctttgacacagggtaaactcttggtaaatattggctaatggtaaggataaaggtttctttggcctaattttagtcatattctcccatgtgcaaggctacatttgtccagagttctacatttaggattccaaaataagttaaactttgtatacttcatgtcaaatcagtcatctgagattcatttattttttctgaccattgacacagtatataatgcaaaccacttgttcagtcccatttaattatgaagtcaaatcacatggtatacccaaaattttcatcccagtgattttgtatttccaaaaaatcaaatctgatagactttttttgcaatgcaatgtattgcttaaccattgactggtaaacattcaatccagccaggagtaaagatacaggcttatgcaaattaataataagtgccttttcatcttacattctcccaattcccttcctctagggcaaggaaaatagtcatatcctggatattttctttcatgctgctgtttaccttcatggtgtgtatatatgatactcctccagtaattgctctgaagtgggcaaaattagcatggaaagaaacaaatgctaaatacagtataagttgtttaggattagatattgtaaaaatataaactatacatccaggagagatgtcatcaggatgcctgactagaggtgctcaacactcatcttcttcacaaaggaggaccagaacaatgaataaataagtgcgattcaagtagagtgtctatggaagaacactggaattcagcaaggaagggacaaaattttctgaagcacagaaacttgggatgtcagcatacgaagcaaagcacccaactgggatcagctcagaaccaagagagactccccattaggataaaaaagtaagcaggagatctccagcagccccccgttactaatgcagatgcctgaaaccctatctacaagagaaccccacagtccttgcaggccctgatcccagtaaagggagttgtctagagttaatgcagctgtattgctccagagacagaactaatgctgtgtttcccactccttgggacataacttgcaacaatatggtgtcattttgagaacaaagtcatgctggagtacatcctgccttgaggccgaagagcccctgtatctccatatcccttggtcccacctgtcattccaccatgccaacacaaaaggctataatgtcacaaccccagatagacccaagagtacagttatgacaccaacacttgagcctacacagtaccctacacctcaaaaaacaggcagtccagcacagagtataggcttctccccaaaccaaaggagccaacatgtttgttctccagggcatgagaaccacctactcaatgccctctaccgctggtgaccttgtacccttaaccaacagagctggttatcttatctaacttatatagcttatataaacagatctaaccagagctgctgtacactgtgcatgcaaccagaggccaggggctgacccacccagtacaagctgcccctggcaatgctgtctgtctctgtaactagtagagctgccacaactggtgccctacccccaagtacttcagaactggcctacacagcaacccctatccccagcaacccctatccccagcaaagccatgctacagtcttaaaaactgcccacagcccagactactgaagcactagcggataccactgacattaattacagatgaataaatcacaacaaagactccactagtgggactcacccagaattaaagccaaagcaccctgccctactcatactttaagatacatatataggaaaaagtacaataattatcctgtaacagacctcaaagcaaagtaaatatataaactgcctgaaaaggaatttaaaataataatcctaaggaaatatcagtgagacacaagagaatacaggtatattgatacaattcaactaatttaggaaaataatttatggtctgaatgagattgcatagtttgcaaaaattgtctcccattctgtaggttgtctgttcactctgttggtaatttccttctttgtgcagaagctctctaatttaattaaacctgtttgttgatttttgctttcattgcagttgcttttggcattctcatcatgaaatctttgcctattcctgtgtctaagatggtattgcctaggttgtcttccagggtttttatagttttaggttttacatttaagtcttcaatccaccttgtgtctatatttgtatatggtgaaaggtaggggtccagtttcagtcttctgcatatggatagcccattatcccagcatcatttgttgaacagggaatcttttccccattgcttgtttttgtcaggtttgtcaaagatccgatagttgtaggtgtgtggccttatttctgcgttctctgttctgttccattggtctatgtgtctgttcttgtacccgtaccatcctgttttggttgctgtagctctgtagtatagtttgaagtcagttaacatgatgcctccagctttgttctttttgcttaggattgccttgactattcagtctcttttttgcttccatatgaattttaaaatactttcatctagttctgtgaagaatgtcattggtaatttaatagaaatagcactgaatctgtaaattgctttgggcagtgtgatcattttaatgatattgattcttcctatctatgagcatggaatgtttcccatttgtttgtgtcatctctgatttctttgagcagtgttttgtagctatcattatagaaatattttacttctctggttagctgtattcctaggtattgtattctttttgtggcaattgtgaatgggattgcattcctgatttggttctcagcctgtttgttgttggtgtatagaaatgttagtgatttttgtacattgattttgtatcctgagaatttgatgaagtggtttttcaggtcaagaagcctttgggctaaggctatgagattttctacatataagaccatgtcatctgcaaacacggatagtttgacttcctgtcttcctgtttggtgctctttatttctttctcttaccagattgccctggctaggctttccaacatcatgttgaatagtagtggtgacagagggcatccttgtctagtgccggttttcaaggggaatgcctccagcttttgcccattcagtatgatgttggctgtgggtttgtcatagatggctcttattattttgaggtatgttcccttaatacctagtttattgatagtttttaacatgaagaggtgtcgaatttcatcaaaagccttttctgcatctattgaggtaatcatgtggtttttctctttagtcctgtttatgctgctcttttctttctactttcttgaagtaagaccttggattattgatttcagattttctcttgattctaatataagcatttagtgctataattttccatcctagtatttctttagctacatcccatctattgatatgttgtatgtttatttatattctgttctttgtatttttaattctttttctttctagtttgattctactatgactagataacagaatatgtaagatttcaattatttttaattttagacatttgtactatggtgaaagatatggtctgtctcattttaaagtatcctttacatactttaaaattgtgtattctaaggttggtggagtattctgtagatttcacttaaaaagattgattgataatattttcagttttcctgtataattgctggttatttatctaaagttatacacacacacacacacacacacacacacacacacacacacacacacagagctgctgaaagaggctagagcagtttcaatctacttaaaagaactggaaccacagcctgcctagacccaccctgttgcacatggaagaaatgtcatgaatatcacatttatatttaaggtaatcattaattgtattatttgttgctatttatatggtggtaaatatacataacataatattcatcattttaactatttataaatgcacaattcagtggcactaagtgtattcacaatgttgtgtatccatcactgctatctataccacaaatttttaaccatctccaacatgaactctgcacccattagataataacttgtaattttccattccccctcagcctcttgtatcctctagtctactttttgtctgtgtacatttgcctattctgggtacctcatataagtgtaatcatacaatatttgtctttatgtgtctggcttacttcacttagcatgatattttcaagctccatcatgttatagcatatataaaaatttaattgctttttatagctgaaaaatattctattgtgtatatgcatgtatatatatgtatgttttatatatatatgtatgttttatatatatgttatatatatgtatatatataaaacattttggctttacattcatctgttaatggattcttgaattgttccatcttttggctattgtaaataatgctgctatagacattggtgcagaaatatctccttgagtttctttccagttcttttggacatatgcttaggagtggaattactgggtcatatggtaattctatgtttaactttttgagaaaccaccaaatggttttccacagtggctgcacagtttacattcccaccaacaatgcacaaaattttcagtttcttcacatccttgccaatatttaatttctgggctttttctttaaattataaccaatctaatgggtatgaagtagtatctcattgtgggtttgatttgcatttccctaatgactaatgatgttgaacatcttttcatgtgcttattggccatttttatatcttctttggataaatgtctatcgaatttctttgcccatctcttgaattgggttgtattttaatgtttttgttcatctgtaggagtatttttaaatatatctggatattaccattaccaggtttgcaaatattttctcccattctctaattgtctttttgatttcttgatagtgtttattgatgcacggaagttcttaatttgtagtttttcttttattgcctattctttcagtgctatatcagagaaattgtagcaaatccaataccactacaatggcatattattcagtaataaaagaagaatgaagcaaattcatagataaaccttaaaatattatgctaatgtattatgttcacagagttatgcaaccatcaccagaatcaattttggaatactttcattacctcaaaaagaaatccatacccattagtaaatcttctaaggtctcttctgggccaagtatacagttttgctcatgtgtttgaccttctaaatgtttaaagcttttcaaagccctctatggccatctcattacccagtttttcctttttacgtttttcagtcagcctcttatcaattcccattgatggtgtcacccgaggcatctgtgaagtcaaacaattgacactgatcgtttttgactaattctctgtgaataaaactgttcacctggtcatagaaatcatgccctgagaatgtagcttttcaataagctttcagacaggtcgaatagagacaattttctgtgtatgaggcttctggattgctctaaatccattctgcttcctccaatggctgctaggctataggattttataccacagtagtgaggctattggctgttaaggataccagggagctggggattagggccaattaaaacaccacgaagctcattgttcttactgaaattcagccacttttcttgaataaacattccttgtatcgttgcaagcctttagtttgtttccagagttctgaaaaagttgactttggcagatttttgccaatgttctcgttgcttttatggaagagttgatttttgaagtccttactccaacattccagaagtgccctcttggatgaatgatcttaaacactttagttcaacatagaataaatgtgtgtttgtgtgcatgtgtgtgtgtgtgtctctgtgtgcatgtgcgtccatctgcctgtttatctgtctgcctatctgtgtctgtgtattaatatttctctcatatgtacacattttttattgtgttcatctactttgactgtaaaccttctgtctgtgtgttggttcttgaatatttatttcaaagaaatgttatttttacaacattgttcttgttctcctttaaaggtcagctacctttttccttatattttcatccatacatctgtgtttggcttttattaagtagcagcagtgcaatattcctggttttatctttctggcttaagcatgtgagcaagacacaaaggataataatacaacatactttaagagacaaaacaggttgctataataatagaagatctatttaaatatatttagcatctctttatgtagaaactaaaacaaatccaatattaatagcattaagcatttggggcatgtgtgtgagaatatgttttctgttcaaaaataaatttttattatccaagtcctttaaatttattttttccaatttgctttgctaccctagctgggatcattatccaaaccaagcatcaaaattcacaattatatgaaaaataaatatatactaactacatttccacggggaaaaaattagttggcaaaattggtactagcctaaatatgactataccaacttaccaatataatccggtacttcaattattttggctatgctaaatcaggatgccacaattcctcctggaatattaaataatcctttgccagcagattgtccaacagccagtcatacttgctcagcacctatcttgacaaaattgtgaagcaggcaaagttatgtcttcagcacctgcccatcccctaatttagttccttttgtttcttctttcataataaatggacaagcaggcgactcacctctttacaaggctctccatgtgaccacaaaaatgttttaagaatagactaccttatttaatgaaggagacaaaaactgtaagaggaagtacatccccaatttgaaaaatcttatcgtatgtcttattgtaaaacagtgcctcctgatgctttcatgtctccttccttctttccttctcactcttcttctctctctacatctctctctcctttattcttccttctccccattcttttctttctttctctaccctgttcttcccccctctcatccttctttccttccaggcacatgtgaaccacttctttttacattgggtctctcaaatatggagtattaatcacataagcacgtaaataatggcatgctgttcatctgggaatttttccaagtaatggtggttagcaagctgtgtaatgagcttcttgtaaccctttctcttccctcactctgaaattaaaggtcagggatctctcactagaatattacaatgctaaacataccaaaagtatctgaaaatgtttagttaccaataggcaagaaaagttttctagtcctttcattttcatttaaaaaatatctcttgggaaacctatttcagatcacgaagttttacacaaatgtatagctaaaacagtcacctatcgatccaaatacctattaacagataaacaacagacaatgattcactcattcacccaggataaagccatgtctgtgtacacacaaggacaatgtagttaaaatgggtgactttagtttgttgctagagatatgattgaaggaacacagacacttgagtcagacagacatgagcttaagtctattctctcttatgtatttgctagttttttatgtagaaaatgtgaatttcctatgttacgttgaggtgattgaggagaagaagattaaatgaaatgataaatgcaaagtatcaaacactgcctggcacatagtaagcactcagtgattactgctgactgctgctgacattcaaggagtttccagtgtctcaagtcctgtagatgcccaaatgagtcactccacactttgcagattctttctgtagtatcagttgcccttagtgccttctaggaagagaagaacattagtccccttcagctcaactgtgtatatagataggataagggacttgggcaagaggaagctagtgctagtgactttctcccatgaacacttttcctttaagtctttttatcatcaccaaaatctatttggtttagagtttctgtcttactaaatgttaccctagtggcttgaaagggttagtgccatttccaaattgagtatattctgccctaaaaaaaatctgaacacaaatccctacacatatgcatacattaatttcagcctgcttttcttccccgcccaaaggctcaggctgtctgaagagtaagcttctagcttctcttaggcaatctgtattttaaaaaatcactgatccttccatcagaattacttcctttcatttcagagaacaatcctatcctgtcaaaaatacactgcaatagaaataaagaggaataatagcagagtataatttaatagaaagaaaggagggtgaggtaaactataggcaagaggtatgcaaatgcttaatgtgacacacagaagaaagaagccatacgtaggtatatgtgtgttgtgtgtgtagagtagtgtgtgtaaatgtgtataggagcatgtttgtatgtgtgtgggggcatataatttgtaaattggtatagtgcataggaatgaagcactatgtatcttgttaaagatactgcttttttggttcttgaataaggaggatgctggaaaacatccaccattatctgtactcttggtttgcacaatccttcctccctgctatcccctgccaccatgcaaaactttcatactgcgtcattaattcttccagcctggggatagtccccaaattctctcattactgggctgcttagtgccatcaaaatttggattattaaggagctgcatgaggccttgtttccttataatgaaagcacaatgaccatctagatagagattaatatctcacttggggttatgtaatattttctttattccattctagttgcagtccctcttcctaatttttcaaaatgccactgaagcccatttcatgaaattgcaaagtaatctgatggtgatgaatcacttttagaaggaaaaaaatttgccgaagctatggatttgcattccccatgtcattttagttaaaatgaggaatgcttggaatttatatataaacagcattgtgttttggccttatttattacaaaagacacttgagagagctgcttgtttcaattatactttgccattgtgtgaagagagaaaaaaagtgtcttcttttacttacatatttgctatcagtttaggacttttaaggaatagtttgttaaaatggctattgaaaaatttggggtcctaatgtttgttctcagagacaaatctatgaatttattttctacctgataattcatcaaatctgggcctctgtgaaaggcaacccagttgtttttaacatcaatgctctccctcactatcttcccatctttcttttctaatataattcttctgccccaaatcaaaattagaggttaaattcttcttccccagcacacatggtcttttgcccaactcacttcacactactcatctttggttcaaatcccaacaacagtcttctaatctccatctgcagtccttacccccattttctcttccctctaataggtgctagaaagacaagttcagttttctgtctgatatcatgaaacccctaccatgaaatcactgaataatctacttacctgaatgattaattctgtgaagtttgattctttaatataacaacagataagaatcttattaatttgatattttcgggatcacagaaagtttcactagtttttttctttagaaacattgtttgccttctatggaatgggtgagtccatggatttttcaccattgctgaatcaagccatgaagttttccctttattaataagtatttattgagcccttagtatgccatttatccaatgaataataaggagtgggagagtggattgagacaaaggatgcaaacagtgtggaccctgctcataaagacaaggataagctcttgccttcgtttgaaggaattgtattattgatttgataatcttcccaggacctagagaggtgctaatagttagagttcagggttctaattctggtttgctagtaatcaagtatttgatttaggcaaagtctctttataactctttaggttcctgtttatgtgaaaacaggggattgggctagatacacttctctctctctgtctgtctctctgtctctctctctctcccacacacacacacacacacacacacacacacatgcacgcatacacttgtgcccacgtggaagacatataaagcaagtagtcagcagtgagaataatgagtcaaagaaagctccttctaggaggtaagatttaaattttatttcatcacttatgtgtacagagtaatggttctgctgagtaatgttatcttaccttaagtttcagtttaaactaaacatatgatgaaattactttcaacacgatcttagtatctgtcctcccactttggttttgcatacagaaagtaattttggatgtttgatattctagtacttggcatatcctactcattatagattaagtatttctggcttctgccagatgccatttataaccttttgccaaaacttgtttacatactcaaaatttgactatccactccttgaaggcagagacttcaaaatcttctatttatttatagtgcctagcacaatgccaggcacataatattctctcataatcttctgacaaagatgtctttgggaaattatattgagagatgacaccaatgtttgggcattcctatttgaattttgtaaacattataaattggaccaacagaatatgatatggcaataaaatcacatcagcttcaatttatcaagttcttactatgtgccaggcattttacatatgttatctcatttaattcttataacaacactataagataaatgctattattctcacttacttagggggaaactgaggcacagagtggttaaatagtttccataaggtcatatagctaataagcacaataagtcttcacttaatgtcatcaataggttcttggaaactgtgactttaagtgaaacaacatagaatgaaaccaattttaccataggctaatcctaaacaagaatttcaacagcatatttctggtcacaaaaacatcatcaaacttctaaatgaatacaaaaacacttctaatattaaacgttgaaataaatgcgagctatacatacatttaagaaacattagtaaaaacaagtaaaataattattaaccccaaaatccaaaattcctttctgtatataaaaccaaagtgggaggacagatactaagatcgtgttgaaaatgatttaatcacaaatgttagtttaaactgaaacttaaggtaaggtaaaatttctcaacatgacacttattccagagtcatgggtaactggagcctatcctggcagctcagggcacaaagcagggaccagccctggacaagacatgattgcatcatatggcacactcacacactcatacactaactcagactaagacaatttagacaccccagttaacctaatgtgcacatctttgggatatgggggaaaatcagagtacccagagaaaacccacacagacatggggagaatgtgtaaactccacatagacagtggtcctgaccggaaattgattatttttcctcatcaacatcataaaacaattttgaacaaaacaacattatttgaagaccttctgtaatgaagcttggaattgaaaacctgtctagctagaaaccctttaaccactattgtattgactacttggcattaaagcaaaatcattttctgtgaactaatccatagtctaattccacagtcttcagttcccctctcatctagaaagaagacaacatagcatttgcttccttttccatcttcgaccttgaaagatatctatgtttttcctctttgaaattgactctaagaaaagtcttctttcctgagaaagtgaagtgaacttagtatcaagaatctctttgaatggagaagacgcattctcattttgtactatcaagtcatagaaatgtgtaattttagattttgagagccagatcctttaataatagattattagaaactattgttgatttattttcctctgttattatttaaagacagacttgcttttaccttaaaggcattgaaataaatgtactaggatgttaatattcttctcaaatttcaactttgtatagaaacagaccctggatttgttggcagctaatcaattcattctggttaggactgcttcacttacccctgaattttaacctgaatctgaatactcaggaagcaaatttaaggactaagaaaataataattttcccacttggtagattggtagcccaccaaagaaggggctgttaacattttagagtgggaaaattaacctgacttttctgtgcaaggggctttctctctttgttcaaggacaataggcctttatgcaaatacttctctgtctcactccagtttaaaagttcttctggctgcttgttagctgtcagtaagtattgttctctagttttcctatcttttaagggcataagatcccttgagcaggcttggcgggcatacattatccctgacattattgttgcacgtatatcttctaaaccatcccaattggcatattccaagaattctcaagggatagaggtgacaccagtgaaagcaagaactgatggtccaagttgcccagtcaagtggtgattttgtttcttgaatgagaaatcagaactctgtaagtccccttccatggtatggtttataggaagctaacatttgtggaattagaccccttggtgatacgacctttcagaatacctaatctcaaataatttcaaccttttttttttttggctgcttttcattgttaagacatattcagtcaaaatatttttggaaaacatatgtttttagcataaatgaatattatattgactcaaattggttggaaatcacaagttaaaactgctctgtcttctgtagctaataattcttggcactgggattatgtttcaggatggcagaacagtctgcatgagtgctctgattggttatagaatattaattggctgctgaggtagtgtttagagctccaatttaaggttgacaagaatgatagctttcatttgtatgcaaaaacttcaactgtcccttcaagaaagatgatcacatcctacttcatctgtcactctttctttactttttaatagaggaaaaagaaaggagaatgaaagaacctttatcaaacatgattttcaagattgccttgatgcaaatgaagtgtctcaatgatcttgttgcttcactaaagcatacttatttactctttgttggtaccttagtccattttctgttgctataaccgaatatctgagactgggtaattaaaaaagaaaagacatttatttcttacatttctggaggctggtaagcccaaggtctagaggccacatctggcgcgggcctttttgttgatgaggaaacaaggtggtgcagggcatcccatgactagggagctcacaaaagacagccaaacccattttttttaacagacccactatcacgataactaattcactgtcttaagccattaatccataaatggattaatttattcatgatagcagagccctcataacccaatcttctcccaaaggtctcacctctcaacactactgtattggggactgagttcctaacacatgaacttttgtgggacacattcaataccatagcaatcagattaagaagtacatgaactggaataaggtgaagctttcattcactgaaaaatatcaactacagggtattgtctctgagattttcaaactttaacagtgatttgtttggcattctgtgagacatttcttattagccaaagataaataacaatctgatttgaggtactagcaaaatgaagtactgacttccatcatctccatcatgccactcaattgcttatacaaagttgctcagggaagacctggttctatgtgaaagcagagaccaactgtcagcttaaggaaatatatataatggaccctgaaagaataccatattccaacataattcactgtgattttggattagattctactacatataacagaaaaccctgcttatagttgttcaaacatacacgtattgattctctcaagcaaaaagaaacagaaattaggcagtccagggttggtatagtgacttcaagaagtcatcagggatctacacttttactttcttactgctcctctattgtttgcatctgatttccatcccaaatttacgagatggcctatggagctctagacataaagtctgtactctatggaacggattaaagacatgtggtaagtgtcaccttggaaacaggaaccaggaggaaatagaacatagggcagggggcattgtaatagggaaaataacatggaaagaaaaatatagagcaagtcctcaaactcgccttatcatcagaactagctgtgggagggcttattaaaaacacagatttctactctccattccagatccactggattatattgtctagtagcggtacctagaaatgagaatttcaactagccttctaggtaattctggtaataaggcaatgtattatctagagtgatgatagcagctgtagtaagcaaaccgaaagatgtagaatggttgagatatgacagaaatttattttttctcatacaaaacgctagcacgtgttcctaatttaaggatctgggttccttcattcttaaagtttcatcatctttagcatatatcttccaaggtcaccattatcacctgtatcaagctggtggaagagaaaatggtatgaaacatcttgtgtggaagatttttatgggtcaagcctgaaaggggtgcatatcatttccacttacattgcactgactaaaactcagacttatgatcacacctaactgcaagggaggctggcaaatgtgtagtataggtatgtgctcagaaagaaaggagacaagttttactgaaaagccagcagtttctgtatagtaaagtttgggaacagggctggcctcagggcatgtgacctatgcagctacacaggttcctgaacttagaagggcctcaagtttggttgaatgccctgatgttactctcttaaatttcttaataatttttgaacaaggggccatgtttttcattttgcactggaccctacaaactggaccctatttaactggtacagcttaggaaagaatgacccagagtgtgaggcagagccagaggaatatggcacagttcaggactttgggcagccagcaggtactgtacttcagaagtgttcattaatgaaccaatgttcttggccaccagagagccttctctcagagtgctatcctgttctgcattttttatctgtgacttagatgacatataaatgatatttatcacattttcagatgagaggaagttgggagggacagttaatactttggagcacatatttcttttcaaaaatatctcagtagtttggaatgatgggttgaaactaaccagattacatttaataggaaaaaaatgtaaagcttttcattcaggtccaaaactccaactgcaaaagcacagtcttagaattttatttggctgagagcacaagcagtgggactagattgccaaaaattctaatttagtcttagtctgcatcacagaaaggtagggtccagaacaatagaagtattggtttaattgcactttagatgacatcagaaattatgtgttcagtttattgtaccatatctaagaaacccattgatagattagattgtgtccaaaaaagattgtctaggatggaaaagggttttggaaaacatgtcacctgaaagacagtgggcaattgaggaaactaagtgtttagcctgaaaggggaagagcttttagaagggaagggggtgaaagagatcaagaaatctgtctgcaaatgttttaagcattggtatatagaaggtgtattgggtttattctgtgttgttccagagaccagaaataggaccaagaggtataacatacaaagaaacaaactacagctgaacataaagaagaaattttaataaagttattccaaaattgaaatgattgatgtcaagaggcagtgagcctattgcagaaaagttatcaagcaaagactgaatactgggaactgtggagggaactcatgtattaggtaggaagactagagtctttgtaattatgactgtctaagactaagtactattgaaatgatgcaaattgatcaggatcttgttagtcttatattttaaaaggactatgaagccagactgcctaaattcaaacttcagctttgtttcttattacctatgtaatcttgggtaggtcacctaatttcttaatgcctcagttttttcctataaaatggagataataatagtatataccccatacataaagttattgaaagcattaaatgaattaatactggtgaagtccttatagtaagcattttgtaaatgttatatattattattttccagaaatatagttggtgataattcttctatctcttcttcaatgaatgtagcctttagtacaattagattaatttacactagacataaaatagaatgctatggtgacaaaatcctttaaaacaccaaaacaaacaaacaaaaaactgaagtggtcctgtagatattcttcacaggcaccctgagaatggcataagatagctatatctctgggatgcaatgttggaagttgtgactttaggaggacatttccagctttccagcttatatatttagagattttataaaaacctcatagggctttttatatttcttaggtcacttgatcctcatattaactataaaactacacagggcagttaccatatccattttgaagttgaggaacctaagcaatagaaaagttagaaaaggtaacagaattgttcaaggttacactataaatttttagtggagccaggatcagaacccatgtatcttaagttctagctcagagctcagagataaaccaaatgggtagtaagttgcttttagactatctagtctgtggaagaaatttcataaggctgatgaagtggcttctattattttgccagtaacttgcctgtttgctttgcagcaaaattgacatcagcctgaaaacccagccacccagcttaatttcctttttggctttgcataggttagggggagtcaataaaatcagtgacttatgctgagtgtattatccacacagacactatggaaatatacttgccagctcaatccattttttatgcattattatagatgattttgaagcttgtggagaatatgtggtcctcttaccaaggcagaagctggctatgtgagttttagatctgtatctatttgtacaagtactgtgatagcacgtggtattgcagaatcgaatttttgaagtgagtgagtcttgctttggtgatcctgatgctctgtatctctatctaccctactctcacttcttcccttcggtacctggcccttgtcctttcaaccttcctctcattggtgtacctattaggttggtgcgaaagttattgtgaaattacttttgcaccaacctaaatatttacagccattcatttactgtggggtaattaattgggttccatccctaggagaatatacagctcgatgttctctttaattggcaaatcaatgtttgctaccatttattgagaactaaactatgtaccaggcctctgcctagcactttagaagcatgatcttatttgatcctcataataatcctaaaaaatgggtactattattatccacagttatgcatcaaggaaatggagtcccagaggagcttaggaatcatgaccaaggtcacaaagtaagtgctagagccagaactaagactcaggtgttaacacagaacctatgctttcaactacaacatcttagagttctgtgatctagatagtgggtggcagatgtttttgaaagttgagaaaggcttttcctataaaataataaacataagcaaccatttgctctgaattagactgagatcagcctgatgctaatgaacatcacagacatttccaaggtctagatacacataagacaggtggggatgaggagcttctgctgtcccaggaactgaattcttttctcacgtactatgcagtgccttttttttttttctcccaagctctctgagattaaatggatatatgctagtgagcactggctgtcaggctgatgctaaagcactaatgggtcattagcccatagacaaagatcctaaagggttgggttttggtcagacaagtaactagccttcatgttaaaagcatagcagtagacactgagtcacctaacacagcaagatctatttgcagggttttccctgatttgtaacctcaggtaataacccccacaagagtttcctgaaaagccttttgttctctcacaaatgacctgaccactttttgactaaagatactctcagagaaagtgcatatttgctgtagaaacatccagtggcactagatcaatttgtcataagctcagagcagttttcacacctgggtttccatctgtacttgaatgttctgcagaggaagtgtcagtccagactagggaataatgggatgaggttggggaagtgaggggtgggatggaggggtggtggtggtacagacccttaggtgaattagactatacttggaagctgcttcatttaaaccagtacagaaaacactatggtggaatttgattcccctgtcaaagaattagcttgccttatggtatttcaaagacgtattatttagagggtcaggatatcctttgaacatcgaacccaatttcttgacaaagttatatcaggagatgaatgataatcacagctgactaaatgcttattctatcagagaaaatggggccatcaaagctccacagttaactggcaagtttactcaaaaagttgattcaaaaaggcaagtcaccctttttcatgagatttggatcctactttgaaaaattcccaagatttcctatctcagtttctggagacaacaattcttgctttcctagtctccgagttggacttaatgagataatcatgggaaagagaaagtgctttgtaaattcagttaatttttttcctttctcaattcttctgtatccagtaatcacatcttgaaatcacctagcttatattttttccttggaactatgagcagtcataattggctccatttgaaaatcaatttcaacatcatagatcatcagcttatatttgattaattaaattagttctcatcggtgttacgaagacagggaacaagcttggaaacctcccagagagctgccatcatgtgggaaattaatcaagatttctaagagccaggtcctgacttcagtgatggaaatggaaagtaaaactactttattttcagagactgctctagtatgatttagttcatttgaaatattattacatattcatccttgaatgattctgggggaagatctcagctttaaagccaaacagacatagatttgaatgatagctctgccatctttgctagcaaggtaaccttggtcaagtgacctaacccctttggcctttaatttcctcaaccacaacaacaaaaaatggaaatagtggtactcatctcataggaatgttgtgaggattaaatgagactgggagactacagaataggagtcaggaaattaggatttacattttggttctggctcttagtagccagaggttagtccttaggagagtaaattaacctgtctgaacctcagtttcctcatctgcaaagtggaaataacaccctgcactttatagatttttgatgaccatgcatttggcttgttgtcatgtaaacaaataggttactcacaatcatggaaagttctctggtaatgtaaagctgacatggaggaggataaagtgataatgccttgtgatttacactttattttctacctcagatcccaaactaagtaagtctttatgttagaatggttctcttctttctgagctctaaatatcacatcacaaataatgtttaccaaacaaatattctgtgaattagaaaattatccctgtcatgaaacttttgattttttgaaaaatgcttatttaatatccggttgtcatcctcattacggactgttagcacatccaaacaactgaacttaagtgatattttgcttttccttattcttttgtattgcaaaacatcatgttaacaagttatgaatgcctaattagtttgaaaaccataagtaaataaaccattagactgaaaacagaagtatcaatacctgcccaatctagtcaaataattgcctttatgaactttggtttgaaatgcaaagattatgttcaaaaactgatttggctgaaatgagaccagtaaaaaagttattttcataaaaatacaatacagacaatatgttattccatatgacagccgcaatgtcatattctgcttctttaaattttatctatattttatttgattacttcttgtggcatggtagtaggcagaataatgccctccaccccaaagatgtccataatctaatctgttaggaatatggtaggttctatagcaaagtcaaattaaggttgtaagtagaattatggttgctaatcccctgacctcaaaatagggaaatcatcatggattatccaggtaagctcaatgaaatcacaggtttccttaaaaatagaagaggtaggtagaaaagaaagaataatataatgtcacaaggattcaacctgcccttgctggctttgaagatgaaaaatggccaagcaccaatgaatgcagacagactctagaaggtagaaaaggaaaaggaattgattttctcccagggcctccagaaaggtatgcagccctgctgacaccttaattttaatccagtgagacccacattagacttctcacttcccaaacaataagataatagtaaatatgttgttttaaactactaagtgtgtgatagcttaccagcagcaataaaagttaaaacagtcaattaccactttttgtcagttactacagccattttatacctccgtttcttctactagattaagccttttgatctgactctgtgtattcttcaaatttatactttactgcccccaacgaagatatacacactagttggtagagtacctttctgtaatagaactacaaacatttgttaactgattataagaatgaattacaccaagtaatccaaaatcgaattttcatcccattctttgacctgtggaattttgtggatacagctaaaggaggtattcagtcaattaatccccaaagctcatcagtttagtgaagtgtttaggtttctttctttctttcctttttatttatttatttattttttttggtgatgcttatatggagatattttggatgtattttgaacacacacacaaaaaaacagtcttaaaaaaaaacacggaagaaatatgacagtatagagtagtggctatgaccttggactcaagggtgagatagactttggttgaatcttggacccaaaatgtatttaccagcaatgtgactttggacaaataatttaaactcattgagcctcagttttcttatctgtcaaatgttgataatagtaggacctactttatacattgtcatgaggatttaatgagagaataaatgtaaaagggcttggcatgaaatccctgcttaatcaatgttagccatggtgcagtagcaagaatattgaacttttaattcaagaaacttgggtttgggtcttctgttttattattaatttgcagtatgatattgagtacattcctccttttctgcctttcagtttcttcatctgtcaaaatagccagatgaattagatctctaagggtttgtctagctctaaaattatccatccttgggtatcatattatatttttagacatcactatctaggccaaatttctagatcctgacagatcagtcatcacagagccaaatgatgatctttaagcaaggtaaaaattcacccatctcccatgtttaacctttcatacttattttaatactaactatatcccaagttctgtgtgaaacctggaagtatactatcttgtgaaatttctttgataataactatatgtggaatttgtttgacatcaacaatataagggtccagggagtactattttagagagagaaagaaaaatcttacttgaggggaaaaaggcaacagtgaagaaaaagcaggaactgtgaagaaaaaaaaaaaaacaaaactaccatcataaccactgtttaagtttccatttcccccaaggttgttttcttttcaaatttgaagaagttgctttatgtctgggcagatttgtgctgaataaacattgttctctccagagaagggccttgtgtcaaatggcattgagaagaaattgccctgccttatacttaagctttcccaaagctcatgcactgctcaaaactcaaatattagtggaaataaatgtgggatctagagaaaagggcaactcagggcaacttcacagcagccctgaccattcactaccctcagggcacatccactgaattgcaaggcaggacacaggctctgagccagttgctagggaggccctaagctttgcaggggcaatggtcaggtaagttgcccagcactttcccagcagtttaacctctatttggtaaaggatcacttatttattaaagacaataactgactttaagttctatgctaataaaaggcaaatacttcaatggctttaaataatggaagggatatttttagtgaaactggaatgtgttttaaaagcaatgtaatcctctgaatataaactttcatgtgtttgactctcagcagttctcaataattttatcttccaaatatacatgtgaggaacatgaaccattgtcatcagtaacagtgacttaatgaagcgaattatttttaaagggttgtagtaggtagggagatgagggagatacatgtaaaagtatctgaagttggagccatcagtgatttgaaaacaaattttcaaataattctggggatcactggttctgttttttgtggtgagcctatcacaaatgttctattatagctgggacacctagagaatatatcttctctctagattgagttaataaacagtccatgctgatctgtttcctcctgttacaaataagacagacaatattataattttggtagagaaaatgattataaaatattaattgctacagtggttagttgatggaagtaataacaagctgaaataaaaacaaagcttgattattaatgaacattgattttttaatttaacatatgcctgggctcttttcctaagatgttattatgaactagaagattcactcatagtaatgctggttagaatcttgaggaaaacagctttacttgtcttcatcggcttctgcagaaggccaccctgtttgttggctaacatcaatgtgaagatagtaagtcaagaaaggggccctggtgcccaatgtgtgcctacaatggactaaagtctttcattccacatttagagacaatccttcaaaagcagctagccttatgagagaaggtacaagtgtcttaagttcacattaaggtttaaatggcagatgcttttttgcagcaggttttgatcagagtcacaactttgtgtgcctaaaagcaggatggagaagaaatttctctaaaatagagatcacaaaattaggaatattagggcaaaggagatatattgtaaccaaggctggtcctgcttgaatttacaggtttggaacattaaggatgatattgaataatcatgatttttctatactttttcctggataatcatctaaattacgggactctcagcctggtaattctagaaataaaatatttttatcgtatggagctttagattaagtggccagtaaattgtgtacatcataatacaggattaggaagactatgtagttaattgagaaagagagattccttgcctcaagcaattatcagctaatcacaataaaaaaatgacaagtattccaaagaataatagctcttatgatgtgttcagagctcagcaatttctgcattcattctgtgttcaatttatgaaatcttcaaactagtcaactacctaggctaagcttggcaaatctccattcatgattacaggaaatttttaaggtattaacaggatctctggctctccgtaaatctgatttgctaagtaaggacctccattttgtcttctcacatgaaagctattcccaagtctttcttcccaaaatcctcaattccctcagaacaataggcagtctgtaatacttgtacatctgcgcactttcggacaaagagccataaggctgctattgctctcttttggaattagctcatgagcttaggtgatttggaagaggaaagagcccatggaatggttgctacccattgacaaaatccagtgactatttcagaacttgagaagtatttggcataaaatattattgttttaattaataaaattgtgttttattaatggatgtgtgtgatcaatgtcacttctttgcacaacttcagggcatcccattaatattatatgctcccaggaatgccattcacatggaaactgatgtaagtgtgcccctggagttgggcaatgagatggtattgcctgttacctttggccatctagtatttatttctttttctaacacaacctaagttttctttaggacagtggttattaagcaggtacaatgttattgccctcattacattttgccaatatcttgagacatttctagtttcacaactgggggaaggtcctactggcatctttgggtagaggccagggaagctgctaaacatccaacaatgcatgggacagtcacctacaacaaagaatttgctgttagtgaatgttatctcgctgaggttgaaaaaaactgcttttaggagattcttctcttcttcatgatttgcatataatctttcctaggcctggagctcaaaacttgttcattcagcctgtcattctgggattttgaatcttgatcaaagtgaaacaaggacaaaacatttaaccaagatacaacacaataaaagaaaacatattaaaaaaaaacaacaaaaccagttcaattcaatgagggggtcaagatgaaattattgtatagtctcttttgcttgcatacctagacctcgcctggtttcttttctgttattaaacctagttccccaaacttcctggccatccttgagatatacttctgataaattcccttttggctttaattagcaaaagtttgattctgttccttgcaatctaagaatgctatgggaagcacagttttttagagaaagaataccaccgggaagttaatttggagattgtgtttatttgttccccaatgtcacatactatcttctttgctgaattatatgagacatgatctttatcctccaggagcttaaaaatatagttaggaagacaagacatacccatgtaatgtgaggtttaatttgtattcaaagtagtacatgtcatgaaccaaatgggtggttcaaaggagtagtcaatgctttaggatttaagagaggagaaagattagcttggactgttattaaggaaggctttctggaggattcaagacttaaacaagtttttggaggatagctaggacttgggatgaaaaaaagaaagggggaggtcttagagtattgtgggcctggtgaaatcagacagaactcaattcaggtcccttctttagattcaagaagaagctgcttgactttgggcaagttatttgtaaaatgtaatataaaaagtcttgaaacagcctagaacagtagatattaagtaaatcataactatggtagctgtttttgtttgttaccaaacttagaggaagagtttaagccaagatgcatagttggaaattaatgcgatgtgaatgaggaaagtaagttgtctatagcatcaataaaatagaagataggtgggtaaaaaggcaggaaaggctgggcaccgtggctcacacctgtaatcccagcactttggaaggccgaggcgggtggattacctgaggtcgggagttcgagaccagcctgaccaacatggagaaaccctgtctctactaaaaatacaaaattagccgggcgtggtggtgcatgcctgtaatcccagctactccagaggctgaggcaggagaatcgcttcaacccaggaggcggagattaaggtgagctgagattctgccattgcactccagcctgggcaacaagagtgaaactacatctcaaaaaataaataaaataataaaataaaataaaataaaataaaatataaaataaataaaataaaataatgacaggaaagttattaaggctagactatgactgcctttatgttcccaggtgacaagttcagagtttatcctcctgtaaatgtaggaaacattggtaggttttgaatggttaaatgttatgacgaaaatagtgatgttagaatgtgattttagtgctgctatgctgaatggatttgggaggatccatttcattgaccataacatacaaattccaaaatagcttcattcacagaaattaatgagtttctgtccttctactccctcccacttggtctttctggccaatctaattaaacaggtaagtcaacaacaaaagaggacaatgaaagttgtcataacagtaggtaacacttgggcaatgtagtcaaattcatttattcaattaaacaaatgagtctacttattttttaaactaagttcatggaaattgaccaatcatttcagtcaaaccagttgatctggttgtacatatagataaaatcattgcctatcatggaaaagaacaagttattttgagcattcttctcaggaaagttagtgtcaaacatataaaacctagttttaggaagaagaaggcagtaatagtagtagcttcactaacacgttaagactagtgtcatggtatacacagtagagcaattatatttaaggataattaaatataagcagctactgaggaaagtgcattggtgaaattgtacattgaaacgttagtaacaaaatgtatcctttgctcccattctttcaatcaaagcatgaagcttaagcagcaaattcaaagattagctcagaccccaattagtcccccttgaggtccaggataaaattcctaataaaattgtaaatctctgccctgttgtttaggggacttggtattgacagttctttctttcctttcacaattagtaactgagtttcagatgagatttaaaaataaaaatgaacaagaaatgagcttgcctccctgtggcagcatgcactctagctaatctgcaaatgctataattatgcaaggtgctgatagatttgtctctgggctggtggtcaggatccaattgaactgctgcagttgctgctttatcatcacaaatgttctgcacttcttagcaattctcaggcctaaacatgatattggaatttaaagaggcaccatagccttatatcccattgagatgtgctgggttaagtgccagttcatctctttccattcacaggtttagggggaaaaggtgtatatgtgtggggtgtcctacagggatcatgtttcaactggctgtttgccacaaagccattcccattggactaggaaccctagtgtaattatcgtagagtcaaagaggctaaaaccactgactcagtactgagctctttacctgtctactgcctacaacttatatcctgttttcctattcatcttgcaagtgggggcttttggtcccaaggggacaccaaataagacaatataagcttcatttaacttcatatctaaattggccacatttgtaactgtcttctttaccttacaaggtcatcatgaagataatatgagctaatgtatctgaaagcactttgaaacttatgaaccacctataaatgtaagatgcttaaaattatcattaatattagtgaatgtcacttcagcaattgatatttaacaataataaaattagggtaaatacatccatagtccatggcggaagataagggaaggggaaaacaatgaccccaaactcatcctgctgaaagcagagcaagattgtcatttccatacatgaaatacattccttacaattgcttcccacctatcacattccagttaatttatttggaagaaggaaatattttaaaataagattgcccaagaatagtttccagcaaactaaatgtctataatttggatgtgtaaggtaaattgacaataattctataaagaaatcaaaatgggttttttattaataaaatgaaaaatggctggatttaattttatttatgttttgaatacatagcatatggggatggttcaaaatataaaggcatatagtgaagattaaatcttccttctgcctgcccatgacaccctttccttacccaccacagttactcagccatccactccctctcttcagaggacaccactgttaccagttgcacatgtatccatctagaaatatttcatacatatacaaacatttatatatgcatatgtatgttttatactcaaaatagcatgctgcgcatactatttgggaccttgtttttttcattaaacagtatgtcttggaaatattttcatatctaatctacagatttacctaattattttaaacagcagtatcataatatgtcattatatgaaatcaccacaattgtaacaaggctcctactattagaaattgaggttgtttccaatattttactattacaaataatagcaaactacaacaaaattgaacatctgatataactggattttaaattcaaacatattcattttttttaaagtagatccctcatgtttccaataatatttaaaaatcagattattaagagtaactgtagtatttatgaaatgaagactagacattatattagtaggtctaaattatgccaaagtcaattaaaacaaaaatgttgttcaattccataaggacaatacatattgtatgtcatcttgaatgatgtgttggaaaaatgaaggcaattaattcactgaaatttttccacttcaggcagctcaggtattaggaagagaaagctaatgtgccataaagctctttcctaagtatatttctggtgcatttgtttattatcaacaactattttgggaatctctccaaatttgtatagttccctaaccttacctgtcctgtaatcaacttttatttctctctttcgcttctaaatattcttcaaatagtatgagatcttctctcatgttggcagggaattcctaagctagtcaattaatggtggcttaatcattatagcacaatcctatgctattcctcctgtgaattataaagaagtataaaacatttctttttagtaggtaagagttcagttggatacttgaagcaagacataaatacagaatcagttaaagggaattcaggatataaacaatagtttgatataagtaagggttgttttatgacaacaatacacatgacattatgtatctgcatactgagtcctctcatttctttcttccaggtgcctctcagatttgtcctctcattaaaaaaaaaaaaaaattccccaaactccaacctggtgtgactgctcaccaccacccatccccacacactgcagcattgtttcctcaacctcttagtttttgttcttctctcagcccattccacatatcaagccaatcatcattagacatcacttcctttgagtcattttttgtttcaagatctacaatgacactccagcctagaacatcatgtccaaattcctctgcctgttactcagagtcctccagaattcagccccatccaatctatctagtttcatttttaattcatggtgctcacaaaaccccttctcatcaggctcattttcctcaaagcatattatgcttgtgaagttctacttttgtgccttggtttatgttgttaatctttcctgataatcttttgaaaatctttttgagaatcttctgagaatcttttcttctttactctctgcctttccaaatcttctccactctctgcctttccaaattttctccatcccttaagtttcgtatggagatccattctcttcataaaactttccccaaaccttccagcgaatattaacctctcctttctccatttctttaccacctatatatagccttatagctcaaatgctacattctatgttccattctctattatggtgtgctagtcctgtgttcatagtcctgtgttataaattgagggcaaagataaagactttactttctttccctttagtagctagcacaagacttggagtacaaaagatgcttaattggtatttttgatcaattatcccaatgaagatatcattgctttattatattgttttggaggttgcagtggagagtgggggataattcagaggtttagaagattcatgtcactaaaaatgtccgttagggtaatatttcattgagaataccactacaaagcatatatgaggatttactatttctcaattatacttttaaaatatatatttctttatacttacaaatttataaaaaccacccaaaatagtccatttgtttcatcttgttggaaaatgtagttgtcaaaatggcctatttacagtgaatcaatggtgctctaaatgtgctgggaaatggatattgtatggatagagtaacaacccaagtaggaagtaggaacactgtctaataaatgtttacacaccatcaagtctacaaacattaaatatcatacatgatagaatctttctcatcctgtaatttatctcaatttttccattactttctttcattttctcttctagctttactcacagacaagcctcccaagccattgttccccatggagaatcagccaagtgttatagatgtccagctgggtaagtcccctccttggaataacacttcctaaacttgccctctgttaacagatggggaaaattgcatgaaccaggaaaggtttattgccactgttattacatgcaaatcaatttgtgttctgctcatttataaccctggagttcagtgcgatagcagtttaaggaaatgagtttgtattgcatcaaaaaatggtaatactaattagttacactgggtattaagtgtgctgtatgacagagctttttaattctgtgattgatagattcatgagtgtcttgcattggtgattggtacagaaaacttttcatacatgtcagccaaaatttttatttggacagcattaactcctggagaccaagcacttcttaaaataaaatacaggcttcggtttcgcctttaaaatgatttgataatattattttcaatatcacaatccagggtcatttaaaacttgtttttaggttgggatcctgaatatttatgaatcatatgatgttgggaaaagtggcaagttgacttatgagtgctattgtctttttacacactcaaataagaacacaaggtgttacacctctttttagagctcctactgctaatccttgtaattttaagtactgtaagctaaaaactcagaggcctgctaggatctctttcaaattgtggcctttaatttaaatcatgccctttaacatttgcgagatttcatctgtcttggatttcattctagtattctaaatttcttcaattctaaatagaagaaccacaagagaactgagtaaatatgcttgaaatgtattgggcttacactgaatatatgatttgttgatatttgtgaccattgtggtctatatccattatacagccagggaagacaaattgatcccaattttcactcatttagaaaggtttttctttttgtttaatttttaattattgtgggtacctagtaggtgtgtatatttatagagtacatgaaatattttgatacaggtatacaatgtacaataatcacatcagggtaaatggggtgtccatcacctgaaacatttattctttctttgtgttacaagcagtccggttataatattttagttattttaagatgtacaataaattactgttgactgtagtcaccctgttgtgctattaaatactagatcttactgattctaactatatttgcatgcccattaaccattcctacttccaccacacccaaaacccttcctagcctctggtagctatcattctactctctatctccatgagttcaattgttttaattttttagttccccaaaataagtgagaacgtgtgaaattcgtctttctgtgcatggttcatttcacttaatgtaatggcctccagtttcatccatgttgttgcaaatcactggacctcgttcttttttatgactgaatagtattccattgtgtatatgtaccacattttctttatccatctgtctgttgatggacacttaggttgcttccaaatcttggctattgtgaatagtgctgtaataaacatgggagtacagatatctttttgatataatgatttcctttcttttgggtatatgcctagctgtgggattgctggatcatatggtagctctatttttagtttactgaggaacctccaaaccattctccacagtggttgtactaatttacattcccactaacagtggacatttgggttccctttgctccatatcctctccagcatttgttattgcctctcttttggatgaaagccattttaactagggtgagatgatacctccttgtagtttttggaagttttgactcaacttttgatctttataattcagttgggattgttgaaagcttatttatatcttgaaaataagagacagaaaattatattcctaatgttcacttttccaaaatgaaatatagcaaatagtagtttttaaataagcctagcaatgtgagtaccaaagttaagcattttaaacaaaacaaaaagaaattaataaacatgttatcaagagtggactgtgcaaatggtaaatatttggaaataatgaagtattagactgtggctcttcttatgtcccctatattgttttgcagtcattatattttgttagagccaaatctagatatgctgatacccttactgactgtatgatacattttacttacatttctctaccttgaactgggataaaaatattccaagggaactttgtggttccaggggttacatggagccatatgacggtctcgtatcattagtttacatggaaattcaagtggataaattgatttcatttggtatgaaaacaatttatccacatatatatctatatatctatatctatctatctatctatctatctatctatctatatgtagaaagcaacatttgcatgataaaatgtacatgataagcccaggccctgtggctcatgcttgtaatcccagcactttgggaggccgaggagggcagatcacaaggtcaggagatcgagaccatcctgattaacacggtgaaaccccgtctctactaaaaatacaaaaaagcagccaggcatggtggtaggcacctgtattcccagctactcgggaggctgaggcaggagaatggtgtgaaccctggaggtggagcttgcagtgagctgagatcatgccactgcactccagcctgggtgacagagcaagactccatctcaaaaaaaaaaaaaaaaaaaaatagtacttgataagatacacaaataaaatgtgagtaaattttatgtttgtggtccctggaggaataccttctgtactctcctctgctattaggcacacaacagcaaagtttgaaaagtattgatccaaagcaaggagaaggaccattgtagaagatacattccattcagattcactgggtgtaacacctgtatgtactgttcaggacatctacaagatgtgcactttgtataaacctgtattctaacatagatatatatgccaaaataccctaccaagtactaccatcctataagattactaaaataatttacttccaatttacattagatgtaaggctgaacttttcgggttttagtttgtaacacaatt

SEQ ID NO: 1249 - DNA, 920354 bp, mus musculus; identical to SEQ ID NO: 1248

SEQ ID NO: 1250 - DNA, 920354 bp, mus musculus; identical to SEQ ID NO: 1248

SEQ ID NO: 1251 - DNA, 920354 bp, mus musculus; identical to SEQ ID NO: 1248

SEQ ID NO: 1252 - DNA, 865 bp, mus musculus
ctagccacacagcctcagatcctattctaacatcgatccatcctgttacccttttaagaggcggatcccgcagtgtcctttcctccctcccagccacctctacccccagtcggctgggcggagcttcacgctaaagccccagagcccgacgcggcagccgcggtagcggagaagactggagctccgaggagctgcatctgcggcaacctgtgtgctgacgctacgtgcctcctggctccgacgtagctcgcagctccccagtctcactccattccttccccacctggcgcgcacctgctcaagaccagggtcctgccaagcgctaggagggcgcgtgccaggggcgctagggaactgcggagcgcgcgcgccatggggccgccgcctggggccggggtctcctgccgcggtggctgcggcttttccagattgctggcatggtgcttcctgctggccctgagtccgcaggcacccggttcccggggggctgaagcagtgtggaccgcgtacctcaacgtgtcctggcgggttccgcacacgggagtgaaccgtacggtgtgggagctgagcgaggagggcgtgtacggccaggactcgccgctggagcctgtggctggggtcctggtaccgcccgacgggcccggggcgcttaacgcctgtaacccgcacacgaatttcacggtgcccacggtttggggaagcaccgtgcaagtctcttggttggccctcatccaacgcggcgggggctgcaccttcgcagacaagatccatctggcttatgagagaggggcgtctggagccgtcatctttaacttccccgggacccgcaatgaggtcatccccatgtctcacccgggtgagtgca

SEQ ID NO: 1253 - DNA, 68113 bp, mus musculus
tcgtcctatccccttgctccgaaggaaagtgggtgctctttctgtccccacggagtggggcagggtcctccccgagattcaccaggcctgggtgttgggcaaaaaaaaatccttcatttgcctctctggtggaaaagggtaaaacaaaccgggtgcagaggctggcaaatcaaggactgtttgagctctttgcgttcccttttcctggtttttcacaagggtgtctagccttggattaagtggtggtgggcatcgggtcttaaatgaccgaggagatcacctggaaatctcttcctcactctgctttttaacaacctcagactggcagcagattttcccctcctctccctgtttttctctccatgtttcctgggtatcaaatactagattgtgctactgtgccctgttaacctcattgcaattttggtggaaactttgcttagttcttgggttcttctctgcccagtggtctcaagtcccaagtgacttggtatcagtgcttttgtttgcttctgaaaaatctgatttaggttattgagttgcaaaacaggtgactaacgttcttgaaaaagaagaggtttctgcatgaggatagcaaaggcctagactttggaaaaaaaaatagtccaggtagttcttaaattcttggagatggtatgaggttactatttttccccgtcggttatccttccacaaacttccctatttgtgattaggtatccataccttatgtatatagttatcctagaccctaaaggacaaaggggaaaaaaatggagaaaaagaaagagacacgtgtaatagcagtgtatcatagtttttaagagctgggcctcaagtcagagcttggtttaaattcctactctgttgcttactagtcctgtgaccttgggcaacttatttcaagtcttagagtctgggttctctcatcagtcaaatgagaatgaataataagaaaacttatccacaagtttgccttcaggataaaatgaaataatgccttaaagagtttagtgcagtaaagcacatcatccactctcagtaagggttagctgataggattagccttctgggagtcactggaaggaagaagctgcttatttgactactggaggttttctgtttttcttaaaaccttatgactgaacctgcctagagagcacttgtattgagtggctggatggcgtaatggaaagaacactgaattggaactcaggagatttgagttcttttagccccttctttgcctctaccgactttgtaaccttgtacaagttactcacatgtcaaatgattgtataggcagtggaggccaagttagaagcgtgtactgaaacaaaacaaaagtagatgaactctaagatccctttcagatctaaaatgctatgatttttagtttttatattgattaaaggagaaactgtatctctcttggccgataattcattgattagaatgaatcagtagcttttagaagttactgaaaatcaagaataaagacctaataaagtttatagtctttatatttcagttgactgtctaatagcaagggtttgactttgtcttctaatgagattcatttgcatgaatgatttgtaattgaagagtatttaattacagagtcctacttagaccattttccttttacttctgttaagggtatttatctgatagttttaggagacaataaaattaacttttgcttggctcccactatatgccaggcactctacatacatattacttatactttattgagaggcaatatggtgtactaagaaaaacacaggcattttagtcaagattgggaataaaattctggatttaccacacaatagctttgtgtccttggtaggattatttaactttactgagccttggataccccatctgtaagatggagataatatttatgttgctgtgattattaaggattatatatatatatactacccagctgataatagtcactgaatgttataataggttaatgctaacaggatgcaaaaaaataatgtacaaatgtatgattgtgcaactgtcgatttgaagacatgaatacactgagaatctaactatgggtgttgtgtttcaggataccatataggaataaagccctaaatattgatcactaaattacactacattcagaaaagcattttgatactttaaaaacaatattatctgagataaaggctataccaaagtttgccatcaagctaactagataaaaccagcaaattacttgaggtaaggaatcacatttctccttgaactcctggaaaaactatttttcaatatagggggaaaatcactgcatattatccacatgtgttattgaatatttgtttgcaaagtgttatattgtttgctttactcattcctcagagtaagcctagggtttccttttaacctctggtcaaaaacttatcttggatcatagtggcagagagataggactgagatttaagtatggattagttcattatatattgctgtgaattacgaaggggccaccaaatgtggaaaagccttctgtatcttctttgtttacaaaatctctcttcactcactctcataggggcctgcacttgaattgtttgcccttggttagagtttgtgctgagtgtctatattcccacctaactaatttagaacagttgctttaaaatttttgtttaggagaaagaaactccactatataagagcaatcaattaggaaaatgagacttttatgtataccaaaatttttcaaaagttaattgtagcctaacatcaactcatgcagtttatttctgtattttgtttgcagagtattcagaaaattctgattcacacagataaataattgcaaatgacagatgcttattggcagtttggcttgcaatctctggatatatttcaatcaaatcagtgcagaaacctgaaaggaaattaggagaaaatttttattccaaagtgtaattactattcaaatttcttatcttaaaaatgaaagtcagataagtggccaaatcttaaagtaagcattaaaaccatctaaaatgtaagattgtcacgagacacgttaagcatgttctcactattgcacaacaaactgttctgcttacgccaggcagatgggcctgagctttgcctggtgtctaattgagcacaacccacaggttgaagagatatgtatacttgcttgtacaattttccttgagtcaacattgtaggcatgaatttattgaaagactggtgcagaactacaaccttcataattcatgaaacatttacaacgttatgcataaaacatatgcaaagggatgtcaggagaagcattattcctgagggctgtaaaaaaaaaaagtgaatgaaccaagcagtttaattaatgatttgggggtctccaatgggatacagtttgatatataacacagttgcttgtgtacattgttgaaagatagtggaacagattagttaagaggttgtgctctgccaattagtattttttaaatcttaggccagttattttacttctctaagtctcagttttctcctatgtaaggtaggcataataataaacttgcctcctaaggttgctgggattcaatgagataatgcagataaagcgtttagcacagtgtctgacatataggaagctactattatgttttaatcacagttaaatatattttagaaaatgaaagttgaatcctgtgtttgtagaacataattggaaatgaacagtctagagtacttcaaagtccacattacctgaaattctaatttgatccctttaggtacggagggtagactgaattttaacaggaaaaagatcttttggtcctcctatgtttgttgtacttttctcaaataactgcttctccctcctgctaccaatctttttccgttcacagaggaccttggaatagtatgtttgtactacttaatcaccacccaatcccttctcaaccattttatatttaagttttattctactttttctagaatgttgactttgaaaataaatctttttttaatagagaagttcaaaagggattggccagtgatgattaaccaatgtaaaatactattcccaaagccattttcagatgtagccttcttggtacctctgcaggactgtatttgacactgttgactgcctctttaaaactatcccaagtagtgtcttccttccttgcctctcttttgtttcattactattttattaattcatgcatctgacacttctcacttgcatcccagactcctagcactcctcctccagtaaatagatgccacatcctgttgattctggcactttaaacattctcacatatgtctccttcttccttgctttcaataccctgctttcagttcctgtgtcttctcatgggaaaaaatacttagcctcttgattggtctccttgcctccagtagtttttttcctagtatgcagttcttcctccatgccatcagaacacagctctgatcacatatatgctattacttataaattttggactacatttatcagcatggcatataaaactcctagtaatctgatcccaaactacattcaaagctttatatgtctcttctttcatgttggtccctaaacattctctattcttttccactaacattcctttgcttctgctattgccaacagacctgtttttcttagctctgctagtcaaaaatttacacatccttcaaaatgcaacacaaatgcctcctcatctttgaagcctttcttaattctttcttttcctcttcccagcacagcccacacccaaaacaaagtatagtaatctctttttgttccaatagcacttcctctcttatagtacgttctgcattttgctggtaattatttgtttacatattttaccttctactggattataatcattttaatgttttgttaatctttgtaatctctatagaaacctttgtactatacatgctctagaaatgcttgctgaattgccttaaacactcaagaactctaatgccagaagggtcacaagattcactagaaaagtatctagtggatcggaattcaattcatcgagcatttatcaaaggtctgctgtctgatagatactgtgcttcttgcctgagtatacaaaataattaaggtaaagtccctgccctcttaagcaatgtagagcctggtagaaggaagaagagcatacaggaatagagtgtacacatacttcaagattgctggctaacttctatggtgattagcctggttttatggatttttaatggcaaaatgccctaggtaacaagaaaataatgacaaatgacttttcatattgagttttccctgtgctggggtgttttatttttttgatcttttaaaaactacaccagcattatatttatgtctccaattaaaatgcttccattgaacatgttggtgaatgtgaaatttcataaagtaaaaatcttttttaaaaaaaggaaaatagagtcagccccctatatctatgtccacatctatggattcaaccaactgaggaggaacaatatttgggggaaaagaagcatctgcactgaatatgtacagacctcattttcttgtcattatcccctaaatgatacagtataacaactatttacatagcatttacatcatattaggtattataaataatctagagattatttaaaatatacaggaagatgtgcactggttatatgcacacattgaaccattttatataaggaaattgagcatctgtggattttggtatcattgggaggtcctgaaaccaatcccccatggatactgagggatgactatatagcttgatcagtgaattgttttctaagcacataaataacttttcccccctcagtccctggaagatatgtgttttcaatacagaatgccacattttaactctgttcacactcaaatggacagaaaagaggagagtactaaagacattttctaagtaattttctgattataaaattaactgttatagaaaacttgaaaaatacagaaaagtgtaaaactaaaatacccataattctacaacacagatgacaccattaatattccttcttaccttgatttctgtacataggcataactttgtattctacttttgtaatagttaattttttataaatattaatgtagtaataaaatacagaaaaaaatgaaaaaagatatacaaatctgttttagcattggggggattagtcattttattcttttttatttatttattttttttgagacagagtctcgctttgtcacccaggctggagtaccatggcgtggtctcagctcactgaaacctcctcttcccgggttcaagtgattctcatgcctcagcctctcgagtagctgggattacaggcctgtgctaacacacccggctaattgttatagttttagcagagacagggtttcaccatgttggccaggctggtctctaacgcctgacctcaagttatctgcctgctttagcctcccaaagtgctggaattacaggcgtgagccacagtgcccagcttatcattttattcttttgctctgtatatagatatattatttaaagaattatatactatatatactagttttgtatactgctttctattgtaagaatttctccatgtatctagaaatagaagatggtcctcttgtagttgaaggttgtggtcattgactgagagttggggattgagcctctctttctttagctaccagaaaggaagtgaaaaaatggagatggggagggttgtgaattggggcatttaaataaaaaatatgcttcaccgaggtttacattgaaatatacttactagccttaaacatggtctgatctaacccatatgcattgcctattgtggccttggtatttcttagggtttgatcaccacttgtgcttcagttcattttctcccccaatattcccataggtaatgcctttttatttttctttttttatgtcttcttcacaattgaggtttgcacctggtttccctgttgcttttaagtagcttttctattataatgatggctactgaactataaactattgttggtgtttaccccaaagtttatttgataaggcaccataggtatttcctgggaataaataatttttgtatatgtaagttctatcgaagtataatatacatcccaaaaaggtacataaatcattgatttagctcagcgaaatttcacaattgagcacacctgtgtgaccagcgccctgctcaaggaataaaatagtaccaaactccagaagagcacctcacgctccaatatgaagaatttttgatgtagcacaattatcaattttgtttcctgagggaatgccctcttgcagcatgtggtaggagcccagtcacccacagaaatattctcctcttcactgcactggggttattttatggtggtgatcctcagctacataccgtagggagttattaccaagcacagagtatatgcacctttccaagccagttcagaattgccacactttgctgtacaccaccaccttggagccctatgggcaaagtggaacacaagggctctttgttgtgttatttcctgttctgtccttttctttttcagctgtgtgtatgtccttccatgcaccatagcacgtagttactgcttgaatttaccgatagtcttagtgcaatattgatttatttattaaggaaagtttggtgattcatgctgacctctgggaaactggacttgatgaaggttgttagctccagaatctgctcatgaattacttgcttttaatacttgaatgaccaagttggtacaaatcagtaattctgagttaaccctattcattttgaccttttttgaaagaagatagtccttgagctcaatagttgatatatgtttctctttaaatgttaacttgtcatttcagacaaaatgttgaaatagcttagttaaatactgcctgcaactaaaagcgtcttagcttttaaaaagaaaatgcaccataatgttaatattgttggtgaaattataggagaaagtatttgttctcttcattattatttttctatattttctgactttcttataatgaatgttttacttttataatcagaaaaattcgtagttttaaagaacccaaaatactccaaaattattgatagatcctaaagaaagcattactaatgtgactatagtgacaacaggaacaaagcatatctgctcatagaaatgatttacaaactattatgagaatttaagaattgctttggccttttgaatatagctatctaatccatatgatagttggtgttaccttttattgttaacactggtttcttcatgtgccttgacgactaaaagaattttcaggactgacttttcctattttaatatggaatctttctcttctctttacccattgtatcactagctttttttaccctccccccaacacacacacacataaaaaaatgcacattccatgcctttctttgtatttttgtttttttttcccgtaagaggcctgcttaccctcattagcccccttcagtatccattctactcaatactgttaagattagtgctaatagctcaatatgaagaattcaatatattggtaattttcatccatgagacactgacttcatctaatggtgatagattttgtcattctagaaaataggaggaaattgtattagattaagggcagaagggaatcgtgatattcttattttacactttattaatgatagaacacacaagctcatttaaattgagttacttgtttttaaaatgagcatttcccttgggattttattcagctatataaaattccactagttggtggtttatacaagaaactgtcaagttccaaggttgctttggtaccacttattttcctcttagaatgtattttgtgtcatacttttctaccctcctctgtctttcataacatgattaattttaccttaggtaatcttacacatacatacacacccctcttagagcttctttttccttttcaaaaattttgtgcttccttctatgtgattccacttcttttgatgtagtagtaaacattatagcaaaccagtactctcaaaatctaatgaccttgaaggtgtccataacttactcccataaattctataaaaaccacccattaaccatgtaatcctcctgattaaatacacatttccttcatgtaccagtattcatgataaatttgatgtgcctttgttttactttagatattgcagtgatactgctttctgaaaagttttattacaaatatgggttaaataataatttatatttgctttgcagttttttgtcctcaaagcactttcatatgtaataatctttgagctcatttgagaacccagtgtttagcaacattactgtgggaaaatatgttgtctctacttccaaagaactggtttacaaatgaacttttaaaacataacctactagtgtttctattgtggctgttcattatgatagccccatcgagtatggattattatattattcccaaccatgctggtttagggagttttaattcagtttctgtgtcatgttgaccaaagttctgtctcaccttttccatgtacttcaccttaaagactacattttgttttcttaatctttgaggatctcagatgttggcttatcttaagagcatttgtaatgtccctaaaagtcttaagaatgtatcttaacttgatttgtggcttagttagtcatcagtagattttctttttttattattattattataatactttaagttttagggtacatgtgcacaatatgcaggttagttacatatgtatacatgtgccatgctggtgtgctgctagattttcaagtacagttgtccattggtgtctgtggaggattggttccatgacctcccgcatatactaaaatccacagatgctcaagtccctgatataaaatggcatagtatttgtatataatatatgcatctcctcctatgtgctttaaatcatctctaaaatacttataatacctaatacaatgtaaatgctatgtaaatagttgttaatagcattgtttagggaataatgacaagagaagaaagtctgtacatgttcagtacaggcactttttttcccaaacatttttgatccttggttagttgactccatggatgcagaactcatggatatggagggctgactatacatctcttatcttcgaagatttcaacagtcacttggatgaaagctagaaaaaatgtgattatactgagtgagggtttcattcatagaaccatgggcaatctatattgaacacaattccaaaatactttcataggtgtgtttcaatcaaattctttcatcaccagttcattttggcaaaagggcaggatatgtaagaaagactgaaactggatggtgtgaaatcaccaattacctcccttggcacaaaccataactgccattatttttgctgctcctctatggctgatgctttttggttgaactggctagtaagacaaaagaattgacttactttgagtaatgtaattaaaggccaacagatcatcatttgatggtaaggaaagctatttgattgctctgtttttatttcaacctattgtaccaaggtgaatgtgttccatttgaaattgggggacagcatattgcaatggaagcaggtgtccttgagtcagacagcttgatttgaattccagctctaccaattaataaatatgtgatcttgggcaagttgttaacctagaccttatttatcttgttcatcaaaagggggataataatacctacattttccatgatattataaatcaagtgtttggcaggtagtgagcatttagtaaatgctagttctcttgaacctttgctaataatttcattactactaaacataatacttctccattggttattatagatatttactaccacactttgaaatatgtaattgtttcatatgtagaagcagaaaaaacggaacatccatattgcaatttttctgggcagttcctgaaaaatgcaggaagaaatcacataatcaagaaactgaaacgactatattatcttccttctccctggtgtatttccattttaagcaaaagcaaaaccttaaaatcaagatattaagctctaacaatggaaatggctatgacccttttgctggcacagtggttaagaagaggggacttaggaatcaaatggatttggtatgagtcccaactctatcatgtaaaactttgtgaccttaaccaaattaatctaagactcagtttcttctcccatagaatgggtaatataattgtctctatgtcatagggttattgtgaggtgtaaattaaataatatatgtacagtgctcagtgcacatcctggtttattaaaggatagcttgaccatctccttaccctcatctatagcccagctttggagattggcagtgtatatcactgcagggcttcttagagcctctaatatgcaaaagaaaccctgtttgactttgttcaatgcattattttctgaatttatctgcagagtcctttttgtctttccaaatacttaacatccgaaatacgatttgggtagcactgattatcagacacttaacaatttctctcttctattctcttctcttctcttccttccttccttttttccttccttccttccttccttctttctttctgactttttttttgagacgcagtcttgctctgtcacccaggctggagtgcagtggtgcaatatgggctcacttcaacctctacatcccgggttcaagcgattctcctgcctcagcctcctgagtagctgggattataggagtgtgctaccatgtccagctaatttttggattttagtagaggcggggtttcaccatgttggccaggctggtctcaaactcctgacctcaagtaatccgcccaccatggcctcccaaagtggtgggattacaggcatgagcaaccatgcccggccctcatattttaactgtgtcaaagctttgtcaatgtcagagactaaccaataaagttaacctcagtatgataggaacagaatatattcaatgtgatgacaaatattctttttttgtactaatatggtagcttttatatcaggtttatgtggctttaaagtggttctacatgctaggtttattctctttactgactttcagaaacaatttatagtgaaaagataaggacataagtgagacagattcatgtttggttttataattcatgtgtggaccttaatgtagaagctagcttttgtaatatgtcatacaggaggaaatttaatatactcaggtactagaatgttcttttttatagattttttggtacctatatgataccaaaagtcatgcagaggcatcccaaattctccttttctctaatttgagtacataatggaataataactaattggactactggaactcttgcacccttggattttgtggccaggtcaaaatgaatacctaatctctcaacataatattcttcctaactttaatgacaaatgcaatttccaacccaatccccatattaaaaactatacctgaagagaatgcacataagaagaagcaccaatttcaataaaagtttgaatgcccctttatgaccagcattatgctgaatgttgtagtaggagaaggggagtgtgtaagcagcatgctcaaaacaatgatagtgttttttccttccagggacctcacatttttagcctctgttgttgttgttgttgttgttttgtttgtttgttttgcctaataatattttagtctggcacttaaatgtcaatttaggtagggctttcagatctacacaaaaaaattgcattgactagagtttggcaacatttaaggtacagagtacaggtacctttcatgcattgttttactagttccacctggtctgaaaggttcaggataaagtggtgaaggtcatgtcccagtttcattgtaagtctaggctatgacctatgcctgtacccatatgtttgctcctaaataaacaattgaataaacagtggaattctcctttacaagggctcacattataggaaaatacaaccaacaaataatttttactttttatttttagagacagggtcttgccctgtcatccaggctggagtgcagtggtgcaatcatagttcactgcagccttgaactcctgggctcaagcattcctcccgtctcagcttctcaaagtgctgggattacagacatgagcaaccacacctggctagaaccaaaaaataaaggacaaaaggaacaccgtaatttctaatgatcatttgtataaattttctctctctaaaacctcaaagtctcctgtttgctcctttttttaaactgcccgacaaataatctaattatttttaaccacttgtgtatatcttgttagtcatagttgtttcaccttttcttatcaaatagtcctatcagattctgaacagctttttgtatttcatagtttatgggattgaaaatgttgatggtatagagtttactgactagcattcctctagaaaacataaataaatagcaactgcaaatgttaaatctggcttctagaaaccttaccaccccaaaacagaaacaatgacaatagaaaacattggcataaaaattttaatataattacagaataccctatttatcaatataataacatatacactataatttctgcctggccttgcaatagcatatcttatttttttcctcagtatcagcagaaatttaaggttttatagagactcaacctgttctggatgcttcaatgcttctcttttatgccctctgaaattcctcataaccatccaagccatcagcctactagtgaaccaggatgactgtgttttaacttgagctttgggctaaaatggcatgtgtaccagcatctgaatggaagtttgaaactgaggtataccaaagccccatgttggaaggggattatttgtcaccattaatgcagctctggaagtatggtaatttcaacagaatcagcactgtggcaataagcattccactaaacccaaggtctataggatagaattagtatttaattttttatctgtttttgtgataggtctttgctgtaggcagacatgtcttgtctagatatgccatctttatatagagagaggacgcacaccttagactgttaaccacagttatctttaaaagatgaatttgttttcagattaaatcaaaattcaaattatcactaaatatattatacttaaaattgcattcatcagaaatttatttgacatgtgttatgtggtaggcactctgctagttgctatagatacagtgatgaaagacctagtccctaacatgaagttcatagtttatgaaggacaaataaaccagataactttaagggaagtctgtagtagatagtgtaaaagcaggacatctaacgcagtcaggtcagaatcttataaaaggaggttcaattttattccgtaggtgaaatggagctctttaagggtcttttgaaaaagaataatgtactttttccttttagaaatgtttcattagtagccatgaggagaatgaattagaagtctaagactggtggcttggagaccagctaaggggttgttaatggtgatttaagtgaaagataatggtgacaatggagatataatataacaggaaaggaatgggactatttctgatatagcaaatttttaaaattctatgtgaagtacattacatactgaggaaaacaaaataattctattggcagagtttttctctgcatggtaaaggattggcattgatctggacagagggaatagactgctatcttgaaactctttgaccttaatgtttgaaaagctataaacaaactccaatccagtatttctcaatgtattttccacagaccacatgcagcaaaataacccacagaacttgttaaacctgcagattcccaagccccaccccagacatactgaatgaaggaatggggcccagagagctcagtgttttaacaagttttccaggtgattcttctgcctattaacgtttgaggatcatcgatccagcacaatggttctgaaattatgatctggggactactagtctctgagattctttcaggggtccatgagatcaaaactatttttataataatacttacacattgtttgccttattcactgtgttaatatttacacagatgatataaaagcaatggtgggtaaaactgctgtcaccttaacacaaattaagactgtggcaccaaactgtattaattgtattctctacctccatgcacttcaggaaacagaaagtgctagtttcacttaagaatgcccttgatgaatcaaaaagaataattaattttattaaatctctaccctgcacaactatgtatatagtgtgtgtacatattgatatacatatatgtatatgcacatatatatacatgtgtatatatacacatatatatgtatttctgtgtcatgaaatgggaagtgggcataaagcacttcaacagcataccaaagtatgatggttatctgaaggaaaagcacttgtatgactgagtcatgagatgaaatagccacttcaaacaactctttaacttgaagatccactgacaaacaacagttattcagacttcagtcctatttggaagatattttctctaaagttaactgggtgagcctgtcatttcaggaaaacaaatgacaatatttgttgccaatgataagatttaagtttttaagcaaaaatcagaattttgaaaaacttttatctactatgtaagcataacttcccaatacttagacttttctaatgggatcaatggtgatattaacaactgacttttttgttattgttttatcttgaaatgagtcaccatataactgcataactcagtgaatctgcataactgagtctgcctaactgggatctatgtaacacagtgagccaatattttccaaatgaccaatgcatgatattgcaaaaccccatataaataaaagatccattcaatgtgtgagatagaccaatggattttcatttaaccaagtagaaagaattcattgatattgtttcaaattctaccttgcacatagtatttaagaaactaccatttgttgagttttggtgtagtatcaaaggataatatctacagttatctgaaaatgctattgagacatccatcagttttccaattgcatatctgaatatagtttcccttcttgtgcttatttgacccagccatcccattactgggtatatacccaaaggattataaatcatgctgctataaagacacatgcacatgtatgtttattgcagcactattcacaatagcaaagacttggaaccaacccaaatgtccaacaatgatagactggattaagaaaatgtggcacatatacaccatggaatactatgcagccataaaacatgatgagttcatgtcctttgtagggacatggatgaagctggaaaccatcattctcagcaaactatcacaaggacaaaaaaccaaacatcgcatgttctcactcataggtgggaattgaacaatgagaacacttggacacaggaagggggacatcacacactggggcctgttgggtgggggaaggggggagggatagcattaggagatatacctaatgtaaatgacgagttagtgggtgcagcacaccaacatggcacatgtatacatatgtaacaaacctgcacgttgtgcacatgtaccctagaacttaaagtataataaaaaaaagatttccttcttgtgctttaaccaaaacaacatatcactatagatctcatgcagaaacagctatgaagattcagccatcttttattacatctgatattacaggttggcacaaatgaaaaacaatgccactcttccttgttacattttgttgggaaatatagttatttttaatacaattaggttaattactttaacatgaacttatgattattttaaatgaatatatatatatattgagatggagtctcactctgtcacccaggctggagtgcagccactgcaacctctgcctcccaggttcaagtgattctcctgtctcagcctcccaagtagctaggacaacaggcacgtgccaccatgcccagctaatttcttgtatttttagtagagacggggtttcaccgtgttaaccaggatggtctctatctcctgacctcgtgatccacccacctcggcctcccaaagtgctaggattacaggcgtgagccaccaagcccagccgaataaataaataaatattttttaaattcctccgtgttaatttctaatgtggtaaatatcaatagaaataatctactaaacaaaagttatttggagttctcaataactttaaagagtgtaaaggggtcctgagaccaaaaaattggagaattgctgatctagcccttaggttctatgtgatacgttaaacataaccactagtggaagtcagaatagttcaagcaggatcaggtgttttatataatatttctaagaattgtttacctatgagtgtgacatgtcatccacaaattattcatctgtgaccttttgaacagtgtcatttctaattccctaatgtctttaatatactgtttcctgaggactccatctaccagagaatttttgtgctatatcaagtatgtgacccatttcctaatgtattattgccttcaaaaactacagcaaaattatctagaggtgcagggcagaaaggcaacttgctgtactctacattagctatgtgcctttgttgattttaaaaaatggtaataaaggtgatttgggtcacattccctgcgatacaccctccctccaaaagatgatctgtgataatccagaatattaagaaccattgctttaatcaacagctaatctgtactaatgcctattctgcaacagactagattttaacaaaaggctagataggaggtgtctaagttcatttgtgtggctataaagaaatacgtgaggccaggtaaagaaagaaaagaaatttgggggccaaataaaccatattcaaaccatagcaggaggataatcactttatacaagggtatgcactactgattttgtctggttcctagtgaaacaccgatatataatccagatacttttaagaaatcacttgtgtatttgtttctttgatgaggtacactgatagtaaatacatatatatattgcaagaactgctatgaaggaatcaagaaacgcaaatttggttcatctgtgactgagaccaatcaaaaggaaacaaaaaaagttgccactaaacaggactttgaagaaagagaggctagtttggcttaaaagtttagattttttttttctgttttgaaaaatcactacttaggattcttggtctgatgaagtttggtatcaccctttgaaataattgtccttccccagttgtctgaagagtttgggatataggaggaaaagccaagcctttgaaaagctactgtggacaaaatgaatatttagaagtccacttgaattggttccagattttataatggaggaaatgtttgttacgttggaactctttacacctagatcttgttcattctggatatcagcaaattcagaagtgctgaccctattgtattatcaggatgtttggacagtattgaatgtagttttataagaagaactactttgcccttcagttgcccttattattctcattgtgaataacctctattttctaatatgttaatattagaaaatgttagttgaaagagatactagaacagcttccttcaccttgtattttgtatttcaatgccaaggtgctgtaagtatgttatcactatgctagaatatttaatatattgtaaaaatattttagaatttattttacattttaacacgttaatattaaatgtggggaaaaaaaggtccagaggcacagaacttattacatagttggtgcttaataaatatttgttcagtgaatttgtgtttacaaataagattagacaaaaaccataatatcattagctttttgaaggaaatgaaagaagttggccaccagcaggatcctacagtggatttctatacgttgtgaataataatttttccccaataatgcccaagatagacattctttgtattaacattttaattgaatgatattcaacagcaataggtaagagttgctacagcttatttcattacctttgttcccaagataggtaaatgccaaaaccttttttcactgttaaacatttgaaattgaatctctatttcttcttctacttaattgctacctatttctaatctgtcccttctcctaagatactttagatagcagaatgaaaatgcatgaaactctagccatgtctcgttattattaatgactattaagcttgagaatttctcctagaattggaatctgtaactactatatacatttgttgtatcaagataagtgtgctttaagttataatggactcaggaatctatatttaagtaataagggtccagattaactactcttgatgactaaattgtcaaatacaaagtggtataaatacactggaattataaaaatgacagctttttctgctattcaactctgaaaatgtaattattagatataagatttatgagtaaatccttgattgatctctacaaatcagataggcatttaacaaataaattttatagtttgtgttaatgatttttgcctaacagtccatgaaagaaaagggtgtgaatgatctcacaattacctttgaaacaaagtacagatttagaaagattgaaatcttgaaaagacagctgttctgtgattggggtttagactatctgttgtccaattatcagtttttctcatcagatacttttagcaaattaaggacttttttcttttctttgggatgagcgctatgtttgtttagaaaaataggatgaaattaataaatgatttggagagattctataaggatagaagaaatgtagtgatcttcctttgccagacttgattatagaaccttagaaacctagcacagcctgacctccttcatgcagaagatgcaacccaatcttctgatcccatttgagttactttggctacattatactgtttctctctcccaaactgtagactgtttcaggttaccagtttttaaataaagaacactatcaagttgagaaatatcaaaaccaatacaaaacaatttgttattttacaaatcattggacattgaaggaaaataaattttcctttttattctacttgtatcagtttgaaatgtgatttgggaattattattttctactactggccataatagtagatatatacaattcatttcactggcttggatcatattcttcctagtgatgaatatctaacatacggaagatatttgcaagtgtgtagagggcagggactgcactttattactctctatagccccacaggctagcatagtgccaggcatgtgtgtagatattcagtaaaacacttaatgaatgaaattaagagtactgtctgtcttctgtataaccggtccacaagaaagttaatggaaccatagctttgatcttattagtgctacgttttaatcaactgagctatgtaacccatttttggcttcttaagcctggtactttccaaaggaaatagttgttacagtgaaattttggacagaaaagtggaaaactctagaacttgtacaggaatctatgtattagcatatcaacattggttttaaagatcagctctcaacattttgagaaaaaaacataattttacagactgtggtaaaactgattccatttgtataatatggtgttgttttattatgagagaataacaaaatttgctgataagcaaaactcagcaacataaacaacatagattcagtgatatggtttctgttcattggacttgtgttcttgagggcctgaactcttgttttcaaagatcaatttttatgagcacttaaagaaatgctttgatattgcagcactatttacaatagccaagatatggaatcagtcatcaaaagatgaatggataaagaaaatgtggtatgtgtacacaatggaatactatacagccttaaaaaatgaaatcctgtcatttgtagcaacatggatgaaactagaggatattgtgtcaaatgaaataagcaaggcacagaaagacaaatgtcacatgttctcactcatgtgggagctaaaaaagtgaatctcatgaagatagagagtagattggtggttatcggaggccaggaaggggagggatgaagagaagttgtataaggggcacaaaaatacagttagacagaagaaataagctctagtatacaataatacagtagtgaataacttacagctaaaagaattgtaatcttctcaacacaaagaaaaataaatatttgagatgacaaatatcctgattaccctgatttaatcattacatattatatacagttatcaaaatatcacatttatcacaaaaatatgtacaactatgatacatcaatttttaaaaaaggaagtgaatttttttctcaggcaaaagatgatattttaatctatctttgaaaaaaatgccatccttcacattttccaaaatcttgtttaatatgagaaaagcttctggtcctgtgtatgttttaaatattcccttcactttctattccctaacacactgaaaatcgggagattaaatatctatgataaattctgaacatgaccacatctatattgcttataataaatggctaactttacatctgaatgttttgtggtcctttagaaagataacttacaaagtcactaattttaatttgaaaggtttggaattcgctggcgcattataagagaccctttccaatattttaaggatagaaaaaagctaaagggaaaaagaggctcaacaaggcctgctgtagcaacagaaacacacaacaccacacaaaaaagcacacacactaaaagggtttctttcttgttccacaaaggaagtttgattgttcttccttggagtttcagggtacatattttgtggttttcaacagagtaacaagtagaaacacttaatttgggaatgtgcatgggttttcactagtttttaaacataagtatgaggccagccatggtagttcacacctgtaatcccagctctttaggaggccatggtgggaggatagcttgaagccagaagtttgaagccagcctgggcaacatagtgagacccctgtttctacaaaataaaaaaattacccgggtgtggtggtgtacacctgtattcccaactactcaggaagctgaggtgggagtatcacttgatcctgggaggtggagactgcagtgagccgtgatcgtgccactgcactccagcctgggcaacagagcgagaccttgtttcaaaaaaaaaaaaaaggaaattaggtatgcacaagtgaaaagaatagcaaagtaaaatagttacagattttgaattgtatttagttgtagttaagcttttttaagactaggtaagttcagtagtgagaagtggggaaagagtagaataagcagttcaatctgtaactgagtgaataatcaattgtacttaagttttgaatctgtaatgtccagtggtgagcttgttcagtcagttgtacacatttcatcccaattccacattcacgtggctatggtgggagtatttacaccatggaaactggcacacactacacattagggctttctccaaccctgagagcagatttctaaacatttactactgcacccatgaatgtgcctatttaattttcacttttacagttaaataacagctttaggtttcattgaagataactagtgtagaatggtgaagagcagagataccagagccaaactatctgggtacaaataccatttcttcacttactagcttgtgttaccctaggcagttagtcaaacttatcattaatggggatagtagcaatgcctaccttatagggttgacgtgaggattaaatatgttaagggtctgttttatagataaatcttatctggcaacctcagaaatccagtgcatagccaggattcaggaaataaacaaaaacatcactgagccaccaatgtaaatgtcagacagagggtacttgccctgaagcccccaagctttctctagaagctaattttactctttctgtagaaccaagcttgattgtcttttctgagccaaagggatattagaagcatgacatcacacaaaaaaaaagagagagaggagagatgctgctagaagcaacaactgaagtgagaaccttcctccctcaaagaaaattatccaatgtgagaactcaaaaatgagtcagactgcttgattgctaagatctgttccatttccaaaaatttatgacaagagtgaaaaattgcaacagtttagaaacaaataatcttactactatgttaaataatggcatacaaagataatccactgtcaataataaatcataatcagtatctattagttaagaaaataggacagggagcaagatggccaaataaaacccaccagtgatcatcccctccataggaacaccaaattgaacaactccccacacaagaaagcatctttgtaagaatcaaaaatcaggtgagcagtaacagtgccttgttttaacatcatattaaggaaagaggcactggataggataggaaagatagtcattaatttcttacaccacccctccctcatcccctggtggtgcagcttggcacagagagaaaatctgtgtgtttaggggaaggagagcacagtgattgtgggactttgcatcagaactcagtgctaccctgtcacagaggaaaacaacatggggcataattgtgcccatacccatggagggagcatttagaccagccctagccggaggagaattgtccatccctctggcaagcctcaccactgtgagctaaagtgccctggggtcctaaataaatacgaaaggcagtctagaccaaaaggactgcaattttgaggcaagtcctggtggttctgtgctgggctcagaaccagaggacttgcggtgcatatggccaagaaagcgtttgcatcacccctcccccaactccaggcagtacagctcacagctctgggaggagaggaaagattaaagtggactttgtcttaacatttggataccagctcagccacagtaaaataaagcaccaagcagagtcctgaagcccacactccaggccctagatcctggatgacatttctagacacaccctgggccagaagggaacccaccaatttgaaggaaaggacccagttctggaaggattcatcacctgctgactacagagcccttggaccttgaataaacattattagtagctaagcagtactcaccatgagccttgggcaaggcttcaggtgtgacccagcacattcccagctgtagtggccaaggggagagactccttttctctgcttgaggaaaggagagtgaaaagtaaaaaggacttcaccttgcaatttgggtaccagttcagccacagtaaaataaagcaccgaatagattcctaaagttcctgactccagaccctacctcccagacagcatttctagacccaccctgggccagaagggacaccaccaccctgaagggaaagacacaagcctggctggattcaccacctgctgattaaagaacccttgggccttgaacaaacagcaatactcaccataagccttgggcaaaacccagaactatgctggtttctggtctaatgcagctcagtcccagcagtggtggccacaggggtgcttgcatcacctctcctccaactccaggcagcacagcatggtgagagagattccttttgtttgagagaaagtaagggaagagaacaacacattctgcctggtaatccagggaattctcctagatattacccaagaccaccaaaacagtacctctactagtctgcaagagccacagcgttactgggcttggggtgccccctaatgcatatatggctaaagtgaccaaaaacttagatcacaacactcaattccctttgaatgcttgaaaagcattctcaagaaggacaggtataaacaagcccagactgtgaatattataatacctatctcttcagtgcacaagcaccaagaaatatccacaagcatccagatcatccaggataacattacctcagaaaatgaaataaagaaggaaccagtgaccaatcccagagtaacagaggtatgtgaccttttagacagaattcaaaatagctgttctgaggaagctcagtgaaattccagataacacagagaaggaattcagaattctatcagataaattgaacaaagagattgaaatactttaaaaaaatcaagcataaattctggagctgaaaaatgcaattgatataccgaagaatgcatcagagtctttcaacagcagaactgatcaagcagaagaaaaaagtattgagcttgaagaggggctgtttgaaaatacacagtcagaggagacaaaaaaagaataaaatagaatgaagcacacctacaacatctagaaaatagcttcaaaagtacagatctaagagttatttgccttaaagaggtggtagagagatcgagatagaaagcatattcaaaggaataatattataacactgtagttgtggtgtgtgaactactcataccttgagtaggaagactaagagatgaacctatcaaaaataataactgcaagttttgaagacatagacagtataataagatatgaatagaaacaataaaaatgtaaaaagccatggaggggataaagttaaagtatagagtttcaattagttttctctttgtttgtttgtttgttttagcaatcactgttgtcatcagtttgaaataatgcaatataagatgttatctataacattcatggtagcctcaaatcaatgaacctagaacagatacaccaaaaaataaaaagcaagaaattaaaacataccaccagagacaatcaccttcacaaaaagaagacagagagggaacaaaggaagagatcacaaaacaaccagaaaacaaataataaaatgggaagggagtaagaacttatcaataataacattgaatttaaatagaataaacttttcaatcaaaaaacatagaatggctgaatgcattaaaaagccccaactagctgccatccttaagaaacacacttcacctataaggacacacatagactgaatataaaaggatggaaaaagatattccatgcaaatagaaaacaacaaagaggagtagctatacttatatcacacaatatagatttcaagacaaaaactataaaaagagataaagaaggtcattatataatgataagaggatcaattcagcaagaagatagaacaagtgtatatatgcacccaaagctggagcacccaggtgtataaagcaaatattatacaaactagaaggtgggatatagaccctgatataataatagctggagacttcaacaccctactttcagcattggacagatcatccggacagaaaatccacaaagaaatatcacacttaatgtgcagtagagaacaaatggacctaatagatatttacagaacatttcatccaacagctacagaagacacaattgtctctttggcacgtggatcattctcaaggataaaccatatgttaagtcataaaacaaataatttttttcttttttcttttttttcagacaagttctcactctgttgcccaggctggagtgtagtggcatgatttcggctcactgcagcctaaacctaccagacttgaagggaaccttccacctcagccttccaagtagctgggactacagtgggactacaggcacatgccaccacacctggcaatgttttctttctctttttttttttttttttttttttttttttttgtagcgacagggtctcaccatattgcccaagctgttctcaaactccttggctcaaatgatctgccaccttggcctcccaaagtgctgggattacaggtgtgagccagcatgcccagccaaaattttttttaaattgaaatatcaagcatcttctctaaccacaatggaataaaactaagtcaataataacagaaactttggaaactatacaaatacatggagataaacagtatgctcctgaatgaccagtgggttaatgtagaaattaagaagaaaattttaaaatttcttgaaacaagtggaaatgaaaacaaaatgtaacaaaacctatgagatatagcaaaaacagtactaataggaaagtttataaaaatgagtgcctacatcaaaaatgtagaaaaccttcaaattaacaacctaataatagaactagaaaagcaagagcaaaccaaatggaaaattagtagaagaaaagaattaataaagatcagagcagaaataaattgaaataaaaaaacacaaaacatcaatgacatgaaaagttgttttctttaaaaaataaataaaatcaacaaacctttagccagaataaagaaaaagagaaaacccaaatagataaagatgaaaaatgggacatacaaccaataccacagaaattcaaagaatccctggagactactgggagcagctatacgccaataaattggaaaacgttgaagaaatggataaattcctagacacacagaaccttccatgattggatcaggaagaaaaccaaaacctgaatagaccaataacaagtaatgagaagaaagccatgacaaatagtcccccagtaaagaaaaacctggaacccaatgacttcactgctgatttttgccaaacgtttaaagaagaactaatgccaaccctactgaaactattctgaaaaaacggagcaggaagaaatacttccagactcattctatgaggccagtattaccctgataccaaaaccagacaaagacatatcgaaaaaaaaaaggaaactactacaggcaagtctctctgatgaacatcaatgcaaaacctcaaccaaatattaacaaaccaaattcagcaacacattaatagggtaattgatcatgatcaagtgggatttatcctagggatgcaaggatagttatacataaatcaatcaatgtcctacatcctatcaacacaatgaaggacagaaagcatataattccaattgatgctgaaaatcatttgataaagttcaacatcctttcacgattaaaaaccctaaaaaagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtgcaaaaatcacaagcattcttaatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaagaaataaaagaggatacaaacaaatggaagaacattccatactcatgggtaggaagaatcaatatcttgaaaatggccatactgcccaaggtaatttacagattcaatgccatccccatcaagctaccaatgcctttcttcacagaattggaaaaaactactttaaagttcatatggaatcaaaaaagagcccgcatcaccaagtcaatcctaaaccaaaagaacaaagcgggaggcatcacactacctgacttcaaactatactacaaggctacagtaaccaaaacagcatggtactggtaccaaaacagagatatagatcaatggaacagaacagagccctcagaaataatgctgcatacctacaactatctgatctttgacaaacctgacaaaaacaagcaatggggaaaggattccctatttaataaatggtgctgggaaaactggctagccatatgtagaaagctgaaaccggatcccttccttacaccttatacaaaaatcaattcaagatggattaaagatttaaacgttagacctaaaaccataaaaaccctagaagaaaacctaggcattaccattcaggacataggcatgggaaaggacttcatgtccaaaacaccaaaagcaatggcaacaaaagaaaaaattgacaaatgggatctaattaaaataaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccactatgagataccatctcacaccagttagaatggcaatcattaaaaagtcaggaaacaacaggtgctggagaggatgtggagaaacaggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgtggcattattcacaatagcaaagacttggaaccaccccaaatgtccaacaatgatagactggattaagaaaatgtggcacatatacaccatggaatactatgcagccataaaaaatgatgagttcacgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctagggactgtggtggggtggggggaggggggagggatagcattgggagatatacctaatgctagatgacgagttagtgggtgcagcgcaccagcacggcacatgtatacatatgtaactaacctgcacaatgtgcacatgtaccctaaaacttaaagtataataaaaaaataaatttaaaaaaaaccctaaaaaatctgtgtatgcaaggaacatacctcattgcaataaaagctatatgtgacagatccacagctcagtatcatattgaatagggaaaaactgaaagcctttcctttaatacctggaacaggacagatatatccacttttaccactgttatgcaacgtagtactggaggtcctagctagagacatcagacaagagaaagaagggcaacaaaattggaaaggaaaaagtcaaattatccttgtttgcagataatatgatcttatagtttgaaaaacctaaaggccccacaacaaactattagaactgataaattcagtaaagctgcagaatgcaaaatcaacatatataaatcagtagtatttctagatgccaatggcacacaatctgaaaaagaaatcaagtaagtattcccatttacaataacaacaaataaaataaagtactaggaggaaacctaaccaaagaagagagctctacaatgaaaactgtaaaacaatgatataagaaattgaagatggcacaaaaagatggaaagatattccatgttcatggattggaagtttcaattttattaaaaggttcatactacccaatgcaatctacagatttaatgcaatccctattaagatataataccaatgacatcattcacataaatagaaaaaataattatagaatttatatgaaaccacagaagacccagaatagccaaagccatcctgagcaaaaagaacaaaactagaggaaacatattacctgactttaaattatactacacagttatagtaaccaaagaagcatggtactggcataaatacagacatatagaccaaagaaaaataatagagaattcagaaataaatctatacattcacagtgagcttattttcaacaaagtgccaagaacatacattggggaaaagataggctctccgattaatgctgctggcaaaactgcatatccatgtgcagaagaatgaaactagacccgtatctcctgccatatacaaaaatcaaatcaaaatggaatgaagacttaaatctaagacctcaaaatatgaaactactaaaagaaaacactggggaaactctccaggacattggactgagcacagattacctgagcaataccccaccacaagtacaggtaaccaaagcaaacatgaagaaaggagatcacatcaagctaaaaagcttctaccagcaaagaaaacaatcagcaagtagaagagactacccatagaatgggagaaaatatttgcaaactattcatctgacaagggattaataaccagaatacttaaggagctgaaatcactaaataggaaaatatctaataatccgattaaaaatggacaaaagatctgaatagacatttctcaaaagaagacatacaaaaggcaaacaggtatatgaaaagatgctcaacataattgatcatcagaaatgcaaataaaaactacaatgagatattatctcatcccagttaaaatggcttttattcaaaagtcaggcaataatgaatgctggcgaggatgtagaggaaagggaacccttgtacactgttggttggaatgtaaattactacagccactatgtagaacaatatggaggttcctcagaaaactaaaaatagaattaccgtataatccagcaatcccactgctaggtatatacccaaaagaaaggaaatcaggatatcaaagagatgtctacacccccgtgtttattgcagcactattctacaataaccatgatttggaagcaacctaagtgtccatcaagagacaaatggataaagaaaatgtggtacttacacacaatggagtactattcagccataaagaaaaatgagttcctgtcatttgcaacaacacatatggaactggagaattattatgttaagtgaaataagccaggcacagaaagacaaactttgcatgttttccactcatttatgagagctaaaattttaaacagttggagatagatatcagaaggatggttaccagaggctgggaagggtagaggtgggtagaaagaaattggggattattactgggcacaaaaatatagttagatagaatgagtaagacctagcattttatagcacaaaagggtgactgtagtcaacaataacttaatgtacattttaaaataactaaaagcataactggaatgtttgtaacacaaagaaaataaaaatgcttgaagtgatggataccccatttaccctgatgtgattattacagattgtatgtctgtatcaaaatatctcatgtaacctagaaatatatacacctgacatgcacccataaaaactaaaaattttataaaaagaataaaaaatttaggaaaatatagattactttttcgagtgttcattcaaaattgttaaaactaagtatttgtgtaaaaccttttgttacctataaattttacttttatggaacatctaattcctaaaaatagcagataaaggcattactgtcattaagagactgttaactcaaacaattaaatagcaaaacaacaaataatctgattttacaatgggcaaaagacctgaatagacagttctcaaaagaagcatacaaatagccaacagttacatgaaaaaatattcaacgtcaccaatcatcaggaaaatgcaaatcaaaactgcaatgtgatatcacttcactccagttaggatggctattataaaagagacaaaaaacaaacaaatactggcaaggatgtggagaaaagggaactcttatatacttactgttggtgggaatgtaaattagtccagccatattggaaaacagtatggagagtttttaaaaatgttagaaatacaattaccatataatctggcaattcaattactgggtatctatccaaaggaatggaagtcagtttgtccaagagatatctgccctcccatgtttattttagcactattcacaacagcaaagatatggaatcaagctaagtatccatcaatggatgaatggatatagaaaaagtcacacgtgtatacaatggaatactattcagcatttaaaaagcagcaaatcgtgtcatttgcagcagtgtggatgaacctggaggaaattaagtgccaaaagcaattgcaacaaaagcaaaaacaaaaacaaaagttggcaaatgcaacctaattaaattaaaaagcttttgcatagcaaaagaaactatcaacagagtaaacagacaacctacagaatgggagaaaatatttgcaaactatgcatccaacaaaggtctgatatccgaaatctttaaggaacttaaattaacaagcaaaaatccaacaaccccattaaaaactggacaaagaacatgaatagacacttttcaaaagaagacatacatgcagccaacaaatgaaacatatgaaaaattactgaacatcactaatcagattactagagaaataccaatccaaatcacaatgcaataccatctcccaccagtcagtatggctattattaaaaagtcaaaaaataacagatgttaacaaggttttagagaaaagggagcgcttatacactgctcgtgggaatgtaaattagttcagccattgtggaaagcagtttgctgatttctcaaaaaactcaaagcagaattgcaatttgacacagcaatcccattattgggtatatacccaaaggaatataaatcattctaccataaagacacatgcacatgtatgttcatcacagcactatttacaatagcaaagtcatggaatccacctaaatgcccatcaatggtggactgaataaagaaaatgtggtgcaaatacaccatggaatattatacagccataaaaaaagaatgagatcatgtatgatctcatgagtactcagatacagccacataggactattgtcattcacttttcttaactgttcattctgatctttctgcctaaaatacccatatttgctctgacactccctgtcctctgcttatctatgtattacttaagtcccagctcaaatgatgcttctatacaggttccccaagctccaagtgagagaataaatgtttcctctttggtcccctgtcacttggtttctaacctctatctagtatttcattttactttgcatctcaattggcatgcctctctaaattaagaacttttttattttgggcagacactgtctttttttttttaaagacccttaatttaaaaatttataattgacacataattgtatatatttatggggtacaatgtgattgtaaatgtaagtatactatgtagtataatgatcaaatgggggcaattaccatatccatcacatggaacatttttcatttgtttgtggtaacatcattcaaaatcttttcttctagttatcttaaaacatacactacattgctgtttgctatagtcaccctactgtgtaaaaaaacaccaaacttattcttcctgcctaactgtaagtttgtacacattggccaacctctctccatccttccctaccctgtaccctccccagcccctggtaatcactattccattctccacttttgatttttttttttttttgagatggagttttgctcttgttgcccaggctggagtgcagtggcaccatctcagctcaccacaacctctgcctcgggttcaagcgattctcctgcctcagcctcccgagtagctgggattacaggcatgcactgccacgcctggctaattttgtacttttagtagagacagggtttttccatgttggtcaagctggtcttgaactcctgacctcaggtgatccgccccccatcggcctcccaaagtgctgggattacaggtgtgagccaccaagcccagtcttgaaattttttaaacttttattttaggctcaaggacacatgtgttggtttgttgtataggcaaattgtgtgtcacaggggtttgtgtacagattatgttctttgcagcaacatggatggagctggaggccattatcctgagtgaacaaacacagcaacagaaaaccaaataccacatgttcttatgtataagtgggagctaaactttgagtacacatggacacaaagaagggaacaacggacaccggggcctacttgagggtggaggaagggaggaggatgaatacctattgggcactatgcttattacatggatgatgaaataatctgtacacaaacccctgtgacacacagtttgcctatataacataccaacacatgtgcaagatcagttgagatcagatcatatatggctttacatgttaggctaaggagtcagattgtaatgagtaattaggagccactaaagactcctgggcagaaaaagaggcatgattcaaccatgttatggcaaaagtcaagcagaaaggtcaactctaatgaaactttaagggagggactggatataggatgaccagctaggaggttactgtaatagtttcagtaccctatttcaaagaaattatgagggtctatattaagacagcagaaatagaaagatctgataatggagacaccaagaaagtaaatagcatctccatgactgactaggtgagcagtgaggattcaaacatgattctgaggttactaaactaggtgaccagaggggttgttacactgttaactgcaattgagaacagtggagggggagcagtttacagatattttcaagtgcatgggaagtatcaaaatgcttagaaataggtcttttacatgattaggaagccaattcagggttttttgttttcgttgagacggagtctcgctctgtcgtccaggctggagtgcactggcacgatcttggctcactgcaagctccgcctcccgggttcacgccattctcctgcctcagcctcccgagtagctgggactacaggcgcccgccaccacgcccggctaattttttgtatttttagtagagatggggtttcaccgtgttagccaggatggtctcgatctcctgatctcatgatccgcccgcctcctcggcctcccaaagtgctggaattaaaggcgtgggccaccacgcccggccaattcaggttttttaatagttggactgtatatagcacgtatgaatatagattgtgaggactgaagcacagcattgttgctaagatgtatacaatgtacatttcttgcctatccttgttttttggtttggtttggtttggtttggtttggtttggtttttgtttttgttttttgagatggagtctcgctctgtcgcccaggctggagtgcagtggcacgatatcagctcactgcaagctccacctcccgggttcacgccattctcctgcctcagcctccccagtagctggggctacaggtgcccgccaccacgcccgactaatttttttttgtatttttagaagagacggggtttcaccatgttagccaggatagtcttgatctcctgacctcgtgatccacccacctcagcctcccaaagtgctggaattacaggcgtgagccaccacgcccggccttgttttgtttttcaaccttcatctgaccacaatggcccatgtgttcctgagtatccacccctgccacctaccccatatgttctaaaagaacaaaacatttctattagttaaaaacttatggccaggtgcagtggctgacgcctctaatccctgcactttgggaggccaaggtgggtggatcacctgaggttaggggtttgaaaccagcctggccaacatggtgaaaccccgtctctactaaaaacacaaaaattagctgggtgtggtggcatgcacctgtaatgccagctactcgggaggctgaagcaggagaatcacttgaacccaggaggcagaggttgcagtgagccaagattgcaccactgcactccactctgggtaaggagcgaaactccgtctcaaaaaaaacaaaacaacaacaacaacaacaaaaaccaacttattagcagtacacatctgtgattcaaaagaaatatttaaaaatatattccaaagcctaacttttagaattctctatgctttcaaagattatacagtttataatatcggaaatgaatgctacattatataattaatcacaactttattactatacattttcctgagagatggctcttagagaaaagacaaataatgtctgtgattttagtgccatagctaaaaatttaaagcccctaaataaatagaaaaaaagggccactgtttggtaaaattatctccagatccataagggatatttgggtcatatactgatattggaagaaaatataacagagggtctctacatttcagactccttcactccccattgtttttgagattttccttttgtaaatgagaacaaggtgagtcattaatctctatcaaactgaatgatcacacatgactcagtagagttttaaaaagggcttaactaaatggctatcatgtaaaaatagtgtcttttggaatgttaaggatctataataaaatgctttgaataaaatgtttaaattaataacttcaaataaagagagaatcttagcatactatgagatatttctttttggccccatcttttgaaaactttggctactgaggaccataaatttaagggattgcttgattaacaattttactgtgtacattgccatttaaggtttatacccttaatttgaaaattaaaactgtgaatactattttaatattttactgagaaatggcttttagagaaaagacaaataatgtctgtgattttagtgccatagctaaaaacttaatgtccccaaataaatagaaaaaaggggcactctctggcaaaattacctccagacccataagggatatttggataatacactcatattggaagaagatacaacagagggtgtctacatttcagacattcagtatttttgtatttaaattctagtctaaaagtcctttcattttatttttattttatattttgttggtttttttattattatactttaagttctaggctacatgtgcacaacatgcaggtttgtcacatatgtttacatgtgccatgttggtgtgctgcacccattaactaactcgtcatttatattaggtttatctcctaatgctatcccccccagccccccaccccacgacaggctccagtgtgtgatgttccccaccctgtgtccaagtgttctcattgttcaattcccacctatgagtgagaacatgcggtgtttggttttctgtcttggtgatagtttgctcagaatgatggtttctagcttcatccatgtccctacaaagacatgaactcatctttttatggctgcatagtattccatggtatatatgtgccaaattttcttaatccagtctattattgaaggacatttgggttggttccaagtctatgctattgtgaatagtgccgaaataaacatacgtgtgcatgtgtctttatagcagcatgatttataatcctttgggtatatgcccagtaatgggatggctagatcaaatggtatttctagttctagatccttgaggaatcgccacactgtcttccacaatggttgaactagtttacactcccaccaacagttaaaggagttcctatttctccacatcctctccagtacctgttgtttcctgactttttaatgatcaccattctaagtcgtgtgagatggtatctcattgtagtttggtttgcatttctctgatggtcagtgatgatgaacattttttcatgtgtcttttggctgcataaatgtcttcttttgagaagtgtctgttcatatcctttgcccactttttgatagggttgtttgattttttcttgtaaatttgttcaagttcattgtagattctggatattagccctttgtcagatgggtaaattgtaaaacttttctcccattctgtaggttgcctgttcactctgacggtagtttcttttgctgtgcagaagctctttagtttaattagatcccatttgtcaattttggcttttgttgccattgcttttggtgttttggtcatgaagtccttgcccatgcctatggcctgaatggtatttgcctaggttttcttctaggatttttatggttttaggtctaatatttaggtctttaatccatcttgagttaatttttgtataaggtgtaaggaagggatccagtttcagctttctatatatggctagccagttttcccagcaccatttattaaatagggaatcctttccccatttcttgtttttgtcaggtttgtcaaagatcggatggttgtagatgtgtggtattatttctgagggctctattctgttccattgatctatatctctgttttggtaccagtaccatgctattttggttactgtagccttgtagtatagtttgaagtcaggtagggtgatgcctccagctttgttcttttgacttaggattgtcttggcgatgcgggctctttgggttccatatgaactttaaagtagttttttccaattctatgaagaaagtcattggcagcttgatggggatggcattgaatctataaattaccttgggcagaatggccattttcacaatattgattcttcctatccatgaacacggaatgttcttccatttgtttgtgtcctcttttatttcgttgagcagtggtttgtagttctccttgaggaggtccttcacatcctttttaagttagattcctaggtattttattctctttgaagcaattgtgaatgggagttcgctcgtgatttggctttctgtttgtctgttattggtgtataagaatgcttgtgatttttgcacattgattttgtatcctgagactttgctgaagttgcttatcagcctgaggagaatttgggctgagacgatggggttttctagatatataatcatgtcatctgcaaatagggacaatttgacttcctcttttcctaattgaatactctttatttccttctcttgcctgattgccctggctagaacttccaacactatgttgaataggagtggtgagaaagggcatccctgtcttgtgccagttttcaaagggaatgcttccagtttttgcccattctgtataatattggctgtgggtttgtcatagatagctcttattattttgagatacgtcccatcaatacctagtttattgagagtttttagcatgaagcgctgttgaattttgtcaaaggccttttctgcatctactgagataatcatgtggtttttatctttggttctgtttatatgatggattacatttattgatttgcttatgttgaaccagccttgcatcccagggatgaagccaacttgattgtggtggataagctttttgatgtgctgctggattcggcttgccagtatcttattgaggatttttgcatcattgttcatcagggattttcgtctaaaattttctttttttattttctctctgccaggctttggtatcaggatgatgctggcctcataaaatgagttaggaaggattccctctttttctattgattggaatagtttcagaaggaatggtaccagcttctctttgtacctctggtagacctcggctgtgaatccatctggtcctggactttttttggttggtaggctattatttattgccacaatttcagaggctgttattggtctattcagagattcaacttcttcctggtttagtcttgggagggtgtatgtgtcgaggaatttatccatttcttctagattttctagtttatttgcgtagaggggtttatagtattctctgatggtagtttgtatttctgtgggattggtggtgatatcccctttatcattttttattgcatccatttgattcttctctcttttcttctttatttgtcttgctagtggtctatcaattttgttgatcttttcaaaaaaccagctcctggattcattgattttttgaagggttttttgtgtctctatctccttctcttctgctctgatcttagttatttcttgccttctgccagcttttgaatgtgtttgctcttgcctctctagttcttttaattgtgatattagggtgtcaattttagatctttcctgctttctcttgtgggcatttagtgctgtaaattttcctctatacactgctttgaatgtgtcccagagattctggtatgttgtgtctttgttctcattggtttcaaagaacatctttatttctgccttcattttgttatgtacccattagtcattcaggagcaggttgttcagtttccatgtggttgtgtggttttgagtgagtttcttaatcctgagttctagtttcattgcactgtgatctgagacagtttgttataatttctgttcttttacatttgctgaggagtgttttacttccaactatgtcgtccattttggaatatgtgttatgtggtgctgagaagaatgtatattctgttgatttggggtggagagttctgtagatgtctattaggtctgcttggtgcagcgctaagttcagttcctggatatccttgttaacttactgtctcgttgatctgtctaatgttgacagtggggttttaaagtctcccattattattgtgtgcgtgtctaagtctctttgtaggtctctaaggacttgctttataaatctgggtgctcctgtattgggtgcatatatatttaggatagtcagctcttcttgttgaattgatccctttgccattatgtaatgaccttctttgtctcttttgatctttgttggtttaaagtctgtttgatcagagactaggattgctacacctgctttgttttttttttttttttttgctttccatttgcttggtatatcttcctccatccctttattttgagcctatgtgtgtctctgcatgtgagatgggtctcctgaatacagcacactgatgggtcttgattctttatccaatttgccagtctgtgtctttttcttttcagtctatgtcttttaattggagcatttagcccatttacatttaaagttaatattattatgtgtgaatttgatcctgtcattatgatgttagctggttattttgctcgttagttgatgcattttcttcctagcatcgatggtctttacaatttcgcatgcttttgcagtggctggtaccagttgttcctttccatgtttagtgcttccttcaggagctcttgtaaggcaggcctggtggtgacaaaatctctcagcatttgtttgtctgtaaagaattttatttctccttcacttttgaagcttagtttggctggatatgaaattgtgggttgaaaattctttaagaatgttgaatattggccccgactctcttctgatttgtagagtttctgccgagagatccgctgttagtctgatgggcttccctttgtgggtaacccgacctttctctctggctgcccttaacattttttccttcttttcaactttggtgaatctgacaattatgtgtcttggagttgctcttctcaaggagtatctttgtggcattctctgtacttcctgaatttgaatgttggcctgccttgctagattggggaagttctcctggataatctcctgaagagtattttccgacgtggttccattctccccgtcactttcaggtacaccaatcagacgtagatttggtcttttcacatggtcccatatttcttggaggctttgttcatttctttttactcttttttttcctctaaacttctcttcttgcttcatttcattcatttgatcttcaatcactgataccctttcttccacttgatcaaatcggctactgaagcttgtgcatgcaccacgtagtcctcatgccatggttttcagctccatccggtcatttaaggacttctctacactgtttattctagttagccattcgtctaatcttttttcaaggtttttacttctttgcgatgggttcgaacatcctcctttagttcagagaagtttgttattaccgatcatctgaagccttcttctctcaacccatcaaagtcattttccatccagctttgttctgttgctggcgaggagctgcattcctttggaggagaagaggcgctctgatttttagaattttcagcttttctgctctggtttctccccatttttgtggttttatctacctctggtctttgatgatggtgacgtactgacagggttttggtgtggatgtcctttctgtttattagttttccttctaacagtcaggaccctcagctgcaggtctgttggagtttgctggaggtctactccagaccctgtttgcctgggtatcaccagcggaggctgcagaacagcaaatattgcagaacagcagatgtggctgcctgatccttcctctggaagcttcgtctcagaggggcaccccactgtatgaggtgtcagtcggccccttctgggaagtgtctcctagttaggctactgaggggtcagggacccacttgaggaggcagtctgtccgttctcagatctcaaactccgtgctgggagaaccactactcttcaaagctgtcagacagggatgtttaagtctgcagaagtttctgctgccttttgttcacctatgccctacccccagaggtggagtctacagagtcaggcaggcctccttgagctgtggtgggctccacccagtttgagcttgcccgccactttgtttacctactcaagcctcagcaatggcgtacgcccctcccccagccccactgctgccttgcagtttgatctcagactgctgtgttagcagtgagcgaggctccatgggcatgggaccctctgagccaggcgcgggttataatctcctggtgtgccatttgctaaggctgttggaaaagtgcagtattagagtgggagtgtcccgattttccaggtacggtctgtcacggcttccctttgctaggaaagggaattccctgaccccttgcacttcctgggtgaggcgatggcctgccctgctccgtgggctgtacccacttgtctggcaagccccagtgagatgaacccagtacctcagttggaaatgcagaaatcacccgtcttctgcatcactcacactgggagctacagactggagctgttcctattcggccatcttggaacctcctctaaaagtccttttagagttgcatgtgtgtatttgtatttattccagattggagttggatcattaacccagattagcaccttaacttaatatcagtgggaggtttctctagttggttataccttaacattcaataagtgctcttcttttgcttaagattattggtctcaggtcatataaactagagggaatataaaccttgataagcattggaatggcatgagcaatctgacattcttttaacattgggaaagataatgtttgtactttatttttttccacaaaacttatataattggtggtagagaggtaagtattttagataattagacctttagtaataagattagtcttagtttaggcttgtctttaataggtagtgaatagaaatgtgcatttctatatgttatcttcattgctaacctgatcacgtctgtgtaaaaccttagaacaccttgagcaaattttatattgcttttgaggatatagaaaaatggtacatcatggacatatgtagtttgtacatttgggtttgtaaacattgtttggctcaaattactatcccaatatgtaaatccttatacatgctagtagtgagctcttgagataatttatcatcttataaattgggaaatatttctgtattccccaaatcttagattccttatcatataagccctattttctacaatttgggggactatttgtctttaagcaagccttcatataagatgcaaattgggtctcaaaggcaatactgttgaattatagatagttaatctgaggagggggaggtgtttgttgtatataatagcttccttactaagttatgagttccctaaaatcggtaaccaaatctcatgcgtgtttatataacctacaactttcatatagatagtaggtgctcaaaaatgttaattgaatgaatgggtatccttcctttgtctcattgagacccatttaaaatcattttagcaattgggttattatactaagaatgtttcaccaaactaaaactgaatttgttttattttacaggtgcagtagacattgttgcaatcatgatcggcaatctgaaaggcacaaaaattctgcaatctattcaaagaggcatacaagtgacaatggtcatagaagtagggaaaaaacatggcccttgggtgaatcactattcaatttttttcgtttctgtgtccttttttattattacggcggcaactgtgggctattttatcttttattctgctcgaaggctacggaatgcaagagctcaaagcaggaagcaggtttgtaatggtcctttcttccactattaaaaaaaatttactgttctaattgtagtttcagggtcctgcattttaatacattgtacttgctagacaatgatctccccatatgttttacaaaatctggtagtttttaaaagtatgtcagctcttctcaaaggtttattttctatatttgtcaaagaacttaatcctacctgattaaattttctaacacctcattagagaacacatccagcatttaattacatataggtgtaaatacatatgttcttttaaataaacatttttttctaaattacaaaaacatttcatactcaatatagaaaacttagaaattagaaagtacacgggaaaaaaactcacctaaaacctgatatagcaatataactatagtcatcgcccaaaggtaaccactattattttatatgtacgtctgtatttgcatgtggggatggggctgagaagagggactaggctgagaaggcagggtagaagatctgattgtgcatgatatattgttaggcttcaagtggagtcaaatattaatagtttctaccatattataacagtgtataaaaaggtacaaggtacacaaacaacagagcaaaaataccaaagcattactgaacagtaaagtacctatggttgtatggcattgttcctgccaccattaaattgtccccctcagccccctgatatgctcacatttctccttacccagcttaaattccatggttactcccatgcatacatcttcagttcccgtggcccttctttctctttgttatagttgctggaaaaacaaatccaaccctggttaaatttacttcccacctactctatgtcttcaccttgcacaactgaagtatcagaaaggcatttacagctgtactgactgatctcactttaaatttgtgaccgtaaaatcagagtgggcccttaatgctacccaggaatcacactatgttttcttggccatttactctcctactgttggataaccatatgtgttcctttccctttctccaacacctcctccaactttactctcaatttgtattttattttactgagaaaattgaagcaatcaataatacttccacatcttctcatctatcttcatctgcgtctatcctattcccctgctttgtcttctgtttttatggatgaactgttcctttgcaaaggctaactctttcactcaggtataagattatttttgtcttttgtatactcaaggacatcactccagaaattttcctctctcactctcctactttaacaatttctccctctcctcctcatcttttccaccaacatgcaaacatagtattattgctcccattttcaaaagattttctcttggccccaggccaaaaaccttgaagttgttctttattcctttttttctgtcacctcccatgtaaactatcagcaaatcctattatttctaccttcattatatatccagaatttgattatttcttattaccttcattgcttctgccccagtcaaagccaccataatttcttacctcctcctcccttcaggtattctcagtataacagcggaatggtgtgccacttctttagaaagctcagtagggatttaatgctttcagatgaaaatacatttttatatgtactgagcagtttctctaaaggcgatcgatttctggtcacttcatgtactcttcctccaataagtgaaaaggaactcaatttatttagggggcggaaggagcagtgaggatttttatatagcaagaaagttaatttaatttaggaatagatgagaaattgaaattttattataaaaacttcataaagattagataccagcatatggtaataagtgatggttatctcagtgtttaaagttaattggcttctatccttctccttagagaagcagcttatcacattggtggcaggttcagcctgatactagctgcagtcaaaaagatgtttaaaattcctgtaccaggccactcagtagtttcacactgtgttaatatttgacatttgtatattgtgcggttttttatctgcgaggctggaaggaaattggtgtccagtgtgactaactattcaaaggttatagttacaatgacaagagtgtttggtttgcatatgttcatggtggggtatgtgtttcagtattctcagtgctataataaatttattgacatggcattaaaccccatcagaaaataataaggtttataaagaactttgtctggtgttacagagcttcattggacatttagctctggtctacgcatttaattttcatagtttataatacatcttatgataattaacctctgtagaaatggtcaagaatagcattaaaacttctcatctatttggagaaggcttttgaaggggcttttaaaaattacttaatggactatatctgtttatcctttgaggactaaaagattaaatatatggctgataatcctttttgcttataaatatttgagagtgctagaatgtcatttatatatttaattttcatgacagtattaatttttaaaaggtagagcttaatgcatatgctgattataattatcactaaacatttaactatattatctccattttactggtagaaatgatgatgaagctgagttatggaaatttggcttcattagaatgttaggcaaatttaatatattcaagaatttcttccttctgaaggttatgatacatggtatataatgtcaggaaactgataactgtaaccataaattctgatgactgaatgctcagatgagcccccagacagaatagcctcatatgttgtagtgtgatgtgtaagaacacatatcatccctgttttttagatacaaagcttttaaacagaacaaaaaagtatcaatggattataaatgaaaataacatattaggccttataagttagtttcatgtcccttccgggaacaaccctaacttgagacaagaaagattatgggaaaccttatggcatacacaaattaaactacattcaggagtgaccactatacacttgactctagcatggagtaccaaacattttcgggtaccgtaaatgtatcctaactgtattcaagcagttaatactcaatagccacaatgcatgtgttggattaaacattggcaagtgaaacaaaagagggctgtaggtgaaataggagctggcctagatataatgtgaaaagctgaatttacttttaatgaagagtggctttcagaagaaaaggatttactaactaaaatagacagattagaaggaaatcatcttccaagaggagggaaaagaatgggaatccacttgcaaaggtcataaagctttgataaactgatcacacagacccaacacataatgctagagaatgctaggaatcaatattgggaaagagaatatactctaacacaacagaatctattaactattttacttaaaagtgatccccaagtagccatgggggtaatgaccttccatttttagctgtagaagctcaggcagagaatctttgagacacatgcagatcctcaaatttatggaatttttttttgtaaaattgcaacttgcactgctgatctctgactgatctggaccaaaggatgggccaaaataaggctagtaggaatagaactaatactgaatgatacccatgtactcccatgggagggaaatggccttgctgtacaaagttaacaggaacctataacttgataataatataagttgagacaaatgattggctttgtccccagctaacatggaacctagaaatgacagaatgattgcaactggtgacagcatttgttcctcatcatatctggcatatgggcaaaggctaattcttctaggaaggtttaataaatatttctgtgacatttccggattttttttgtaaccaaaccaaactgtatcataaccatgctctgatatggtgtaatactggtattgttagtaaaattcaactatcttatataaataaatcatatggtaatcaaatatatttgagacattgaactaaaaactcctcacagtgtgataccaagggagagtgactggcatgaagaagaagtagaatgatttagttcattactatattaaattgctctgtgcaagtctatcacaaagttcaagtggccatagatcaagggaataaatggataattaaattggtataataatgtaaagatgtttgtgatggtcttataaactggatgaattgttcctttgaacctgtttccactccttgttggcttctgcaagtattagatagacttgtgttgttcttatggcaccttatataaaaatactgtgctaactgaacagtatatacagttgacccttaaacaacttgggtttcaaccacacgaatccacttttacacggatattcttccacttctgccacaccggaggcagcaaggccaatatatccttttcctcctccccagtctagtgaatgtgaagaaagaaggatggaggccttcatgataatccacggcctcttaattaagataaaatttattttctctcacacctgtcgtaccagcactttgggaggccgaggcgggtggatcgcttgagcccaggagttccagaccaacctgtgcaacatggcaaaaccctgtccctgcaaataatagaaaaattagccaggcatggtggcatgtgcctgtagtcccagctacttgggaggctgaggtgggagaatcacttgagcccgggaggcagaggttgcagtgagccgagatcatgccactgctctccagcctgggtgacagtgagaccctgtctttaaatatatattcttttcttccttatgattttcttaataacattttcttttctctaatttactttattgtacaaacacagtatataatttatataacatacaacataggtgtttattaactgtttatgttatcagtaaggcttccagtcaacagtagactattagtagttaagttttgggggtgtcaaaagctatatgtggagtcttggctgtgtgagggtcagtgcctataactgccatgttgttcaagggtcaactgtatactgtatgtagtacactgtttataaatattatgctaactgtatagtaactatactgactactgtaccaactgaagtgataatatataaatactgtacaaacagttactgtactgaaagttttattataaaaaggctttgaccaacaggatggattgtgaggaaaaaggtaacacaacagatgcagttgcttactccttccatgtccccaagggaaccatgattggcccctggccaaccctgggaatgtggctctcaaactggtctttatgttagtgattgataattttgttatatacacctggaaaaatggaccatgttgtaccagcctgtcagagttgcttttcacaacaatcaagattgatgatatcctagtttcattgttggggtcctcagtttccggcaacatggccagttgctagcaggatgcacctagtaagcagtcccttcatctgagtcttggaccccaacacttaaattggttccctgggcagagatatgccacacatttctgtagtttgctgccagacagaaagagcactcctgtgtgctctcagatgaggaaggactaggctacattaatattttaaaatctgtccttcaacttaaagcattactaaaaattatctaaactatttctggttacattaagtttttttctactccactagtacacgaaattatctggaagattcattaagtacctgcacactgtaccactattaacatatatacatttgcagttggtgtgttcacatgtatgtatctatttctgcctacatttgagagtagttcagggtcttttacagaaaccatgagaattttgactcttgtataagaagaacagattaaatccttgtctaagtaagacttagttttacaatatttcttctgactttctcactgaacaaaagaaagctcttataatgggtctcaggatttttatatattcacttactctaattttaaatttataccactaattctttttccagctttattgaagtatgattgacaaataaaatttgtatatattcaaggtgtacaacattatgatttgatatacatataaattgtaaaatgattgacataaattaatacatctatccctacacagttacgtgtgtgtgtgtgtgtgtgtgtgtgtgtgtgtgtgtgtgtgttgaggatacttaagatctactttcttagcaaatttcaagtaaaccatgctgtaaataagatcctcaggatttattcatctaaaaaatttgaactcatagatgcagagaacagagaagtggttgccagggggattggggaaatggggagatgttagtcaaacgatacaaacttgcagttataccacaaattctaaagggtgttaatcacatttctttgaaaaaaatgctgtaatctgagctataacctatctactgagtcaaattcaccctttcttcactgttcttccttatagtgtatttccttacactgctcacagttatgttcttcatgagagtggtctgcactcttgtttatcccctcatctgtagttccatagatttataggaagctgttttatagcctgcacctcctcttacctgtaggaatattttcactcaaatattgtggataggtttttattgaataaaatggatttctttcagttctcagatacctaaacagctacatggctcagacttttattttgtcctaggaatatatctgaggaaaagaatcctcttactataattcttgattttaaatatcttgtgttaaaactcttagccaaatttttaggaaaatgtttatttttaaaatatggtgacttaagtacagaaaaatctagtttgcttatatctctctcctttcttgctttttgcacaccctgtcctccatcaagtaattaggtttgactacatacttaatactattcatgtgggtttcagttaagctaaaagctgaacgccctgggaccaaaaatcaggctgaaaaatcaccagactgaaacatatactttacctaattggatataaagacaccagtgaactaggtagaatatctttgctttcaccataatttcaaaattgaacattgtaataaagaatgatcattggtttgacattttatcatcaaccccaatatattcccattcagaatcaagaaaaaaaaccatgtagtggagattcttcactaactagagcgaatgcagcttttgattagtcagaatagtcacattaagcttctgttaagaaaattggccaacaaccagcttctttgaatcagtcttcagttctactgccaaatattcttagaccaggtatctcttaggattagagaggaggaggggaaaggcaaaaggcgtttgacatcatatacttgctttttaaaattccccaaatcacagtaaatagccagtttgggaagaattttaagattggataattgctggctttaaaggggtttttaaatttccttcgtttgtcttcttcacaagaaatgtgaagcctcttaaaggcttctttgccattacacaatggaggcagtgtacaatagtggagagatcatgggctttaaagccagatagaacctgggcttgaattgaatcacagctctgaagcttaccagctgtctggactttagtcaagcttctgaaccttacttttcttgtctataaaacttggatattaaaatagctatttcacaatgttgttaatgattaaacaagatgacacatgtaaaaagcttacaacctgacacatggtaaaggttcaattaatttgtaaacctttctttccccaaacttaatggagtagagacttttaataattgaaatgagaagtgtcttgcatgagaaaatcaagaaagtctgtttatattttctaaattcagaaaataatttttgagcaaactctagccactggggaatttttttctaagtgactaaggcccagtcctccagctactcaagagagaaaggcacattaataatacaattactgaacaagataagaggtggaaataatgtgttactggaatttatagactaaggaaattctgatctggtagcaaggcattggaaaagtatctcatgtaatttgtataatgtagatatgttcttgaaattctgttttttaaggagtaaggtacaaattacagttcacatggggcatattgtctttaaatgttgaggtatatttgggcactgtaaagttgacataatgttgttcaaacacgtgttgaatataatctactgggccctaatggtgttctcatatttcagtttttttaagagggaggcttgcatcttggaactcttgctatcagtgtcacagtgaaatatcttgagtactatcttgaatatcgtgaggcagtttttttgtgagtgactttcctttaagctctaaaaatagtttgtgctttttattaaatcacttgtcttgcatccatatttaaagaaaatagcttttctttatatcagcccagtaggagctattgaaaatactcaaattttcttttaaacacatttttattctaaggctgctttgttaaacattagtttatgctatgctgcaaatcttttagagatcctttataatcaaatctcttgtctagtgtcttctggcattttggatttggccctgtttttttattttttgtattctcccccaccatcattttctagcatcgcccttaatgcaagttctactgttctcctgggcatagactcagacattacatacaaagtttccctttgatcccacacttcaaattaatttgcattatagtcttggctataattaagaaagttatatatttggcattaatgcctaataaattgataagcactatcactggagattcagacatttatattgtattgaatcaaatattttgcaatgagaaatcagactgtatagactgaatcaagtaaataccctagagaggtatcaattccttatgagagctttccccaactgtgtgatacagcttgttgcctaaacctaaattagaattgctttaagcacaaagagcaaaacgattgtgaaagacatcatcaactacattacattttttcccctttcttcttgctggctctatttttttatcatttgcatttttctcatctcgatgtccaactgactcatgatctatgtggaaagaaagtagtgaagtgtaggtgtgtgggccagggccaggaccctgtaggcatacaggtggaaggattgccacagtttgacagaccctagaatccaggagctagaaaaacatcaaaagacagatgagttatggatggttgtattgtaatggactcttggaatatgaagagcagagttccagtaccagctttattatttagatgctgcattcccttttgaataagttattttactttttcaaccctccacttgagcatctctaaaatgaggatattaccttcttctgggggttgttgtgaggattaaatgaggtaatggatataaaaaatatattttaaactgtataacaactgtatattgtaaggaaatggtaggagtagcttcctactccatgctacagtcaaaacagatagctactttgatataactctggacttcagtggggctgacactagctctgatatttcaagcaagacattcttcctctttgagcatcagttttcttctctgtctgattagatgtcgggctcggtaatctaaagatcctaggtgtacctttgttcactgtcactctattattatcttacaagtaacaaaatagaagggaagatatttgtgctgaaattaagtcccatcatagaatttttttagttcacaattatgtcccaaaatgggagtgaaagtgccttgattatcacctcttttcctttttagggtctaggccttcctattcactgtttctgttagacttatttgctggtcaggtaataatctgagaggtttctgcttttcctgtgacagcaaagaaatactttggctaatattctccttggcattaagctaaatatcttccacaaaatgatatcttatataggagacaggtttgggcatcaatgagattcctcacctactgatacttatagattcttaccttccaaaatatatttgctacaaatatttgtagcatttgtagcaaatatatattggcaagtacctgttatgcttattgatgaatggtagtttacattttgtgtaataaacattttattgagtatctgctatatgccagacattatactaaatacttacattatctctaattttcatgtaacataaatgtcagctggggacgggggtacatataggagggaagctgcttacattctcccaaaggtctgggggcctactttttgccgaatttctaagtttgttcattttacagttcaaaatagaaagatcacttatcttgccatgctgcacatgctaccattatattccacacatgtattagtcgggtttgtgttgctgtaaaggaatacctgaggctgggtaattcataaagaaaagaggttgatttacctcatggttctgcaggctatacaagaagcttggcgccaacctccgcttctggtgaaagcttcaggaatctacctatcatggcagaaaggaaaggggaagcacgcgtgtcacagggagagagagggagcaggcgccaggctcttttaaacaaccagcgggaactgagaactcactcattaccataaggatggcactaagcccttcatgagggatcctcctccatgacccaaatacctcccaccacgccccacctccaacattgggggtcacacttcaatgagatttggaggggacaaatattcaccatttcaacacagcatctaccaagtgtcatacttagcctctacttcaattcatatgtatattatattcactacttcaattcatatgtatattatattcacttgaggcattcctgtctgtagtagaccttagtgaaggggaatgaagtatttgcagcatcaccagtaacttcaaattgacaaatatcttaacaaatatcacctgggattttttcctctggctagttcaccatacatagagggacaatgtgttattgaactgtatagactctctttatagtctttccctcacctggtagattcttcccacaccccaacttcacttctgactcaattatgcataatgttttagtttttattccataaatgagcctgtggcttgcttttgcatatccagacacatctagatatatgctcagtgaaacaataaaaggcgaccactctcagaatcaatcttcttcattaagcaatcgtggttataagcaccaatatttttcttaataccaaacagtgtaaaggttggtactaccctcattttatagataagtaaacaagctcaaagaattaaatgactcgtgcagggttattcattgagtaagtgataaagtcagattttgaaccattggaatccaaatcctatgcactttccaccaaacaagacacgattcaaaaaggaaattggaaaaaaaatgcatattaatgtcctctgagcttgcaaataggaagattgctttgaaaattcatagtatttgaatccattaggggtgggggaaatgtatttttaccattatggtcccaacagtattgtttaagaaagtagggaaacataagttaagtaaaaagtctcagtaacttggaaaatcctgccttatatcaggtaaatgggacatttattatggctaattaagttttatcttttaaaattgatttgtacattgacttttacctgataaatatttattgatcctctctatctttttcatcatacttcttttaaaaaatagtttttctaatacctgctgtttttttttttacagaggcaattaaaggcagatgctaaaaaagctattggaaggcttcaactacgcacactgaaacaaggagacaaggtacattcatgacttttaaatgctatttattttaaagcagtgctaccaagccattgttcaggctaaatgttcttcctaagtatgcttttattggcatttatgaaccttattgactttatatgcatttgattctagaggttggctgaataatggcctcccaaagatatctaagataactattcccttgaacctgtgcatattaccttatatggcaaaaaggactttgcagatatgattaagttaagggtcatgagatggggagattatcctggattatccagatagattcaaaatataattgcagtgtccttataagagggagagagagggagatttgaccacagtacagtaagggatgtgacaagggaagcaagagggtggggtgatacaagaaagaggcaaggagctaagggatgcagacagcctctagaagctgggaaagataaggagagggattctcccctggtgcctccagaaggagtgcagtattgccaatgccttggttatagacttcggatttccagaacagtaagagaataaacttgtgttgttttaagccactgaattatgataatttgttacagcagctacaggaaactaatacaatgctttagtgttactttggttgaatacgcattttcagatttaggacagttgaaaactaccattcatgggtaaaacatgtatttcaaaaaatagctatagaacttatggaaataatacaccattttaaatcttaccaaagtcatgaaactgtaaaacactaatgaaagagataaatcaaagaagatctaaataaatggaaacatataccatgttcatgggtcagaagacttgctgttgttaagatgtcggttccccaccaaactaatttatggatttgatgcagtttcaataaaaatcctagtgtaaatcttttatagaaattgacaggctgattctaagcttagatgaaaatgcaaaagaactagaatgaacaaaacaattttgataaagaacaactttggatgattcatgctacctgatttcaagaattattttaaagtcacagcagtcaagatagtgtcgtattggaaaaaggatagatttatagatcaaagaaacagaagagagagtacagaaataaacccatatatatatggtcagttgattttccataaaagtgcaaaagcaattcaatgaagaaaggatagccttttcaggaggatagccctttgttggctatccatatgcagtgattggatatccttaagcaaaaaacaagcaaacagacaaaaaagaacttaaatccattcttcataccctatgtaaacattatttcaatagatcatagaccttaacataaaacctagaactatgaaatttttagaacaaaacgttaaagaaaaatattttcatgacttgggtgacaaatatttcttagatataactccaaaaacaagtccaaaaaagaaaaaagttgatacatttggccttgtcaaaattaagaatttctgttctttgaaaggcactgttaaaagaaggaaaagataaggtacagactgggagaaaatatttgcaaatcatatgtctgttaaagggctgtacccagaatataaagaactcttaaaacttaacagtaagaatacaaacaacctaatagaaaactggcaagcaaaacagacaattcaccaaaaaaatatatatatgaatggcaaataaacacataaaagatgttcaacatcattaataattaaagaaatacaaattaaagccacaatgaaatacaactacgcattcattagaatggctaaaatgcatacaactgaaaataccaagagctgggcgagatttggagcaactggtacactcattcatttgctggtgagaatgcaaaatgtatagccaatttgaaaatgtttggcagttccttatgaagttaaaaatacacttaccatagcacctagcaatctcactactagatatttaccctaaagggagaaaaaatctacgttcacataaaaacacaactgttcatagcagctttattcataattgtcaaatactggaaaaaagccaaatattgttcaactggtgaatggataaactgtggtacatacatatcatggtatactatttagcaataaaagtgtgatgggaatcccattgatacatacagcattatggatgaatctcaaatgcattatactaagtttaaaaagccagactcaaaagctagataatgcatgattccatttatatgacattcggggaaagccaaaactataaaaacagatcagtggttgccaggaggtggggatgagaggaaaggttaactacaaagagtttagaggagtttgttgggagtaatagcactattctatatcttgattgtgataaggattaagtgacgacatatttttcaaaacgtgcagaactgtacactaaaagggtgaattttactgtatgtgaattataccttaattttttaaaaatgagaaaagttatagagcttgcacaaatggtattttatatatcctaaatcaggaaaaataaatcagtgctacatgtttccctttgttctgttccccttttgtttcagtttattcttttacctttttaaagtctggatacttttaaatcacctttgggaactttacagttacataatcattcagtgatataatgctcctccttttataggaatttaggctggttaagtacatgtatgttctgatcttgttctgtagtttaatgtattttttcttatctgtcagagtaacaataactacttgcttgtaggaaattggccctgatggagatagttgtgctgtgtgcattgaattgtataaaccaaatgatttggtacgcatcttaacgtgcaagtaagtttgattttcttctatatcttcaataaaatagctgacccacaaaaatgactgtgatggaagaaaactattttgaatatttccaaattaatgtaaaaaatgtttattttttaacttatcttcatttaaatatagaatggtttatttttatttttattcatttcttaataccactgaaattggtataagtctaattgtaatctgcttcaatttgttctaaactaattccatagaaaactgagaacctagccagcacaattgatatatatgtattatatatatattatatatagtatatatactatataatatgtattaatattatatatactatatataatatatattatatactatatataatatatattatatattatatataatatatattatatataatatataatatataatatatattatatataatattattataattataatatatataatattattataattgtaattatatattataattataattatataattataattataatatatataatatgtattatatattaaatataataatatatttatatattatatagtatatatcttacatagtatattatgtataatacatatactctatattatatatactatataatatagtatataatatataattatatatactatataatatagtatataatatatagttatatataaatatattttatatatagtatattttaaatatagtatataatatacatagtatactatataatatatatactatatataatacatattttatataattatatatactgtatatactataatatataattatatatactacatataatatgtattatatattatatattatataatgtataatatattatatattatacattatatactatatactgagtatatatactatatagtgtatagtatataatatatgtatatgtacatgtacatatatatactatatgtacagtatatatactatatactgagtatatatactatatagtgagataatataccatatattatctattatatagtatacaatagtgtatatatactatatagtatatagtatatatatactatatactatatatactatatactatatagtatatagtgtatatatactacatatatataaattgtgtatatattatacatatatgtaaattgtatatatataatacatatatataaattccaactaaggagtgaacacttccaaatagatgctcataacttgatttcattttattttttcttgatagattagaataaatttaaaattaatccagtactatccttatatttatgtgtatttatattatattatgtatatatgtatattatatatttatgtatatatatgtacattatataatatatatactctacataatatatagtatatattatatacattatacactatataatatagtgtatatattatatacattatacactatatataatatagtgtatatattatatacattatacactatatacattatatataatatatactatataatattataatatgtagtatatatagttacacatgtaaatataaggacagtactggattaatgttaaatttattctaatccatcaagaaaaaaataaaatgaaatcatgcatctgtttgaaagtgttcattccttagttttttaaattatccctctcctgaaggttgttcttaacactacttcttttagctatttaatacaatagtgatgctcttggaacatatcacattgcctaaagcatcagtacagtgttgttgtactcaatactatattggactatattattgagaatgactgtaccatttatcagttagggaattctaactgtttaagatttgaaataatgaacaaagtcttaggtcaggtagtgtcctagccattttcaaatgagtactgaaaatatttttttttggagctagagtaatgaggcttttacatttaaaagtaccgtattatggaatttccaaattttgtttctgtgactccttcattttatgaatagtgtgtttaaaaggaaaggcatccattcaaagactaaataaagttacactaagtaatctgttaatatatattaggtaaagtgttgctactttacaactgataattatgtttttttcctgaattagccatattttccataagacatgtgttgacccatggctgttagaacacaggacttgccccatgtgcaaatgtgacatactcaaagctttgggaattgaggtaaacattaatatgttatttatatgaagaatatatgcctgggctttggagaaaataacaaaataacatccttattttttcgctatgtaatacaccatacttatagtttatacctaaaaccagacatatttatatcatatagacaatgaggtgccatcttgggccatctccattttccttcttcctccctctttccaaatagactcattatttggtcagaatttgaaatgataaccatataaaccaccaacttggcatccctctttctgtttttgtaatcttttactattgcatagtgaccaaacttgtagttaaataagcagacataatttgagaaagcataataaatattaaattataattttatatttggtaaatgaaaaaaaggcctattttcaagatacaacataaaatcgagctcaaatcttgacttgggaaggtacatagatgacaatgattctcaagttccataggggacagcatgatgtttttttagggcctaacttgtacccagcattattttatgaagtgctggtatcacccaaatgaacataccagatgagagtgcactccgcctatagcatctttcatcccattggtggacccagttactctgttttgactggggctaacaagagacttgtgatcatcaaaagggatcataggtttaaaaggttaagaaatattgctccaatgagtcacctataaagaaactttgaagtgatatgtcgaggaaaagcgtgtacactgagaggcttttaatttgttacatgttctttaaaggtggatgttgaagatggatcagtgtctttacaagtccctgtatccaatgaaatatctaatagtgcctcctcccatgaagaggataatcgcagcgagaccgcatcatctggatatgcttcagtacagggaacagatgaaccgcctctggaggaacacgtgcagtcaacaagtaagcatcatactaaaggttaacgagtgccctgcaatccattgtagatcatatgcctgtatagtactcttgctttttagcgtttgttccattcagccattatcatgatccaggttttttctacttaaaataatgccgtgaaggatgcacccctaccttaatatacatatattcaaatgtatttgaaatagatgaaatgcatcagagtggggattatttacaaaagaaagatttattggaaagcttctctctgatgcatttaaatcttggcttattaactaattacagagggtaaggagaaactttaaactttaggagccattgtttattgcagataaagcagaaattaaaataaaggagttctgaaatgataaaacagaattcaatttataaaagtttgatttatacccaacttctctggaacccatgttttgcaagtaggaaactgtttaagaatggtatgtgctgccacctgttgactatttaccgtgaaatgaacaaactgttagaaactaaaattgaatatatcattttcaaaattcatgtgaatttgtattgcaacttagtaattttatgccaaatgagaaattttagggagttctgtttttccctataaagataaaacccctataaaaattattttccctttcttttacctcaatcttttccatgtttttgttggtttgaaagtcttctctcaatcctcattttgagataatttaattctagtataaaagtaaaacaaaaactgattgtcaagatgacttatgaaactttcagcttcctattatataaacctttgtcctctataggcttatcagtgccatagataccacttctgaagatatcacaatgaatataaccacacaaaggcaaactttgtatttcttatatctaatcttcagacattcccttgaatataaactagttataagtatcttaataatctgtggattattctacctgtaatagagaatcattgtctgattgccccagatgatcttgtactctcataattgtgtggtaatagaattcagtaaagataaaagagagtgtacgagataatttattgctagtcttttaaaaaacaacattccaatctactctttttgtgttctgttcttctgtgggtaggggtggggtgggggaaaaaggtaagcacaacagattttgcagagatttgaaaagcaaatgaaataatgatccatgtttctcctcctgtattcttaatttggatgatagtaatactcacccaaccgccccaaaccagaaactagggacatcccaaattcttcccacttccccttctgtgttctcaattctgtcccctaatttccaaccttaattccacagtcatagtttgagccactatcttctctttgcctattccttccattcttccttacccaagaagttaggggagcccagtataactcctgtttctcctttaagactgacacctctttgagaagcctctcttgactagatgtgatggccctactgttggcttccatagaacttcgatcattgcacttactacactgagttgtattaaaacttttaaagttcttttggataagaacagtgtcttatattcactgttgtctatccagcacccagcacatagtagatactcaaatttatgttgaatgaattaccacttaaaccagatttaattttgtctgggattacatattactagtttaagaatcttgcgtattagccattgattcttatggtgatagttgatttgcataactttgtaaatacacatagttcatgtcgtgtgtcacatcattgggctaagttctattagagcactggttttcaaacttaagtattcattgagtcacttggagggcttattaaaacggaaaggtcaccaccagagtttctgactcagtgggttttgggtgatgcctaggaattttcgtttctaacaggttcacaggtgatactgattctactagtccagggaccacattttgagaaccattgaataagggccctactgtcaatcctggctatacataaaaatcacctggagagattttaaactttgctgatgtttggactgtacctcagagcaactgtgatttaacatgaggtgcagggcctgggcacaggtattttttattttaatttgaaatgatttcagactgactgacaaaaacgtttcaaaaataatacaaagaatgcccatataccattcacccagcttctccaaatgttaacatataaccatatacaattatcaaaaccaggaaatttgctgataaaatgttattatcaaaactataaacttgactcaaatttcaccaactggcccactaacgtcctttttctgtcccaggatcccacattgcatttaattgtcatgtgtccttagtctccaatctgtgacacttcttcagtctttgtctttcatgaccttgacacttctgaagattactggtcagttattttctagagtgtccctcaatttgggctagtctgctgtttccgagtgattaaatttattgtccatttttgtcaagaatactacagaagtgatgttgtgcccctttcagtgcccccatatcataccaggaagcacgtgatgttggtgtcttattagtgatgattcaaactttgcccacttggttgaggtggtgtctgccaggtttctccctttaaagttactatttttccctttgtaattattaaatatcttatagagagatacttggagactacacaaatgtcctggtacttatcatacttctacccactacttttagcaatcattgatgcttcttgcttgcagtaattattgaagtatttaccaaatggtgattttctgtttgcatcattctttgtacatttattgattaaacttctaatataaggaagagctcttccttctcctccatttatttattgagttatttatttattgtactataggatcctagacgtttctttcattctataatatcattctcatcgtttatcccttgctcatatcatcctagatttggtcattgggaacttgttcaagttggtttttgtgttctttcaactttcttactttctggtaacacaaggtgttctaggtctgggattagccaactttttctgtaaggggccacatagtaaatatgttaggctttgaaggccttaagtcttcattttcatactcttatttttttgtttttgttggtttgttttacaaccttttacaaccatgataagcacttttagctatggtttgtaggctggagtttgctggcccctaggctaaaatctaggttaaccttgtactttccctctcctagccctagaatcagccacttcttcaggaggccttttactggagaatagtatttcaaaaccaggatctgagcaacgggcatgcttattgctaccggggtgtcattgctattggcccttttagtgaacaagactagaaaatatatgtatttactctcacaaatatacacatacatatacattatttctctatctgtcattttatctatctatctgaaaaacaatgaccctactaatacatctgattccaatcccacactacagggttcattctagcctccccctttatttatttgtaactcctttctccgacagtgaaaggagaaatattctttttatccacagtatttttacttatttgttcaattatagaatatacataaaatagtttcagcattgctaacacatacccctgtgtaaaacaatgtcagtaactagtgtacagttctttttgtttttagccttacaggttagagtcaaaatactgttttccaaagttatttaagtttagttgttttcttccccattctcttcacatggttatgtatttcatttataatacaattaagttcatttattactgtttgtattcaattcaattttgggcatccttccaacttcctggttgattttttaaatctgtctatctatatttatgtgaatgaagaagcactggtaattttttaagtgcccaggtgattgaaatgtatagccagatttaacagcttgttatatttaaggtaaggaagaagtagaagacataatttttgctcttaaggaggctataatctaggtagaaataagcacatgtacgtgaatcaaaaaagcaattataaatcaatataataatgccatatgtgctttatgtaagatatagcataaatcatataattattagaggtacagggaatgaatatggtaatcagtgtatgttgaaattaaataagaaagacttcttggaagtaaatgttgaattttgtcttaaaagaggagaggggcaaaatcatcctaaaattgctatttctttttaaagatgaaag

SEQ ID NO: 1254 - DNA, 138 bp, mus musculus
agatttcgtcacctttaatgcagtcatttgcatgtatgtatttagttctacataatgttatcacgtgtagatttatataagcactaccacagtcaagatacagaacaattgcatcaccacaaggatcctttttgttgt

SEQ ID NO: 1255 - DNA, 1568 bp, mus musculus
gggtgacgtaatagcagagaagggctagggagcggttgccgagcaggggctctaccgcgggcgggcagctgtgccagctaaccgtctgggatctcgcactgggggctgcagcttttccccgcctcgagccagtgtgcgggggcgggagaagagccagggggagcgggctgggcccggggctgcggctgcggccgcggggctgcggctccccagccccgccagctggagcgctcggaggtagaggaaaggtcttgacggggtggctggatccgtggcaggtaaatcccgcgactaactgcacccgggctaccgcgggggagggggtggctgttggatgatgctttaaggctgctgggcagatgttctgcctttccggacccccctcctgtcctgtttgtgccccagcctcgagtctcctacgtggctccccggagccctgagaccaagcgagcagtttgcatgatcccagttcgcggacaagtgggtgtgtcagggccgttcccagagggccggggctccttcgcttggtcaaaccctagactcgtttactggggcctgggccgcttgaggcaaaacccgccttgaaagctacgtcagcctgtaagtcttccctttcacccccccgcccgcccccctacccagccccagtagctgtgacagcagttccctagaaaaggggagggggtgtggccacggtctggccaagtccggggtagaacccccccgccccttacacacacacacacacacacacacacacacacacacacacacgaggaaagagaaaaagtgacgattttcttaaacgggcgccttcccctctttcttttatttttctttatccccctcccctttttttggtggggggatggtaataacagggggacccttttcttctcctgtggggattggaatgatgcaataacgcccccagaaagctcagggtccctggattggccctctctttgtctggggagcagtgtcattgggtccactgcctctccttctctcctgttccccttagctcgctgggggacattgccctcagtttgtgaactggctctggcaagattactgccgcacttttgggtgaactgaacattttagattcttactctggcaagttttccttccctaggtggtggttaaggggtggggtggggtgggggatggtgggaagagggggatgcaggcaaggagagagatagaggccccacttgtttttttttttttttttggtcccacctttcagaatccagttccagattctagacttgagggttctgggctgttggtctgtagaagcgaaggagagaagggtgagtggcttggctttgggaagcatgatgggggcggttgcagtgctatttttaaaaaacggctttcagcagggaagcctttagccatgttagtcttgctcccctcatggttttgcagactcaaatccaggccaagtgtatggctgtctgaggtattggaacagaaggaggtccattcctgttggtgacaacaccgtggccctgttctgggatgagcaaggtgtaaaggtcagtgcggttttcactggg

SEQ ID NO: 1256 - DNA, 235730 bp, mus musculus
agtacttgcgctcgtctttacaccccgcccctttccctgtgctcatccgcccacccacccatcagcctagaggccccgggctgtcccagtcggctgctgtttcgcgccgcaaaagaggagtccggcaaggcgccgcaccacgcatcctggccggtggacatccagacgacacagattttatccgaaaaaaccacttggctcagggtaagtctacaggcggccggtgcggtccatttcactgcctgagtgctgctgaggggcaaggggcagcgaagtgcgggttgaatgaagatgctgggctgctgtaggcggagaagcattgactggctggctgtgggctcagggtggtagggagcagagggaggccagcaacagattgttttggaagaggaaatgcaatggggagaagctccagggttgataggacaaggtgctgcctgcgatgaccaaaaacatcctttcactgggaatattttcctgaaccacagctttgtcctatccctggacaatgatttgctccattcttgggtagattttaagatccgtggggaacctgctcccaggcctccttaaaatcgattagtgtggccctcggaccaaggatacctgcccttcgtcaaaagccaccttcagaaatagagagccaggagccggatcatgaaggttcaggaaccagggtccccatttaccttctttgtcttgtatccttcaaacttaagaaatggccagatttgtttgcctgtcttccttaaaggaaccaagaaatgcaaatggaggggcatcagtcagatctctgcttcaaagtggacacctccctccctccctagacacacatcgactcggacaaatggtcatgatcatgtcccacatatgcaggtactgagctgaattcacagatgctgatctttctccatggtctcttagaatgagactagaagggctttttccctattacaacctgggctctttggatcgcagtcatgtacctggtgatggttaagtgtttagcaaggttattactccctcaggaaaagcctgaagcggggaaaccagcctgaaagatagaacctctgaactttacccgagtttattataagagtaggagagacatagactaattgataatgctctttttagagattgtgcatgttaacccttggcttcaaatgtgaaatgattacaacattgacatggcacacccagacccacttttctattgccatatatttatcttcatggcatttaacaagaatgacagatttatatatcagcattcataattgtctattgttggtgtcataggttttttgatgttttattgatgatttatattatgtctcctttcccataaactctttaaaaactgagatataaatgatgtcacatggtacctttcatcatgtctttaaaatctgcttattctaaatcaaaaggcatgttaatatatttacatagtacgaagttcgtttcaaagcaaatatatagtctgggataaaagaaacccacagggtcaaggagtctctgaagctctctctgtgaggtcgaaggaagaattgaatgtcacctaaaatccacattttggtccctggaagatgctgttttcataaactttcacaatatacatagggagagagagaaaatctgtgtgtgtgtgtgtgtgtgtgtgtgtgtgtgtgtgtgtgtgtgtatgtagtttttcaaggacctcaatcaaccccatacaatcttggctctgcttttgtaacagaggggagcaggaggtgaatttgtgcttccaaagcacccaggttcgtctgttaaactttctatttattactatgttaccaaaatgcaatgaattgcctctttccaactcagcaaataagagaaacggattctgcattaagtgaaactgtttatgttgcatcaggcaattctttctaatgttcactgctgagagagagcagaatgaggattactcaagtaggatctgaaaaggtgcccattctgttactttttaaagcaaccatagtaagtattttcttaggttaaaattacactttcaaatagatatactaaagaccgggttgcagacaggtaggaaagaactggcagcatcataattggggaaaaactcaaaatatcagcacgaatgaagcctacagtgtaggttttgctctgttcttggtgatgtgagtatctggctgttgaggtaagtcctgatggttacccaggggataagcatgtgagcaggttcagggattcagaaccaatgtagcccccggcttcactgatactaattcacctggcttcagtgtacatctcaacatggagacctgaaccagatatctgccatccttcccagccacaagagctataatcctaagattctgttctttctatagctaacaactaaaaccggaatggcacgcagaaccacagtacttagagaagactaggccaggaaattagagatgcagaagggaggaagatgagaggaatatgagagaaccgaagatgttttgaaacaaacagaaagaaaactatccaggtgtttgctttgactgggaatggaattaatccagaaatcaactcatatgtgaagcatcttaaaattgcctgtatttgacttgcaaacactgtgtaaacaatgatagaattccatagtaccagggaattgggaaccttggagtacattctcagtgttgctgtctcatttctctccttacaatattaaattccaatctgcaagccattcaggtgcttagttattgaatggatatttcaaatgtgtcatgatgctttcctgtagcctgttttcgaatattctaatttattttttgccatggctccatcactgaaggtggtagattgaagcatttctgcctgctttacttctgccaaaggttcctgttttcaccttagtatactaagctgttcagatgcctcctgctaactgatgaagaatataaggcgcagaatctctctccccaaagtactctgtgccacaaggtgccactggcctaatctggcccagtcatttgccaggtttgcagggaaaggtatgacaaagtttgcagcctatagacagaaataaagcctcattctaggcagaagttattcctcatcccacagatgagggataagctaaggccagccatcatgtccagagcctagtagctgacatatccacagtgtcatcctttctaaaactcacgaagcttttcttctgttgatgggcccctcaaactttgtccagtgagaccagcagagccatactgccagcaaggaatgattcctgaatgactcaactgtggtcttataaacaaacatgtacatcatgctcaactgagtgagcacagatgatttaaagaaattataaaagctgataggggctaagaaaaattgcaatttgctgggtgaagggaactttgcaagtttcttaggtttggttttctgtcaccaattctggagttggcccttggatggtggtggccaatgcaattgccccaggtttttgccttagcaaaaggaaagaaaaaataacgataagaaacaagcggggatcttggaggggtcaatcctctcatttcacctatagagaaattgaagtctagagagtagaaatgacctgcctaaaacagactactagctaacaacagtggcaaaaccacaacccagtactgtttgctgatacgaaatacattttctgaagttctgtggagatcttcccaagaaatcgagaggtaactaaagtcaagtttaccaagatcacagccctctacttccattccatatgtatgtatacgtgtttatattatatgctgctgtcatatctttgtgacttaccttcttgaccaccacctccccctaacacacacacactcacacacacaatcctatcttgctagctaagaaaacattatatgtgtctatagctagcgtattcagatggaaggcagaattaaacatgacaaaaatttagctgctcacatttatgtgtctgatctggctcacaccaccaacagcaaggcatctagaaatcccagtctgttctgcaccatagtagttttggggaatggaagctagcagaatccagtgactatggctctggtttagtatactcagtctcagaatcagccccccaaatgcatgtgcaaatacacacacatgcacacacacacaaacatgcacatacagtcacactctttccgaaaaattaaaacaaagaaaatagaaaagataaggcaggtggtttttagagcagagtacaagaagaaggaaaggtttgcagacggatattcttaccttcccccattctttagccttattgcctaattttcattaatcccaccctaatttattttaggatctgagaaaatagagcaatgcaaacatgtttactacagcccagaaggatgatctgaaaaacctccacatttgagtgagaatatcacaaggatagggaaaaggctaggatgtagtgagctagagccttgctactccaagtgtagtccccacaccaggattgccaccatcccctgggagctatctataaatgtagaatctcaaatccttccccagaccgactgaataagaatctgcattttatgaagatccccagtgattcatttttatactaaaatttgagaagcaccgggctagagcttatccaaaaagcatctgaaagatatttgaaaataaacaattacctactgagcatgtagggacaattcatgtggcttatcaattaaaaaataaaatataaactttttccaggtccacttatcttattattcactgtaaaacccttcagtgtgggcaagagagttcatgtaaagggagtgagatcataggatttgtttatttaccaggacgacttgggtgtgggaactcacacagacctgagttcaaatcctggccctgctcacgaattactagctgtgtaaacatgcactttgcctctaagcctcacagtccccatctataaaatgggattaataatagtaccaactggcactgggctgtcatgaaaaattaaataagaccgtataatgcactgggatatggtgaacaatcaataaatagaagatataattcatacgatttggctaataattttagtttggtagaaaaccaaccactagatgtgatatattggggcacctagcattatttctaattgacgtgaatcttactgggttttctacagatagaatgctaagatatacaacagtaaaatatatttaaatatgatggaggccactagaaacaaatattttttcagaaggaattacaggtgtccctagtgaaatcactccatggaagaagactgaagtcagaagtggccctgttctatgaagcatatctcaaaatattaccaagttagaaagtcaaaagtgaggcattttctgcatgtttgcatatatatgcagcatgaaaacacacacatacatacacacacacggacgcatcatttgatggacaaattataaaataattcaaggccaaaatgacattctaggagcagaactaggtttctgcctgataaaatctttaaaatgcacaaataataacctctacttcgtaacttgctcatgttgcacagtttaatggcttaggtatatactatagctattactattttgtaggtgaaaaaaaaagagcaactcctacctcttcccagcccatggtgctacctacctgctcaattttctcaccagtaaaatatgatacacgtagtactcataaagtccaagaaatcaccaggcacttgattctataaagacttattgactggcatgtgcaatctgggcaacctgattgtaaagacacagagacagacactaccacctctggatcccagtcctttggtatgttccagacctccagcttcccctgattttcaatagtatcagattagtaaggtatcaataatcttataatagacaatatttatatctaattgctaagatttctgtgatcaccctaaataaacaatagcacgtgttatcaattattgactatctttatattagttttctattgctgccataacaaattctcacaaccttatcaatttaaaacaacacaaatttattatcgttatagttctgtagttctgaagtctgacacagggatcactgtgctaaaatcaaggtttcagcaggactgccttcccttctggaggctctagcagagaatctacttcctcacttactcagattgttggcctaattcacttccttgatgttacaaaactgaagtcctaatttctttggtggctatcattcctaacttctagagacaacccacattccttagtgcatggccccattcctctgacttcaaagccagcaagggcctgtttgatgagggggaactcagctggccaactcctgtctcttctccctttgcatctctctctggttgactgttctgccttcctcttctgctttgttttgtgcttacattgggcccactgacataatccaggattatctcctattttaaggtctgctaattagcaacttcaattatatctgaaaaatctttttcaccatgtaacatatcatattcacaggttctggggataagggtgttgacatatttacaggttggccatatcttgtctaccataatcttctgtgtgttgagtgctacaaatatggggttttaaatgacattcactacagtttctatatgataggtattattattattcccatttaacaggtgaggaaacaggatcagacaagttaactggtatgtttaacattgcgcagcttgtgagtggtggaggcagggttggaacacaggtcactcttcctccaaatcttgaattttccctgttggcctacattatgctgaacgtggcctgaaagtttgtaactcacataaaatatttaacctcaagaacgaacagaaaacgttatccttttgattgttgtcatctttacatagtggtcatcaccagaaatttttttagtagcttttagtctaatgataaagaccaaacaatgaagaaagattgacaggaatataaaatgtatatttgtttatacatctaggaaaaggctgatgaagtagtgatgggtaggtaaagaagattgtcgcaggatgtttgatgttgcaaaagagaggattttcacatttgttacggggcagttatgccaagaaagaggaaaatgagagggctagttggaaggatagaaacaagagagtgttaaggagtaattaaacagctcaatcctcaaagtggtaattgagcccctaatatcaatcacttggcgaatattcgctcagtgtgcaccaggtggaaggcactgttgggaatgcaaacaggcatgcccttccttttccctctaggaactttcgacatggtcagaagtgagtgggatgatgggagcaaacatgaagtgaaatcctggtgtggccaagtagggcatcatgctttaagccattcatggaaacaggcaggtacttccaggagatagagtggggaagttcagtctgtagaggcctttagatgttcaggctgtgctggatttaatttagtggatgaaaggaagatacgaaaggatttggagattttaaaaaaagaaataatgataacccatttgggaatgattattctggaaatggtgtgtaggaattccggattggtggaggagcaagcaatggcaggcataccagttaggaagcaattatagaaatttaggctttttgtccttgcgatagtttgctgagaatgatggtttccagcttcatccatgtcccaataaaaaatatatatatatatataataaaataaaaataaagatgataaacagaactttgctactcaaataaaaataactgatatggccttcaaaaaaaacaaaaggaaatttaggcatgaagagtagcactgtggttaggtacagaatctaggtccaaattcgtctacgtgtgattttaactgtgccactctgagccttagttttctcttctatgaaaagaaaaaactaaaagtacctgccttaaaagaatactgtgaagttgaaatgagttacatgtacaaagcacttagcccagtacctggccagagtaaacatgtgcacgttaactgttatactgttgttattgctgttgttactgtagtggtgcacttggaaaggatggggtataaaatacactgtaaagaaacaataatgttgaatggctgtgtgatgtgtgatgaaggtagtcagagatgactgcaagttttacctccttgctaggtaacagagaagtggtgccataagaaaatgtgaaggcgaggtgagataataaggcgaggaagataataagttggtaataagctttgatataagattaagcgcggagtcagtgtgagacattctagtgaaaatgaagcttggagtcagtgtgaggcttggagtcatttgaaaatgactaccagaaaattttagatgtgacactggagctcaagagaaagtttagggatgaaatgaaaatttagaaagtcacagatataacaatttttatctctgggctgggcatggtggctcacatctgtaatcccaccactttgggaggccaaggcagatggatcgcctgaggtcaggagttcgagaccagcctgaccaacatggtgaaaccccgtctctactaaaattacaaaaattagccgggcatggtggcacgtgcctgtagtctcagctactcaggaggctgaggcaggagaattgcttgaactcaggaggtggaggttacagtgagctgagatcatgccactgtactccagcctgggcaacagagtgagactccgtctctaaaaaacaaacaaacaaacaaacaaaaatttatctctaagaaatacatgtaaaatctccaagaaagaaagaagagagacaaaagcagatagttaaggtttaatctgtggcccatgattagtgggggcagaagagccacaggaagaatgattgaaggcaaaaagagacctgtgcaaggcactacagggaattcacaagaagaacacgccctgctcagtacaacttatagactcaggacagaaagcattataaagtatgaaatatataataatgacattcaattttaaaatataaattatcagtttcaaatataccttattttgttgactagaaaagacaggaagtcttcataagtattttagcccttgaatgatgagtgacatttggaaaaataacaaggagcacatttcagatgagaagaattatatgatcaaaggtgaagagttagaaatgggcacaccaagtttaagagagagagagagatcgatctgacaagagtgaaggaagataaggaaaggtaagagaggaaaaatgttcaaatcacccacatagctaaactcaagtcccaactcagtctcatcttagctttaaagttggaagtttcatgtcatttttttctgacataaaactcaactcccagctttctcagttaagtgattgagtggacagtgatgcttttaacaagaataaagtgatagaagaaaaatagcaggttagggtgaggtgataggagggtagaaaagggatgatgagttatgtttgggacatgttgaagtaaaggtgccagtgtgacatccaagcacagatgttaaacaagcagttagttaaatgggtttagaactcaaaatagaagtctgagctgtagatatagattagggagtcattatcccataataacaggacaataatagcagtgatgatgacaaatacttatgaagcatatactctatcaaaggcatggttctaagagttttccaaatagtaaatcatttaaccttcacaacaaccttatgaaggaaatgctgtttttatcctcatctaacaaaaggactaaaaccaaggctcagagaggtctcatgcccaaggtcacacaagtggtatctattggagacaagatccaaacccaggcaagtacagatccaaagttcgtgctcctcgttaccatactaagagtgagtgttagtagtcttagaagtagagtcacttactctagcagagcagagtaaaataggtcagctactgatccttgaaaataccaatatttcagaggtaagtcggagaaaagaatctttcagaagagaataacagcaatcatagagatagaaggaaaactaggagtgagtgatggccttaaagtcactgaggagagaatgcccaaaaaggggaatggatattagcagcattaagagctgcagccattggatttgacaattcaaggggctttgaacaatgcagtagttaggacaggggacagaaaaccacaagccatgggcaaaattgggcctaccatctgttttggtgtggcctcaagctaaaagtggtcttcacatttttaatgcctggaaaaaatcaaaagaaaatacatttcatgatgtaaaagttatatgaaactcaaatttcagtgtctatagatattattggaacactgtcattctgatacatttatgtattgtctatgacagctttcctactacaatggcagagcctggcaacagagagcatatggcacaaaaaccctaaaatcttctctatttagccctttacagaataagttagccagcccttaggttaaaggattagctgaaagtcaaactatctcagttcaaatcccaactctaccactgactacacaatgtgaccttgaaaaagtcaccaaatgctctaatgaccattgtcagtaaaatggagattaaaatggtatttatctcataggattctttttatttatttatttatttatttatttatttatttatttttgagacagggtctcaatctgccacccaggctggagtgcagtggtgtgatcatggctcacagcggccttgaccaccgcaggttcaggtgatcctcccacttccccgagtagctggaggtacaggtatgcgacaccatgcccggctaatattgtgggttttttgtttcgtttgtttgtttgtttttgttttattgtagagaggggggttacaccatgttgtccagactggtcttgaactcctgggctcaagtgatccacccaccctggcctcccaaagagtggagattacaggaatgagtcacttatcaagcccaacttcacaggatttttttgagaatcaaataagacaatttgtgtaaaggacctaacacagtgcctggtgcatagttagaacttaataaatgtcagctgctgttgacttttgatatggtagaaatgaagccaaatttcaataggtggcaaaaggaattggagatgatgtctatacaaatagaaactatacttttgaaaattttcacagtggatttgaggatggaggaggaagtaactttgggggggggcagttttcagttttagtggagagacttgaactcagggaaagggagaagtgaatgaagattgagaatctaggaggaaagaaaatgaaacaacaacctgatgaggtaggaagatcaagagtagagatcagagattaaccttagaaaggagcaggaataattcttcctcaagaaataaaatcgagttggatgcaaatataagattttacgtggggtgggggagattcatatctcaaagactctttcctctataaggttggagacaagcttttctgttatggggcatggataggggaacttgatggaacactggctatggaactttcagaaagaaattggcccaggagattccaaaggggaatatgtatgaaatggccctgtgggcttgatggagcttggaaaatcgaacttggcggcgtcaatctgcacaaccatgtgaattactctagaagtgctgaaaaacctgaaagaagaaatccagaaactagaggggtgagttaagtcatgacttttagttgtgttgaaatacttggaaaagttaatgccaccattggcaaacatttgaatcccataccagcctgtcattggaaccactgcctctgggaccctggtcttgtcaaaaggctctgcagcttgctcatctttatcctgcctggtgtcgtattatgtttgcacaatggcacagcctccccagacatttctggatttctttccctgaaatctcattgcaacgtaacagagacagacggtacattggaaagctctgaggaggaacataaactgtgacttttgtggagagagaatgatactgctgaaggatgggggctagtgctacagagtctgagtacctttcaggactccctgagcctagccataaaatccctattaatttgagagatgcaggacacaagctttatggtgtccaggataaatccaaataaaatgctacaatggctggtgtgctgggtttggctcccttgagactccaggggtaaagttacagggctaacaggccaactcctgtctgggcaaactaaaggcagagcagaagtcagggaaggagacgttgtctgaggaggctacagattcagagaacaaatgctttagctagaagttgagatggcaaggaagaaatggaacaagttttcctaaaaaggtgcccactgggccccctggaggcttgcagctcagctagaacttagccagggcagctctgaagattccattcagacttcctctagagagcatgcaccttctgctggggaaaacaggcctcccgtaggcatttccccatcttaccctgaccttttgtcctgggactcagacaagtatgcattccccttagaggcttccaggctcatctggaggtctgctaaaaggatatggagtgccagtttacattcagatagcacacacatgcccaaagcactttcccatccagcattttaagcagactagtatggtgtcaaaagcactatactgggagtcaagagtcctagccctgctacttactaggagtgtgaccttaagcaaaacactaagccactctgaacctcaacttttagcattcataaactaaggataatagtagtgttgtcctaatagagttgttgggaggattaaataatagtgcttagcatagagtctggctcataataagctctcattagctgccatcctcatcctcatcatcctcatttaacatataaagaacttgaagcatgtattaggcttgaagcctggctctgacacttatgagtcataagaccttgggcaagtcacatcacctctctgagcccatttctttcttctcagtttaaggtagacttggctgatcctacaagatactgtgtgtaaaaagtatacaatacttttcgaatactatagtattcatttcccttttcagagagcatcatctctttttaaagacagggaaaagtacctgagaggtaaaggcatttacccagtgaagcaacagaaaacctggaatgagaacccaaggccctctacttgcaacccagggctcttcctaattatattctctgaaagcagtttggtctggtactcagaatagagtgttccacatggtcccagcaatgcaggctgtgctgatgatgtgtgtgtttccctgatgctcaccagccagaaggcagcagtgctgactgggcccctcgcaggcagatgtcagaagccagaacctcaagctctttgtttgcccctgtagcaagtgactagcattcaaaaatagagagttctggccatcttcatacccaaaatactttcttctccccacaatcacccaaccttggtgtatgaatccctatcattcaagctttgtccttttaagcttcagcccttgttcaaaaggtgaactccctatgacatgcatacaatgcctgctaccaagaataagcaatcagagcaacagtatgaattaaattattcagtgctttttctctctggaagcaggaaagagggagatttcaagtgcaggacactgttcagtcttcctggatagctagaacaaactacagacagcaggaaagatattataaatggagagaggggcacataaagagtaggttgcaaaagcagcccatctctacccattttgaaagtgcaggagcaggacagacagaagagacattcctggaatggtgaaaagagcatccatttagaatgacaaggtcagacttccaatattatggcaaatttcctaacctgtctatgcctcagtttcttcacctgtaaaatggagtgatcatatcatctaccttaccagatagttctaagtgtaagaagaaagaaatgtgtgtgaacatgcttataaatcaatgcccagatctaagtgatcatcaaggattcggttaacttctcagaggaggctcgaggatgcagtgaccttgacagctaaatggccaggagagatgcacctggcgttcctcccatccccttcactgttaagtggagcatttaatgcacctgccatgcttcctctctgagtctgcctctcttctcatctctggcaaagtggaagcatttagtagctctccctggggccagcagtaggtttcaagggctctgatctgagagcagtggaggtgggcagttggcagagggcaaggctcttctgagactgaatgccttccctctggccagctgtagcctccagacagatacggaagtcctgccaccaacctagggtagcagagacaattaggatgacctctcagtgacaagactctggagtcattaaagcagtgacataattggcctgacaaagctgagacggcagacacacagtccagcaatatggcaaaatagttgtctcgaggaataaataaagcaatctataaataattactgaggctattagctatattttatcttctcccctatcctgcttcctgacactactggattcagaggccccacaggggtggcagtcagagtaagagaggtgacaagggaaggaatggctggggccaaggactccagctggctagaggctattggggaccctgcaaaatatctacctacaagttccagggaccccccaaagtcttctgtgatgaaagcaggcaggaatgggtgaagagtcacctctagtgaggaatggaagagagaaaggactgctaataggacagaaatacctaaggcccacttatcaggtcatgacttagccctagccactacagaggtgactgaccctgggcaaagctgaagctccggatatgtgtgggaagttagttgagagggtggtaagatgccgggctgtataattaccctgaaaggccattctcacgatttccttctctttgcttttattaaataaaccctgaactgaaagtgacagaaaggggaagatcatgtatgaacaagtaaaatcagaactggtaaggagaaaacaaggccagccacattatccctcaaactgagaaatttaagtttctttgtactctgccctaaattttatttaattcattttattaaacacttggcatattccagacactaagtgctttacaaatattgactctcataaccctcatcacagccctctgagataaagactataataattcccattttacagatgaggaaaacaagagacagggacattaggtaaattgcctgaaatagcataactaataaatggtgaaaccaggattcaaacacaggctagcccaattctggagaagagaccatgcttttcacctctatgatatgcttcctgacaacttacattcaaactctacacctaccatgttctgttgatatttgatatttattggtgggtatcccctaccagtctaagcattgatggtaggcaccatgaaggccagggccagacctttctggttcaccaccgtacaccgtattcccagggcctaacacaggggctgaatgattaaatgaattcattaatgaaatatagatttcatgagtattcaatgaaaacaaccaaatgccaaataaaataattgcaatagtttgagacaggagctattttcaatgtatgtgcagaactgtagatgattctgtgctataggaacacagaagcagaagggtttggttctgcctgaagaagtcagggaacgctgtacagaagggatgtaacataagagctgggacttgaaggagaagtaggtattcacaagcagagaacggccatcaggtggaggtattctaggccaagagaaaggcatgaggaaagtcagagctgtctggggacaggtagttggtgtggttggagtctaggatatgcacatggtagccagaggtacctttggagagctaggcaggaacctactggtcaattcaaacttgatcctacagccagagcagaaccatcagccaactttttttttttttctttttggaaatagagtcttgctctgtcatccaggctggaattcagtggtgccatctcagctcactgaaagctctgcctcccaggctgaagcaattcttgtgcctcagccttagcacaccaccactcccagctaattttttatattttttgtagagatgagttttcgccatgttggcctagctgctcttgaattcctgacctcaaacaatccacccgcctctgtctcccaaagtgctaggattacaggcgtgagccactgggcctggccccatcagcaaacttttaagtaggacaaagttatgacaatcaaatttgtgttatggaaatgtcataatactcaagggaaagatggaagagaccatgaagccaaggagaccagaaaacggaggtttgaaggcaatatcctaaatcgaggatagagattgttagaggctgtattgatagctcttggtgataggatgtggaagaataagggaaaaggaggattcaagaatgactcccagttttctggcctgggaaactggatagatggtgttgccaaaaatgaatacgaaatatgtgaggtaggttaagataagcgtgatgataaatttggtattgagtatgttgagtttaaggtatgtgtggagggattatataccagtggtgatgctcagtaggcagtttgacacatagatgttaaactcaggagagagatataagaaatcagatttgattcattgctgtgcaagatcagtcattgaaaccaagtgtgtgaatgtgtgaatgaaaataacctttttgttttttttttttttttgagacgtagtctcgctggtctcccaggctggagtacactgcagtggtgcgatcatggctcactgtaagctctgcctcccgggttcacgccattctcctgcctcagccccctgagtagctgggactacaggtgcccaccaccatgcctggctaattttttgtatttttagtagagacagggtttcaccgtgttagccaggatggtctcgatctcctgacctcgtgatccgcccgcctcagcctcccaaagtgctgggattacaggcgtgagccactgcacccggcctaatcttttcttttaaactcacacagatcatgatttgatccatcctatgatgaaaggaaactctgtaggtcttaggataaaagagagatgccttccctttcaaatactcattcctaaacttttcagtagagagattattcctgatacatttctagatgcttagggaaagtcagtcaatgattatggacaagccagaggcttggctcccattctgagaagttgagccaaagactccaggtacttacttcctttgcattttggaagccagctgtcagaggtgtatgaagctggcacaattggtagcagctctatggtctccacattgcaggagggaatatatctttcttccagttgccccctacacttgtcgactgactggctattgtggcccaaagcaaaggttggcaaataggctttccttttcagagaaaaagaaagaagaattttaaaaaagggcatttttgctaaaatgctcagtgaacttgggtgagtaatttatcctctccatggcttgagatataatgctatctacctgacagcaagaaagttgtgaggatcaaattaatcacggagtattaaaatgctttttaaaatacactacaagcaagatatattataatttcaagcaccaagatctctgggctctagtttccaatacttcattgttccaattaaaaatggtattttacttggccttcgtttactttcctatatatgacagaagtgaccatagacctttcatattttggattgtgcacatgtttggggggcaggatgtgtgctggcttgtagacaaatgcaatgatcataaatggctttagaataagtaagcacttggccggacgtggtggtgggcgcctgtagtcccaactgctcgggaggccaaggcaggaaaatggcgtgaacccgggaggcggaggttgcagtgagccgagatcgcgccactgcactccagcctgggcggcagagcgagactctgtctcaaaaaaaaccaaaaacaaacaaacaaacaaaagaataagtaagcacttaaaaatgctaagtaggtttttatatactacctgacattattcttttaatctttcacatctcttcctctgatatctctttttcttcaaagaattcatgcaagcatacactactgaacccagtcccctgtgaggaaaggggggaaaaatgtcttcctgtgccctgatctagaggcagaaagtgctcctttatttaaattaacaaaacaaaactaacatttttattagttgtctatggttgtataaaaaagcagcaaatcacagtccctgaaatgtctgcagttctcaaaagccaaaacaagcatgaagacatgagctaatatcaggcagacaggctatgccacacagaaaagtaaggaagaaaacatgccaatggataaaagttatttagcccctgaatggattgcctagaaaggtaatttggggcaggatccacggacttgaaatctgaatgaaatagcaagagagatgaatcaggaaacaatggaattgatctgtcatagtttgggttgacccctacaggccagagttcaaacaaaccagtctagaatctctaggtcccttcaaacctcagagtctcaggttataattatatgaaatgcactgagactaatatttttgcaaaccagcctaagacatcattaaacaacttctaagcagaaataaaagacatctgtggtaatgccaccactattcctcagtctcatgggctagaagttgaagtcatcctaccttccaccgctcctttgccccatatatataattaagtcactaagcactcttcttttgaattctgcattttgttattgcctatcttactgcattttccactgctattaccctacttactgcccttatccgcaagctaagcctccgagctggtccaactgcctactgtctctccctgtcaatccattctgcacatagtcactagattcatcctcccttgacattacccttctaccttcagtagttcccccactacctataggataaagttcaaacccttttcccatggaccttaggccttccattatctggcaccaacaacgttttgagtatgatctttctctataaatcctctgctctagaaaaactatttgcagtgtctcccaacacaacctctgcttcctctgcatttacctataccagtattgtagcaagaatatagctcccattctaaactgcctctcaaaatattatctatcctttgagatccagctcaaattctaccttacccaataaatatatgttgcatgtctagtatgcaccaggcattttaaagccttgctagctttcccagtcttttattgctccctcctctgagtctattgagcagtgtctaagtatcacaattggcccttcgtagtgattctcttatataattattagccatttttttgtcttaatgttttttgtacccaagtacactgtaagcttcttgagagcaggatcttggttctgtatttctttcttccctcaccccttactctacaccctgaaagtaacatattgctttgcattttgtaggaaggaaatgtattttaattatttttataacagcatatttccagtcagaaatcctgttgacctgagagagttactacatcagcatcaaaacagcctaaatgaagcagagtaaaagtaaaaccagttggctctcttggagccaatacaattaaattctaagtctagaaggaaaacacatctgttctagtaaaatggaatagcctggagatataaagaatccctataacatataggaggaagaaaaagatgactatagctcataaaagaaaatcaaaccattatatcattgaaataaactgctcctggttttagacaggagaactaattcaaaactttcaatgacttccagttataagttcactttacggttccttgcagattgaaaattagtgtaaagaaggagcaaagaggtagccagcaccagaagaacctgcttctggactttttcttttattccctttccctccttctcccactattttctccctgctacatctccaactaccactagaccccctacacacacacatacagacgtttttaatagtcatgtgtgtgtgtaaacaagtgtattagctgcctttgtaaagactgctcttctctgtctccttggaggattccagttaaggagggaccacagccctaaccccaaatcaaatgccagagactctcagagtcttcctgacctgctctgccttcacagctcctcctcttcttttgcttcaactctgtttcaggccccaccctcatctcagatctgaagactaatatggtcctcagttttccccctcagtattcctcctcagacatggcttttcattctcccttagtttcaactcacgcttggcctcccaatgaaacaagcctgtttttatatccaaggaccatctccaaggatacccccaggacttgtacaccacagggaatctgacagggctgaatgctgatgttcagtaggagatgaagataccctctctcaactcttgtctcttttgccaccctttctgtagccttcaacacagatttgatcaaaatggatcttggccatacagtaaacagagcttgatacagtccaagaaactctgtgtatgtttaattaataaacagttgttgaacagcttcaatagcctataagctgaatcagagataaatcaggacacagtcaacccaggaagtgttatccccaacattggaaagaagtttctaaggaggaaacagaaaattaaggtccaggaaatggccagttgttggagggtccagacgaaagccaaggctgagccaggaggcattttcatctaagagtccacaaaattagaaaaccaagaaagagaggttttattttccccatttcacagaggaactgtagaggcgtgagttcaaagagaaagcatattgcagctaacaaagcaacccttttgggggaagcctttccaactaggttctgttgatggttttcagtcatatattattttggtggggggaggatattcatgcaaacaacaaactgcagttagcaacatatcatattgcacaaagtgatttacaataagaacttcgcttgggaagtgatgataggttcatgtgcacccccagtggagaaacactgagttaaatcagagggatcaatccaaccaaacacaggaaccaggaaaccccaatgtttttgacaaagaacctcagataacctcagaaaagattctttatttcaaatctggtcatatttaagtaatttattatgctaaatatattacatgaataggagcagcctcatgttcattaatattggaaaacattacatcttagatccttcaaaagaatattactattactcacaacctcactttattttgtgagggaaatatcttttatttactcttgttttaagttctgaatagatgcaggttgccctgggtggtcacctctccctgaattggtatataattttgtcattctcaggtagtttggcaggagttgcaaatgtaaatatcctcaggtgtcaggcagtaacataaaactgtgaaactatggggtaggagataactgggagtagtaaaaactgtggtgatcagcagagggcatgcccaaccaagaatttaaattcaaaactttttaaggccacatgctggtcaaacatatgtttctaagttttggactcaacctctggcacctagttttctatctctggttaaaactcaaaggaaagagggatgggcttgataagtcctcagtgtctttcagctggaatatttgtttattttgcattaaatgttgcaaatcaatcagaaacccctttactggacagattctaagtggaattcagtacaaatccattttctcataccttaatatcacttcccttattctattcttcagaataaaaaaaattgcatggttttcctttgactgaaacatcttcataaaatttcctttatttaccatcaacattggtccctaactgctctctgtgagagctactctggcattttggagactatagagctgatgccctaacttggtcctattctgagaaacacataggtgaaaatttggaaacaaacactttagcctgagtttatgatggtagggatagatgtggagatttggggttatcagaaaacccccgacttggtgttggcctctcctttctacaccttcctaaccttccatcccttaaactccagggtgatataactcagaagctccagaaaacaaccttgtccactgagtgcatacccttaaccaggctctttgaatgggttttacgtcaagaatctgaacagttctagaaatggaactgcgtcatgtggcagagactgtagcaaccaaaataacagtaggcaaggagaagctctgctgcccatgcagctgcagagatgcttcagatgtacagtttcttgtagagcagagattattccatgtgttgtgcatagaatagcaccaaacacatttcattaatgctgaataaccacccagagaggcagaatgggcttcattagatggtaaaatccaggagtggcaatgcaagatgtgggtggtgaattggggttctcatttcaccatatttggggctcctcagaaactagtgaagctagttaagatttaacattgttaaatcagaattcaatgtcactttttgagaatggaattaacatgatggagagagtttgataaagagtatcttggtaatcctacctgttgtgtttgagagacaggaagcctagtggttaaacccagaggctctcgagccagtctgtctgggttcttctaattccaactctaaggtcatctgtgaggccttgggcaatttgcttaacttttctgtacttagttccttcatctgtaagatgaagatcataagatccaccctatagtattgttgtggggcttaaatatgaagcacatagaacagtgcctattatgtaatgagtactcaaaaagattattaaaatgctttcctcttaaaagcttttaagaataagaataaagttgatgctcactgtttaaagatttgaagaaatcttaagcaagtcacatcgcttttctgagtcttagtatcctctgtaaaatgggatgatgagagtatatggcaagatgtttcaagcatttttttggtagtacaaccttttattcaagattaattgatgcttctttttatttaaatcttggtataagggaataatatcctacatatgccttagatacttttagtccacaagactgagagtgacgctttcctctgctatttcttggtttcttaaccctatgacaccagaggcatggaatgcccccagcttatctgctcacaccagctgttaggggacagtagagattttcctttagagtgaaagctgcaacaagcatctgagaataatttgttatttatcaagtgtttccttttgttcaccatcaaacctgacactggtcattggaatcacacaaaccagctggtgagtaaaaacactgagtttagttttggcttgcttctcatcctggcctgttatactgaatgtcagggtaagtctgctctgaagcctaggtgacgagctccaagttaggagagaaaactctaatattattctttcttcactgggtaggggctctggagaaatcactttacctttgtaagtctgaagaaaacagagtttgcaatcactgtccctccttctctcacaaagacactacacagagagcagaaacaagaatagacccagggctagagaaagggcaagcaagaacaggcataggtggtggtctctctccattaccatcttttgaataaaatgtttctccaacagtggaccactagccccctgaaatgaagccatcttgggtgcttgctaaaatattagattcctaggcctcacccaaacccactggatctgaatctgtggtagtggggaccagaaatttgaattttaataagctcctttaaggattcatttatccactaagaaacttgcttaagaaccactggtctagtcaatcaccagctctttgaatccatctggaaacgatgatcatctatttgagatctcagttatggacaagttagttatgcacagaaaataagtgttaattgtagctggagatgattgaatggggtaaaagggaagattttctggcagtgtgattagacacataggaacgtggaatcaataaaagctgtagaaactcagcacacatttctgttttgaaaataagatgactaagtttggtaattcagggaaaagcttgcactatatgaagcttgaactacctgaagggaggttcatatttctgtctccaggaataataataaaaaaagtgtaagcaaaaacatccctttaattgtgctgtatacatttcttgagtcccttgaagccaaacaaacttattttaccactaaggaaactgaggtttaaagagaaagtcatttttcccgggtcacatagctagttgattggttacaaatctttattaaatcagtcattgatgggaagacaaaacttacttgatttgcctatctgcccacatttcccttccctcccccaattttgagaagaaaacactgtttctcccactatatttttgccttgcaattaggctttaatgcttgtcagctgaagcagaaactcttctgagcatttaggcagagcgtctaaaggagatctaatgaccctcgtgactgaaagtgaaaagattcaaaaaccagtgtttacagatcttcagctgctctgatcaagccttaaaattgctgaagccagacctttggttgcacagctatctacaggagcagccaaggaagaaaatgttttctgaataatttacaagatatatgagtaaatgtgatattcaattaagcatgtagtcataggaaggaaaatcaaacaattgaaattgccactcaatggttggctgtaaatgctgcctatgccgctaccccactttagagatgcctgctagacactggcaagaagaagacagtgcagttaatggtaaaaatggcccctctctaaaaacagagttagagtgaacatatgccttcaaccctcttaggaaaatgagccaaaaccagccagtaaaatgtagctgcacaggctgcctggcagagaattttcatacattgctaagcagcaaaatgcatagaacatacggtgctatggctggaaaggaccttccagatcatctaattcaactcctttcattttataactgaagaaactgaggcttcagagagggaaagtgattatctcagtatcacacagctggataattggttctaaatattccctaaatcgaactccttggtgtggaagcatgtttgatttagtgagatgtcagaattacagaccactttttaaaatgcatttcttttaagaattctacgaagtttatagagtaaataagtaaacatgtatcccagtaattcacaaccttggcttgttatcagaatcacacggggagacttttaaggtagctctattaagcattctcatgcagggccactgtatacaattgtgcaggccacgcactgcatgagagtgtccactgatggaggtgaatgggggcccaacttgagccactgcacagacttaccaagctatgcaccctgatttagggctgcacctgctcaaaggaagatgtgcctttctctactttgtgaaaagggtcaatatggattagtagcagcactatattcttggctccccacctcacaggtatcactgcaacttcctacttcaccctatcttgatgctccaatatactttgaatcctctcccactcctgaaataggctcaattggtggttgcctcttgtgtatctctggacagaaaaagccctttcaatgtgtggtacaatttctccctcccccttactacaactgtgcagttgtttaatgcaatgactttcaagttttcttgatttctaactcaattactaaaaaaaccctcccaatatatgtacaaatatatatatataaattatataaatgtaataatgtatatcatgtataaacatatatttataactaaacatatgctactgtactagaaacacacaaaattcctttaacacaggcaaaaaggaaaatttaaagtatgtaataaggatgaaattaaccatatttaaaaataatatataataaatatattatagtctgaaaatctttttggctttcactaaaaaattaacattaaactaatgtctttagagagagaaatgttctttaataagcttcatttgttataaaaaacttcaatctttcataatgcagtaatctgaagtcctgattctaaattcagcaatttcaattcttggaattaatggctgtcagccaccccccaccgccaaaaaaaaagatacctcacaaagacttgcagcaaatctgtttcgcctacttcttatcagtttattaattggaattgtgctgttttgacttggtaatgtggctaacaaagagctcatcctatgagtagaaccttctagaagcagaatggcattagctctgccatttccttattattttcttgtgcttacactaagtttctcctcaatccctgatttacttgcatgaaaaattgcaaactacttgctcatttgtgaggattaggttaattaaaactagacagtataatatgtaatttcacataagcaggcacacacaaactgcaatatattttaatatgaggagagtaaatgaaggcatgaggataatttcatcaacccctccttattctggaatttccatgcttcccttaggatccttcccatattgttcatgacatgtgactggcttagttcctccaattcccctctgaactcgagtcctcaagtttcctcatatcctgtcctatggtaactacaggagacattacagcagttaggaggaaaacatgaaccagggaggacttctcagtggaggctatatctaagctgaacgctgaataatggggaggattttcaaggagatggagagagagggcttctcaagaggaggtgacagtatgagaaatgtcataaatagcagagtggttatgttctataggctttaaagacaggtagacttttgggttcagatctctagttctggctgtggtcttcacctctctcacatgtcactattcaatctctatacccacctctctcacgcccaccccatgaatcagaattttggaacatggcaccagagtatctgtattttttagggcagttttgagaactgccatgtataccatgttcataactatagttatgtagtatgtttacccacatcttgaccctctctcttgcagtattgtagagtggctccctattacctattgagttacatcctctgtccagcctccagcaccctaactgcaaccacctcatcttggtgtgctaccatgtttccttgggcccttcaaccacaacacattccctccttttagtattctttaacatatgataatcccctactttgacaattcatccccttccactaccaatccacatcactcccttcaaggctctgctcagaacacattgccccaaagaggtactctccatattcctctgctccaccttgcctactttctaatcccacatcacctcaaagtgttataacatctttgtaccacaatcaagcctcacctattttagatgaattgagcattccaatggatgaagaaaaagatcacatttgaagaatatggaatgtatcttttaaatacatatatccacccataccactgactcataaagtattaccaaatagtagcctagtcatgtctgctttattcagatttggtaaagctataatttgtacaactttagatacatgtaaatcaggtacatgtgagctaattcaatatatgtgacctaataggttacttaaaaactgttttatgatgttaagcacactcctatatgggaaggctggaacctggttccatgtctatctccctgctgtctcctttcttcaacctcagggaaagcatgcacttgcagtgctcatcatttttttccacttagttaataacaccaagaaattattttatacacacacacaaacacacatgctttcttcctcccccttcctatatctccattcaagccatcccttacaccaccaggccatctattacaccaccagcaaaatctcttcaccactcacctgtacagccccaactagtcattcctcttagctctcaataatggggtaaaaaatgtgcttttgagacactaatattagtactggtgccattaacctattaagccctttcaatgtaagggaacagcatttattaacactaactacagaccaagttctgtgatagatgctaagcatacagaacttcagttagtcctcactacaacaccgaaacataggcaccactgtcaccattttataaatgaaactgaaactcaaaatatcgaagtcacatagctagacagtagcaaactcttcatttctacaagaaaatgcatgccaggttccccaaaccaatttaaatatcacattctggaatttgaaccatttaaggatttgtatacccacgagtaaactcctttgaaaaatgtgtccatttaatacttccagttagactgctttctccttgagtacactaatgttgtcattaaccaacaggttttcttcataatgtcaaatatttccatctgatttatcccctgactcattgctaccccacccctcagcttcatacttcagtgggtgaggggagtcacttctataccacaaaaattatttagaacttttcataaaagttttcctggcacacaaaggcagacatatatgccaatggaatagaatagagtacccagaatcacttatatggccaaatgatttttgacaagagtgccaagaccattcaatggggaaataacagtcttttcaacaaatagagttgagaaaagtggatatcaatatgcaaaagaatgaagttggacccttaccttacaccaagtacaaaaattaactctaaataaatcaaagacctaaatataagagttaaaagcacagacctccggggggaagcttcatgatattgatttgaaaatggtttcttggatatgacaccaaaagcacaggcaatcaaaagtaaaaacagagaaattatactacatcaaaatttaaaacatctgtgcatcaaaggactcaacagagtgaaaaggcaacctatagaatgagtgaaaaatatttgtaaatatcatatctgataagatgttaatatccaaaatatataaagaactcctacaactcaacaacaaaatattccccaaaaaaatcaattttaaaaaatggacaaaggactcaaatatatatttctctaaagatatacaaatggccagtaagcacatgaaaagatgaacaacatccctaatcattaggaaaatacaaataaaacccataatgagataccacatcatactcattaagaaggctaatttaaaaaaaaacagtaaataaagagtattggtgggaattggaaatattggatcccttatgtgctgttgatgggaacgtaaagtggtgcagccactatggaaaacagtatggtggttcctcaaaagattaaaaatagaattaccagagaatccagcagttttgcttctgagtatgcacccaaaataattcaaagcagggtctcaaagagatatttgttcatccatgtttatagcagcattattcacaatagccaaaaggtagaagcagctcaagcacttgttgacggatgtgtggaaaacaaaatgtgacatatacatacaatggagtattattcagcctaaaaaaaggaaggaaattctgacacacactgcaatgaggatgaaccttgatgacacattctaagtgaaataagccgctcggaaaaagccaacttctgtgtgaatcaatttataaaaagtacccagtgttgccaaattcatagagacagaaagtagagtggtggttgtcaaaaactaggggtggggaaatgggaggttgtttaatgggtgtagtttcagttttgcaagatgaaaatagttctagagactgattgcacaaccatgtgaaatgtacttaacactactggactgtgtacttaaaactggttaagatggtaaattttatgtgatgtgtactttatcacaatttaaaaaatagttttctggcaaagctggcttcaagatcagttggagcaatgcagaagacattttttttttctcatgagcattaggcttttgtgttcactttcatcaacttttgaacagatgaacattgccctggaaaacacctctaatttctgctctcacttattgaggcagacagtggatggggaaagcagtggatcttgagaagatacaccgttattaggcagggtttcagcagaaaacagaattcaccccagacagtcaaataaattgtaataaagggaatggaccaagggctgtggtaatgcctctgtggtgaggcacccacatactagcagcagtaggtatccactgtcagccccagaggtggaggaacaagagaaggaaatagtaggaaatgaaacctcgaaggagttacctggcagaagcagaagtcctggcaccaaggaaacagcatcaatgcagacaagaaatatcctgacctctatctcttcccacccttcagtcttctggagaaaactcccattggctgaaccagccagcaaagaacccaggttatacattctgctgcagttagtttctcaaagcacagagcagggcagagaaggacaaagagtagatatcgggtatacacgttgggggtgacaaacagaataagtggcacacttggattatagtcttaggcctgttgctaaccatgggaacttagagaagtcagttaacgtattttgatttttggcccacttagaaatttgctcatagtaacccttgtcttgcccagctgatgggctctgtgagtctcaaataaaataatggatgacagactcctttctacccaacaaagtgctattaaacatagaaaaataatgttttttccactctttcctcggtccttctctcctctacctgagaaggtcaggaaacaacatagcagagtaggaaaaactaaactggcaggtgggagacctgtgatgtcaagcaagtaagtgacttttgcactctgagcctcagttttcacatctataaatatctgaactacatgttaatattaatgccctttctgactccaatgattttcttactgaagagtaggttagcaagatgtgcacaagaccatgcacatgtgcgcacacacagtcctttttcttctgcctcaagtcacacacacatttacacaaacctatatgtttggctttcatcaaaccaatactgctataaatgagagcaggaaccagggcattaattactactttgtctttcatgtcataccatgtgagagccctttcctgggataatcgcctaaggcagtgttgcccaacatgggttccttcagtatgttaacaagtgttacaagaggaaaaagtcaattcagtatcgaaaatgctgggataacaaagcagcacttctcacagcctttgtttgtttgtttgtttgtttgtttttgttgttgtttttgagatggagttttgctctggtcaccaaggcaatggtacaatctcggctcactgaaacctccgcctaccgggttcaagcaattcttctgcctcagcctcctgagtagctgggattacaggcacgcaccaccacgcccagctaatttttgtatttttagtagagatggggtttccccatgttggccaggctggtctcaaactcctgacctcaggtgatccgcctgcctcagcctcccaaagtgctggcattacaggcgtgagccaccacgcccagcctagcctttaatattctaatgtacattgtgcatctctgagagggtagtaaagtaaatggtgggattttttatttgccaaacttatttgactgtagaatcctcccaccaccctacccacagcacctcaaattctttggaatgatatgaattgttggaccaaatcctatgttcagacagcctttctgtacattcatgcttaggcccaaaatacattttgttctatttatacattaagaatatatttttattttaagtctcagctactcagaaggctgaggtgggaggatcacttgagcccaggagtttgagcccagcctgggcaacatagcgagatcctgtctcttcaaaatatatatatatattaaatatataaatatatatttatgtattatctattaattactatataattaattacatattttgtatagtatatatatgtgtgtgtgtgtgtgtgtgtgtatatatatgcgtgtgtgtatatagtagcctgtaatacatgctttgtctctcagttcctgccttggtgccccatgcagttggtggtgcttccagatgaatatggagggcagggcagcataagaaggcatcattccttacccaaatcaggaataggcattccagaatgtctttaagataaggcagtctcttggtatttggcattgtttaggcaagatgaaaagttgctgtcataataacaattcacaaaggaagagcagtttacagttgcagagagctttcacataaaccatctcatttctaaaaactgaggtcagtaggatcatcttcattttacatatgaaaaacagcaagattatttatctcttgcaaggttactcagcagagccaggactcaatagcaggtctagaacttctgtttccagtgcttcttttaatgaaccaagatggaaggcagaaaggctcccttagctttctaatgacccaaactcattggccacacagtgctgagcattctgctgttggagaggcgggatgaggttgccctcttgcttccagggagggagggacaaagagtatttttttaaagctttccttttattgtttgtttttctaatctcatgagttaaccatgctcattacagaaaggtcagaaactacaaataagcaaacaggagaaaaaattaaaataccaataaacacctaccaattcagacacaactactgttgacaccttggtgttccagacacttttctatgcatgttagagtctatgatacgttttctttcatattctagtgtttctggaattgggctgtatcttctaattgatgttcatagctgatgtggtaatccttccctccctcacaaatatggttagggttatcatactgatgatgtgtcttaaaactgtggcatctcagggtccatgagggatcttatatttttcccccaaattatgtcagattgctgttttgaaacatgcttttatcactcatcactctcccctcctttttttttttttttttttttttttgatacggagtcttgctctgtcgccaggctgaagtgcactggcgcgatcgcggctcactgcaacctctgcctcccaggttcaagcgattctcctgcctcagcctcccaagtagctagaactacaggcacacgccacgacgcccagctaatttttgtattcccctcccttttatttcttggcatgatgccatgtcagtagatatttttctaccaaaagtatatttagtgaatgcaaaaccactccactgattggttgcactgtattttttttaaccaaacacctattgctgagcatttaaatcatttacaacttttcccaactacaaacagcattggcgacagatattcactgaagaattgaggttatactaggtgccagacataatactgggtgctagagatagagaaatgaacaaaatagatgtggactcaaccctccagaagttgatagtctagtagaaacagcgggcattaaacaagtgaacactttcatgtatatttgtagagatttattaaatatcaaacactgtgaaagataagaacagtctttctttagattagacaatcaggaaagggctctctaaggaaggagtaattaagctgagatctgaaggatgagaaagaaatagccagtgaagggaaggctgcaccaaactagactcccacaagtacagcaggaaatgcccactctcttgctgatatggaataaatagtctcctttttctttaccattctgctggaggatgaaaggattctcattattttttaattagcattttacaaattatttctaaggttgaacatgtgttcttacttcatgtcgttttgtctccctagaagagcttatcaataacactgtattcactgctgtgacgaggtcatatctactatacaccacagcataaagctagggcaatggctgttgaagtgtgctccctctggaacctccagagtatatcagcatcacttgggaacttgttagaaatgcatattctcagggcctacctcagaccaactgaatcagaaattctgggggtgaggcctaacaatctgtcctaacaaatcctccacatgattctgatatattataaagcctgaaaaccactttcaagaaaatattcaatggatatttgtggatggatgcagttccaacatcctaggatcctaggatgctcctccaaatacataaatcagagaatatagacctcaattgaagcacaaaacagagttttgtgctgaaaagtttgtgctgagagttcattcatttatccagcaaatatttttgagcatctactatgcttaagaactttgctacatactgaagatttaataaggaaataagacaagagtccctgccctcacaaagctaatcgtctagtggagcgattccttctcaaagtgggatggacggccaaggaaagttctagcatgcactgtttttgaactcttgaaaagcaaggaaaatggaacaatggtaatataaacacattgtggtcaggataagtgagacaaaagtgaaaagagagaagcggacagagatggtctgtccatcttggtcctgctgagtctcctctacaaactgctccagaacagaggtagattccagatgggagaaatgccaaggtcctacacagttattattattcacatatttctctaaattgtatgcatcatttcccttttctaggcagcatagtctcagcttccttagattcctgaagtgtgccccaaggatttgtagctctatgttaatgtgatacataaaatagagtcaccttgacttcacatttatctggcttatgtaagctctaaccttttactgcagtgcaacagaaatgccagacccattttgtataggcacataaacaaatactctgattctaaataatatattggggaccctggtgactatgagagcatgacagcctacagggagttaggaattaagctactgatccaagctctggtgtggagggaggcaccaggctctggctccacttcttttcccaagaaaactgctcattgcagtaaagtctttggaaagagcttcagaatttttccttccactggctataaatcaaggaagctatctagagaaggggtctgatgagatcactcacccaccaagtccaatagccttgaacaagctctttataatcctttcttctaatctaaaagaaataaagcaaaaaaaaaaaaaaaaaaggtgggggtggcggtagacggggctagttatgaagttatgatgcatctagttttctttcccccctagagcagggtttctcaatctctgcactcttgacattctaggcaacataattatttgttatagggctgtgcattgtaataggtttggcagcacccctggcatccactgactaggtgccagtaactcctcctcaagttgtgacaaccaaaaatgtatccagacatcaccaatgtcccctggagtgtggggagggaatctcctcaagttgagaaccacagcactagaaattaaagcagttagaaatcccagatattaacccctggaaagccacgtggactttattttcccagtttgataaatcgaatcagtttaaatacagaagacaccactcaacggttcacaaaaataatttggatagttatctctctcccacttataataaacccttaactgcctccattgactttaaataactcaacattatcagagcaatgaggtgaattactgagggccaacaattgagggactcaaaatcaagttataatgattactccttgcaaatgtataataattcatgttttacacatctgtcaatttgaattcattttaactttcattggttatttctgtgtgccaggggcctttaattttcataccacctatattagttttctgtgactgctgtaacgaattctgcttaaaacaacataaatttattgtctcacagttctgaaggctagaagttcaaagtcagtaccactgggccaaaatcactgtcagcaaggccacactacctccagaggctctaggggaaaatcattttcttgccttttccagcttctggtggctgtcagcattcctttgacttgtgaccacattactcccatttctgtctccaaagcaaccttacctattcctcttctacaggtcatcaaatctccctctgtccccctgttataaggtacatgtgattgcatctatggcacatcagataatccaggataatctccctgtttttaaattcattatttgattacacctgtaaagaccttcccccacaccccatctctttgccatgtgaggtaatatttacaggctccagggatatggatatgggggaacggaaggactatctattatcagccaattataccacccttgtgacgcaggcaaagattaatatttatagatgagaaaatagtggcacaaacaagttaaatggtttataagaagttacatgctgtgagagattggcacagatgggacaagaatccagggcttctgactcctcttttgaattacccatggcccagaagaatagaaacctattctccccttcctccagcaaacagttaaaaggcactgtgaagttagtataatcatgaaggattagaggatggagtttacaggctagcgaggattctggaaagcctcatatcattctgaggggcttaggggtgagaaatcacacagaattttccaagatattagaatagcacaaggaaaatgaaaggagatgatatggtatgagaagaaagcaaactgtagccttttaatattcattgagtccatgacagcataatgtttcacctgctatttagcatttcacattggcaacactgagtagggcatatgctgtgtataattttatgaagctctttaacaaaatagtctatggttgaattttcacaatatctctgtatggaagggcagtcattatcatcattccatttcataggtgaggaaactgaggtttggggagttaagagattttcccaagctagaataaaatccaagcctttttccttttatgataattgtcttttctaattattgtccctcatgtaagaatgatatatacaggtgtctcataaagttataacccatagctactgagttatcagtatagatgacaaatgttactttatattcaaccttcaggagacccagtacccttcaggcacttttcatgtaattcagatacacaaacaacaggtggcagtaagtgccttaggtaagtgatttgaatgaacaaatttaaacttaaatatacttattttaaactatgacaaaaatggtagattttcaggatttccgttttattgtttacagttgctagtctatcttattctatgcaatatgttcagatgtgtttaaaggtcaaatgtataaaataacttcaagaaaataaaaatctgttatttgctgtctttcaaaataattcctgctaactgcaattaaactaaagttttgtcttatcctgagactaaaattagaatattcatttccactttactctaaatatttttaaaatctaacttcctcctgattttaaaattagattttaaaatctaatttcttcaagatttctatttaacttactgacaaaagagccatgggatcttttactcaagtggaaaaagcttttatcatttcccattttctctctaagttttcagggaaaggacttaaagaatgaggaaatagtaggcaaggacatttctcctcttgagttccctatctctagcttttttttttttttttttacctcttctcaacagagaaactatcaaacagcagtgtgttaccactgaaagtacagagtcttttaacttttttttctatcagaatgaagtaagttttcacgctaggtcttaaaatgatagcaactagcagcattccccttcctgtttatcacatgtaaatttcaagttacactaagccagtagctacttttggaaatacgtgttaggaaggggaatgctgctagtttaactacctgtaacatccacacagtggcttctgccacagataggctccttttttcaaggctaagagatacaaacatacagctcacaccaacacagcaaatcaaagaacccgcacatttaagtactttttatacgaaaatgttcatttgttacattaaagatacactggcatttgtagtaaacaatatccacattgtcagtcaactttaaaagtaacactaatctagggttggctctgcactagggactttgagaactcaggagaaatgtaaaccacagttcctacctcaaaagatttacagcctaattgaggaggtggcatttctaaatgatgcatttgtattatatatcagtataacatgtacataagttcatattcaaaagaatggttacagataccatgaagtacagtggatcatggtagaaaggaaggtttcatggagaagaacttaaagggtgaatatattttgcataagcatataaaagaggcaagaatagttcaggaatagaataagtctcacgaaggcagggggttgagaatgaacctggtaggattgaaggtcagatggcacttgcctggaaggaggggaaatttggtaaaaaaaaaaaatatagctaagatatattacagtcttaaaggtagagagtttgaaaaatatgatcagtttataatacttttcatctgcccctatatagaggctggatctaatagttaaaaatgaaagtttaagccagagtagtagttaggagtactggacagaagaaaagccaggtgttgggaaccgaagagggctaatccatgagatgagaagaaaagacaggggccatgaccttgaggaggtaagctacaaaggatcagaaagccattagcatgaatagaagcctaacaaaaatttaaaaagggtgatgagttctatttggcatggtgagtctttaagagtgatagtacctttacaaaagaaaccacagaagatgggatcccacatagaagaagacagttaaaggaaaaagcatccttgcctcttggagcaactaaacacaacccatcattaacatcagagtccccaggtccaatgtggcaccctttatttttcctccaaatgttcagcatcgtttatcttcctttctcgcggatcctgcatttaacggctgtcacattgcttgggaaacttgattgcaacacggtcatttcatgggcaccagtcagaaggcttataccaaagtccttgcaaaagacaattttcatataagatatgtacttgtcatatctgcggtgagcatctgtcagtctcgtcataggctgcacatagagaattagtttataatccttaacactccagcttcccatgctgctcctcctgagtggattgagacatgcaaattaagcttgttttatttgatttgcatttgagtaattgcctactgtccataaagtaatgataaaacaaaaaccttttccaaattgaccagcttacctaaaaccattgagaataagagagagtcgagctataaaatgcctttcagaaataagaggagccacgttcataaaacacattgatttctttcctactacagagctataagcaatattacctgtggaaaaaaaatagatcagagatttctgtcattttcaaggcactggtccggaaatcggcaaacaaaacttcagcaagatctcctaaatcctctttaccagctgaagcagttggttgcattgcaaatgaaaaattaaaaagataggatcttcaaggtcaccagggagactatgtcgaccccttacccccagagttgtcagtagagtatagcagttttaaggatgtggactggagaatttgactgctggtgttcaaattcaggtctgctcaccattaactgtgtgagcttgggcaagttatttcacctctctgagcctcagtgctctcctctgtaaaatggagataacaatatttcattcacaaagaggattaaatgagtcaatgtatttaaaacacataacatggtgtctggcacacggtaagtattcaatggatgttatgattataatttcaatttctttccagccatatggccctttgtcatcagtttcataggtcttagcgggtaactataattctaatgcttataattattaacttttctttatacaaaagacatcacttatgctcttgtgccaaatgtagcagatgctgtcataccaatacttttttacccttaccacttcagtgcctgccacccccaaattcctactgccagcacctgcatttctttccctggggactttttctggattccaaacttgttttgccaacttgtatagtaggttggaaatgctgagaaattaatggccccaaccaaagactgataggagtcagcgtactctcacctctcaggtggggtaactctgaaggagatgtcttacactgcctccaagactttcccctgaagacttaagccccagacactctgtctgtggcagcaaatgtgataatgttgtctttaacacgtgcttacttgtttcactgctccattcttctatcactatttccttcaactctgaaacaaactacttatacttgaatccctgtctcagagtatattcttgtgggagcccaaactaagatcttctcacaaacctgtgagataattaagggtagacatcataattttgcagtttcagtaagaaaaccgagttgcagttcatgtgggtagttggtagaagagattggcctagaacccatgtctcttgataaactgtgttctttttctgttaccaagtatatatcacagctttttccagctgcatgcagactaataatgtcagtaattccctattatcttcctcctcattgtatatcagttggcctctgaaaagtctgtctggaccaagcaggaaatggtcatattccagctgactcttatcactgaacttccctatgtgtgacatgcgtatttatcagtttatactttaagtgtatgatcttaacaagccctctacctaatgaacactacattatctgccagagtctggaaatggattgttctagatcatcaagagtctagctaataaggaagttctgaattagctggaactgatttgtttttaacgtagcacttagcatagcggttgcactaaaaacacattaaggtccctttgatgatttggtctcaaggtcatgtacgaacacatcaattcttattagattgaaagacctacaaaaggttgttttatctttttaagactttcccccacaacccaaaaggaaggtacccaataaccctgggtaccataactgaaaggctacttaaatagagcatctgttagatgtaagagtacaagaagattctgcccattgagggctcttatttggagagcctccttaattaatggccatctggtcccccatgaaggactataattaagaaagcaatgtaggagcagatacatcagttaaaaactcgcctgtgcttgcctttcctccaagatattcagtagtcaggtaaatgccaaggtcacattgagctatttgtctttttcataaaaaaatggtttgggtgcagaggttgggataaaataaatcactgattgaattaagtggcagacacaggacttgctaacatctgaatgcccctcactgactctgattcagcagagatctgctgttttcgttgtccctgtttttttccagttgattttaggctctgtatgacggtaatagaggcaccctggatagatgaaagaactgaccatccttgatccttagctttgtcaaaaggatctgcacatgtccatttttactgcaaacatgagggaaaattcctgttgtggttattccttaagataataaagatatgttcttcacccaagctcccagagagcatctgctgagttagaaatcatctctattgcaatgttcaaacctagggatatgaccaaaccatacgcttctctaagtatttgcaaaacaacaaaaaacaaaaggagtggcaacctaccccttgctgtctaatgtcctccatctgcaagacctccgggtgaaagccttaagagccccaggcattaggtacagagtgttcctattatcagaaaatggggttgcagcaaatggctacaagccactagtatgcttaaattatagccctccctcagctatgccttttatatatttctctgaaaaaggtgaaataataaaagtatcattttagaacagtggagagcaacatgaaacacattgtcaactacctcctggctttacagtaactttaatgttactgtacaacgtgacccttcacctttctgaaccttaccttacaacaatagcaacattacatacctgtaacataactaagaaccaggaggtaagcaaagagggcatctgagcaccaagtctgtgcactttaactcatgtgcttccttaaaagtgaggccccataggctgggcgcggtggctcacacctgtaatcccagcactttgggaagccaaagtgggcagatcacgaggtcaggagaccaagaccatcctggctaacacggtgaaactccatctctactaaaaatacaaaaaaaaaaaaaaaatagccgggcatggtggtgggcgcctgtagtcccagctactcgggaggctgaggcaggagaatggtatgaacccaggaggcggagcttgcagtgagccgagatcgcgccattgcactccagcctgggcgacagagcgagactctgtctcaaaaaaaaataaaaataaaaaaaaagtgaggccctataggacttgattcagaatctatatacatttgcattgtatgcataattttaaccaagtttgaatgttttatttccagtctcaccaaagattagagacatcctgttaaaagctagtcagtggatgttaaaacaaagataacagaacacctacagcacagggagagaaaaactacggaaaagctggcaaaataactctgcagtcagagaacattcagtgtttgtgcaaacgttcattcttacagcctgtaataggttctgagggcattgctggatacagcacactgaaaagctgaaaatcatagtgtggaccttgagtcatcaagaaaagatgagactgtattccatacagtctgcctaaggaggcaacgaagtgtacaatacatgttagaaaacgttctaacaaaagcagttaaattaaaacttgttgaaatgtaacgacgtaaatttctacaccagaaaactctactatccagaaagattcctttttcaaaagctccatctcttgctgaaatttcaattgttctgacttcatcatttacagccttggtcatctcttggtggaagactatgattttgcatctcatactcccttttgcagtggaaaaatacatgtgcatggttttgccaagtttttaaactcttggaagaagggggaatctttatttttaattgcatattttgtatgcttctgggggtcacaaactgtccccattcttatattatcagtgaatttccaataaaaaactagtgcaaatttagacacctcccaaaatgaaggaaaattacccacaatgcatctttgcagtagaaggttggcccagttagattatgcagcaatttgtgtgatttctcatctggacactcagcacttagttcccatttcacctctaccaactgaagctttgacaatttgtctgacaagtccataacctaacttttttttaaaaaaatgcaaaagaaacagaagctacctatgtttgtaaggtacagttcagagattgtagaaaagggtaagagtaatagacccagagcagagggaaacagaattaagacaagaaattgtataacttagttctaaaagctactgtgagggctaaaaagggacctataggggatggcaatgctggaagaaagatttagggggaaaaagataaggtcaagagggcaaaagaaaattggtatgaatgtcccaataaataaaatagtcagattctagaggaagtagccagtacaagccggatagagcaaatatgattaactatttttgccaatctttggtgacagtggtgcataggggcattagagaagcagcaggtataatctttgaatggatctgggcctttagtgttaaggagtccagactagaaaagctaggtgaactgtgaaaaaaggataagtagggtctaagagaagatccaccaggtaaacctagaataccagaggaattacctaggatgataggaatgtaacatttcagagctgtgcttaggaaagaagtatatttttcactgaacaagcaatgtttacaattgatagagaaagaaggaagaaagaagaaaaaatgacccaaggagataataaatgcatcattgaaagcaattttgaggggacacattttgaaagaagactgcaatttagtcaccagactttgcttgaagccttgctcaatttcctttcccattgccttgatcattagtagagtctttctcactactcagcaacagtcaaatacccatgagtatcctctaactctaagcaagggtttctgtgtagggaagacatatggagaccagcgttgcttataagggtctctgtggagagaagggtctgtagttggcagaagtgatagtcttctcaagccaagccttacaaaacaagccctggattcagtggcccagataactgtttgttggtaagagtgacatcagcaaaatagcagaataggcagctccaaactcccattgctccacagaaacattgaaaagcaagcagaaactgtcacaaccttgtcaaaactctggaaaatagtcaaagatgtacagaaaccaggtatatgctgaatcaagaaaaaggcaacttcctacacattaggaaacttttgtggcatttattccagctcttgtcccacctcctccctagtttggcggtggtcttgaaggtggcaaatcacatttcttgtgtgggaccctggtccctgattccagagggagtggaacagaccttatcaaaggattattgtgtttgtctgttctaatctatgtatgggctccccaaagggctgatgcaaggcactcatcttcatttcacctaactcagaagtcactcagtgtgaaagtggtggacatttctcaaaggtgttgtaaggcaaatgaaaatcctgtacccaactggggtgaaagattatggttgaggcaaatagtagaccacctaaagcctagaagaaaaatctgggcataaattttctttgggaaattaggagattcaaaatcacccatgtatactggggaattaaaaagttatgcatatccccagagtaggacacatgttcagaaaagacttaagaagactctaagctttcacatctggctgctttctgggctcagtataagcaggaagtgaaggctaaggcagtttcagacagctggctaagtgttgaaggaatgccccaacacagagctaatcttatatatatacatatatatatatgtgtgtgtgtataacatataacataatataggccgggcgcgatagctcacgcctgtagtccgagcactttgggaggccgaggtgggtggatcacgagaccgagatcgagaccatcctgactaatacggtgaaaccccgtctctcctaaacatacaaaaaattagccaggcatggtggcaggcagctgtagtcccagctactcgggaggctggggcaggagaatggcgtgaacctgggaggcggagcttgcagtgagccaagatcacaccactgcactccagcctgggtgacagagcgagactccatctcaaaaaataaataaataaaataaaataaataacatatacacataagataataatcaaagatatattcttcacccaagctcccaaagagcatctgctgagttagaaatcatctctgttgcaatgttcaaacatagggatatgaccaaaccatatgcttctctaagtatgtgcaaaacatatatatatatatatatgagttcaaggacatctctgtcaaagcagtagctaaacacaagataaagaaacagaagacttaactgaccacacgtgacagataatacagtctttacaaaaatagtttggaaaagtaattaaacaaatggatgactctagctttccacaatcaaaaatagcaaaccctagagaaaggggagaacctgatatccagagtagccaccttataatattcaaatatccagttttcaacaaaaattcatgaagcatacagagaaacaggtaagtatgacccattcatgggattgtggggaatagaaactgtccctgaggaagtccattgttagggagatttatagctctaagctcttacatttttttttttttaaaaaaaaaaaaggaaaacttcaaatcaacagcgtcactttacatcttaaggaaatagaaaaagaagaataaagcaaacccaaagctagcagaaggaaggaaattaataatgattaatcagaagtaaaattaaggacataaaaataataaagagaaacaatgaaaccagaagttagttgtttgataagatcaacaatattgacaaatctttagttagactgaaaaaaaaaacgagaagagatattaatgaaaaaatcagaagtgaaagcaacttcattactaccaactttacagaaaataacaaggattataagaaactactatgaataattatgtcacaacaaattagatgacctagataaaatggaaaaattactggaaacacacaaattaccaaaaagatcatattaaatatcatatattaaaacattatacactatgactaaatgagatttatcccaggaatgaaagtgtggttcaacataaaaaaaaaaatccatcaatgtaaaacattacattaagagagggacagagaaaaaccacatcttcatctcaaatgatgcagaaaaagctaacaaacaaatgcatcaaagtttcagaacaaaaatcaacatacaaaatcagttgtgtttctgtacattggcaatgaagtatccaaaaagaaaatataaaaataatttaattcaccatagtatgcaaaaaaatcaaatgtctaggaagaaatttaacaaaagaggtgcaagtgttataccaaaaactaaaaaaaaaaaaaacaaaaaatgataaaagaaattaaagaaaatctcaataaatgaaaagacattctgcatcatggattgcaaaacttaatattgttaggatttcaatactgcttaaaaggatctacagattcagtgcaatttatatcaaaatcaatggcattttttggcagaaatggaaaaccttatcctcaaattcatatcaaattgcaagggtccccaaaaatgtcaaaacaatcttaaaaaataagaataagtttcgtgtgctcacattttctgtttttaaaaacttactacaaagcatagtcctaaaaactaatgtggtactggcataaggagagacatacacatcaatggaatagaattgagagtccagaaataaactcatagatcaatggcctattgctttttaacaagggggaaacaatagccttctcttttttattgagatgggggtcttgctcaaacttgcttgtgggctcaagcaattttcctgcctcagcctccttattagttggaatcacaggcacatgccattgtgcctggcaagaatagtcttttcaacaaatggtgctgagataactaaatatccacatgcaaaaagacgaaattgcacatacttcacaccatatacaaaatggggcagcaacctaaatataagagctaaaactataaaactcttacaagaaaacataagggtaaaatcttcatgaagttgaatttcacaaaggattcttagatatgaatacctaaagcataagcaacaaaagaaaaacataaataatttggacttcatcaaaattaaaaccttctgtgcatcaaaggatattatcaagagagtaaaaagacaacctatagaatgagagaaaatattttcaaatcatatctctaataaggatctggtatgcagaataaagaactcctgctactcaataacaaaaagataaaacctctatttttttaattatactttaagttctagggtacatgtgcacaacatgcaggtttgttacatatctacacatgtgccatgttggtgtgctgcacccgttaactcgtcatttacattaggtatatctcctaatgctatccctcccccctccccccaccccactacagtccctggtgtgtgatgttccccaccctgtgtccaagtgttctcattgttcaattcccacctatgagtgagaacatgcggtgtttggttttctgtccttgcaatagtttgctgagaatgatggtttccagcttcatccatgtccctacaaaggacatgaactcatcctttttatggctgcatagtattccatggtgtatatgtgccacattttcttaatccagtctatcattgatggacatttgaaaacctctattttaaattgggcaaaaaacttgactatgcatttctccaaagaagatatatgtatggccaaaaagcatatgagaagatgtttatcatcattagtcattagagaaatgaaaatcaaaaccacagtgagagagctcacacctatcaggatgtttcataattttaaaaaagacaaaaacaagcattgatgaagatgtacaaaaattggaactcttgcaccttgctggtgggaatgtaaaatggttcagccactatgaaaagcaatttggtagttcttcaggaagttaaacatagaaatgccatatgaatccatatttctactcctaggcatatacgctatgtaactgaaaacaggtactcaagcaagcatatgtacatacattcctagcagccctatttataatagccaagagatggaaacaacccaaatgcccatcaatggatttatgtatggataaacaaagtctggttgattccatatgttgtctattgtgaacagttcttcaataaacataggaatgcaggtatctctttgacatactgatttcccttcttttggatacatatccaatagtggaattactggatcatatgagagttctatttttttttttttgaggaaccttcatactgttgtccataatggttgtactaattcaccttctcaccagcagtgtgtaacagttcccttttctccacacccttgccaacatttgttgtcttttgatttttttgatagtagccattctgactggagtgaggtaatatctcattgtagtttttatttgcatttccctgatgattagtgatgctgggcattttttcatatgcctattggccacctgtatgtctttattggagaaatctctattcagctcttttgcctatttttaaatcaggttattggtttatttgttggtgagttgcttgagttccttacctattttggatattaacctttcatcagatgtatagtttgcaaatgcattctcttattctgcaggttgtctctttgctctgtttattgttttttgagattatatatatatatatgtaatatcaaagtctatatgaaatatatatatatacaatggaatattacctagatttaaaatgaaatgaattactgatacatgctacaacatggatgaacattgaaaacattatgctaagtaaaagaagtcagatacaaaaggtcacatattgtatgatttcattcatgtgaaatatccataataggtgataatattatctatatctatagatatatatacatctatgtatatagatatatatctatttatctatgtctatatctatgataatattatctatatccataataggtgaatttcacctcaataaattatttttttaaactttgctggtgctcaatatgtattttaaatgtttattttttagttaactcctattaacataattaagaatacacagcttcagcaaactgaaaacaaaattagccaataaacaggtgcagaaattggaaacagtaagattggagggaatgctcacagttaaaatgacaataaaagcactgtctgagtttcatagccaagaagcaattcccagatgcctgtccttggtttgagtagagcagggaagctattactcagacctttcattcaaggcagggactggagggagcaggaaataatcctttaattccatgtctcaaggagctgggggttttgtccccttttcttttctgcagaagatagttcattgtgttcatctgccctaggggaacctccggagagttggagccaggatttagaaaaaactaagaaagatcgagatttccctgcttatcagaactcttatggaaagcaataactgtgcttttaatgaaggctgagtagtatagtggaatagacattaggttgtagagccaaaaagacctgatttcaaatcccagctctgccccttaatagccatgtgatgtcaagctatttacttagctgactcaaacttcagtttccccttctgttacatgtagatgtataaccctgcaggatccttgtaaggattaagtgagatagatataaaatacctagcacaaagctgggcacacagtgggtactcaacactagttatttttcttcagtcaaataacagatgtcctctccatcccactccacctctcttgcaaaaatagtaattagaattgattgatgatgaagtatagtaggccaaaatttcaattagaaaggatacttaaacaattatataggtgatggatgcaatgctttttcacatagtaaaacattctgtgtgaaaggatagaagcagattcctccaggagagatcagcaaaatgagagaaagacaaggctgatggacaaatccatcccagaattcctgtttttttctattgtccccacaagaaacaaaagctatccacatcccataagcaatgggaagctcaacaaacagattcatcacaatcatttgagcaagaagagtaatggttttcttatcctccttatgaggctccaggattcggaatgctatagcgattaacaagaatgtgtgtgtgggttgagaaagatgttggttcaaattccagatctctcacttactagctatggacttcgggcaagtcacatatcttcgaggcttagagttctcatttataaataataatacttagcttgtagggttattgtatgtattacacaagatgatacatgtaaagtgcttagcacaatgcctagtacttagtcaatgaccaaaaaatattcatttctgctctctttttaatcacataaaattctactctgttttacagaaaggagctctttttaaagatgaggctatcagctgggtgcggtggctcacgcctgtaatcccagcactttgggaggccgaggtgggtggatcacctgaggttgggagtgccaggccagcctgaccaacatggagaaacccaatctctactaaaaatacaaatagccaggcgtggttgcacaagcctgtgatcccagctacttgggaggctgaggcaggagactcgcttgaacccgggaggcagaggttgcggtgagtcgagatcgcgccattgcactccagtctgggtaacaagagcgaaactctgtctcaaaaaaaaaaaaaaaggatgaggctttcatgaaaacgactcattattctacctttcttctaattttgagtatcatttaagggtcctctactttgggttatatagctacctattattctgtctcaatttgaaagttgagagacagttcactccagttaaaatggcttacaccaaaaagacagtcaataacaaatgatggtgaggatgtggagaaaagggaaccctcttgcactgctggtggaaatgtaaattagtacaaccactacggagatcagcttggagattcctcaaaaaactaaaataaaggtgctgtacaacccagccatcccactgctgggtatagaccccaaagaaaagaaatcagtacatcaaacagatgcctgcactcccatgattgttgcagcactattagcgatagccaagatttggaagcaacctaagtgtccatcagcagatgaatggacaaagaaaatgtggtacatatacacaataaagtactactcagccagaaaaaaagaatgagatcctgccatttgcaacaacatggatagaattagagatcattatgttaattgaaataatccaggcacagaagacattatattacatattctctcttatttgtgggatctaaaaatcaaaacaattgaactcacagacatagagagtagaaggatgattaccagaggctgggaagggtaacggggggttggagggagggtggggatggttaattggcacaaaaagaaaacagaaaaaataagtaagacctactatgtgatagcacaacagggtgacaagagtcaataatacattgcgtattttaaaataactaaaagttgaaaggcaagaagcttttgtcagcagaaaattcaacaaattaaaagttaaaagcaacagataaacaacagatgctggagaggatgtggagaaataggaacacttttacactgctggtgggagtgtaaattagttcaaccattgtggaagacagtgtggcgattcctcaaggatctagaactagaaatacaatttgacccagcgatcccattactgggtatatacccaaaggattataaatcatggtactataaagacacatgcacatgtatgtttattgtggcactattcacaatagcaaagacttggaaccagcccaaatgtccatcaatgttagactggattaagaaaatgtggcacatatacaccatggagtactatgcagccataaaaaatgatgagttcatgtcctttgtacggacatggatgaagctggaaaccatcattctaagcaaactatcacaaggacagaaaacaaaacactgcatgttctcactcacaggtgggagttgaacaatgagaacacatggacacagggcagggaacatcacacaccagggcctgtcatggggtgggggcctgggggagcgattgcattaggagaaatacctaatgtaaatgatgagttgatgcgtgcagcaaaccaacatggcacatgtatacctatgtaacaaacctgcacgttatgcacatgcaccctagaacttaaagcataatttagaaaaaaagaaaaaaaaaagttaaaagcactaagtttcatcccagcttttctaataactagcacagcatctttctgggcctgtgtttgtatatagtgaataaggatctttgaacttgagtattccttccagttttaaacttgcatgaaactaattattcaggccaacaataaaagacaagtcaccactttgctagcaagaagaaaagaaatatgtacatggggatatttgagggaccttgagaagtcaaccagtttgcttaatgctaggatgatttaagtctgacacctgggatagagatcccatacattctttgttgatgttctctaaggtttttctccctgaaagtaagcctctgtgatttatatgtacggaataagtaaagtatgcaaatatcataagtatataatagtcactgcactgatgcagtgaatcaacctatattctgagacatgatgggctctgcagtatgaaataactttgaggtactcggccaggcgcggtggctcacgcctgtaatctcagcactttgggaggccaaggtgggtggatcatgaggtcaggagatcgagaccatcatggctaacacggtgaaaccccgtctctactaaaaatacaaaaaattagccaggcgtggtggcgggcgcctgtagtcccagctactcaggaggctgaggcaggagaatggcgtgaacccgggaggcggagcttgcagtgagccaagatcgcgccactgtactccagcctgggcgacagagcgagactccatgtcaaaaaaaaagaaaagaaaagaaataactttgatgtactcataaaagaggatccagaaagataatttgttatttggtctgaaacttaaacataatctgctctcagggctgagggtgttttctcctattatcaagcctatgtagttaaactttggcccatgtattttgaaagatgaagcataactaaacttacagaacttcccaatcatgcacacacatgcgcatacacacacaacatacacacacacattttcctttcctcctaaaggagacaggatctatttttcaaattatatcagtaagatttgattcaaagaacacatgaattatcttcaccctataggtggagcaatttaccaatactaccaagaatagagcttctagaaggccaaaacttagagaaggtcactaaagggcaagttcagagtctcaggatcaagggcagaaatgtggtaactgttgcttctgtctccctagtccaggaaaaaggcaagaaatttcttcagatgaacagaaaactaaatgcctccatggaagcttgtcctccttgacccaaatttctttctttctttctttctttctttctttttcttcttcttttttttttttcatggtctcactgtcacccaggctggagtgcagtgccaaatatcttaatgtagcaatttctctccacaaggcaatatataatctagaaattcaatgtcatacacaatcaccgccattaagaagctttcaatccagccaggactctacacatacaaatagaagcattgactatagggttccatgatggtcaggaatgagaaaatcaaaattaaaaaacaacaagcatagactataagaactgaaagaggttaagataatctagtccagtggttttcgtactttttggtagaattttttagggttccatagaagggcctcaaactattgaaaaagagtctagggcatttctttgcacctaggaggctctagcttcatgaccttcttttatttaactttatttattgttttatttaacttttactttatcttatttagttctacttatattgttagcagaaagggttccatgaccaaaacaaaatgcttgaaaaccatagctcttattcaaattcttcaattaaaatataaagaaatgaaggccctgaaagggtccagcaatctgtccaaagtttttctgtaactagccaagccatgaagtgttgaagaaaagatacattaccttgtgacatctctgcttctttcaagtgccaaataagtgctggagacaaatcatgtaggtggatacaatcacagggggacttcagtggacagagagtgcttcataagggagattgggcttgaactgggctatgacctgtgaggagagtttcaagagttggaaggagggtatcatggcagaagtacagtctaaatgaaggtgcaggggcactgatgcatccaggagtgctcttataactgtttcttgtggaaacggtatgattatgaaagctgttaaataatattgagaataacactattgtgtgtttgtgtcaggtgagacacaatgaggaagtaaaaccaaaatgcttgaaatgaaagaagtttattactcacaggttcaagaggttgagggtgccaacaggaggctaataggaagcctggggatagcagagtgctcaaccagtggatggggagtgagaaagggggtatatctgtgggactatggctttattaaggtccatgggcattatctcttaggttttcctgtgagaattgtggattggctagtttaaagaaaacacacatgaagagggatcttattcacatgactctggtgttcattaggttttatcatgattaccagctgtggagtgtgctgggtttggggttaatgagatgcggaatttgtgaactatattacaaacaaacacatggagagtggaagttttaactaggtcaaaggtgatgggggcatgactaggttaccaataacttatgtcaggccaaaaaaaatgaatgccaaggcagtgattatattaaacaaatttacgacatggtgttagtgacctatggttcctgctcaccaaacattttgattctcattctgacaaaatctgttgctactgatcttttcagaatggtgtctgtactggaggattctgtcaaatcagctttggtatgaaccttaataagctataatttctataattggcataactggctaatttttcttttcatatccatcagcaagcttagagataaaataccaaattttatcccatatactgaaataccattatttacagtgcgttttgattatctgcagctagacttttttcataatatctgggtacccacttccaacacataattctgtttaattgtcatgaccacaaagaccattcttcctgaaaggcattgtatccccatttctatttaaaagacaccaaagaaagcaaggggtttgtgttgtatttggtatgaatagtttcagggatgattaacaaatgattcttggctaaaagaaagaaatgttgggagttgatattattgcatactagtgatgatttagttgctttacttttttagctttactatggcataggcatagagtgagagagttcattagaataatttctctctttattaaatggaagtaatcccagggaggtgacttacccaaagtcatgtcacacataaattgagtcaggattacaggtctcttaatcattcacaaaacttcctttctctaaaatcaccctaatttgaaatattttctgaagtctagtaagactgcttgagactttctttcatcttttcttgtgctgttcatggagcagcacaacttgactgtggaagggtaggtgtattagtcaggggcctctgcaggcacttattaaaaaattgacttgcatgattatgggggctgagagtcccaagacctgcaagctggagacctaggaaagctgatggtatagttctagtctaagtctgaagtcctgaaaaccaagagagctgattgtacaagttctggcccaaaagccacaggcttgagatccaagaagagctgatatttcagttcaagtctgcaggtaggaaaagactgatgtcctagttcaagtagtcaggcaggaagggtcccctcttactctcagaagggtcagccttttgttctattcaggccttcaattcattgcatgagggccatcctcattaggtagggcaatctgcttcactcagtctaccaattcaaatgttaatctcactccaaaacaccctcacagacacacccagaataatgtttgaccaaatatctggacactctatggcccagtcaagttgacagataaaattaaccatcacagtcaagatgagggaaactcttctttttgtaaagggagatagaacttgggaaatcattagtcttctgtccttccactcatagaatgaccagcatctccaagcaggcaggttcatttttaagatgatttaaaggtggatgaagcttccaagaccagagttcctataaaagagatttctagagattgaaggcaccatttccctaactctataaatgagggaggggtgtaatattgctagttggaactgctctcacccccttttcaatttttatgtatttgggctgatctcaccatgcatttttccctctgctggggtttgggcagagtttggagtagcaaatatatgaggatattcagcaagggaaccataagccatggaaaaacatggaaatatagctgtaaatggaggcagattatagatgcagaatataggaacatgtcaggaaaatagtccagatataggaagttcatggcaattgcagataataatgagataataggtcagagcctgacaagtaatcaatagcagactctagaagctaaatggcaagccaagtccaaggaaagagtcagaatagtataaattgacacaaggctccaaagacaagaagatttataaaccagacaacttctgtctctgacaggaagcctcttatactttttttatagtagtctggggcctgcttgccaggatctagccagttcaggaccaacattgctgcaagtcacagaatcacgatctttgtcagaagtacctgccaaggactgtgagaaacccacaagaggctggaggttggaaacagatttcagtagaaggaggtaaatttgtaaaaagaaggccaaaaagaaaggagacagaaaagaattttaaagtaactaagtcctgtttgtaaaaaaaaaaaaaaaaaaaaaaaaaaaaacaaaaaaaaaaactgctgggcgcagtggctcacgcctgtaatcccagcactttgggaggctgacgcttgcagatcacaaggtcaggagatcgagtccatcctggctaacacggtgaaaccccgtctgtactaaaaatacaaaaaattagccgggcatggtggtgggtgcctgtagtcccagctactcgggaggctgaggcaggagaatggcgtgaacccgggaagtagagcttgcagtgagccgagatcgcgccactgcactccagcttgggtgacagggcgagactccgtctcaaaaataaaaaataaaaaaaaaaatcttcctcaatccccacagacaagtttaacagagggcttcacattgttgtaatcagactacataaatgctaaacaataaaagatagaaaatgttagtattgttgtcagtaaaattcatagcagttaatcttgtcccagtaaaatgttacttatggtatatcccctggccattaacatgtttttatttcttttcttgagcttaagcaaaagtgaagggcattaccagtcgaattttctttttgtggttgtaattttgaaactactgtaaacttttcttcctctcataaccatgccttttctagagtccatagtcccactccatgacaattacactacaaagcaatgtacaggttttagttatgatgttctgtctggaacggtgaatgtgaacactcactcatccatgcaacacaggtattgagcttctactatgtgtcaggcattgttctatgctctggagatacagcagtggaaaaatgcacacaaaactctcctctctcataaagctcatgttctggtgaactttctaacatgctgtttagaggacctgataactaggacttctggcctatcatggtacacacatgaaaaatcagcttttcgtttcaaccaaaagctctttcctctctgcctgtactttaatggtttagtggaatatctcagttttagaaaagcattcctattctccatcaaaaatgatataagattgggaaaaacagaaatctgaatgtgacttagatcatacttcttattgcataaatacagtatatcctacctccatagatttcttgtactcttatatactccagaatgtatacctgggcttgacttcaagctcctgggcctgctgaaaccagaccctttaggggccatcattcagaatctacagatatttactgaacacccattaagtgctggtcacatggctagacacaatcaaatcatcatcccgtttattcctcacaacaattctgtaaaaggtaaagaacaggtattcttaatcttcacagactttcggtttctcagcaagatgtgcaatgacttacccaagatctataaaccagtaagcattccattggaatatgaaaatcattctttgactctatgatcttgcctcccagtgttcttatgggggactctttttccctattgatcaccttcattgaaaacatgcatgccgacataacacacacagtagccttggtctttatttagaacaggtatattcaattatcctgactgttcaatgtctattatttcctttagattccacatttgcatgggaacatcaagtggggacagcaaggtattggtgataatgaaaagaccattcactagtatatgactgagagtttgaacatctttccctattccatttggtattggtaaatctgaggcctgagcagtttctcagtagagattcatgcaaaatcagaggaaaagccccagacatctgtatgagtagcaaaatttatgaatattctattgtaccactggttagtagggaaaagccttcagttatgactcaacctcagaagttaattagatggaagcacctatactaatcttccgcaggcctccctgtgttctgtttttgtttcgtttattctacttgcctactatacttactgtatgggttgacatagtggacatcatttgatattgtgaatccagagggttttgtggaccacgaagtctgttctcaattatatgtaaggatggggaagacagaaaaaaaagagaaaaagctataggtgataaataattcttcatggctcagtggaatcaactgtttgtttctaccccagctcccacaggacctttccacaaagcttctaacaaccagaaagcaaactgattttctgccagtttcttccattctcctgtggccctgtgatggaggtggtaacgaggaagataaagaccctaaagtccagtagcaaatggaagttatcaagtggcctgaagcatcaggcaactagataaatatccccagaagagttgaaaattgactgctgtcatgagtgggaaaagtcagctgcagtcagattattgattattttgtagtagaaaaattatccccagtgtctgaatccttggaaaaatgaacaatgaaaagaaaagattttcaataaataacctaagctgatttgacagggatctgaatcaggcccctgcaaaggtaagaaatataggaggcagccatacctttaaattcagtctttgacagagtcagatatgatcattgacggtcacaccccagagatttcattatttttagatttcattattttttctgcctctgcaaaaataatacttgctcatctcatcacattgataatgtactgtcaacactggagaaacaaactgtgtgtgttttttacattcaggcctaagaatgtcactcaggtaaggttccttcaagaccctaggatattacatttccttctgtgttcctcatcagatcctttttaatggtctaatcagagaactttgaagctcaaaggtaatttccatcctaagctgttatgattactcgccttcaaagacccagaacctctgagtccctgtccttaaaagactgttctcaaataattccatcactacttggtcctgaaagagaaatagagctgtgtctttgcccaagttactcacctcttaaacaattggtttaaataaaaatatacatctgaaaaatggaagattcagcacaattcatgatttaacaactagcattgctgggcatggtggctcacacttgtaatcccagcagtttaggaggccaaggcaggaggattgcttgagcccaggagttcaagaccagcttgggcaacatagtgagaccctgtctcaaaagagaaaaacctagtatattcaatgttagatacgaatgcgaggatgaatccaatgttatatacaaagtagttttctttttctaaaacttgaagaataaaagtgtttttaggctttaagttatttcagaatgcaggtagtcatggagaagatgagaaagttagtttgatgagagattttaagctcatcagatctcaaatgctccattttccagcccttccaacagtcaatagattctagaaagaaaaaaaaataacatgagatggctgccaatgatcactaccagaaggcttccacttgctaggcctccatttcctcatctgaaaaatggcggagttattggccaggcacggtggctcacgcctgtaatcccagcactttgggaggccaaggtgggcggatcacggggtcaggagatggagaccgtcctggctaacacggtgaaatcccatctctactaaatatacaaaaaattagccgggtgtggtggtgggcgcctgtagtcctggctagtcgggaggctgaggcaggagaatggcgtgaacccgcgaggcggagcttgcagtgagccgagatcgcgccactgcactccagcctgggcgacagagcgagattccatcccaaaaaaaaaaaaaggaaaaccgggggagttattttatattatatttaacatgccatgcattccagtgctggcattgccttaattcaaatgccccttcacagttcctgtggctacttcctcaataggctttctctagcttcgaaagaattgcctccttctgtagactcaaagtttcttctcataatttatttctcactgaaatgatggaggcccttgtcagaatttctgtgataggtggaattctaagatggcctgccaatattctcagtcgctggtgtatatacaccttctcccagttattcaatccaacaccaatctagatactgctatgaaggtatttgcagatgtaattaaggtcccaaatcaggaccttaagatggtatgattatctagatgggactaaacagttgcataagcgctttaaaagcagagttttatctggctggtgagagaggaagtcagagagacaggatccagctgacttggaagaaagcaaacatttatcttgtgaactgcctttgggagccacatggcaagatactgtgggaagcttctaggagctgagaggtcgccagccaacagctagaagaaaaccaaattctgccaacaaatcgaatgaaatgagaagaggccttgaacccagatgagaaattcagcccctgccagacaccttgatttcagttcagtgagactatgagcagaaaatcaaagcatgctgtacccagacttctcacgcacagaaactgtgaattaatacgtttatgctattttaaacctttaagttttactaatttttatgccgcaataaaaaactaatataggtccttttaaccatcaaggcctggcttctcttggcttccccacttttcttgctttaaatttcccttagcttgggaattatttattcttcttcacatctcttctctgaaaagacatgagaaagatttacagataatatatttgtaaatggaacaacattacatgacgtagccacagccacaacttcctgtcattagtgaaactaaagacatgaaatatagtaatatgagttaaatactcagtcacccagaggaatggaaaaataaatccaaaatgattccatgaaccttttagccaaagtttcagcgttcaatacaaacctagatataatatcaattcctttattcaattatttagaaatatttagctagcactatgtcagatagcagggacaccatgatgggcaagacagaaaaggtttctgccctcatggagctgacagtctagtgcagtgtggtccagtagaaatataatacaagccacatttgtattaggttggtgcaaaagtaattgtggttttgccatttgcatttattaccttcaaagatgtcaataaaaaccaagtgaaattatttcaatgtaatttatttaacccactgtatccaaaatatcattcaacatgtaatcagtatacaaaattatcaatgagatattaggcattcttttttattgtactaagtcttcaaaatctggtctgtattttatacttactatgtatctcacttcatactagccacactttaagtgctcaatagccacatgtggctcatagctactgtactagtttaataagtgttaaccagatgaatggcaggtaaaacggtgttctagaagaaggaaatagcataagcaaaggaccagcagtgcaagaagatgaatgtgcccaaaggctagaggaaagaaagcagaacatttgcagaaaaacacaagtatttcagacgctgctggtgtgtggatggggaaggaagaagaaaggcccagcgccccaaggtccaaggcccaacacctcacttcctgctgagatactctgtcagctctgcttctttctacattaggtccctcataagtatattcctttctctgcttggaaattttattctctaaacctctcctcccaagaatatctaacctctcatatcccgtaaaatagtaggcttaattctgccacattattagtggcaatcacccaaggaaaaggctatcactggggccgaaaatagttttgcagtgcctcagacatttagtttgtattgccaccactctgggcttctctacctgccccagaagtttctctcttcctctgtaaaagtagtaataatcgtggctgggcgcggtggctcacacctgtaatcccagcactttggaaggccaaggcgggcggatcacgaggtcaagagatcaagaccatcctggccaacatggtgaaatcccgtctctactaaaaatacaaaaaattatctgggtgtggtggcacacgcctgtagtcccagctactcgggaggctgaggcaggagaattgcttgaacccgggaggcagaggttgcagtgagccgagattgcaccactgcactgcagcctggagacagggcaagactctgtctcaaaaaaacaaataaataaaattttttaaaaaggagtaataatgataaacaacaactgccacgtattaagtacttaaaatgtgccaagctaagtgctttacacggattacctcttttaaccctcacaagagccctctatatcaggctgcttcattatcttttgtttacaggcaaaaactgaggcttagagtagtgaagtgatttcatcaaagtaatgcagcaaataggaggtacagttgggattcaaacccaaggagtctaaatttggatagtttacattaagttattgtgcttcacctccctctacacacacatgcacacatgggtgcatgcacaagtacacacagagcaaaagctaaggctctgggaaatacatggtcaagttcgaccgagccctcaggagggtgagctggtggtcattctgaggaaagagagatgagaagatggtcttaaagtactaggatgtgggaccaggaagagaaagggtatcaggactgacctgccaactatgctttctgagcacccctgtctgggccaggatttatgccagctcatccttaccttggactatataagagaaacacaggtaagaaagactgaattgctattaaagttgatattgttgggccagtctctccttgagatacacacacacacacacacacacacacactccaaccttccagaggtgcttctctgtacattgtaatgtaattggtgtctcagggctactgggcccatttattgcctctgttcttgcctttgatcctctagagaagaggtgatggatggcaaatgcaggagccgccttgccggtcattctaagcaaacagaatcactaaccaatttcctcccaacctcatcatctctgtctagttgttccccacccccatctttgtagagaataattaaacttgcaagcactgggcattgttacttaaagctaactgcaatattcaaaaacaaccccaaagattttttttcctggtctgctgccctggattaagggtggctttgttttgttctgatttcttgctgcctgtgatatctaatttgccattgtgctttaacaacaactctctttaaatactagaagacagttctaaccatggcagggggagatggaggcaaagacgcccaagctctacagacactgaatcaggataaacatcctaattatttaactctttcttcagctactggcctcctcctattacccaggagaacatttgcttagttcctctaatgcacaccatttgtatttcatctgtcttcgcaaatggatacttggtaactttgatacagctctacccaacacagctgtgtgggtgtgcaaacccttatagtgcttgaaaattgtcatggagattgaggtctaaaaaaatcagccatctaaattgtcttttaaggggcaccggatgacgcgaattgtgccccttccaacagtggtttacaaagtgtaatccctgaaccagcaacattcacaccacctggaaacctagaactctaaattctggccaaacatggtggcccacacctgtaatcccaacgttttgagaggccaaggtgggaagataacttgaggccaggagtttgaaaccagcctaggtaagaaagcaaggcctcatctctaccaaagaaaaaaaaaaatccagattctttggccccacaccagccctactgaatcagaaactctgagagggggaaaatctgcatgattcaggtggctctgaagcacgctaaaatttcaggaccaccgaatctagagttagagaacctgtgtttaaaaggcaagaagacccctgtctctcctaaaaatacaaaaaattagccaggtgtggtggcaggcacctgtaatcccagctattcaggaggctgaggcaggagaatcagttgaacctgggaaggggaggctgcagttagccaagatcatgccattgcattcctgcctgggcaacagagccagactctgagactatgtcaaaaaaaaaaaaaaaaatggcaagaaggcagagtagagggaaaagcggctttatttttaacagtggttttcaacattggatgcatactagaatcatctggagagctctaaaaatactgatgcccaggtcttactcctagaaactctgactttgttggtctggtatggggcctaggcattagtattttttcaaagctacccaggtaattctaatgtgcaaccaggactgagagccactatttttagaaatataggggaggatgtcatctggagatcttttaccttttcagttataacctggtccatgccctgttttggatcaggggagtgctaggatggctcatgagaaatcaggaggtattaccagtttgagaaggggaaggaaaggcagctaacatgcactgaatgtctgctatgcaccaagcactatgctaggcactatatccacacatccttgaacagatagatttgctggcagcaatcgctgttgagcatccaagggaaggaattagaataaggagatgattagttcacaggagcacatgcagagaagcttctcattataaccactcaaggaataaacgaacaaaaaactgtaaagagccaagcatatatttgggatgagttaggtagatcccagtttagatgcagaaggctggactaaatgacctaatattttttcaaaatttattctagaatactatgaaaaggcataatgtcagatacaatctggaagctatttctgcacattcaaaatgatggagaaaactgaggtactatctcccaaaccattctcactgaaaactttgagctggctcaggcaaccttaaagaggaacgaggttaagtattacacccattttatagactaaaacagtggttctcaatgtatggtccctggaccagcagcaccagcagcacctgggaacttgttagaaatgcaaattccccatccccatcccacttctactgaatgagatgctccaagcttggggccttgcaatctgtgttttaacattctctcaggcaaccctgatgcatgcttgagaaccggttttagaaccacagtttactgagtttgttcaactgatcctcaagggaggagtcatttttaaaatttttttcacatcagcaagtattcactgaggatcctgcctatctataccccaacgatgcccttctctgaattgtactggaaaactaagagatgcaaggctgcagggaggactggcaatgtggctggcaggaaatactagagactgaggctccaaatcatataatgtgcttgtagtgtgaccctacaaagattacctaacaactctgagtcaaaatctagcacatggcaggtgttcagtaaagatttggtagctaaatacctgtaaggatgatagtgctgaaggagacaggatacaatgaaggaagcaggagtcagacatatctcagtttgggccctgcctctgcctttgaactagctctctgatcttgagcaaggcacttcccattttagcctcagttttctcagctataagatgagggagggagattctgattacatgatctctataggctctgctgacatctaaactgttctgtttcaaaatgagccaggcacggtggctcaggcctgtaatcctagccactatgagaggccgaggcaggcagatcacctgaggtcaggagttcaagaccagcctggccaacacggtgaaaccccgtctctactaaaaatacaaaaattagctgggcatggtggcgcacgcctatagtcccagctacttgggaggctgaggcaggagaattgcttgaacctgggaagcggaggttgcagtgagctgagagagcaccactgcactccagcctgtgtgatagagtgagactctgtctccaaagtaaataaataaataaataacaacaacaacaacaacaaaatctacactatgatcttgagacagtttagtgatccaatttctataaagatagggctatataaatacaaaatgtactgaagcctcaagatacattttatatacaggatcaatttccagcacccggcaaaatactgctatttaacaccaaaggaagtggcttaataactagagctttcaattgtctgagtagtacacaggagtatttcctcatggtaggaagttgtttggagtagctgggaaacattatgcacaaataactggggcaagctgcttgtgttcattaggatcgtagaactggaggaacccctcaataacctttaaacttttgaaggtgaaaagtattagcaaagggtcaagaaaaaccctacatacagattaacaggaagaaatgcaaatagtgaaaagagctagggcgatggaaagaggccagacccagattcaaatccctgctccacagtaactgtgtgaactcagacatgccatttagcatctctaagccacagactcatctgtgaagaggagataataacacctgcctcataaggctgttctgagcattaagtagaacaatggactacataagagcccagtaaagacacacccccatcccaccaagctgaaatgctccatcaattagagatgatgttattattctgaattgcctttgcatgtgaaagcaaagagaattgtgagatcctggctgcctgcaacttcatcaaaaaaaagaaaaagaaaaagaaaagaaaagaaaaaaaaagagacttgacaagaacctgctgcctactctgtacaggatattgtgaggcatagccaagaaatggtaggtggaatcacaccgaactgcagtatttgaccattttaccgacaaacccaccaatgttatgtggttcaacctaagataggaggctgtcccttattttatataaagtctgatcctgtcaggaaatgattgatgcccaggaaaacaatatcaatccccaaatgtctacccaagtcctaagttgaatatacagtagaccccgttatccatggtttctctttctgtggttacagttagctgtagttaatggaagtctgaaaatacgtgagtacagtaagatattttgagagaacatttacataactttcatgacagtatgtgtaataattgttccattttatttttgattactgttgttaacctcttactgtccctaatttataagctttgtcatacgtatatatgtataggaaaaaacataatgctgtatacatgaagtttgatactatctgcagtttcaggcatccactggggtcttggaacatatccctccagggtactgtaaagcaaaatgtgcagtgcagggaggcagctggtgaccctagaggtagcaaatgctctattttggcttagtgaatgaacggactcaccactattttgatatcaaaatagccaccttttagccacccacctgaccccactcttttctttctcagtcatggatatgagggcagtggaacactgagcccctgctgcagaagccctagcatgccaaagccccccactggggagcctcccagttccaggcaaaggaattcagcacagccaaagcaaggttgagatgaataactggatttactccttgagatcccgggagcctccaacgggaacaggctgtttcatagggccagtctcagctgataagaggcagcaaatgactctttccaagtcacagtcattatgatgcctgtaacctttttattataaaaatatatgcatatcccgcagaaccctacttacttgcgctttcttggatggctgctaggtttcacacacgccagattagatacattctgacttgttcaggcactgtcagtttaggtcctttcctcctggaagcaacaaaaccaggcaaagagattaataaggtccactacatataaggagaaattggggggcactttcttagccagaggttgctcaaagacagccccatcccagttgatgaaccagtctaccatgtacatggtgtctagctgatccttttttccccctacacagcctgctcagacatagcctgtattttacccttgtcaaatgggggagggtagcatgtcccttctgcagaggattaaaaccacacagtttccagcctggacactgctcatgctctcccctgagggaagtgggtagttttctggctggccctctcacaggcaggaagtttggctgccatacatcctcggtttcacatttacttaacaaacaattatgtaacagtttccatgtgccaggcactagtctagccactacacacatatcaactcatttattatcctcataagaaccctgagaagtacagtcacatgctgcataatgaaatttcagtcaaggatagaccacatatatggcgttggtcacataagactataatggagctgccttatacagacataccattttttatcatttatatcatttatcatttttattatatataaattatattgtgtataaatgatattgtgtgttagatacacaaatacttcccattgtgttacaatcgcctacaatattcagtacagtaacatactgtacaggtttgtagcctaggagcaatagaccataacacatagcctaggttcctagtaggctataccctctaggtttctatgagtacacactatgatgttcacacaatgaaaaaatttcttaaggagacatttctcagaacatatccctgtcattaagaaatgcatggctgtacgtacagttattaagcccattttacagatgagaagtctgaggcagagaaagatgaagtaacttgcccaaggtcacagagctgctaagtgggagagctaggatttgaccaggctacgatttgagctggtaagtgggaaagctgtaattatctccccttcacagatgaatctgtggcttagagatgctaaatggcatgtctaagttcacacagctactgtggagcagggatttaaatctgggtctttcctctttccgttgccctagctcttttcactattgcatttcttcctgataatctgtatgtagggtttttcttgaccctagctccagagtttgttctctaaactactagagtatcctacctcttgaagtacgattttttttattatactttaagttctagggtacatgtgcacaacgtgcaggtttgttacatatgtatacatgtgccatgttggtgtgctgcacccattaactcgtcgtttacattaggtatatctcctaatgctatccctccctgctccacccaccccacaacaggccccggtgtgtgatgctccccttcctgtgtccaagtgttctcattgttcgattcccacctatgagtgagaacatgcagtgtttttaagggataggtagaggcagagggaagggcagaggctctacccacagatgcagccactttcaccaggtcttgaattgagaggcactaaagacttctgctctaaaatggttttcccttgcctttatgcgtcagagttcatgctgtgctccctcttctgaggcatccaaggtcctcacttaattatgaataaaacttggcaggaacagtacagttatcattggtcattaacacccagacccaaagcatgttatcacattcaaagtcaggcagacttctgagaatctgggtccctgaagaggcaagttgtgaagatgaggaagagagtttaagaaaggtctatggctgtcaaagctgcctaggagagaaaggcctgaggatgatcatgatgaagatacccgaagcagcctaagggattttatgaaaatattgggtgcctcagcagcaagaccctacaggaggaaataagactacactgaaaacagactttactccttcccggtttggcccccgcaatctcgattcataaactacacccaactcaaacgtgacacatggcagctaggttctcttctgcagtggcagaggatcccaggttaataaagaaggcccgtggttaggcaagtgtccaaactcacacttgtcctcttcttggctgtgtcaaagatacagtcctcagtgaagcctgtccctagctcccccacgctagggcagcatttgagaaaacaaagcaacattaaagcatccaggtcagaaggcacaagaaaaccctcacatggtctggataagccagggttattgactgtggcagtgacaggcagatcctctcagacggttacaacccagattcccagctggttgtggttgcacagcccacacactctaacgactcagcttctctcaatatgattaagattatgattaatctttcatttatcaaacatttgatatgtgccaggcactgttattagtgttttacatgtatgaactcatttactcttcacaattatgttattacgtagttattattatgcctagaaaaactgatgctctgaaaaatagcaggccagaggtcacacagctacaaagtggaaaattggggtctttctctcctctgtctcaaaagtcaccttctctctatattttttttttttttttgagacagagtcttgctttgtcacccaggctggagtgcagtggcgtaatcttggctcactgcaagctccacctcccgggttcacaccattctcctgcctcagcctcccaagtagctgggactacaggcacccaccaccgcacctggctaattttttttttcttttgtatttttagtagagatggggtttcactgtgttagccaggatggtctcgatctcctgacctcgtgatccacctgccttggcctcccaaagtgctgggattacaggcatgagccaccgcgcccagccatcaccttctctatttctaaaatacaataaggttcatacaaaaggaggtgatttctgcatgaggctctattggtcttttatctctcatcaaggacccagcagcttggggatcaaggaggaagttggccaaggccactcacatcatccaccaaggcactaatctcctcacttatgtccaagccaggctcttcttatgagaggaactaatctatgagcatgtgtttggtgggtttcaccttggatatagtggagggctactttctttgtagggtgctatttagagtatagctggacactttacaagacaggagacaaacagggaatggccagcaggatgtacggtggctatgtgatgaaattcctctccccttaactccccctaccacccatatggttagcccataattggtaaactccgccattctggtcctttaatatggaactaccctaccactggtcaacaagcagacttgccaggctgtgctgggactgaaacctctcttattcttctgggtccagtcagtccctttatcagagtgacctggatggagagcaagggcatctgctttggagccatttaaaggctcctagagtacctctgtgtcctaaggggcagattagaaagaacagggccaaggaagtgctgagaatataggggagactagaagtcaaggtaatgaatgactctgttatgccggcctaccacagtgtacctggaatgatcttcaggatctgcacaaacccttaggtgtggagggagggagaattgattgctgtgtgctctgtaactgaagcccatgtaggaactccctttatagtccaaagaaagcatattgaaggaaagcttacttgtcctggctctggctccctgaaacaaactaaaaaaatctcttaaatctctcttctcacagggaggaaacaaaacatagtttcatggcaaagcaagagaccatgtcacttaagggacagtatcccatgtgaaatagtaacatccatactcatctaaacaccaagtatgcagatggaactgagtaggtttccaaagcaaatttatcaatttctccttcagattagctccccttccagtccttccattcagtcatccagactcaatctcagagttttcactgaagttgggaggtgagagaggaatgttcatcaaaacctattgattctacttttccatcctattattcctagcctcaccaccaccaccccagtcctagaccttatctatgccactccacccccactccaccccacctccctatactggataccttcttgactgccttcctatcttcaggactagcttcatagtcatgctatctgagcaggctcataggtactcacacttggtttaatgctctgctgttaccaccttgaaagtcctaatttttttttctttaacaaggagccctgcaatttcattttgcactgggccctgcaaattatgtagccactcctgcctgtttctccccatctggacccatcttacacatagtgtttattgccagagtttgtttgctaatgccaataataatgcatctaatggctctccgatgcctccagaatcaaacccaaacctcgcagcctggtcttcaaggccctctgttacctggcctccatctaatttcccatacatcccatataaattctactcattccagaatggaggatggttttactattaacaacttcagcagaatgattaacagctgtggagtctgactgtggagtcagacccagttgaggggcctggttctacacttgttagctgtatgactttgggcaaattccgtagcctctctgaacctcagtttcctcatctgtaaaaaagagataccaacagtgcctatctcataaggtcaatataagaattaaatgatataatcaatagaaataagtctctaagcatagtatctggccggcccttagtaaacactaaataagtattagttactaatattatttgttgtaattgttacaaagctgagtagttctaaaagtcactatgcctaatgcctatctaattggccatattgctggctggatttcaggtaactcacagtgacctgccatggccctctacttccctttcatgtacctctcaaccaccatcctctggatggagatgattataatttgcatgttgttgagctgtgttcaccacctccctctttttgctctctgctagtgtgggagcaacttgatgggccagcagaagctgcagaggcagacatggagaggaagcagcacatttgccaactgggtttcagagggaagcagctctgggaactgacgttcaggctttgaccaacccctgccccccgccgccaccttccccctgccaagatctgtccattctcctgggaacccatggtcggccttgggggatacatagagattttggatgagatttgtccaggcatctgcatgaaacagctccgggacagttccctctatcatatcaggtcaatttcaaatttgcagcaaaggttcatcctgagctgctgaagtaattcacaaagtagtcacagaagtggctcaccctatataaagactaaggaccccagcttaagctttttgcatgggtcctttgccacaccccagctgtggtgaggaaaacagctcccagcagggtcactcccagttccttcccatccatttacagatgtgctttatacttctcttagaacagggatcctcaactccggctgcactttagagtcacctgcagaacttctgaaacataccaatgttgggccaccagtaagactaattaaatctgaatgtctgggagagggaccctggagttggtaagatatttttttttttttttttttacttttaggttcagtttcaggggtacatgtgcaagtttgtgacacaggtaaacttgtgtcacaggggtttgttatacagattatttcgtcacccaggtattaggcctagtacccattatttttcctgatcttctccctccccacctccatcctccagaaggccccagtatgtgttattcccctctatgtgtccatgtgttctcatcatttagctcccactcataagtgaaaacatgtggtatttggttttctgctcctgtgtcagtctgctaaggataatggcttccagctctatccatgtccctgcaaaggacatgatcgcattctttttttatgactgctgggtacgtacccaaagaaatggaaatcattctatcataaagacacatgcacgcagatgttcattgtagtaaaattcacgatagcaatgacatgaagctggtaacattgacaaactcctgaagtgattctaatgtgtggccaggacagagaacaagactatatgagaaatgtagcttcttaaccaatttcctggtgtccatgttgttctcccccttgaacctatgtcacttattacttgaaatgtaaagttcaagaaacctccaatatgaccctgtttattttttgccgcccctacccatgcactctaccctccagccacacctggttctttcccagtccacagacacaacacctatattaatctcattgaaatgttgctcacactgtttccctgacttagaatacccccactacttttccaaaagcagtggttttcaaatgtgagtgtgcctcagaatttcctggagggcttgctgaaatacaacttgctgggatccatctcagagtgtctgatttagaaggtctaatatggacctgagatttgacctgctaacaaattcccaagtgatgctgctgggcaaaagatcacattgtgctgctctctcctcaagtttccaaatggcctcttgcaaattgatagtgtggttccaggaagaaatgactctagtgggatctgcccttggcaaactttggggaagaacaggattgccttcagcattcttctatctcacttcattacctcctaattgccaccctcctacttccaagcactcaaggttttcacactggttactacttgttcaaaatgctccacagcaagcattcttgtgttccagccagactcttatgccctccggtctccatactctactaagatgttctgttgataatataacaacagaacatacagataactctatggttaattaagtgcaacatggactctggggtcaaacaggtctggtggacttgtggatccaccacttctctgctgcatagcactgcaaaatcactaagcttccctgaggctacatttcttcatctgtaatatgaggatgtcatgcatagtttgcagggtaattatgaggaataacataaaataatgtatgtaaagaacaaacctgccatatgttaagcattcaataaatagttgctattacaaatgcattaaaactttactattagtaactggtgagagattgcctaggtagccgttgcattttaacaacaaccttcttagtgaggatctctggggaaaccctccatttttgcactgttgccagaatgatcttttcagaatataaattgaatcactttgtccctctgcttaaactttttctcattgctcccctcttgcttgtagaataaaaccctaaatccttaaatgacttatatgcccccatattcagtggttcttaactggggagtatttggaagtttggggacattttggttgtcataaataccaaggggggcagtattaccatttagtgtgcagggaccaggacactaaacctcctacaaccttgcatatgcaaaccagcactccccacccctatggaaaactgtctcaccccaaagccaatggcactcacattaagaaacacccgagtcaaactctctagcctcacctcctatcacttccttgctctgtgtactccagccaccctggccttgcttttagtcctccacagcaccttggacattctgttctttctacttggaaagcagttcttttctgatggatcatttaactcctactgacccttcaaatctcagcttaagtgatattgcttcatggaggccataattcactccccattatagtatatacctccttagaactgtattccttgccttcagaatatttatcttcgtttataattgtgtactctgtaatgttttttgaattatttgattaatgtttgcctcacacataagaccacaaattccaagaaagcaagcatcacgtctgtttttgctcaccattatatacgcaatacctagcccaatgcttggctagcagtaggtactcactctctctctgagaaatgaatacccacataagcagcccctagtcttaatcaagtctccagggagagggggcagttattaacatgctctgctcttagaggtcttagaacaactggctcctactgaactctttgaggtaggagggggacctagatagagtagaaaagtgcttccatgtaattattctgtttgcattcaagcttattagaatgcaatggttggtcacaatgtttatgtttccaatttctacacgtagacattctgattgattgcttgctcccaatcctaaatatattaaaacaaatgaaagattgtttaaagcatgttgtgtatttactttttgatgcttctaagacatgcggggtacctgtccaatttttgtcaaatttgaaaaataccctgtcaagagtccaacagtcttggaacatggtactacatgtgatagagctacttatacctcaactctctagtgaattctgcattaaaaatcaagacaataggctgcttcagctctaagtagcttggagttggtttgtttgtatgtttaatgccatagtccaggcaataagaaagaacgagaaaaagaaagagcaggagtatgtgtttggtgcataaaagaaatgctgattctagctgggtgtggtggatcaggtctgtagtcccagctactcagtaggagactgagtctggaggatcacttgagctcaggagtttgagaccagcctgggcaacacagtgagaccctgtatgccccaccccccaaaaaaatgctgattctgttccagtgtgactagaacccagtaagcaaaggggaaggtaatcgaagatgaagtcatagacgtagctaagaccaggtcagtgaaaatttttgtccattcctgtgagtaggctgggagccatgggatggttttgagcagaggagcagtgtgatctaacttgttttgaaaacagatcactttcagtactgtttgaagaaaaaaatgtgtggaggaggggtgatgtgtgagcaggttgcagggtataaaggacagaagcagccaggccagttaggagactattgtgataattcaggtgaaaggagatggaaattattgaccagatggtagcagagaaggcagtaaaacctgattggatcttagatatattttgaaagtagaacgtgacgtgcgagagaaaagaaatcaaggattcattttttattcaacaaatatttactgaacacctactatgtgccaagtactgttttatgtgcttaggatatagcagtgaacaaaacaaacaaaaatctccatctaatttgagttcactttttgttttgttttgttttcagtcagagtcttggtctgttgcccaggctggagtgcagtggcaggatcttggctcactgcaacctccgactcccaggttcaagtgattctcatgtctcaccctcccaaatagctgggattacaagcgtgcaccaacatgcctggctaatttttagtattgttagtagagacgaggttttgccgtgttggccaggctggtctcgaactcctagcctcaagtgatctgcccagctcggcctcccaaagtgctaggaatacaggtgtgagtccctgcaccttgtctgagcttactttttaatcaataatagataacatgttttgagcacttcctgtgttccaagcactttgcattcttaacttatgtaattctcactacaacccaataatgtatgtgtgtatggtattacctccatttctcagctgaggaaactaaggcacagagaggcaagtttcttgaggtctcacagctgataagtagtgaagctgtgtttccaacccaggaaattatgcttgagagtctgagttcaaagcacttcattctactgcctctttaccaggccagtattcccacaacaggagcaaagctggaccacctgggtgaaaactagggatctaactgctagatgactcaaagttttttggcctgaaaaactgcaagaatgtacttgacatttacaagagcttgattctgaatataaattggtagcctgggcacagaaagatttgggccagtgagtactctctaaaatgtccaatattatttgacacaaaaatgttgtgtcatagcaccatgtaagtgttagctctaattatccactagaatggttaagtggcattcaaaagggcagaatttatcaggcttgctgagactctgacacactgccaggcaaatcaggaggctttggtcagtgaaatcgccctaggattctttcacagaaatctaccatcaaatgtggtagaaatatatgggaacaaaagtgataaggaaacctgagattaggagatatactgatagaaattgcttgcatttttgttaggtgcttaccatgttgtaggtatctacatgttgtaggacaggatgtacctatcctaagtgttggcaatgtattacatcatctaatcgtcgcaacaaccctaggaagaagatattagtatttccatgtataaaactgggggtctgaaaggtttggtgacatgcccaggctctcctagctcaaatgtggtagcagtgggacgcaaacacacatctgtttgactccaaagcccacgctgctccccaggaggttaaattctcctgctgtgctccccagtgaaccctgtccagatcatctactcacctatatttgaattgtttctaacacttaaatttgtacttctttgtatatttctgtacgtgctttggtaccatctcattcaaacgtatgttccttctctcccatttattttataagctcactgaggttggggccctgatttgcttatcttgctactttccagtggtgttacttatgggcatctccccacaagtgagtgtctaataaaggttgctgattgactgcaataaactgttttagaaatctgctggtgattctaaatctggtatgctttcatccaagacaagattaatatcacagtggcaggtaaaataatagctgccatttctttaagatttaatttgtcctaaacaactataccgtgcaaagtgcttcctgtgcattatctcatttaaccctgaaaatatgagtcagatactctaattgctttttaaatttttattattattactattattttgagacggagtgttgctctgtcacccaggctggagtgcagtggtgcgatctcgggtcacggcaacctccgactcccaggttgaagcaattttcctgcctcagccgcctgagtagctgggatcacaggtgtgtaccaccatgcccagctaatttttgtatttttagtagagacggggttttgccatgttggccaggctggtctcgaactcctgacctcaggtgatccgcccacctcggcctcccaaagtaccgggattacaggcgtgagccaccgtgcctggccagatactctaattacaattcccctatttcatgatctagcagtcccactgctgggtacataccaaaaagaaaggaaatcagtatatcaaatagatactgcactcccatgtttactgcagccccattcacaatagtcaaggtatggagtcaatctaagtgctcatcaacagatgagtggacaaagaaaatatggtacatatacacaaaggaatgctcttcagccatgaaaaagaatgaaatcctgtcatttgcagcaacatggatagaactggagggcattatgttaagcgaaataagccaggcacagaaagacagatatcccatgttctcactcatacgtgggagtaaaaaaaaaattcatctcatggaggtagtgagtaaaatagtgtttccaagaggctagaaagggcaggggggactagggtgtgtggagaggttggtgaacacatacaaaactacagttagatagaaggaataataacttatagtgttactgcatgttctcactcataagtgggagttgaacaatgagaacacatggacacagagaggggaacatcacacactgggaactgtcaggggttggggcacaaggggagggagagctttaggacaaatacctaatgtatgtggggcataaaacctagatggtgggttgataggtgcagcaaaccaccatggcacatgtatacctaggtaaaaaacttgcatgttctgcacatgtatcccagaacttaaagtaaaataaaataaaataaataacttatagtgttcaatagcactgtcaggagactatatataattaacaattcattgtacaattaacccttgatttttttccaaccaaactcagactgaacatacgttcatccattggtatgcatggggagttggttccagtatgttcacatgtaccaaaatccacacatgctgaagtcctgaagctggccctgtggaaccccatatttaaaaagtgcaggttttgtatcctgtgaatactgtatttctgacccatgattggttggaaaaaaaatgtgtgtataagtggacccatgcagttcaaacccatattgttaatgagtcaactgtacagtatttgagaatccgtggatacagagggctgactttttgtatctgtgggtttggcagggctgactgcagacagaaggatgtttggattttggaatacaagggtcctggaaccaacccttcacatatactgaagtatgactatatatttttaaatagctggaagagaatatatacagcattcccaacataaagaaatgataagtttgaggtggtagatatcccaattgccttgattttattattagacattgtatacatatatcaaaatatcacatgtaccccataaacatacatataaataaatatgtccaactattatgtatcaattaaaaattaaaaataattttagatggctaattaggaacagctctggtctgcagctcccagcatgattgacacagaagatggatgatttctgcatttcaaactgaggtcatcaggatcaaagaccaaaggtagataaaaccacaaagatggggagagaccagagcagaaaagctgaaaattctaaaaatcagagtgcctcttctcctccaaaggattgcagctcctagccagcaacagaacagagctggacagagaatgacttcgatgagttgacagaagtaggattcagaaggtcagtaataacaaactactctgagctaaaggaggatgtttgaacccattgcaaggaagctaaaaactttgaaaaaagattagacaaatggctaactagaataaacagtgtagagaagaccttaaatgacctgatggagctgaaaaccatggcatgagaacttcgtgacgcatgcacaagcttcaatatccgattcgatcaagtggaagaaggggtatcagtgattgaagaccaaattaatgaaataaagcaagcagacaaggttagagacaaaagagtaaaaagaaatgaacaaagcctccaagaaatatgggacaacgtgaaaagaccaaatctatgtttgattggtgtacctaaaagtgatgggaacaatggaaccaagttggcaaacactcttcaggatattatccaggagaacttcccccaacctagcaaggccggccaacattcaaattcaggaaatccagagaacaccacaaagatactccttgagaagagcaaccccaagacatataattgtcagattcaccaaggttgaaaagtgttaagggcaaccagagagaaaggtcgagttacacacaagggaaagcccatcagactaacagcagatctctcgtcagaaaccctacaagccagaagagagtggggcccaatattcaacattcttaaagaaaagaattttcaacccagaatttcatatccagccaaactaagcttcataagtgaaggagaaataaagtcctttacagacaagcaaatgctgagaggttttgtcactaccaggcctgccttacaagagctcctgaaggaagcactaaacatagaaagaaacaaccggtaccagccactgcaaaaatatgccaaattgtaaagagcatcgatgctaagaagaaactgcatcaattaacggacaaaataaccagctaatatcataatgacaggatcaaattcacacataataatattaaccttaaatgtaaatgggctaaatgtcccaattaaaagacacagactggcaaattgcatagagccaagacccatcagtgtgctgtattcaggagacccatctcacatgcaaagagtcacataggctaaaataaagggatggaggaagatctaccaagccaatggaaagcaaacaaaacaaaacaaaacaaaacaaaaaaagcaggggttgcaatcctagtctctgataaaacagactttaaaccaacaaagatcaaaagagacaaggccattacataatggtaaaagggtcaattcaacaggaagagctaactatcctaaatatatatgcacccaatacaggagcacccagattcataaagcaagtccttagagacctacaaagagacttagactcccacacaataataatgagagactttaacaccccactgtcaatattagacaccaaagagacggaaggttaacaaggatatccagggcctgaactcagctctgcaacaagcagacctaacagaaatctacagaactctccaccccaaatcaacagaatatacattcttctcagcaccacatcgcacttattctaaaattgaccacataattgaaagtaaagcactcctcagcaaaggtaaaagaccagaaatcacaacaaactgtctctcagaccacagtgcaatcaaattagaactcaggattaagaaactcactcaaaaccacacaactacatggaaactgaacaacctgctcctgaatgactactgggtaaataaggaaatgaaggcagaaataaagatgttctttgaaaccaatgagaacaaagacacaatgtaccagaatctctgggacacatttaaagcagtgtgtagagggaaatttatagcactaaatgcccacaagagaaagcaggaaagatctaaaatggacatcctaacatcacaattaaaagaactagagaagcaagagcaaacaaatgcaaaagctagcagaaggcaagaaataactaagatcagagcagaagtgaaagagatagagacacacaaaaaaaaaaccttcaaaaaaatcaatgaatccaggagctggatttttgaaaaaatcaacaaaattgatagaccgctagcaagactaataaagaagaaaagagagaagaatcaaatagatgcaataaaaaatgataaaggggatatcaccacccatcccacagaaatacaaactaccatcagagaatactataaaatatatataaaatacctctatgcaaataaactagaaaatctagaagaaatggataatttcctggacacatacaggttcccagaactaaactaggaagaagttgaatctctgaatagaccaataacaggttctgaaattgaggcaataattcatagcctaccaaaccaaaaaaagtccaggaccagatggattcacagccgaattctaccagaggtacaaagaggagctggtaccattccttctgaaactattccaatcaatagaaaaagagggtatcctccctaactcgttttatgaggccagcatcatcctgataccaaagcctggcagagacacacaaaaaaagagaattttagaccaatatacctgatgaacatcgatgtgaaaatccgcaataaaatactggcaaaccgaatccagcagcatatcaaaaagcttatctaccaaaatcaagttggcttcatccctaggatgcaagggtggttcaacatacgcaaatcaataaacataatccatcacatcttcagaaccaatgactaaaaccacatgattatctcagtagatgcagaaaaggcctttgacaaaattcaagagccattcgtactaaaaactctcaataaactgggtattgatggaatgtatctcaaaataataagagctatttatgacaaactcacagccaatatcatacagaatgggcagaaactagaagtattccctttgaaaactggcacaagacaaggatgccctctctcaccactcttattcaacatagtgttggaagttctggccagggcaatcaggcaagagaaagaaataaagggtattcaattaggaaataaagggtattcaattagcaatcaggcaagagaaagaaataaagggtattcagttaggaaatgaggaagtcaaatcatccctgtttggagatgacatgattgtatatttagaaaaccccatcgtctcagcccaaaatctccttaagctgataagcaacttcagcaaagtctcaggatacaaaatcagtgtgcaaaatttacaagcattcctgtacaccattaacagacaaacagatagccaaatcgtgagtgaactcccattcacaatggctaaaaagagaataaaatacctaggaatccaacatacaagggatgtgaaggacctcttcaaggagaactacaaaccactgctcaaggaaataaaagaggacacaaacaaatggaagaatattccatgctcatggataggaagaatcagtatcatgaaaatggccatactgcccaaagtaatttatagattcaatgccatccccatcaagctaccaatgactttcttcacagaattggaaaaaactactttaaacttcatatggaaccaaaaaagagcccgcattgccaagacaatcctaagccaaaagaacaaagctggaggcatcacactacctgacttcaaactatactacaaggctacggtatccaaaacagcatggtaatggtaccaaaacagatatatagacaaacggaacagaacagaggcctcagaaataatactacacatctacaaccatctgatctttgacaaacctgacaaaaacaagaaatggggaaaggattccctatttaataaatggtgctgggaaaactgactagccatatgtagaaagctgaaactggatcccttacttacactttatacaaaaattaattcaagatggattaaaggtttaaatgttagtcctaaaaccataaaaaccctagaagaaaacctaggcaataccattcaggacataggcatgggcaaggacttcatgactaaaacaccaaaagcaatggcaacaaaagccaaaatagacaaatgagatctaattaaactaaagagcttctgcacagcaaaagaaactaccatcagagtgaacaggcacggcacagaatgggagaaaaattttgccatctacccatctgacaaagggctaatagccagaatctacaaagaactcaaacaaatttaccagaaaaaaacaaacaaccccatcaaaaagtgggcaaaggatacaaacagacacttttcaaaagaagacatctatgcagccaacagacacatgaaaaaatgctcatcatcactggtcaccagagaaatgcaaatcaaaaccgcaatgagatacaatctcacaccagttagaatggcaatcattaaaaagtcaggaaaccacagatgctggagaggatgtggagaaataggaatgcttttacactgttggtgggagtgtaaattggttcaaccattgtggaagacagtgtggcgattccttaaggatctataactagaaataccatttgatccagtgatcccattactgggtatatatccaaaggattataaatcatgctactataaagacacatgcacacatatgtttattgtggcactattcacaatagcaaagactgggaaccaacccaaatgtccatcagtgatagactggattaagaaaatgtggcacatatacaccatggaatactatgcagccgtaaagaaggatgagttcatgtcctttgcagggacatggatgaagctggaaaccatcattctcagcaaactatcacaaggacagaaaaccaaacaccgcattttctcactcataggcaggaactgaacaatgagatcacttggacacagggcatggaacatcacacgccggggcctgtcagggggtggggggctgggggagggatagcattaggagaaatacctaatgtaaatgatgagttgatgggtacagcaaaccaacatggcacatgtatacctatgtatcaaacctgcacgttgtgcacatgtaccctagaacttaaagtataataaataataataataataattttaaaggctgggcacacacctgtaatcccagcactttggccaaggtgatgaatcacttgaggtcaggagtttgagacaagcctggccaacacagtgaaaccctgtctctactaaaaatacaaaaatcagcttagtgtggtggcaggtgcctgtaatcccagctactcacgaggctgaggcaggagaattgcctgagcccgggagtcagaagttacagtgagctgagatcgtgccactgcactctagcctgggcaacagagccagactcagtctcaaaataataataataataataataataataatgttttaaaaaacaattcccatatttcagatgggagaataagatttaaagaggataaaaacctcaaagaaattcagctagtaagtgacagccataggtctgtctaactccacagtcagttatcttagccactggggttaaggtagaaattatgccatatgataatttttctcaatgagtaaatgcaattttaaaaaatgtatatcttcaaatgcttaaagctgctttcttgagatataattgaaatgcagtaaaaatatttaaagtgtgcaacttgatatgttttgacatatgtatgcacctgtgaaaccatcaccacaatcaagataaatagaaatatccatcaccttcaaaagtttccatgcttttgtaagccctccttcccaccattttctagtcttaccctgtgcccaagcacaaattatttttttgaatgtgcaaggtagtaacttgggaaagtctctacttgccaaaggatcatactggctctatccctcatatactggattcatttgattaatgtcacagttagctgatctgtgacttgtgattctcagtgctgaaccctaaattgagtctgacatccaagctaagtacagtaataagagtgatgataaattctctctgagttagaaagctaatctaagaagccagctgggctgattgatttcttcttttcagaaacaaaagatgtagattatttattagatagcctgaaaccctagggatctttttgggctcctgtgtattaggaaaaatgggcttggtatttataagcttttgaaaaaatctctatattgcccagtagagagatttccaggctatgacaaaggtagcatatccagtcagcagctaaattcatttttttaaaaaaacctatcaaattatttatttgatgaatagacctaggtgtgatagattgctgccaggtttttagaaaatgatgtgcaggagccctaaagggcttttctttatcaaattgattcatctatctactttgctcatttgctcatggtgtcctccacccaaacgttaacctaacattttcactctaagtgggagaaaaaaatggtggtgaaggattgtatgaacatctgagccttgatggaccattgcctttggccactgtcccccattcgtctaaatctcagccctgtttatgaaataggatgatagagaaagaaggttaacattatctaaatgatgagagattaatctgtatggttcagctaataagtcataagagtacagggaaaagagcagtcactgtgtactgaggtggtcagggaaggcttcttgaaggaggggctagatgtaggcccagaggaaaatgggaaagaattccaaatgcatctagccactggcatgaccactgtggtaccggcaggaatgagtataacaaatgcaattggtatagaggggaaagggagcatctccaggactgaaggtctctaacagccctgcattgctgacctagaagagatagagacacaaggaaggaaagaggaaagagacagacaactggtgggagtaaaagagtagtttctgatcaatttttctgtctcttttacctcattcagtggcaatcggatgtctgggtcttttaatttcagacaagcccttgcctacccatcaaagataaagcagttctgcttagagcagtttctactagcagcagcagttagcataaaagaaaagtaagtcgcacgaggaatttctgcagagaaaacatttttccttgatttttctgtcaaaagatggaagtatgccatggtgggaaatatctgagacaattcgatctctctgtagtaggccatctggtaaccaagcacttctgatcctccactgatgcccagacatagctcatgcaggatcccagaaagcaatcattcatttaagagagctgaagagaacatctttgcttgttttcatagacacacggggttgaaataaaggtggtctgctctgatctcccaagaaaaaaatttacccaaagtgggctcctggagattgtcttctttatctccctgtcttggggccattttaacgtgatctatttatcccagagaagtgtgcatctccatctcaagagaattttgagatactgttgcaacctttcactactgaatttctccttgtatcttaaagccatagaattattattattatttttgagatggagtctcactctgtcatccaggctggagtgcagtggtgtgatctcggctcactgcaacctctgcctcctgggttcaagtgattaacctgcctcagcctcccatgtatctgggattacaggtgcccaccaccatgcctggctaatttttgtatttttaatagagacagtgtttcaccttgttggtcaggctggtctcgaactcctgacctcaagcaatctacccaccttggcatcccaaagtgctgggattagaggcatgagccactacacccggctgcaaagccacagaattttagatttcaaaggaaccttggagactacttagtctaactgtcccttttaaagaaaaatagaatgttcttgattttagaaaactagataaaaatatttttaattcggaatagaacactacagataaagctggcaactttctcccaatccaagaaaccttcttgtgccttcattttccccccaaaggtaaaaagtgttattggtttctgaattttcttacagaacattttgatacttctacatatgtgaaaatatgtagtattatttttgtgtgttttaatttgtttcaaagatatcatacagtatgcatcttgctttcttcattcatcgttttgagatctagatcattccttttaactgcagttcagtattccactgtgtgaaagcatcacattttctttatccaattctctcttgattcatatttacaaatctgctttatggagagagaactgcatagagaagttgcaggattgcctcaagataagctttggtacaactaaaactagaatctacatctaagatgagaggcagatgaatagatgaatttctcaaaagttatcttgaatgagttaggctcattcatgaaagtcttaattggtccaatatgaagttgaaaccttggctttaagagtgtgaaaattctgaacattcttacttcctagagtgggcgagccaaaaaactcataacccatggtcttatgtgctaaagatcttcaggggtcactcctgagaaagaaaatagctgtgacagagttacatttgtgaataagggaaagcatgctggaacactgtacactctaagaagcatcatgcctcagcccaaaatatttcctctaactttgctcatggggtctgaaaagcctttctttccaacttacagctttgaatcttgaaggtttttcatctgtaaattccctgagaattaaattgatattggccattaacagacacttgatagcttggtttactaggttgcttgctagaacaaagtcattatggaaaatgggtataggatatgcatccaggtacatcgtcaggatgaggcaaagggaacaagaaaggaagaaaatgaacatttattgattacctgctatgtgccaagcaacgttctaggaactttatacatatatttgcacaatgggattagtaatgctactttccatattaggaaacaagagttcagggagattaaataacttgcccaaagtttatttgttcattcatttcctcaataaaattttttccagctacttttgctctatgccggaatctgtgctcagtgaggaaatattttggtgaatatgagacaacaagttttgtcttcatggaattaaaatcaaagaaaatatgtaccatgagcaagccaagataagcatggtaaaggacattggacagtaggcaaatcatatgcaccttgaggtctcatttatttagcgaatatatattgaatacttactacattcaggcaatgagcctgaccctttaggggaatataaaaatgaataagatgctccatactcctaagaatgcttagggtataacatgttcactcaatatttgaataccagcctaaaatctttacgttcaagttcaagtgacaactcatgtttccaagctatttgtcttgtcaggtacaagggtaaatttgtgtcaagcagaggaagaagaaaggaagggtgaaataggtacaaaatgactaaatatcagctaccatctccattaaactggagtgctctataaaagattgcaatcaatagagctagggacaagacagtttttttcaccaactgactgacaggcatatggcacctaattgatataaggtgtcagcaggttcttgttctctgactgtaagtaaaatgacaaaggggttgccagtgtgtctagatatgaggtgttttatttttcctaagatccagagcaaagagaagcatctgctttagaggtagaaaccctgcctaccaccaggataaacttatcagaagccaaatacttgttctccatccagtggtgttctggtaaatgtttaacaaccagatctccagaaaaaatatctatttgctgctttatattgctatacataaatcgtggtggttaattttatgtgtcaacttgactgggccgtgggatgcccagatatttggtcaaacattattctatgtgtttccataaggatatttctggatgacattaacaattgaattggcagaatgagtaaagtagagtgccctctccagtatgggtggccttcattcaatcatttgaaggcctgtatagatcaaaatggcttaccctcccataagcctcccatgagtaagagggggctcctcttgcctgactatttgaactgcaacatcagtcttttctggacttcagactattgttgacgaatggataaggaaattgtggtgtacatatacaatcgaatattattcagcattaaaaagggagatcctgtcaattgcgacaacatggagaacctagaggacattatgctaagtgaaataaaccagacagagaaagaaaaacactgcatgatctgacttatatgtggaatctaaaaaaaaaagttgaatgaatagaaacagttgttggggtgtggggagatgaaggtcaaaaggtacaaaggtgtggttatataggatgaataaatctagagatctaatgtgtagcatggggtctatagttactatagttaataatattgtattgtgtactggaaatttgttaagagaataggttttaggtactcttactacaaaaaaaataaagaagaaagaaaaagaaaggtaattatatgagatgactgttatgttaatttgcttaaaagtaacaattgcctcactatgtatacgtatatcaaaatatcatgttgcacagcttacattatacaataaaaaagtcttaatctaaaaagacactaatgactttattttcagtagtaaagagagcactgatggtccatggtgtgatctggcaatagataaaagcaaaatatcatattgaatactcctaatcaaccacttataagaaacaaagatctggatgatttgtatatgatacacccaaacatttttttgcaaaccaacaaatgtaatgagattgtctggctgctcctgatgttgctagatacaatagagaaagaaaagaatgagctcagggattcaaattcccaggtcaagtgccacataaatgatctgaaagcttctatatgtgccctgaaggagacctttatctcctgtatccataggactgagattgctgaaaatcaaatccagagtttcaacctgaaactggctgaattacaatgaaagttaaacttccagctttgtagattgtctactgataaagtgaaggcatttattgggaagagatgaggtcctgaattttggagtggggatatgtgggaagcccataacgaagctagggacatagagctcctaaattatgacacttctttgccagttaagtaggcctctgtacccccagtggtagcgacttctctacccttgtctgagaggattaaccctgcattgcctgggaaaagtgtaacggcctcccctgaggcagttgctgtgcaggacaatgctgagtcttctcagaacttactcccaccactcctttttgcttctacactgataagtagattcaagccccagcaggcccctaaaagtgaggtacaaaccatgaggaggtatactatactccagaagaactatttgagttttctgtcaacagacagaaatccagggaacatatgtgggaatggatattaagaatttgggataatggtacctggaacataaagttgaatcaggccaaatttgtcgatatgggctcactaactagagattctgcatttaatgttgcagcttatggagttagaaaatactgtaattgtttgggtgaatagctgaaagaaggaccaaaaggcctccagtggcaaattgaaaatgccagacctaccttagtttgatgtagagtttaatgtagaggaaagattcaaaagtttagagattgggatgtttcagtggatttgtcatttaaggtcttctcatttatccttgaaaggtccagaagacatatcattcacataaatttgtgaggggagtctcagcattcttgaagaattctgtggttgctcttctctgtaggccagaccttacagtgaaaactgcagtgactgaattgggaaacctaaatgctatgggagtacctagattctggtgtggcaggggccaagtgcagcactcaactgccaaagacaaggtgggcatggttaccataagggacaacagagtcaaagcagcatcagaatgatctgacttgtgcagacctatggtattaactacttaatcacggagtccctaaaagtgaagtagttaggaagcctactaaattcttacttaatctggatgagcagaaaatttctaggtaaagtgagccaaagtctaacctgaatcataaaaacagatagtcaatcaattttctgactttagccagtttacctacccagaaccccttgaatgaaggggaaaccaggtctcctagaggaaggaccctgatacactgaaaaaatttattctgttaatctttatcccagccttccccaatggggcctatgaccttttaccaaggtaattgtgcatttgggggaaagaaaataatcagatatttgagggactacaagacactggctctgaagtgaaaataattccaaaatatcaatgtggtccactagtcacagtagggggttatggaggtcaggtgatcaaagaagttttagctcagatctgtctcacagttggtctagtgtgtcttcaaacccatcttgtgtttatttttccagctccagaatgcataattggaatagatatactcaacagctggcagaattatcacagtggcttccagacctatagagtgtgagccattacggtggaaaaggccaagtgaataccactagaattgcctctacttcagaaaatagtaaaccaaaagtaatagcacattcctggcaagattgcagagattagtgccaccattaagcacttgaaaaatggtgatggtgattcccaccatatcctctttcagcttgcccatttggcctatgcagaagacagatggatcttcatatgacagtgtattactgtaaacctcttgcagctgctgtactagatatagtgtcattgtttaagcaaattaacacatcccttgatatatacatagtataaatgtattagtctggcatatgtctttttctccatccctgtacataaggcccaccagaagcagttcgcttttatctggcaaggccagcaatacaacttcttggtccaacttcagagtatatcaactgttcacccctatgtcataatatagttcagagggattttgatcacttttcccttccacgagctatcacactaattcattacattgatgatattctgctgcttggacccagtgaacaaaaagtagcaactattctaggcttattggtaagacatttgtgtgccagagagtgggtaataaatctgacagaagttcaaggaccttccacctcagtaaaatttcttggagtccagtggtgtgaagcctttcaagatatcctttccaaggtgaaggataagttgctacatttggcctttcctacaatgaaagaagcacaatgctgagtggacctctttagattttgaagacaacatagttctcatttgagtgtgttactccatcttatttaccaagtgacctgtaaacctgctagttttgagtggggcccagaataagatccaggctgctgtgcaagcttctctgtcgcttgagctacatcacccagccgaaccaatgatgcttcaagtgtcagtagcagatacggaggttgtttggtgcctttggcagtcccctagaagtgaatcacagcgcaggcccttaggattttgccatcctctgtggttaactaatccccttttgagaaacagctcttagcccgctactgggccttagtagagactgaatgcttgaacatgggacagaaagttaccatgcaacctgagctgcacatcatgaacttggtgttttctgacacaccaagctataaagttgggggtcacttcatcatcaaataaaagtgatatatacgtgataaggcctgagcaggttctgaggacaaatgtaagttaaatgaagaagtggcccaaatatccatggttccctctcctgctacgccgtcttctgtctcccagcctgtacctatggccttatgaggagttctctattatcagttgacacaagaagggaagactcaggcctggtttacagacagtttgacacaatatacaggcaccacccaagagtaaacagctgccacattacagttcattttaggatgtcccttaaggagagtggtgaaggaaaatcctctcagtgggcagaatgttgagtagtgtacctagttgttcactagcttgaaaggagaaatggctggacatgagattatatactaattcatgagctatagccaatggtttggctggatggtcagggacttgaaaggaacatgattagaaaatttatgacagggaaatttgggaaagaaatatatggatagacctctctgaatgggcaaaaaagtgaagattttgttccccatgtaaatgctcaccaaagggttacctcaacagaggaagattttaataatcaagtggacagtatgatctgttctgtagatagcagtcaggctctttactcagccacttccatcatcaccaatgggtttatgaagaaagtggtcatgatggctgtgatggaggtaatcgatgggctcagcaacatggactcccactcaccaaggcgtacctggctacagtcactgctgagtgcccaatctgatagcagcagggaccaatacctcctgcaaaaactatcattcatggacttacagaatgctttatccaccatcatattattccacacagcattatttttgatcaaggaactcacttcacagcaaaagaggtatagcagtgagtccatggtcatggaattcactggtcttaccatattcttcactatcctaaagcagctggcttgaaagaacagtggaatggccttttcaagactcagttacagaatcaacttggtaacaatacttttaaggttagggcaggttcctccagaagggtctatatgctctgaatcagcatccaatatatgatgctgtgctcccatagccaagattcacagttccaaaaatctaggggtacaaatgagagtggaatcgctcattattacccctagtaacccactagcaagatttttgtttcctgctcccatgaccttatgccttgctgacctagaggccttagttccaaaggcaggaatgcttctaccagaagacataacaacaactccattgacttggaaattaagactgttgcccagccactttggtcccctcaagcatcttaatcagcaggcaaagaagggactcatggtgttggctggtgtgattgagcctgaataccaatggaaaattgaactactactccataatgaaggtaaggaagaatatgtctgaaacacaggagattccttagaggatctcttaatattaccatgccctgtgattaaggtcagtgaaaaactataacccaatccaggcaggatgcttaatggcccagaaccttcaggaataaaggtttcagttatcccaccagataaacaaccgtgaccagctgagatgcttgtgaaggcaaagggaacacagaatgagtagtggaagaaggtagttataaatgctaactgtgaccacatggccagttacagaaattagaactataattatcatgcgtatttcttccttattttataacgaatattatattattccattctcacactgccataaaggactacctgagactgggtaatttatgactaaaagaggtttaattgactcacagttccgcaggctgtacagaagcatggctgaaaggcctcaggaaacttacaatcatggcagaaggtgaagaggaagcaagcatgtcttaccatggtgaagcaggaaagagagagcaagagcgaggggggaagtaccacactttaaaaccatcagatcttgtgataactcacttactatcatgagaacatcatgggagaaatttgcccccatgaaccaatcacctcccacctggtccctcccctgacatgtggggattacaattcggcatgagatttgggctggcacacagagccaaaccatatctaataagtttgtgtttatatatattaagcaaccatctttgtattatttccttttttattcctttatcatgaaatataaaatgtattaactttacatcgtggtaattaagttgtgagacatcaaggcaaagagtaaacatcactcaaggattttacctcctcttctagaaaaggggttagtgaattttcagttgtacacaggacagttgcatcatgttaggctgaattatgaccttgttattgtttttatttggggatgaagtgtggtttaatgagatgtgtttaggtgccaaattgacaaatggtggacatgtgatgcttaattttatgtctcaacttaactgggccatagggcgccaagatatttagtcagatgttattctgggtgtgtctgtgcaggtatttttggatgagcttgacctttgaattggtaaactgagtaaagcagattgcccctgttatgtgtgtggacctcaatccaatcagttgaaggcctaactagaataaaaatgctgactctcttatgagcaagtggggactcctcctgcctgaccacttgagctgggacatcagtcttttttttgcctttgaacttgaactgaaacatcagctttttaggggtctcaagcctgctggtttttgaactggaacatgcatcatcagctctcttggttctcaggcttttggaatcagactagaactacaccatcagctctcctgggtctccagcttgctgactgcagatcttgggatttctcagcttccataattccatgagccaattatttataataaatctctctcatatatacatatacggatatatacatacatacacatagatagtcttctctgtatatacatatacatataaatttatgtattagagttctccagaccaacaggatgtgtgtgtgtgtgtgtgtgtatatatatatatacatatatataatatatatatatattagtcacagtcttcaggctaatgggatgtgtatctctgactaatacatagatatattgcagattttattgatataaatgatgtgtagcacacaatttagaaataataatgaaatatacaatactctattgtaaattccatatagcctattgaatctcacaaaatgctttcaatgacttttgctgaagcttgtatccttagctgggctatgtttgtaattgatgaaggagtcaagttttgatatgaacattggttgatatttttatttaagttaatgagtgaaactaaaatgaaaaaacaatgatgtatgttgaaattttattcatccatcaatgacatgaatgaattcattgattaatctgaattcaaatactaaaagaatatttcctcaatttttgtgcaatttacaattttaataaggtatagaacatataagaaactgcacataaagtgtaaaatttggtgggttttgacatatatcccattaaactcctgaaatcaccacaaatgaacatatctatcacactcaaaagtttcctcctgtcccttttgtaatgcctctgcatccccatcatccacaggcaaccattgatctttttctcactatagattcattttaattttcaagaatattgtataaatggaataataatgtgtatactctttttctcttgcttcattcactcaccatacttattttgaaatttatcaatattgtagcatgcattgacaatttattccattttactgctgaatagtattccattatatgaatacacctcaatttacttatccatttacctgttgaagaacaactggattgtttccagtttggggctattaaaaataaagccactatgaaaattcacgtacaatttttttgtatggacatatacattaacttttctgggataactacttagttatttttagactggatcatacggtacatgtatgcttacttttaaaagaaattgctaagctggtttacaaagatgtaccattttttcattccctctagcagtatatgagagttctagctccttcacattctcacccacgcttggtatggtcagtcattttaattttaggtttaacttaatagatgcataatggtgtcacattgtggatttaatttgtatttacctaaaaactagtgatgctgagcaacttctcatatgcctgttttccatttatatatcctttttggtgaagtatcttttcaaatattttgcccaacttaaaaaccagattatttgtttcaattttggggtgttttaagagtctttatatgttctgaatgagtcctttatcagattatgatttgcatatattttcccagtctgtaactcatgttttcattttctcaatagtgtctttagaacaacagataattttaattttgatggagtgtgattaatctttcctttcatctattatagattatacttttgatgttatatcgaagaaatcattgcttagctcgtggtcacaaagatttttcattatatcttattctagtcatttatgattttaggccttacacataggtctgtgatccattttgaattaagttttgcatatggtgtaaagtatggctcaaaggtccttattttcacatggaaatccaattgttccagcaccttttgttgaaaaagacccttctttatccacgaattgcctttacctttttcagacatcagttttgtatatatgtgtaggcatactactggactctttttttccattaatctatttgtctctcttgatgctactaccacatttcttgattgctatacctttatcaaaagtccaatgtgtacatctttcatttcttattatttccttctagcactagccaaaacatccagtataatactaaataaaagttgcaagagtggatatctttgctttgtttctgatcttaggtggaaagtattcattcttccataatgaagtatgatgttagctgcgggtcttttttaaacaactttattaagatataattgacatataaaaattatatatacttaaaacgtatgacttgatgttttgttataaatatacattgtgaaattattaccagctaattaactaattaatggtaacctttacatagttaccatttgtgtatgtctgttgagatataatttaagatccagcctcatagcaaacttcaagtatataatatagcattttttactattgtcaccatgttgtatattataactccagaacttattcatcttgtaagactgaaattggggctattaaaaataaagccactatgaaaattcaccaacaatttttttgtatggacatatacattaacttttctgggataactacttaggtacttttagactggctcatacggtacgtgtatgcttacttttaaaagaaattgctaaactggtttacaaagatgaaatgttgtaccctttgaccaacattacccaattcttccctcctccaactatccaactctcttcttccttgaatttgactatctcagattccacatattaaatgagatcatgtagtatttcaatttctgtgtcttgcttatttcacctagaatgatgttcatcagttccatccatgttgtcacaagtggcaagattttcttcttctttaagactaaataatatttaattatacacacacacattaaagttatttccatattttggctattgtgaataatgctgcaatgaacataggagtgaatattaactctttgtgatgctattttcaattcctttggctacatacacaaaagtgggattggtggatcttatggtagttctatttttaattttctgaggaactttcataatgttttccataatggctgcactaatttacattcccacaagagtgtacaaaaattcccctttctctacatcctcaccaacacttatattttgtttttttttgtaatagccatcttaacaggtgtgaggtggtatcttactggggttttcatttgcatttctctgatgattagagatgtttaacacctttgcatatgcctgttggccatctgcgtttcttcttttgagaagcgtctatttaggttctttgcccattttttaattgggttatttgtatttttggtattgagttgttatgagtttcttatatatgttggatactaaccacttatttgatacatagtttgccaatactttttcccattctgtgagttgcctttttgttttcttgattttttcctttgccaggcagaagctttttagttggtgtaataactcttgtctatttttgcttttgttgtctgtgctttcggagttacatcctaaaaattatagacaagatcaatgttaagaaggtttttccctatgttttcttctagcagttttgtagtttcacgtcttatgtttaaatctttatttaagttttgtgtacagtgtaagatatgaatttaatttcaatttttgcatttggatatccagttttcccaataccatttgttgaagagtctatcctttttccattttgcgtttttgacactccgaagatcagttgaccataaatgtgtgcgtttattttttggttatctgttctattctattgatcggtatgtctacttttatgctggtaccgtaatgttttaattactataatataacttagagtcaggaaatatgatgcctccagcttatccttttgcacaagactgctttggctgtttcaggtcttttgtagttccatacaaatattaggatttttttttctattttttaaaggccatttgggattttgataggaattgcattgaatctgtagatcactttgggtagtatggacattttgaaaatattaattattctagtccataaacttgggatctcatctcatttatttgtgtcttttctagatttcttcatcaatattttatgattttcagtgcatacgtcttacaactctttggttaagttaattcctaagtattttctttttgcttgttcttgtctctaatgtaaatgggatttttttttttaatttttcttctggataggtcattgttggtgtatagaaatgccactgatttttgtatgatgatgtatttttctacaactttactgacttatttattagtgctaacagttttttgtgtgtgaattctgtagggttttctacatacatgatcatattatctgcaaacaaataattttacttcttcctttccaattttcatgccttttatttctttttcttgcctaattgctctgggtagaactttcagtactacgttaaatagcagtggtgagcatgagaatccttaccttcttctggatcatatagaaaaagttttcagtttttccccattgattatgacgttagcctcgagtttttcacatacggtctttattgtgttaaggtaagctttttctatatttatttacttattttattatttatttattcagagacagggtctcactctgtcagtgagagtggcactccaggctggagttcagtggcacaaacatggctcactgcagcctcgatctcttaggctgaagtgattctcccatgttagccttccaagtagctgaaattacaagtgcacaccaccacacctgggtaatttttctattttttacagagacaaggttttgccacattgcccaagctaggctcgaactcctgggctcaagcaatcttcccacctcagcctcccaaagtgcaggggctataggtgtgagtcatcatgcccagcctccatattcattttgttgagttttatcatgaatagatggtgaatttcataaaaaaatttttctgtatctattgagatgatcatgcagcttttttattctgttaatatagtatacgacattgattaattttcatatgtatatgttgtattctcctttcttagggataaattctacttcatcatgtaacatgatttttttgttgttttttgttgttgttgttgttttgtttttcttttggagacggagtcttgctctgtcgcccaggctggagtgcagtggtgcaatctcggctcactgcaagctccgcctctccgctttgctccattctcctgcctcagcctcctgagtagctgggactacaggcgcacgccgccacgcccggctaatttttttcttttttgtatttttagtggagatggggtttcacagtgttagccaggatggtcccgatctcctgacctcgtgatccgccctcctcagcttcccaaaatgctgggattacaggcgtgagcccccacgcccggctgtaacatgatctttttagtctgtcggggggtgtggggctgggggagggatagcattaggagaaatacttaatgtaaatgacgagttgatgggtgcagcaaaccaacatggcacatgtatacctgtgtaacagacctgcacgttgtgcacatgtaccctagaacttaaagtaataatatataataataattatataatatggcacctatggaaatcatattagtcctccttccagggtttattgctattgctgtttgttattttgttgttgctgctgttttttttttttctatttagtgaatttcccggactaattttaaaaagtttgtgttctttattgtatacagtcactcaagtctctgctcaattatcttagtcgccagtgattggacagagatttatttaaatgccttgaactaataattctcccaccttttgctgacgtggagcaaccctcaattccctggcaagcagttaataattctgccttaatcttcatttcttgtttgtgcagagcatcaaggtcactcttacatgagtgattagggccttctcaggtgctttctgggcatagacacagccatacatttgtcccccacccttcagaatcccaggaaaatttcagagctctttaaagctccctgtaaacatctcattcccgatattttccttttaagttttttgtcatcctctattttgctccaactagtattatttcctcagggaactatagtgttaaacaattgccatggattttgtaaattattttaaaaacaatttttgtgggtacagacagtctacggatagggttttcctcactgacaaagccctggagtaaggtcaaaataaagacaagcttttcccgggattttccagacagctcatatagtcacagctctctggtgatgggtctttggggagctccaaacccattctgtcttctccagtggttactagcctgctgaattttccagttgctgtatttctgaagttgcacgttttcaaagctaccatcaagcaggagagtggattatcagactacagcaagtaaaaatgccacagtgctatctgttccaataaagatttaactgtttttcttgaataaatgcttcttagattgttgcaagtgtttggttaatttccagagttctgaaaagtcattttttttttcctagtgttctcattgcttttatgggggaacagattaatgttctccttaatacctatggaagaccctgtgcagatatttggggtactttctctgtacaactatctcttatccattaccctctcctgtgatctctagctaccttcaccagaagtccaccaggctctgcttcagttccctctccctgaaccatgacctggaaactctctcaaggtagcaagcttagaaaattatagaacccttctaccttgtttcccatcactcagagaccactgcttttcattggctagtgccctgtgtcctgaaaatcaccatataatatgttttattttattttttggttgtttcaagtaggagattaaatttagtccctgttactctattttagccagaagtataaatcccctccatgacacacttttaagtttaatatgcattattaatattttcctcatcacttctttaattctaaactgtcgacagaacagtaaatctagcactgatttatagcatttgccaacttatattgtatatatactcccgctatggccaatttcaagttaacaacatatgtaatatttctacaacatatgtaatacaatagatataaataacctcaggagcatagattctcctgtaaatgaagtaaaataaataggaaattactttgttttcattattactttgtttctaatgtaatttgtttaattgtaagttgaaataatttaatttttaataactatttaaaaacagcttacaaagtttctgaaaatttaacaatctgttcttgtgagatagtatgagccatctgtagtacactactgcttctgtctctagagattagaatcactgtggaaacatcactataagccagtatgcaaggagaagaattcatccacctagggatatgtgtgcatgctccctgctcaccaagggcattaagctaccctaacaaatataaaaagcaagcgtttcaccacttttttctctccagaggaaaaatattattctcagaattccaccattaaaaattcattactaaagatcttgaagtcttttcaatttctaagaatcctctattaaaatggcaaggtatttcctgtgagcagtaatactttaagccttttaatcggctaatacctttatggatggtacatagctaagtaagaacaaggccttgtgtcattagctcctaggctctgtgcttggcagaggcagtggaaatagatgtaggagggaaattaaaaagggaaagtagcaatactccaatttaaaagtgtctttttaattgactttcagaaagtcagtcccaatatatccatatataggactgagtttttacatactaagaaaatagctggtgcctcctcctatcttggcctgactacccactagcagtgaaggtcacatgagctgctaaccattttgtcttgctcatctccaggagaacattctaatgttggaggaaaaattgaaagaagaaaaagataagaagtccatctataaacctcaaaagtttaaaatatctttacaacagtagccatgccaaaatattaaaaagctagaaatgttcagcagtttatgtaagaaaaggaagcccataatgagaaacaagagaaaaatgaggaagaataattttctaaagacaagggggtttgtgaggaaattgtcacttttgatgagttcaagataatattttttctcaagatttaaaaattaaattagaaatgggtgatatttggcagcccattcataaatatgtagaatgtatacaacctttgaagaaggagggtgccacaagccagaccaagctcctctaaccacaatcagcaattcctgtacaaagctgttagacccacgcaccaagcacgcagtgcaaattcccagtcagctacactgagttcccaggggcagaacaatgctgacctttgcccctgtaaaaattttgtatcgctctctcttgtgcctcatactcacgtagtaaagttttcttcctacttcctaaccccaaaccctaggcaacctctcaatgcctactatgcgtggagtctattaatagtaatttagcctgcaaaactctagaaggaaatgagcagaattgacttgtccccatctacacagctgttggaatatgaataccgtcttcagatttctgaatttttctaaggcaagaagaaatctaaagtggggaaggtctctgtcactaaaaaggattgtaagcacggtccaacttggtaaagggcccaaggaaagaatcatctctggagcttaaaaggaacatggtggcagaagggcaagagatgcaagacagggtaattgtaacctgaggcagtgggagaggcagaacactgaaaggcagccaaagtttgcagccaagaaggacgcatttcatatcagtatttaatccatagaggaaggtagatgcgatgggtatctgggagaatagatagcatgagagaaggaggattgaattgagtcaggagatgaaaaacgtgttgagcagagctattatatgtgttagtgtgctcctttatttacatgggggctcagcacatatcgaagaactagattaaatgcttaaagaaattaaattaaacttacagcaatattttatagggcccatagagagcatcctgacttccaggtgatctttcctccagatttctgaagtactgaggttaagttatgaatgatagaatcataagcaatcattaacaggcaatagagagaccctgggaatagtcttaatttttggaagggacacaagggaagaaaacctcttataacaacatactcctcagagtttctattagaggaaagatcttgggctggtttcccttaagatggaaatcacaatgatcaggattcattaagatgcctttgagcagtatgactgttatttctgggaaacagcactcaagaggctacagtcacagacctcaagatatcagagcaactccatctctgagttgagatgtactaccttctgagtacaggtttacaatccaaacttggattgcccccgccccagtgtcaaaaggaattgagattctatctggattatctagtttatttcatctataaaacagcctaaactgataactgaatctcaaacttcatttcttttagtctgaatcatcctgtttgcctgtcttcatagtataaacaaatagctaactgataaatgtgccctcctttggtgctgtatctaacccaatagtctctaagtaccataattgttggtaatactttgcaaacttttatcgtgttaataaataattgatgttagggctgacatcgataacaatcaccttgtctatcgccctcatttttcagaaaaggaaatgaagacataaagaagcggtaatgtggccgggcgcggtgactcacgcctgtaatcccagcactttgggaggccgaggcgggcggatcacgaggtcaggagatcgagaccatcctggctaacacggtgaaaccccgtctctactaaaaatacaaaaaaattagccaggcgtggtggtgggcgcctgtagtcccagctaatcgggagctggggaggctgaggcaggagaatggtgtgaacccaggaggcggagcttgcagtgagccgagatcgcgccactgcactccagcctgggcgacagagcaaggctctgtcaaaaaaaaaaaaaacggtaatgtgacttgcctgagttcacgcttcaagttagtggcagagctgggactacaatccacgtctcctaattcccaggacactatttttaaactgcaccaatttacaaatagaggtacataccattgctttcagaaatgttccctgataagtttttctctttcattttgaagctgttctattgtaacattttaagtcttaatgttttatgtgggggcaggcaggaatgtgcagaattaaccactttgcaggaaacatgaccttgtacaaaagtaaaactctctgagtaacaataagcttgacctggttttagagcacccgatatgcaaaatgagaaatttataagataatcgcactgaaggtgattgcagtataagggagtactcagcagaacttcttgagtgcatttaagcatttaagatcattatttggcagaactctctggggccgagaaacaaagttaaaacgttaaaagttactgccaaatgaaaaccaaaaaagcaaattaagcatctttgaagaataatagaagtcatgaagaaatagaatctatttgacaggaactcagattctcctggaaatatcagggccctagtcatcagccttaatgaatggcctttctcagtcacacagatagcagcactgtaactcctccagtcaccagggcttaaacttggatattatttgaaggttcctcctatgcctcattctctagagtttattcactaacaaggcttgttttatcttcctttgaaataactctaaaattctcgtcttctccattcagactgccaccattctagatagaatctataaacgtatgacacagtcccattctcccctactctggttcaccattgacacagccataggagtcaccatataacatacagctttcttgatcacttctttaagaacctagagtgtctcttcaatgcctataagatcaagtcacagcttctcaaccagatgttcatcaccctccaacaagtaggcccagcttacttactcctacattcttccctctctttctaaatattgccctatccaaaacagtaccaattctcacccctgacttccacccctaccccacatataataaaagttttctcctagctcctacatctgtctatctatatcctacccagcctttaaaaatcagctcaagttctacctcttccatatacctttcctaaccaccacccaataacttcagctaacactgatctttacaatttcatttagtgctagcaatgctatagacactgatatcctccatgtatttttataattggaaaaaaatagcaggtaaaatttggaactcatttaacaaagtcctgccctgaaacagaaggatggtcaaatgtttatacaagcatacctcggaggtattgagggttcagttctagaccactgcaataaagtgaatgttgcaagtcaaatattttcatctcccaatgcatataaaatttatgtttacactatactatagcctattaagtatgcaataacattatgttaaaaaacaatatacaaaccttaattttaaaatactgtattgctaaaaaatgttaacgattatctgagttttcagcaagtcataatctttttgctggtggagggtcctgccacaatgttgatgactgctgactgatcaggctgactgataagggtgggggttgctgaaggttgaagtggctgtggcaattttttttgttttgttttgttatttatttattttttttgttgtttttattttattttattttattttattttattttattttattttattttattatactttaagttttagggtacatgtgcgcaatgtgcaggtttgttacatatgtatacatgtgccatgttggtgtgttgcacccattaactcatcatttagcattaggtatatctccaaatgctatccctcccccctccccccaccccacaacagtccccagagtgtgatgtttcccttcctgtgtccacgtgttctcattgttcagttcccacctatgagtcagaacatgcagtgtttggttttttgtccttgcgatagtttgctgagaatgatggtttccagtttcatccatgtccctacaaaggacatgaactcatcattttttatggctgcatagtattccatggggtatatgtgccacattttcttaatccagtctatcgttgttggacatttgggttggttccaagtctttgctattgtgaatagtgccgcaataaacatacgtatgcatgtgtctttatagcagcatgatttataatcctttgggtatatacccagtaatgggatggctgggtcaaatggtatttctagttctagatccctgaggaattgccacaccgacttccacaatggttgaactagtttacagtcccaccaacagtgtaaaagtgttcctatttctccacatgctttccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatatccttcgcccactttttgatggggtttttttgtttttttcttgtaaatttgtttgagtttattgtagattctggatatgagccctttgtcagaggagtaggttgaaaaaattttctcccattctgtaggttgcctgttcactctgatggtggtttcttttgctgtgcagaagctctttagtttaattagatcccatttgtcaattttggctttggttgccattgcttttggtgttttagacatgaagtccttgcccatgcctatgtcctgaatggtattgcctaggttttcttctagggttgttatggttttagggctaacatttaagtctttaatacatcctgaattaatttttgtataaggtgtaaggaagggatccagtttcagctttctacatatggctagccagttttcccagcaccatttattaaatagggaatcctttccccattgcttgtttttctcaggtttgtcaaagatcagatggttgtagatatgtggcattatttctgagggctctgttctgttccattgatctgtatctctgttttggtaccagtaccatgctgttttgattactgtagccttgtagtatagtttgaagtcaggaagtgtgatgctttgttcttttggcttaggattgacttggccatgcgggctcttttttggtcgctatgaactttaaagtagtttttttccagttctgtgaagaaagtcattggtagcttgatggggatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattccttggtattttattctctttgtagcaattgtgaatgggagttcactcatgatttggctctctgtttgtctgttattggtttataagaatgcttgtgatttttgtacactgattttgtatcctgagactttgctgaagttgcttatcagtgtaaggagattttgggctgagatgatggggttttctagatatacaatcatgtcatctgcaaacagggacaatttgacttcctcttttcctaattgaataccctttatttccttctcctgcctaattgccctagccagaacttccaacactatgttgaataggagtggtgagagaggcatccctgtcttgtgccagttttgaaagggaatgcttccagtttttgcccattcagtatgatattggctgcgggtttgtcacagatagctcttattattttgagatacgtcccatcaatacctaatttattgagagtttttagcatgaagagttgttgaattttgtcaaaagccttttctgcatctattgagataatcatgtggtttttgtctttggttctgtttatatgctggattacatttattgatttgcatatgttgaaccagccttgcatcccagagatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcaggatgatgctggcctcatcaaatgagttagggaggattccctctttttcgattgattggtatagtttcagaaggaatggtaccagttcctccttgtatctctggtagaattcggctgtgaatccatctggtcctggactctttttggttggtaagctattgattattgccacaatttcagatcctgttattggtctattcagaggttcaacttcttcctggtttagtcttgggagggtgtatgtgttgaggaatttatccatttcttctagattttctagtttagttgcgtagaggtgtttgtagtattctctgatggtagtttgtatttctttgggatcggtggtgatatcccctttatcattttttattgcatctatttgattcttctctcttttcttctttattagtcttgctagcagtctatcaattttgttgatcttttcaaaacaccagctcctggattcattaattttttgaagggttttttgtgtctctatttccttcagttctgctctgattttagttacttcttgccttctgctagcttttgaatgtgtttgctcttgcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggattcaaagaacatctttatttctgccttcatttcgttatgtacccagtagtcattcaggagcaggttgttcagtttccatgtagttgagtggttttgaatgagtttcttaatcctgagttctagtttgattgcactgtagtctgagagacagtttgttataatttctattcttttacatttgcggaggagtgcttcacttccaactatgtggtcaactttggaataggtgtggtgtggtgctgaaaaaaatgtatattctgttgatttggggtggagagttctgtagatgtctattaggtccacttggtgcagagctgagttcaattccttgatatactttttaactttctgtctcgttgatctgtctaatgttgacagtggggtgttaaagtctcccatttttattgtgtgggagtctaagtctctttgttggtcactaaggacttgctttatgaatttgggtgctcctgtattgggtgcatatatatttaggatagttagctcttcttgttgaattgatctctttaccattatgtaatggccttctttgtctctttgatctttgttgttttaaagtctgttttatcagagactaggattgcaacccctgcctttttttgtttttcatttgcttggtagaccttcctccatccctttattttgagcctatgtgtgtctctgcacgtgagatgggtttcctgaatacagcacgctgatgggtcttgactctttatccaatttgccagtttgtgtcttttaactggagcatttagcccatttacatttaaagttaatattgttatgtgtgaatttggtcctgtcattttgatgttagcgggttattttgctcgttagttgatgcagtttcttcctagccttgatggtctttacattttagcatgtttttgcagtggctggtaccggttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagggtgttgaatattggcccccactctcttctggcttgtagagtttctgccaagagatccgctgttagtctgatgagcttccctttgtgggtaaccccacctttctctctcgctgcccttaacattttttccttcatttcaactttggtgaatctgacaattatgtgccttggagttgctcttctcgaggagtatctttgtggcgttctctgtatttcctgaatctgaatgttggcctgccttgctagattggggaaactctcctggataatatcctgaagagtgttttccaacttggttccattctccctgttactttcaggtataccaatcagacgtagatttggtcttttcacatagtcccatatttcttggaggctttgttcatttctttctattcttttttctctaaccttcccttctcgcttcatttcattcatttcgtcttccatcactgataccctttcttccagttgatcgcatcagctcctgaggcttctgcattcttcacgtagttctcgagccttggctttcagctccatcagctcttttaaggacttctctgcattggttattctaggtatccattcgtctaattttttttcaaagttcttaacttctttgctattggtttgaatttcctcctgtagctcggagtagtttgatcgtctgaagccttcctctctcaactcgtcaaagtcattctccgtccagctttgttccattgctggtgaggagctgcgttcctttggaggaggagaggtgctctggtttttagagtttccagtttttctcctctgttttttccccatctttgtggttttatcttcttttggtctttgatgatgttgacgtatagatgtgtttttggtgtggatgtcctttctgtttgttagttttccttctaacagacaggtccctcagctgcagctctgttggagtttgctagaggtccactccagaccctatttgcctgggtatcagcagcggtggctgtagaacagcggatattggtgaaccgcaaatgctgctgcctgattgttcctctggaagttttgtctcagaagagtacccggccgtgtgaggtgtcagtctgtccctactggggggtgcctcccagttaggcttgtcaggtgtcagggacccacttgaggaggcagtctgctcgttctcagatctccagctgcgtgctgggagaaccactactctcttcaaagctgtcagacagggacatttaagtctgcagaggttactgctgtctttttgtttgtctgtgccctgcccccagaggtggagcctacagaggcaggaaggcctccttgagctgtggtgggctccacccagttcgagcttcccggctgctttgtttacctaatcaagcctgggcaatggcaggcgcccctcccccagcctcactgccaccttgcagtttgatctcaaatggctgtgctagcaatcagcaagactctgtgggcgtaggaccctctgagccatgtgcgggatataatctcctggtgtgccattttttaagcctgttgaaaagcgcagtattagggtgggagtgacccgattttccaggtgccatctgtcacccctttctttgactaggaaagggaactccctgaccccttgcgctgtccgagtgaggcaatgcctcgccctgcttcggctcgcacatggtacgctgcacccactgttctgctcccactgtctggcactccttagtgagatcaacccggtacctcagatggaaatgcagaaatcacccatcttctgcatcactcacattgggagctgtagactggagctgttcctattcggccatcttggctccacccccggcaatttcttaaaataagacaacaattaagtttgccacatcgattgactcttcctttcataaaagatttctctgtagcatgagatgctgtttgataacattttacctgcagtaaaacttctttcagttttggaatcaatcttctcaaaccctgccactgttttatcaactaagtttatgtaatatgctaaatctgttagtgtcatttcaacaatgtttcacagcctcttcaacaggaatatattccatctcaagaaaccactttatttgcttatccataagaagcaactcttcatgcgttaaagttttatgagattgcagcaattcagtcacatcttcaggctccacttcgaattctggttctcttgtagttttaccacatctgcaggccatcatttgaagggttcctcaatctttctttcccacaagatggaagtatcatctattggaacatcttaaatgtacttcattcatgacatatttttcatctattacagaatcagagaatcttaagactatatgagaggggaagggactttggatcataaatcatacattgtacatgaagaaactgaggttcacttctgtttcctgggatttctttttttaattttatttagatttggggatacatgtgcttgtttgttacatgggtactggtggggaatgggcttctagtgtacccattatccaaatagtgaaccctacctgatagatattttttcaaccctcattccccttctatcatccccatttctggagtcccagtgtctattatttccatctttatgttcatgtgtgtccactgtttagttcccaattagaaatgagaacatgtggtattggttttctgtttctgagttagttcacttaggataatggcctccagctccctccatgttgctgcaaaggacatgatttctttctttttatgtctacatactattccacatttttttaaatccagtcaactgttgattgtttcctgggatttctgatatgttttcattccccttagaaagccactgctgttaaatcaataaaataatttaggaagaagttcagcagtatgtgttgagagctttaaaaatgctgccaggttttggtccagtaatttgacttctaggaagctatactgagcaaataacctggatatatgtgaagatctttatgtacagaaatatctctctcagcttcatttacaataatatagatcaatgaaagaaatcttaaatattcccaagcttgagactagttaaatacattgtagtatacctgacatgaccgaatgaaacattatgtagccattttagtagagtattttaacacagaatggtagaaagcatactatctcaatctcacctgtcagagctacttccccacaagagaaattggtggtgggaagggcagtatatgcaaagagtgttattacagataattatgtatgaaaaattcctacacaatattaagtaaagaaaactgggtagaaaaatgtgtattaaggatgagttaatttaaaaatgcataggggaagaagactggaaagatttattttaagccatatagttttattttatgtattcatgatttgctggtttaagtaattttttgcaatttttgttttgaaataatttcagacacatagaaaaattacaaaaatagtaaaaagaactcccatgtacctttcatccagattccctaactgttatcatttaaaaacaattttgtaggccgggcacgttggctgacgcctgtaatcccagcactttgggaggccaaggcagacagatcacgagatcaggagtttgagaccagccttgccaatatggtgaaacctcgtctgcactaaaaatacaaaacttagccgggcatagtagtgcatgcctgtagtcccaactactcgggaggttgaggcagaagaatcacttgaacctgggagatggaggttgtagtgagccgagatcgcaccactgcactgggcaacagagtgagactctgtctcaaaaataataataataataattaattaattaaataataaaataaaacaattttgtaaagtagtccctttgtcccatttaaggaagtttggccaataagctcctgtgtgaacattgtcatattacattccaaagtaaaggggcaacggaaatgggacaggctcatttctgatggcctgtgggatctgggattaaagacaatccaagactagtaatgaaatgcaagacttttaacgaattacgctgcttattatttgctgtttcagtgtgtttccattctgcttttaccttgactacttcaaagaatatcacgcagacaaagtgataatgagtgttgagcaacagatttaaaatcccccatgcagctgaatgacttaagggaaacaaatatataactttttacttatgtcttcacctcagtgaaaataaaatatattgatttcatccagatgtcagtggttatacaaacctcccctggacattggagagaaggagaggaaaaagcttacaaaaataaaatcacacgtgtttatagccatgaaaatacattattcaaatgaaagtactgacattttaacataggcactgcatttttaaccttaaaattgaaagagtcccctgtattatagtccttttagagtcagaagagaaatttgggtcatttggcactatccaataaaactttccacaatgatgaaaatgttttatgtctatactttccagtacagtaaccgtgagccacatgtagctattgagtgcttaaaatgtggatgatgcaactgaggaattgaatttatttcattttaatttatttaaatttaaatagccacttgtggctagtggctactgtactagacagcgtgctagactaccatcctaagtagaaatttcttttccagttcccctgatctctttgcattctccctcgtgatcatatcaattcctaacagctccagttaccacttataatatgatacatcatcctggctgcatgttaggttcacctggggagctattttaaaatgtcattgtggagaggaggggtgacctaagcatggatatttgtaaaagggtatttaatatgtagccagggttgagaacctttgatcaatatgcaatgattcccaattttatattactagctctcaatgataagcttcagatgctgactggatctcctcctgatgtcccccaccccaaagaaagcctcaaacaccaacatatccaaatgtgacatgattatgtcccatcgccctcacccaaatcctttgaattgtaactactggacttgcttctgccattttgccatttgttttctatatgtcatatattttttgttcttcaattccttcattaataccttcttttgtgtttgactttttgtagtgtatcattttaattcacttctcatttcctattctagctatttcttagttattttcttagtagctaccatggaggttaaaattaacatcttaaatatatagcaaactggcttgaattaataacatagcttaaatagtataaataactctgttcctatgcagctctcttttcctttatgttgttattgtcacaacttttttatatcatatgtgtccactaacatagattcataattttggtttcatgcatttgtcttttaaatcatgtagaaaaaaatagggcttacaaaccaaaagtacaataatactggcttttaaatttagctatgcagttacatttatcagcgttctttatttcttcatatggcttcaaattgcaatccaatctcaaggactccctttagcatctattgttggacaggtcagtaaacaacaaacttcctcagcttttgtctaagaatgtcttacttttgccttcattttagaagaatcattttgcaggatatagaactcttgattgaagatattttatttcttttagcgcttatcatctactgaatttggatctctgtgtgtggtttctgaagagaaattggatgttaattttattgagcatcacttgtatgtaacaagtcacttccctcactgatttcaagattctctgtctttggcttttgacagtttgattgtagtgtgtatcagtgggaatttctttcagtttttccttcttggaggtctttgaatttctcggatttgtagattcacaaaaggcaatcacttttgcaccaacctaataacttagccttagactaattaagactcagtccttgaggtgaaggaggggcttcttgcccgagcccatgactgcgtggggatgtggttaatctcacaaacaaaagcagggctctgccaacagagcattctcccatctctatccccaccattctttcatggaataattcaatacatatttattgggagcttactatgtgccaggtactgggaataaaatagtgaacatgactgatgaggttctggctattatggagtttacatttgggttgggagagccaaatgttaaaatagtgaacaaataaaaatgtagtcaattcaaataattataagttcttgaagaacttaccttgaaaaaaatgtagatggaaatgaagctaggatagtgagatgtagaatgacatgtgtggggcttgaaagcgtggtcttgaaaggcttcactgaagagaggacatttgttctgaaactatacaataggaaggaaaatgtgcagctttatggaagaggactaaagtgtaaggacccctatgtgatcacatgtttgacaggtttaaagagcagatagaaggccagtgtgttcttaaataccattgtgttttatatacccacatctgagcacatgctgtgtctacaatctagaaagaccatccctagatcattgctatgtaggaaactcttatcaacccttcaagacacagctcagatattacttcctctgtgatgccttcccttatctctaacacttaaagttgaatacttccttctttgtatccatactatcaattagaatatctatcaccctgcactatgtttaacttatttacatttttgtctccccctctggacttggagttgcttgatggcaagggcaatgtcatttatatatgcatatttgtgttccctactaccaagtgctctgggcgtgacaaatagtagatgcacagcaagcacttattgaactgaaacactgaatatctactattgctggcactctcatagattttgtggagcatacaaaagaatctgccttcattgaagtagtcaggaatgtagactctggtgccagaagcttgactccaatcccattcccaccacttactagctgcgtgaccttaaaaaattacttaacctctctgtgcttcaggttccttatctgtaaggtgggagataacagtggtaactgtctaaaagtgagtattaatttaaataatgtatacaaaacatttagcacacacagtatccggcacagaataagtgttgagtcttaccttatttataaattaaggaaataattagattgacaagatttatacacatgaaaaacaaactactgcaaatatattactatacagaactgtttaaagtacctcctgaaccaagatgttgcagcactatcacctcaacaaagcattgctgaatgaatgaatggactaaaaaacaaaaagccacagtataatctgtgctgatctgaccatttctagagcactatgttcacttctgaacattacactttaagagaaacaaagtactttataactagaagcagaccagtaggatgctccaaaatctggaaagtatctaataagaatgactgaagaaactgagaatggttaggtagaggactacattactgctgacattaaacatttgaaagttgtcatgtgtaataaaggggagctttgcttgatgctgctctagagagcagaacttgggccaggggataaaggttataggcaggtgatttcagctgaacataggagagtatttgctgaaagtcagtgttcaccacgcaggtgaggaagtggtgagttttccatctgtggaggtgctgattaaccgaacaaccacttaacaaggatactgtcaaggggactttttcattgggctgggggttattctagatggactttggagttctttgcaggaggttcaagatctggacctttcagggaaagaatagtgtcactacattaaaattagttctcaaagtgataatctcaagccaaaatgctctcaaaatcaacaaccccataactttcccacgaccagcccacccctgtgcttttatacaagaaatttccactataggcactttttggactgctcattcaaggtccctgttcaaatattattttttttcctaggagaagtatggttttaagccactcagccattatcatcagcttctattatagtgcccggtatatattaagaattatttattcaatgtgttaccagtcattcacacctgagatcgtacaaatttatcagattaaatttacttgccttagaaaggccctggagagataaacaactggacagataagtttggaaaattgtgagaggtcacaagggttttaccatttaagcttcagtcttcatgacacgtggtgcaagccatgcacagataccacgacactctgaaggcactgatgttttcttagttaggtagaaagccagcctttcctcctcacagatgaagtcttatgctgggcagaaatctgggctgggatttgccaaagccattttgtgccctggccttctgccaagtccatcgatttagctctttgaatcgcatcatttaagcccacaaatgtcacagattctattagacaaacgcctctggccagcagcaaagaaaagagggaacatgataagccctctgaggcagcctgttagacaattcttaatctttcatggttggagaactacattgcgagcgggttcactggcagaatggcaagaaatactggcaggttttgtttctttggttaagaatatacctagaggcttagctttggttaatggcagattagtgcatctgccaagtataaaggtaaagggtcatggggaaaaaccttccaaataatacattcttaaaagataccagaaactccatcactagttacttattctcagaataatggcagagtaggcctaacagcaagcatgcagagaaaggattggcctctgagcctggagtgaggctgaggctaaagctatgagtgagggtcaagtggctgcagctgtgggggattggaaaagggcaaagaattaggcaagtcattagacagctatgtgagtctgcatgtcaacagacaatgcaggaaatccatttttgcattattctttattcgtagtatagagctgggcataactatttaacagagttttccaaggctggataccagacctctcctttaccctccatcacttcacccgcattcttttagccagacattgctttaattccaaagtcacagcaacgttcctaatgagggaattcatgttaatatattactagtttttagccatgtgatttattatttcatccaggggtagttttggcaatgtagtcccttaaagcaagagtgactctaatggtaaaatctcaggcaaacctttgtagatttattttttctaaagaggaatactattgaagcctcttacaacagagcccactggaaaattacatagaccagactaattccaaatgcaagagatgaaaattaaaactggactttgaactgactatatatcatccgattatacttgcctcaagttacaaattaccatgattttactgttgtctctcttcactactttaacccatgcatctggcacatagtgagagttcaatgaatggtactgcttgttgccttcattatgattaccattagaggcagtggtagtaatagtgccactccagtacctggcaccatgcctgagccacattaagtattcaaaactaatgattatttttataactttattgccccagcttctggcacagtgcctggcacataataggacaccgattgagttagtttccttcattctcacctttccctgggatacaatattcttctgcttccccccacaactgtgccttactaaaggggttgcagatcttcctgtagcagtaatgcttcctataccagtaacaccaccagtgacaccatctgaaaggacatctagccttttcttccatggtagcctcttaaatggcaaatgggcagcaagtgttcaagaccatttttcagatgaggataccaagattatgagctattgccttggaatgttagctcacctctaatccctatatcctattaagctgaaaaaataagaccccttgcattccccccaacccatcacccaactaggccataactgatctcatctttcttgttgcactcggcagtgcctggactgcccccacactttcatgtttaattcatcctccaaggattagcctaagagctaccatctttatgaaactttctgtgaggcctccagccttcaatgagcagggttgtattgtttcctatcccctagcaggggctagcagagtgctagacacaatagaggctctcagtgtgtttgtattgattaaataaatagaagctaattgggttgttggtcctcactttaggaggtcacactatcccttctctcccccactcatttttgtttacaaggtaaaggcacagaggcagtctacaattagtatcattaaagttttgtgctgtgtattggcaaatgcttactctaagtgctgtttgtttagccactttcactactttcactttacttgaaagtagtggaagaatgtatcagtgcttcttcaggcagtgaaacagcaccctcttctcttgggatttagatgtggagagagatttgtcatttgggtcttgaggcagtgaaacagcaccctgttctcttgggatttagatgtggagagaaatttgtcatttgggcctgctcagggcaagaggcaacactcatcttcaaatactaacttcccagaaagacacaagcacatgaattgcaaataccacttgatataaggtaggcctctccctctgccaaagcagggatgtcattacctggaagactgaggtaaatgttggtggaagcttcatgtctttatcttttcttacatccagaaggtgagaaaaggggctctttagcacatttccatgtcctttagctggcaaaacagttaagtaatgaaagacactggaataggtccatcctaactcagcctccagagtggcctggaggcctcagggatgaggggaaaagtggagccaacacctaatagatctgagcctcattttctcccttggagaagataatcattcccatctcacagggatgctacagggagttaatgaggaatgtgtataaattttacctgtaaactatgaggcaagagctctatactgcgattcattctatgtgattgaagacaaaggctatctttttacctttgtctcccagagacagtttaaacacattgtaggagctcaataactaggtttttactttaaaactaattctattaaatataacctggatttaggtatgatacaaataaaacagaccattcacttatcagaatttaatcatacagattctcagatctgttagcttttcatttgaaatggcagaggaaaaaatcatgagcaggcacagagggtacatgtttatcttttgcagttggctttggcctattggagtcaatacccctttccccattgagcagcagcaagaagcagggttgcagttagaactgaaataggatttcaatccaggatgtgcatgtgggacagttacaaatgtaatcctgaaaattagcataggaccagagacctagagcctgaaggaaattggccaaagaagatttccaactttgcatcactaatcagaagtgttaccatgaatattttcaggcaccagaagagaaggaaggtaggaattagcttatgccatgtcttaggaggtttaccctatgccagttgctttgataatgtatatcttatttaactctcacaatagctttatgaggtaggaattattgtgtagcacaggacctggcacacagtaagcagtcactaaatgataactgcgagtaatattattaagattgataaccttagtatcatcaaccttagtaataaataaagcacagagggcttgagtaacttactcaaggccacagaactggtaagtcataaaaccaggatttaagcccaggtcttcctgaccccaaagcctgggctttttctgttatacttctttgtaagcggaaaaaagacggcgtcattgaagtagtttaggattttctaaccccttagcagggctgcctccataactggccacttgagacctccacgtatctaaggatattttggtctttctctgtttcctcactcagatttctgcattgctatgaaccatggcccaactgtactacaaaaaggtcaactactcaccgtacagagaccgcatccccctgcaaattgtgagggctgagacagagctctctgcagaggagaaggccttcctcaatgctgtggagaagggggactatgccactgtgaagcaggcccttcaggaggctgagatctactataatgttaacatcaactgcatggaccccttgggccggagtgccctgctcattgccattgagaacgagaacctggagatcatggagctactgctgaaccacagcgtgtatgtgggtgatgcattgctctatgccatacgcaaggaagtggtgggcgctgtggagcttctgctcagctacaggcggcccagcggagagaagcaggtaagagaaattcctataggctgggaaatagccaggcacaacagggcaccaggtcagaagccctgaaactagggaaggttaggtggtctggaattgagatgccctatctcagaaattgcaccagtgatctcaggtagcatcctggagctaccctacgtggcccatgctgagttttactgatttaccttttccttattagtgtttgcccatatacattcagtactcactgaatgtacttagcaacccaatgatgtgttctttgtttccagactatttaagccccttctaactttcgtataccctgctttctatcttctgtttcctcctctactcaaaggttatattctagaaaaggagagacaaaatacagacttggtctttctacttctcattagcctctctctgaagacaacacaggaggcctttaaacttgagtgccatggtgcagatgcttatggaataaggcctcatatattttcccagtacctgtcaagtgacttcattccacttccaaatgtttgggattttgcctctgtgattctcatatcctccaaggcacctaggtttgatactctgaagtcatcttttatttgtctggctcccttgcccccatgtccaatccccgagtcctgtggttccttccttccaaatatctttcatatactttctctcctctctagttcgtctttcaccagtctggctctggttctcaacatctctctcttagatgagtggttcctaaagtgcggtcccttgactagcagcatcagcattacctgggtacttgttagaaatgcaaattctcaggcctctgccacagccctattgaatcagaaactctggggtggggccccaacaagccctccagaggattctcatgtacaatcaagtttgagaactgctgtcctagattaacataaagctcttctgactggtctccttgtctctagcatgttcccctctctcaaatcccgagcaataatatcccaagaataaggcattattctccctaaatagcattattctccctaaaataggatatgagcctgccattcctgtgcatccttttgcagcttcccttctgctgtctaaaggttcactaaaaatgaacttacaataggcagattaataggagaaaatggcatacaaaatttattaacatgcatatggacatggaaaccatacacaaagtttgaggctcaaagaaaagtcagatgtttgagacataaatactttcttcataagggagaaatgaatggacctgggaggcaaacattattttataaatgattatctttggactctggacggtgccaacaagttaagggaaagtgaggggtggaactatacaagaactaatgctgtcttttttgttcttaaatttccatagattattgcagagcaggtagtgtttggttacatgagtaagttctttagtggtgatctgtgagattttggtgcacccatcacctgagcagtatatactgcagcctatttgtagtcttttattcctctcccccttcccatccttgtcccctgagtccccagagtccattgtgtcattcttatgcctttgcatccttatagcttagctcccacttatgagtgagaacctatgatgtttgtttttccattcctgaattacttcacttaggaaaatggtctccagtctcatccaggttgctgcatatgccattaattaattcttttttttttttgagatggagtctcactctgtcacccaggctggagtgcagtggtgcgatctcggctcactgcaagctccacctcctgggttgatgccattctcctgcctcagcctcccgagtagctgggactacaggtgcctgccaccacgcctggctaatttttttgtatttgtagtagagacagggtttcactgtgttagccaggatgttcttgatctcctgacctcgtgatctgcccaccttggcctcccaaagtgctgggattacaggcgtgagccaccgcgcccagccaactcattcctttttatggctgagtagtattccattgtataaatatatatatatatatgccacagtttctttatccacttgttgattgatgggcatttgggttggttccacgtttttgcaattgtgaattgttctgcaataaatatgtgtgtgcaattatctttttcgtataatgacttcttttcccctgggtagatacccagtagtgggattgctggataaaatgatagttctacttttagttctttaaggaatctccacactgttttccatagtggttgtactagtttacattcccagcagcagcatagaagtgttccctgttcactgcatccacaccaacatctactattttttttattttttgattatggccattctagcaggagtgaggtggtatcgctctgtggttttgatttgcatttccctgatcatcagtgatgtcgagcattttttcatatgtttgttggccatttgtatatcttcttttgagaattgtctattcaggtccttagcccactttttgatgggattgtttttgttgttgttgttgatttgcttgagattttcattgtggattctggatattagtcctttgtcagatgtacagattgtgaagatttttttcccactctgtgggttgtttgttaactctgctgcctgttccttttgctgtgcaaaagctctttagtttaattaagttccagcaatttatctttgtttttattgcatttgcttttgggttcttggtcatgaaatctttgcctaagccaatacctagaagggtttttccaatgttatcttctagaatttttatagtttcaggtcttaggtttaagtccttaatccatcttgagttgatttttgtataacgtgagagatgaggatccagtttcattctcctacatgtggctagccaattatcccagcaccatttgttgaaaagggtgtccttcccccactttatgttttcttattatgcagataaagtcccttaggtaatctcttgcagctgtcatcagacaaatacatgaaaagtccatcgggtcatggtgatgactgcccatctcttctccatggttgatctttcttggttatttgattagatttctagggagggagtcttaagacaattgcatttcttttggaaagaagcttctttactcagataaggaagttacagagagtccctcagggtgtatccttaaaaaggatcagagagacagggaggtggacaaaggtcagaaagagagctcagttctgaggcttatttttgagacctttccactttttttcttttttttttttttggagttggagtctcactctgtcacccaggctggagtgcagtggcacaatctcggctcactgcaacctccgcctcctgggttcaagcaactctcctgcctcagcctcccgagcagctgggactagaggtgcacaccgccacgcctggctaattttttgtattttagtagagacaggatttcaacgtgttgcccaggctggtctcgaactcctgagctcaggcaatccgcccacctcagcctcccaaagtgctaggattacaggcatgagccactgcacccagcagcctttccatttttctaagcactcagcatgcttaagtgccatattttggggaattattttctgtaccccaacactttcaataactgtagttattagaaaagaaaccaatccgtgaagcttgcacctcaatgccctcaggcaatggtctttccagtcctgtattcccctagccccttctaaacacccctcaagtcagacaggtctctcttcactgtctctcttctttaggaacacagaattctgcacatagtagggacaaaaaaaaactaaatcatcaaaattggaatacctcaacactttccaaaaagtagaaatagtacataacaaaaccaaaattgcaaatgtcttagaaatagtaataatagaaacactcagcatcaaatctaatggcatatggccaaagctgagtctaaaggaaattcatagctttcatatttgcctaattaaacaaaaaagaatgaaaataaacttaattataactcacggactaagaattgtaataaatggagcagaaagcaaagacactatgtgataataaaagttccttgagtaaagggcctgaatccccctccaccatcagcattgaacacagtactaagagagcaggactttctctctcttgttcactgctgtattacatcactagaaaaattattggtacatcaccaacacttcataaatgtatatttaatgaatgagtaacatacaacccacactgtgctaagtatctgacatggcttatcccattcaatcctcttagcaactctattagatagacagtattattatcatccctattttaccataagaaaaattgagaccagctgcagtggctcatgcctgtaatcccagcactttgggatttgtccgaggtgggcagttcacttgagctcaggaattcaagaccagcctagaagaaacccggtctctactaaaaacacaaaaattagctggatgtggtagtgcaggcctgtaattccagctactcagaaggctgagacaggagaatcgcttgaacccaggaagcggaggttgcagtgagccaagatcgcaccactatactccagcctgggtggcagagagacactctgtctcaaaataaataaataaataaaaaagaaaaattgactcacatgatgattaggtcaattgtccaagatcacaactagtaaatatgagagccagcattcaaacccaggcagcttagctcttgaacacactctcctaaccactaagccacactgcttccctagcagtctgagtaagtcaggattcccagcacagaagttctgagacaaagtagatcaatggaggatatatcagccctctggaaaggaggggcctgaaggatttgaatgactagcaaagcagagaggtgtgaatatgttcctgacctgactcggtccacctcactatctccattaaagctggtatgttttattccccatttccccagatccctgccaagtgcctgggtgatttaatgtgctattctatactaaggcttacccagctacactgctccagaatgactttgccaacctctgagaatctgcagcctattggcttttcccttcacttgacaccaatcacatatcattttgtactattgtctagccttacttgtgtaaatgtctgatctctgtaattaaattgtttctcaaatgtgaggcaaaaatctcatgttcaatggtttccatgtttccctcatcagtacttaacccagagcctagtacatgatgggtgatatataaatgtttgctgaggaacatgaaagagttaagtgaattttccagaaaagcacatggcttgctgattgaacaagaccctctggactttcatattcaacttgatttagcttcattacagttttgggaatgaggagatcacagagaagtttccaagaaggaggctagtaatgccagctctgtctgagttttgaaagtgggccgagttctcatttgatggccctcatttcctccatctttcctctatgctctactaaatgctgaggctctgccagtcaggaagaaagacactaggcaaacttacactaaggtgcaatcaaaggcatgaccttcctggggaaaggtactacttaacttacagaaatgaacccactgacagtggaaagtcaatcctatggaacctgggtaaagctacttggctcaggcaggtttttatcaggaccctttcatacacattcccaatataagacctactttgtccatacttagctatcacactgtatgtacaaacccacaaagttatcagctccattcccaagtctcttcagcagccttctcctccctttcttctctctccctctaacccccaacatgagcctctgctaaatttcattttcttccattgctctgacaatctctgtgataagtcatatgtctgtaactgtaactgtcacagtactggagctctgtctttctgggagatagaaacaaaatttgtttacttgggagccatcagggatgtgagcaaacacagactttctgaaggacctttggtttagacgggcaagccattttcagggaggcctttctcccacacttggaattcaaacaactactctttttcactgagtccctcccttatctttccaggatattgggcacaattgacctccatcactcttgggaagataaaccactgccttccttggctttactgggcaagggctttagctccaggctagaagtaagaagctgtctgctctatccttatcccagactcttgtgctcttccccgtcttttagtctatcatctcagacaaaggtcaggggctgggcataaggggctgacagtaacttcaaggatcaactttgatatggagactttcatttttaataagaacaaaatctttaaaaatatgatgacactctatcaggtagaattttcctcaccaaacaggggtgtgtgtgtctatgtatgtcggtgtgtgtgcgcacacatgtgtgtgtgtatgttatatgttactctgtggacttgttgctccagaaatctgaccctcttggcccactacctaatcactgtggcctgtttacttaggggtagatttttgacaaccagggaaatttgtgatttttgttgggtaaatcatctgaaattggtctcagaagtcaaaattcttgagacaacataaggtctaatgcccacctatttctggtctagtatgcttgctacctttgagccactgactgtagaaaccactagaggagtactgttatcagggagagcaaatccaaccgcaattcagagaggagactcgcgtctgtgtatgctcaaaaccagctctaaatcaattgttgtgcacatgagcaacttgtcaaaatgcagatttctgagccccactacatacctacagattcagaatcttggagtttaggtctgaaagcagaattttaacaaatgcaccccaacctgtttctaggtaagaggtccacgtacctctctgtatttgtttcctagggctgccataacaaattaccataaattgggtctcttaaaacaacaaaaatgtcttctctcacaggtcaagaggtcagaagtctgataagaatgtatcagcatggctggtttcttctggagggagaatctgttccatgcctccctgctagtctctggtggttgctgataatcctctgcataccttggcttatagccgcatcactacaatctctgcctctgttgtcagagttctcctctgtatctttcttctgtgtctctgtagttttcttctgtgtctctttacctaaatcttcctctcctttttattatgaagataccagtcatttgatttagtgcccaccctaatccaggatgacctcatcttaacttgattaaatctgcaaagacccttcttccaaataaggtcacattcacaagtaccaagagttaagacttgaatatatcttttgggggacacagttcaacccactatactctctatgagaaatatttgtctaaacaagtggttcttaaacattttcagcagtagagtctttcattaaatgaaaacccactcagatgcaaaacagacccaagcagagtttccctagtttaagtgcaggttgtatttcaaacccacttgttcgttctctctctctctctctctctctctctctctctctcacacacacacacacacacacacacacacacacacactcttctactcccacacctccttggcctctgaggagtgaacacagcttaaaagccactggcctacaagacagagtgacagactctaattcaccgttaatggtgcaagccagcttgtagctaacagtgtgaccttgggcaagtcacagaatctctctgtagctcaactccaccatctgcagaatgaagctaacaatgcctagccctacctaatccagaaacctattgtgagaaagaaataaggttaagatatgcccaagtcttttgaaaaaaagctttgaaaaatgctacacagaggtcaataactattattttcagctttactccatccatttgacttagcatgtcgtatggtatggagagaccagctggcaaacggtactcctcacaaggcaccaccagtggagtgagaggaagaggctggtaaacaagccaacttagttctaagattacctccttctgcctggccctgatggcaatgctctcccgtctgttgccaggcaatctgcacgacctcaaagtcatccttcctttttcactagagtctaaggatttgagcaacagggaggtagagctgctggcctctatatcaacaacccacccaagtaattttctttcttggtcacttgcgtcaatgcaagcaggtgaaaagaggctaagccaaccttctccccatggcccgcccctctgggctcttccataattactcatttgtctgtggcagatggctcaaaattaaaattggtctcacagatgagctagagagattaaatctcaacaacactgataagtgtttatgttgagattatagaaaatcagcaacaggacacttcatttactcctcctatctgtttttttgtctcagactgagattacacagtgtggagggggacagcgagggcctggagaaaggtgacgggatcacggagaaggaaaataaaatgtctagcctataaatctcaaacatttaatataaaagcagaaattcaaggagaaaattataaaagtcatcctgctatttatagatagcctgcagtggtagaaagaccataggctttgaagtcagacacttattagatgtgtttccttgaacaaataatttaatctctccaaaccccaatttcttcatctgtaactaggaatgataatgaagtctatttcatagtattacagtgagaatcaaatgaaataatacatgcatattactcagaagagtccatgatatctagtaagtactcaataaatggtagctagtactactcctactcctactagttgaagccatgctgctcaaatcacctgctgactaatgtcatttattcattaaaaaaatgtattaagcacccactagcacatagtggttaataattcagactgaacgaccttgggaaggtcatttaccttgtttaagcatcagtttccttacatgacaaataggtttaatgatatgatatcatgataattctattatttgctttgattcccattccaaagtcaaacttctaggtgaaaacaatggattttgtcaatcaaatcaagaaaataaatcgtttagtttaaattgagagaaaaggacagaatgactgcatggcatcatactggccaaagtgataaactgagttacctactctcatgtatctgtgctaactttcagtaaacatagcttacttcattcacagaatggaattgtagggagtttcaagatcctgtggtctgaagtgaccacacttcaaggtcactcagctgagcctgaactgacacaaatacctcctgccccccaagctactctttctaccaccccactttgcctttgaggaatcatcagaaatgctaccatttacaatggagctgcaaataaataaagcagctacaagtagtgtctatctagaacaattcattgatgacagagtttcagcaaatgattaactctatttagttctgttcaactttctaagtatttttgactactaatcatatgcctcacaatcaaattgaaatatccagttagtgctttcaagaaatgtatactcagagtgacatcatcaagagatatggctgatgagaggtacctaacattcatcccctccacaaaaagtacgaaaacaacaattaaacaactacacttcaactagagtgtctaagggagaacaccagaatatagcaagggactggtgaattccctgtggagcagggaaactcagaatggcagtgtagagagggaagtgaagcaccctgcctccatgaccctgtctctcttgctgagactggctcagagacagcatgggcttctcatcatggggaaaatataaacagaagatccccagcagccctcattactgccattgacacctgcagtccttgctacagcagagtcccacagtcctcacagacactgagcccagtttagggagctgcctggagtccgtgtggctgcattgttccagaggaggagcccacatggtgcaccatccctcacagcactatcttgagactagagccactgctagaatgcatcttgctctgggggccagtagccactgtatctccccctctctgacgccccactgtcattccatcatactcacacaagtggctgcaatgccacaccccagttgcttggagcctagaccaagtagaacagctgtgactttgacacccaagcctatgcagtgccctgcatttcaaggaacaagcgaccctgcacagtggagaagccacctccacgactggtggaaatgccacactttgcacatccctgacctaaccagcagcatcattatcagcaaagccacaccaccacaatacccacagcctagggcactgaagcacttgcagacactgttgatattgattatagctgaagaaattaaacagagactaccttactgtgcttatacagaagcaaagccaaagcacccgaccaaatcaacaccctaagacacatcttcaggaaaaagtctttccctactgttaaaaatcacacaagatctataaatttaggaaacaagactatttattttacaggttagagcctgcaaggtggtcatatcacaggctgggaagaataacctccagaaaagaccagagacaggcacattgaaggaacggttggagtaggaacttcatgctgaatggattagctaaacatatatagttaacaggttataggaggtgatgtgaatatatatgaaggtggtcctgtcatgtgcatattggcaaaacatgcaagcaacatacaacccatgttcattttagggtggagacttaacatttaaatgtattacagttaggtcctatatgtcaaaaggtgaagcggggacatcaagacactcaagtgtgcagcctctgtaaacccaccaggaccagtccatagttggtgcccttttgatcaggaaaagttactgaaatcagtcttttgtccaatcaaaggatgagtggctgggggccagttagcatacattgaaactgaatttgctttaacattgcttatctcaagcccagtgcttgtttagctgctagagaaaaagaataacctcatgacagacaaaacgtagtttattcttttttttttttttttttttagacgtagtcccactgtgtcacccaggctggagtgcagtggtatgatctctgctcactgcaagctccacctcctgggttcacgccattctcctgcctcagcctccctagtggctgagactacaggggcctgccaccacacccggctaatttttttgtagttttagtagagacagggtttcaccatgttagccaggatggtctctatctcctgacctggtgatccgcccacctcagcctcccaaagtgttgggattacaggcgtgagccaccgcgcctggccggaatatattttttgctttacgtgtcagggtgcgtgacttcatgcttgccagacatggccttaggttttgtttataatttggtacaaagagtccagatcatcccactgcactccagcctgggcaacagagactccgcatcttctcgaaccacaatggaataaaccagaaataaataacgaggtattctggaaactaaacaaacacatggaaagtaaacaatatgctcctgaaagaatagtgggatgatagctcctatcttgagatacatgaacctatagaaattaagaagaaaatttttaaattttttgaaagaaatgaaaatggaaacaaaacatatcaaaatttataggatacaaggaaggcactactaaaaggaaagtttatagctataagtgcttacatcaaaaaagtagaaaaacttcaaataaatgacctaatgttacatcttaatgaactaccaaagcaagagcaaaccaaacacaaaattagtagaagaaataataaagatcagagcagaaataaatgaaattgaaacaaaaaatagaaaaggtcaatgaaatgaaaagttggtttttagaaaagatcaaaatcaacaaacttttagccagactaagaaaaaaagagagaaggcgcaaataaataaaatcagagattaaaaatgagaaactacaactgatgcctcaaaaattaaaagtatcattagagcctactacaagcaactatattcaaataaatggaaagatctagaagaaatgaataaatttctagatgcattcaacttaccaagaatgaaccatgaagaaatccaaaacctaaatagaccaataacaagtaatgagaacaaagctataataaaaagtttcccagcaaagaaagacaagcccaggacctgatggtttcactgctgaattttaccaaacatttgaagaagaactaatcccaatcctactcaaactattctgaaaaatggaggagagaatatttctaattcattctaagtcctgtactaccctgataccgaagccagataaagagccatcaaaaaaagaaaactacaaatcaatattcctgaggaatattgacgcaaaaatcctcaacaaaatactagcaaactgcattcaacaacacatttaaaaggtcacttatcatggccaagtgagacttatcccagagatgcaaggatggtttaacatatacaaatcaatcaatgtgatacataatatcaacagaatgaaagacagaaaccatatgattatttcaattgatgctgaagaaacatttgataaccttcagcatccattcatgataaaatccctaaaactctgcatgtacaaggaacacatttcaacacaataaaagccgcatacaacagaccacagctactatcgtactgaatgatcctttcctttcctctaagatctggaataagacaaggatgcccactttcatgactgctattcaacatagtactagaagttctagctagagctatcagacaagagaaaaaaataaagggcatccagattggaaacaaagaagtcaaattatccttatttgcagatgacatgctatatttggaaaaacctaaagactataaaagagaattttagaccaatatccttgatgaacattgatgcaaaaatcctcagtaaaatactgacaaaccgaatccagcagcacattaaaaagcttatccaccatgatcaagtgggcttcatccctgggatgcaaggctggttcaatacatgcaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggatgtatcgcaaaataataagagctatctgtgacaaacctgcagccaatatcatactgaatgggcaaaaactggaagcattccctttgaaaactggcacaagacagggatgccttctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccatcgtctcagcccaaaatctccttaagctgataggcaacttcagcaaagtctcgggatacaaaatcaatgtacaaaaatcacaagcattcttatacaccaataacagacaaacagagagccaaatcatgagtgaactcccactcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttatagattcaatgccatccccatcaagctaccaatgactttcttcgcagaattggaaaaaactactttaaagttcatatggaaccaaaaaagagcccgcatggccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatgggggaaaggattccctatttaataaatggtgctgggaaaactggctagccatatgtagaaagctgaaactggatctcttccttacaccttatacaaaaattaattcaagatggattaaagacttaaatgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctcatatccagaatctacaatgaactccaacaaatttacaagaaaaaaacaaacaactccatcaaaaagtgggcgaaggacatgaacagacacttctcaaaagaagacatttatgcagccaaaaaacacatgaaaaaatgctctccatcactggccatcagagaaatgcaaatcaaaaccacaatgagataccacctcacaccagttagaatggcaatcattaaaaagtcaggaaacaacaggtgctggagaggatgtggagaattaggaacattttacactgttggtgggactgtaaactagttcaacccttgtggaagtcagtgtggtgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaacacatggacacaggaaagggaacatcacactctggggcctgttgtggggtgtggggagaggggagggatagcattaggagatacacctaatgctaaatgacgagttaatgggtgcagcacaccagcatggcacatgtatacatatataactaacctgcacattgtgcacatgtaccctaaaacttaaagtataataataataaaagaaaaaaaaaagaactgataaacaaattcagtaaagtgcaggatataaaatcaacatcccaaagtcattaacctttctgtatgccaacagcaaacaatctgaaaaataaatcaagaaagcaatctcatttaccataggtacaaatcaaatagctagcaataaacttaaccaaagaagtgaaagacttctacaatttatactataaaacactgaggcaagatactgaagaggacacaaaaaatggaaatatactccatgttcatggattagaagaatcaatattgctaaaatgtacatactgcccaatgcaatctatagattaaatgcaaataccaatggcattcttcagagaaataggaaaaaaatcctaaaatatgtttagaacaacagaagacccaaaatagccaaagccatcctgagcaaaaggagcaaaactggaggaatcacattacctgacttcaaatcacactacagagctatagcaaccaaaacagcatggtactggcataaaaacagacagagaccagtggaacagaatagagaacccagaaataaacccatatatctacaatgaacttattttcaacaaaggtgccaaaaacatacactggggaaaggacagtctcttcaataaatggcactgagataactggatatccacatgcagaagagtgaaagtagacccatatctcttgccatatacaaaaatcaaatcaaaatgaaataaaggcttacatctcagacctcaaactatgaaactaccatgaaaaaacattgggaaaactcttcaagacattggtctgggcaaagatttctccagtaatacccctcaagcacagggaactaaaacaacagtagacaaattggatcacatgacattaaaaagcttctgcatagcaaaggaaacactctacaaagtgaagaggcaacctacagaatgagagaaaatatttgcacactattcatctgacaacagattaataaccagaacatataaggagtttaaacaactctctaggaaaaaaaacgattagtcttcctatcaaataggcaaaagatctacaaagacatttctcaaaagaacacatacaaatggcaaacaggtatatgaaaaggtgctcaacatcattgatcaccggagatatgaaaatcaaaaccacaatgagttatcatctcatcttagttaaaatggcttttatccaaaaggcagtaacaaatgctggtaaggatgtggagaaaagggagcccttgtacactgttggtgggaatgtaaattagtacaaccactatagagaacaggttggagtgtcctcaaaaaactaaaaatagaactaccatatgatccaggattctcactgctaggtatatgtccaaaagaaaggaaatcagtacactgaagaaatatcttcacttccatatttattgcagcattcttcacaatagacaggatttggatgctaactaacttgtcgatcaacagatgaatggataaagataatgtgctgcatatacacaatatagtactattcagccataagaaagaatgaggtcctgtcacttgcaactacctggatagagctggaggacattatgttaagtgaattaagctgggtacagaaagacaaacttctcatgttctcactcatttgggggagctaaaagttgaaacgattgaattcatggagatagagatgagaatgatggttaccagaggctgggaaggatagtagttggggtgggggaagtggatatgcttaatgggtgcaaagatagatagaatgaaaaagagctagtattagcacagcagggtgattacaaacaaaaatattttacggtacattttaaaaataactaaaacggtatattggaatgtctgtaacacaaagaaatgaaaatgctttaggtggtgtataccccatttatcctgatatgattattatgcatggtatgcttgtatcaatgtatctcatgtaccccacaaatatatagacttactatgtacaaataaaattaaaaattaagaaaatcagctcaaaattgtttaagacataaatatgaaacctgaaaccataaaattactcaaaaaaaaaaacagaacaaaacaaaacaaaacaaaaaaacgaaggagaaacactttatggcactggttcgggaaagaattttttggataaaagcttaaaagtacaggcaacaagagcaaaaagacaaatgggattgcattaaactaaaaagcttttccacagagaaggaaataacagagtgaagagacaacctaaagcgtaggagaaaatatttgtaaacgatacatctgacatggggttaattctcagaatatataagaaactcaactcaatagcaaaaaggcaaatgtctgattatacagtgtatacatgtattgaaagatcacactgtaccccataaatatgtacaataatgaatcaattaaaaacaaaatttaaaataataaataaaaataaattattttgggggatgttacaaaaaaagaaatttatagtctcatgagaagaatagttatgcatatgctgaccagtcagatcactcctcttaggcatggctctatgtttcaagggacacaaaagacttaaaacagtgatgcttggctctcagaaagaaaaatataattatttaaacttgatctaacacggaccaagggagttggctgcacacttcacaaggaataaacagtgaaataacctcgaaagcaattcacttaatgaaaacacatgagtgtttttgtttgtttttttgtttctgttttttgccacagcccctctttcttcatggttaccatcaactcagggcttccctcccttaacctcatgcatcagggttatatatagcccttatgcacatacacatgtcccattagaaagtttcctattgtctgtccctgggcagatatgtctcatctgcatatgatgtcatgtcctctcccttcacttcacctgtacagttgtctagtgggcagccattttgtctcattttcaccccagcccgctcaatatttactctgttattgtttttttccaacttatgactcttattgcaagctcaattcaagtgtgaaacatcagtgcaaaattcacagccacctttccatctctcctcagagctattgtatcccagcccaccaaacactattctgtactgatttatttccatatgctaacaacaaacatgagacaataacagtacaaggaaatgtatgctacatcatccaaaatgtgtgaagtagacaatataagaggccacacaggatgccagtagatagggcagttcaagtgaggaacgtttcagaaaataaatagtctttgagctggaacagcagaaagaagatggcacgctggtcagaaggaagtgaatgcacaatgatgtcgggagtggaaatgatggtagcttgttcacagtgggtactggagtgaaaagttggtgatgaaatcagtgcttgtgactcatgttaccctcatgagattagcctcatggaggaaggccctggatatttcactcagcagatccaggacactgggctaggtcggtactaaatctgatcacaaatagctgggttgctgtgctcatctgcccaccctctttttttctttcatcttagttgggatgtgtctatggccattgattgaatggctgtttagttgggaccttggtgaacagtcagcatcatcccagaaggttgttagtagttttctgactggcagtcaggacagagaggactagagtatggtgaaaggaaagggccaggtccactgattacccaggggtctagttgggcagggcttccccttagcaaatattggtgagaagctggccatgttggtctttgacactctcttctttcatctgtcttcttccttagatgacactctttccctccactcctatcaccccatacacataggtccaatgtcggtgtcccatttttaacagctttattgaggtaaaattcatgtattaaaaaactgcatgcatttcatgtatccagtttgatgtgtttggacatatgcatatacccatgcaccaaaatcaaggtgataaacctattcatcacctccaatagcttcctgatacccctttgttttgtctgtgtcccatttttattggttgatattcattgattgacaacaattttgacacccatgataccatgcctaagtagttaccttcttctgtctctgtccattgccttcatctctttttcagaatccttatctttttctcctttaaatattggtgctgcccaggattatttcactcctccctttgcagccaaatatctgtcaaaggcccatgatttattttgtaactttcagctagatatacccacctggatggactccaaacatttaacattctctgtgtctagtaataatattagcaaacacactttgggcatttactttgtgccagtatccatcctaggtatataacatgcattatcttattcgatacccacaaccatcctgtgatgcagaataatgctattatccatatttacaagtggagacatcaaggcacaaagaggttaaataacttgtccaagctcatacatctagtaagcggatgcactgggatttagtacgatttaatgtttgtagccaccatcaactctattattcatataagaattgtggatagaactttggagctaaaaatgatcaacagagctcctctgagcctacccttgtcagcaaatcagccttgtactcaaaccaccaagtagatagtatctctcttcttcgcaatgtgcctgcacagggaaggaagggtttcaatgtccactgagagatccagagtttagaatagtctgagctttgtctacccaagcaaaatgaagatacgtcatatttacttaagcaattttctccctctaccccctaatttcttaactccaaatataagatgtgaaattattcaatcacaagggtcctaggtcaccaccacccttctccacattcatttgtttatcttgaagttgtaaaaataatgcatgttagctataagaattataacaacataaaagcatgtaaaggaaatcatcccctatttcccactctcaaaataacgccctagaagtcattactatgaacaaattatgtgtgtcctaggtattttctctacatagtaaaacagaaacacacacaaatacacaaagacttttttttttaacaaatgttctacaaacctgttctttttaacagtacattatggatgtcttgccaaagctagacacaacactgatgaagtgacatttgcactgcatctgctgcttggcctggctgtcatctccccctgccttcctccctgtcctcctcctcctttttggtaaccttgagagcctgatgactttccaagcacaggccagtgaaccatggactttacctctaagcatgtgattggccacttccagggtgattggggccctatccctcatcctccattggcatgcatgcctgccgagagcaccaggtgattttccagggcaatggcttccagtggggctacatgagtcttgatctgggctaccgtctccaaaccttcttgagggtgtgcagatcctgggcatgaataaatagctgcaggctagctaccaaattgcagctaccactgccactgccctgaagatggagacaagaagagccaaggaatatgtcctcatcacctgctgtagccacattgctgctcagaaaagcattgttttttattattttttttaaagacatattctccctgtgttgcccaggctggagttcagcggtgcaatttcggctcactgcaaccccagcctcccgggttcaagctattctcgtgcctcagcctccaaagtcgctgggattacaggcctgcaccaccacgcccagctaatttttctaattattattatactttaagttctgggatacttgtgcagaatgtgcaagtttgttacataggtatacacataccatggtggtttgctgcacccatcaaccatctctacttaaaatacaaaaatcagcttttctcaagaagggctaatttttgtattttaagtagagacggggtttcttcatgttggccaggctggtctcaagctcctggcctcaagtgatccacccgcctcagccttccaaagtgctgggattacagtcatgagctaccgcacctggccaggaaagcatacttaataaagaattatatactagagaaatcagcctgagagtgttgagtagtgtttgatgaggaagaaggaaatgtggccacccaatttcaaaaccacaatctcaacactggagataaatggagtggcatatcaccacatgtttgagcagaggcagaatggctactgggcaggagtgttactgtatctgttaggaggctggactatgtcatctccaaggtctcttctaactctgtgattttgcagtgtatatatcaactatgatttatgatatgatgaacaaagtctgaaagtggaattctcatattgacttcatccctcaactgttgggtagctggagacaaatactcaatctctctatagcttaacgtcttatcactgaataacaaaggaataatgctaaataatcccacagggatgctgtgagaaaatgagcaatattttgaaattcttctaaaagtacctgataaacgcacattaaataggtgctgtgcctgacatataattggcttagtagagaggcaagaatacaaagccccagtaaatataaaaaccacagtggagttataattccacaggcaggaatgtcactgacacatttctagcataaaacatctggagttgtgagggataactgtttagctgtggtccacttgatcatggaatcgtcaggattaaatgaaatatagtggcaatctagtccattcttctgtcactgcaatcaatccaagctgtattaatctctagcctcagaaagagttaaacatgccaatgctaatttgatggaacacaaccttggcacggtatgaaagaagtcccaaagcaattctgtggaagagtcagttgcccagaattctcaaatgtatgtctggggcctccagggagtctcaagtatatgaatgaggccacagatgaggaagagttggctgggagctagggctcctccttgcatacctattcactgttgctgcccttttctaacaaaagacaagcaatccctgcatcggtggagccctgcaagagctgagtgcactatttccttctccacttgcaacttttcatccatctttgagattcttatcccctattaactaaatatggaggagaaaactaagcagtagtaaatttaatttagaaccccagtcctttttaaggcctcttttgggttatccctggcatgtgttcctgaaaaggtgctgcagagtgaaagactgctttgaagctctgaggtgtctggctatatgtgtttcagatagatggacatgttttgcaagtgattgaaaattcatcattatgtgtaaactgtctttgctttctcaagtttcagatgtggggcatgtctgacttcagggaaataagaacaagacagccgatgtttccctaattcattcttgatcagcacctagcttatttttctctagggagacagcagcccacacccctagcctaagagcatacagtgagaaagctaggcaagagacagcagccgtagagctagaagcccaaagcagccctcccttctcccaactacaacaaagctcctgctcctttcttttaacacttggtccgctgtgacaacagcgaaaggtatactgcttgagactgcactattgacaatgcagctgccagttcaaagcaataaaattggaagtaatatcagagagagagaaattatgggatagggacattgttcttgagtgttttttttctctcaaaatgtaatagagggaaacatgtgagtaaaggcagtacattataaaaatattagaaaacatttgcttgtcacagattatgtttggaaagaacttgcttgcagttgaatgatgttaacatgatgagcataagttcaatcacaaaatgacttcagctacttttcctggtaaccacaagttatatattttttaaatgacttctgttttattagtgacccagtaatttaatcctggccattgtgtactgaataatcaattgtttatcatgatggggcacagtcatggccatgaaacagagacttttgaatcctgtttttctgctaaagaaggaataaatattcttgaaatgtgtcacattaagatgtctgtgctagatgaacttaggcattttgatgttattcaggcccaggcgtgttttctcaatggcttcccaaccctaatcaattcttgctacagagtgaggggctcctgggtgcatggttgtttcttagagaagccattcagaaatctcaaatggggagttcaagcagaaagatcctgaatacaaaattgccccagggtgcttccagtagtaccagctaacaaaactgtttcccaccttggggataatagttaaaaaaaaaaaaaaaagtttcccatcattaatagtagtcattgtaggtttgcctcatgtttgcctagaatatccataacttacggaatttttattctgatgataatcaagggcctgtggtgttgccatgagatacatgtccactgacttctttttagtgtagctaagagtaatagcaccatgccatggagaggcagtctccataatgacctgcccagttccctgtcagagtagcccttcagtcctccacagccccggatgaagacacttcattcccatggattgactcttctatccattactaagagatgacttttctagtccataatctgagattcatcctgtttctagccatagagactcttagaactagggcaatagctcagcagtgcagcatcaaatcacacaagatgctggtcccttctgaatcttgtattttggtagctatgcctgagcccttgccttattgtcatgtgaccaagactgttttatgatctacttcaatggttccaaaatgcaagtgattttgccccccagggggacattttggcattgtccccaagggggacattttggcaatgtctagagatgtccttggcttttacacttggtgacaaggtgctattgttatcaagggggtaaggccagggatgctgccaaacaccctacaatgaacaggatggctccccacaatgaaaaatcatctgggccaacatgtcaagaatgctgaggttgagaaaccctggactaattccaataatggagtccctgtcacatatccttcccagtatccccattcatgtttctagacctcacaatactaatcacctaatcaccttcctcctagaccactgcctacatttacattatactgacgcagtgttctgcccacatactgagaaccctctcttttatctactgtcagcataactgggctgcttctgatgccaccaggaatccatcatcccacctgaccaccttgagtctgtatagcatgcttgtttaacaacccaagctttggatccagcctacttgaatcaaagtcctggctcctccatttaatagctgtgtaaccttagacaaattaccttacctttttgagcctcagcttccttatccatgaaatatgaatagtggcaactcctacctcataaaggagataatacatgtcaagagctcagcaaacttcctagcatatttgtaagtgtttggtaaatgttaatcactgctcgttgctaagacatttgtggattgattcagccggcctcttgtacagtgattatcaagcttctagagcagcattatccagcagaactttctgccatgagggaactgttttgtatctatgctgccccgtaaggtagtcatatggctatggagtagttgaaatgtagacagtgtgactgaggaactttattttttaaatatttttaaaattttaattgtcagacatggctagggatgttatcataatgcacaatgcacttttagagtttttcaaactcaacatcccaccaaaaataaaattccaacaaactctcctgggaaagggaggggcattcttactctctccttccagacattgagaaccattgtcctagtgaggcactgtactgatgggagtatgttataatcctcaggtgggttgggaaataagaaggagctaagactggcatgactaattctagctagccctgcctccccctgctccactgagccactgtcaaaaaagcctcatgcccagaacccaaccagggccatagtgctcccaggagacatttggcaatgtccagagatatttttggctatcaattctggggtagaagggagagctgttactgtcatctagtggatacagacaaaggatgctgctaaacatcctaccgtgcacggaacagtcccccacaacaaattattatctggcccaaaatatcagtcacaccaagaatgagaaaatgccctagagagatccctaaacaatcccacacaagggagcatcactatgtgcttaaaagtctccaaaggtaaggggtctctaacctccctgggaattcggttcaatgtttccactaccttcagtttactcccttcaaattacctggaaggaaattgttcccctccatattaggagtagatattaaaaaccaacaattcttcaatttgggaaaatgcagacaaaggagagaaacttctaaaatgatgatagctgcagagagggagaactgggtttggctcaccaattgttaggatatcagaaagaaaagagtttttgaaacctgccagaattttactataagcaacagaccatgattcccacagtatacaataaaacaacttgtccttattaccccccaaaagataatacagtgtaaaagggtaaagatgttctcaaaaggggttggatttagaaatgtttgcggcttctaaaactataacagtctacttataggagccagaaatattaggaccacacttctttgaaatcgatagcatataacgaattcctgatctcttccaacaccaccttctgtgcctcagacacagaaatctgggctgaaaggcccatggagctgagccagtcattggactagatcttatatttctgggtcacctgaacttctccatgctgcagtttaggtacatcttttcctgtgtcgtcgtcaaggaaaaaaattgaaagctactgtgttcactccagaaaactaaactggataggtaattcaaatcataaacccatatttcttctcctatatctgagcttggagaaactgaactgtcctacataattgtcccttactttctcctgtgctttgtctaactacatgataaatgcctctatgtgacagcaatcagcaaggctgaaaatgcaaaatttaaccctgcagatgcttttccactatcagaggtttgaaagatagtaaaggaccctttaatgtttatttcctgaaaagatcaaggatagccacaggaagaggaattaactcctgctgctctggaggactatgcttacatttagggcaactgccaacaggtcagcaacagtattctacctctggagaccagcgtcagctgcctggcctgcctcaggtgtggataactgagagaaagaatgtgagactcaataattgtttaatgaatgtgacaaaatctcttctttcaacccttatcctccaattgtatcatgtaaccttacagtcagatggctacatatgaacaaagcaaccaaacaaacagcatttgacaggtatacggagcatggaatgaaaatcatggtggggaaagggaatgcttttgatgttatgtaacatgaattttgcttctagatttctgatctggtttcctttttacctcttttttttttttaaaggcctctccttaccgtgaggctactttcaggcctttttctttattcaggcgcagcccacactgcttttgtgagtgaaggtcagaactgcccttttgtaacttttcttttgcactcttagacccaactgagttcatttttgtcacccaaggtctcaactcctcttctttattcattctgattttgttttgctggcaaatgtgctcttatcaatatcagtacccattagaaaaaatataaaataagaagtgtttatttatattgagtcctataatatacttactagtaatctggttaccctggccctccaatgatactgtctctatatctgggttctcagccctgtccagaaacctttatcatgatatccaatctcacactagtcatgtgataagcagtgatgtggaaaactctaaatcagcttgtcaccatcctctttccaggacagcaatctacaagagaaatttaatttaaaaatcacacattgatttatacaaagtgaaccaagaactattatggctgtcctagaaagctatttgtatcaagctccacagtagggccacctacaaagctaactggacaccctggtagagtacggcttccttcctctgtgcaatgctagggacgcgttgattagacctttgcttcttacatttttcccatctcaataataacccacatctgctgattgactcattttttgattcatcacatcattttcacaatttcctggaaaacgtcagatctcaactgcatgcaaaatgccttcagggagggctgtctctccaaaggccggccactctgtattcccttcctaccttggagccttttaccttttttggttttttgtttgtttgtttgtttctaatatccatcccagggtggaccttacttttggaatcagtggttcccatcactcattagaacccatattttatgaagaaaatatatggaatgcttcattaaactgtgacaaaaatgcctttccaggttttatcaaactaaaactcacaaattacaaactttcataacctatggaattagtcatgaattttttttctcatagatttagctcctatcttttgaaaacttcagggcctctatgtgatgaaaactcaagaatagttttgtgggctgccaaacgttaaacaatgttatgtaatgtttgtctggtttaaggtagaacattaggttaattaacatccaacaaaacctgcaatatgtacttaagatatgtctgtatattcagtgttgtgatgtgattttaacatttgtttattgatataataaatcaaattgttggccttttgctggttaggggtggagctgtatagtggttaacagtacgggaggctttggtaccaaactgcctggggtcaagctctgggctctctacgtcctagctatgtgacctgggccaagacacttagcttctctatgactgagttcctcagatataaaatgggagtaattattatgcctatagcatagagctatagtgaggactaaataaaatactccagcattgtgcttgtgcctggcatatggaaagtgctcaacctccagtagccattagtattacttttatccctgctgcttaggctaatcctggctattgttttatatatataattgatctgtatgtatcaatattgacatttttaaaggccagtgggttctgtgacattatccccaagtaaatgttgtccatttcagtcttccaatctaaattatatacaccttggccttgaaagctgagatcatccagcaaatcctaactctgatgcttctgtttttaccagattctgagaaacagatacttttccatctcatgccaatggttgctccaaagtaacacatacatcaccactactagctaactaacctgatagataggcagagcaggaagctggtaatgtgaactgattagatgctggtgtttttcacttctgagtaatacagagaaatgaaatttcatttccacacgttccttggactgctgaacactgattttatctggcatgttaggatggagggaggagaacacagaaggtgaaaaaagagggattacaatttcactaaatccaggcataagacaggaggttcattttcaacatgatgctatcagaccagctgtgtgaggaagtgccagttggagaggttgggtctgtgagcagacaacattgtgtgtatgaatgaggcggctcctgataagggtctggccattaattacaaatgggggatttaatttcagaagcctgtgataaactccaccaagggtaacgatagggttcagaaaaactccaattagcagattgtgtccagtgatgaggttaatggaaatgaatgtatcatttgagcccttggtgaataaccttgtaaaagctttagccatttctgacagtggggaaaaaggagtatgatctatcctctaggctgtcctctggcaatagaatttagctgaaaatacagagaagctgactgtagctcaatctattcgctgcattgcaagtgttttatgtgatgagctctgagctgagtggctctgtcctatgctcattcatccagaaggatccttgaacaggatcctagcttttctacaaggaatccttggacagatccagtagcaaactcattatggcctgaatgaaaagtcccagggaaaggcaagacagtgtaacttctttagtggccatgtccttagcccacatcattgcaaattttaaaattcaatcgagttggttgatgtaccaggtttctttagaagtacagttatagataatataagccaaatctaaattcttggcctattgatttccttccctcttcctcacctccccctatctttatttttccttttaaaaaacatgattttaaacagaaagtccaagatctttcagtatgattttggagtttaaagagaaggcgaaatttgataataaataatcaaattgaatttttcacctgacctcaatctgaacacaaaatggctgttaaaagataatttcaaaaaaaaaaaatgttaaatcgtaatcttcatacaaatttaaagtaaacatgacaaagattttattcaactcattaattaatgagggaaccagtaggtaggccaagagtctgcaaactatggccttcagtccaaatctggcctgtcaactgtttttataaataaaatttattggagcacagccatacccattcacttacacttatggctgctttcattttacaatgaaaatgaaagtttcatttcattgtaatgaaacgacattgtaatgtaatttgttgtatggtccacagagtatcaattactgtctggctttttacagaagaagtttgctctcccatgatacaggctattggaaacatagaaataaactcacaaatggatacaaagtagtctatatccacaaggcaataatcaattatattccacccaataagaaatagttgcattacaatttatagagttttaaattaagtcaaagagaatcaaaggcatggataatccagaaaatatactagacaggacctctagtttatgttttttcatgatccaaagtctttcacaatttttcttaatagctactaggagaaaccttatgtacagagccaccagtagtagcagaatccactctatctgaaagtggagtaggaatcaagctgtacagtggattgtgaggcctgagaaagaccttcaccaaacttaagtccctaccagcctagtcctccttgaaattctcattttttttggctaatgccaaggtgttctttctaggtgccaccagttaaaatgtaaataccccccgctcaggacagctccagatattgttatcaatattagtaacttgtatggattttttttttcaaagaatagcagaccagtcacctaaagggacccagaagtccagggacctggatgggaaactgatacaatttagtaaacctaacctaaaatataagaacaatccataaaaggcagtactgattaagcctgcacaggaggcttgcaagacagcactgggttaacttgtattaagttaggtagaacattaaaaagtacacaaaatagaattgaaggggggtgctcttacggtttccatatgtcacagttttgcccaggtgaagactaaaccattactgtgctggggagtttgcttttgattaagatacattttttttgttgttttgttgagacagagtctcgctctgtcacccaggctggagtgtagtggtgcgatcttcactcactgcaacctccatctcccgggttcaagtgattctcctgcctcagcctcccgagtagatgggattacaggtgcgcaccaccatgtccagctaatttttgtatttttagtagagatggggtttcaccatgttggccaggctggtctcgaactcctgacctcaagtgatctgcccacctaggcctcccaaagtgctgggactacaggcctgagccacagcacctggccacttttgtaatacatttgttgttataatgataggaaccatgtttgttgagaacctagtatgttctaaaacaaacttatcaaacctgcgacctgcaggccacatgtggcccaagacagctttgaatgtggcccaacacaaattcataaactttcttaaaacattatgagatttttttgggtgatttttttgtagctcatcagttatcattagtgttagtgtattttatgtgtggcccaaggcaattcttcttctttcaatgtgggccagggaagccaaaagattggacaactctgttctaaaccctatgtagaaaatacacacacaatctcatttaatccttataattttgcccagctgctgtcattttcccattgtataggcaagggaattgagatacaaaaaggctagtaaatgacaaagccaagcaagatattcttaaattgcactgtgaaagtgtgtctggaattcattccttctggtgagttcatggtctcactgacttcaataatggagccgtggagctttgcgttgagtgttacagctctaaaagatggcacagacctaaagagtgagcagcagcataatttattgtgaagaagtgaaagaacaaagcttccacagcatggaaggggacccgagcgggttgccgctgctggctggggtggccagcttttattcccttatttgtccccacctatgtcctgctgattggtccattttacagactgctgattggtccattttacaaacctctagctagctacagagttccgattggtgcatttttacagagcactgattggtggattttacaaacctcttataagatagaaaagttctccaagtccccactagacccaggaagtacagctggcttcacctctcagaagccctcctcaaaatagtgtggacacagtcactcctctttccatctcctgatcatctgctgatttagtcgctatccaaagtactctgattatcttggcccctagatcacagctgtcctcttcagcccaatacgtgtcatcactctggacaacttcagcacccacccatgtggacaatgcagccagcatcctgacccatcagctccttgacctccccactccactgacctccacattcactctacttcagcccactgtgcccatgaccaacccacagctggtcaccattcagcactgctccactgtggacatcatatctactagcaccctactctctgtccacagtctcccatcctcccagtttgcctactctgtcttttcacttcaaagagacctcaagtccctcaatgtctccatttcctcccagacttttagcccttacctatctgatctggtcttcaagtgcaatcacctgaactacttcatcctcaacttcttctcacgtctggcaaaaccacaatcctgaatctatccaaaacctgaattttccatccccacatctggactgtcaaagctgctagagagaaaaaaaaaagccacattcttctgtgcatcactgccattataaatttacagctgctaatttacccaagacttcaggactgctaggccatccttttactttcctttgtcttcctctttctttccccttagcaaatcttccatacattgaactctccccacacaccctgccaacttctcctccctcactcaaagcatctgatctcacctcccatttcaatgagaaaactgcatttttagatgggaaatacttcagcttccagccctcttcaataacaaactactaacacctccattcaactcaccttttttcctccagtctctgaggataaggcatccttattccagactaagatcaacctccacctcaccccaacctttgctctggacctcatctctcctcatctcttcaggcaccctgatctacccacaagccccctctttcccttgtctacagcctcttccctcctccccgggtcctcccccaatctaatcaaggtgctcaagatgcagcctcatctcttcacagccacatttcattaaagaggcttgggatattaggccagaaactcagacaagggtgaagccttgttttaaaagctagggcacaggtgcagaagaagctgcaattcagaaactaacagaacaagaatgtcccattgcaaaagcctcaacagtaggaatttggaatgatggaacctgaggcaggcctcctgagtgcttcttatttcaggccttggttgccctggaaactggggctggacagagtccttggagtagataggtggagccacttgtgaggaaacaagggcaggcagaggctgatcctgtccactcttggtttcaactactattgctggctgaaggctctcacatctatattttcagccctgacttctccttcaagattcatgctggagttatacaatttcctgctgctttcccagtagggacttcaaagttaacaagcacaaaactgaacttttaaaaaccttaaacctgctcctgtatgcactatctcaattagtgacactactgttcaaccaggcattggaatatggagactcaatacccttgatttcttctccctgccttccctgacacatccaatgaatgccttaaatttgttattttttatctatctctagaatcactatctaatttaagatccttgcatctattcacctgaactgatgatatcttttaattagtcttattctgaaacacatggtggtgtgcttggagctggcttgcaccagctggcgagagcgggttatctgctcctcttcccaactccatgttccaggatgtcatattggtagcatgaaactggccacagtgggagtatttacaccacaaaaactggcaaacacacaaaacaggatattttttcctcccctgtggagagctggttgttaaacatttatgagcatgattaccactgcccatttcccacactgtggccaagctaatcaactatgccactctcctgattaaaaccctcagtggttccccgtggtcaacagataacatataaattccttagcatggcatatgaggccttttatcatttggcccttgcctaaatatccaatttcttctcccatctctttttagtctcacaacttatgtgctagcacgaaggtcacaaactggttcactggagccaaatttgtttcacatatgtattttgcttggcctgcacactgtctttaaaatttttgagccaacgtttataactttaagagcttctacccccaaatccatgtttccggcttcttttcaaaaatttataacactgctcctcacttgtgtttatgacaatttacaggagctgagtagtagctgccccctttgagagggtctctgcagtttaccagtttctatcattcactcgcccaaattatgcgtatacacctacacctggtcctgatttctgttacctgtttggcctgcattttagatagattattatcagaatcttctaaccctcattatagaactttctcttcctttactttggctgtcctgatgatagtccgtggtctctgcacagcctgggaaggaataaaaacagcaagatgatgaaggaggacaaagcagaaggggtagaaggaataaaaagaaacccgtagtctatggatcagtccccactttgaagcaatagaattgtgaaaaatacaggcagaaatgtcccaagtttgtgagacctcgtagtagttccctgcagagctaatcatctaacccttcttggagtcttgggatgtctgccttctcagctggacatgggaaggagaggtccaaggaaattagctcatattgacccaaattgtgggagtcaggtttataaacaatagagtcaatttctcttttcttttctttacttttttattggagacagggtatcactctgttgcccaggctggatggagtgcagtggcatgatcacagctcactgcagcctcgacctcccaggctcaagcaatcctcccatcttaacctccctactagctgggactacaggtgcttgccatcacacctagctaatataatgtttttgtttgtttgtttgtttgttttttagagacagagtctcactatgttgcccaggctggtcttgaactcctgggctcagatgatcctctcacctcagcctcccaaagtgttgggattacaggcatgagccaccacgcctggcccaagagagtcaattccttaatgtgaaaacaggaaatttaatttatttttgctgagtgcctgctgtgtgtctagcactgtgctagatgccataggggaaacaagagcagaccaggacaactctgccttcaaagagctcataaccttatcaaggaggcaaaaagtacgtgtgtgaagtaatttgagaataatgtaagacagcatcagaaaagtgattttcttgcatgtaaccttgtgcccacagtatttgagcgggcagcaagagataagctcaaagttaagaggaggagctattgaagaagccagaacttgcaatggcccctgagtggcagagaaatggggcgagagaccattccacacaggggatccacaaggatatacacacagaaagcaacctgtgagtgacaacactgataggaggagaaaaagcagtctgggcgggagggcaaggttggtcactgtagaccagttttctttttaaaaggtttcctctctggtgttaggtactcaggaagccgaatggagaataataaagttccttgttagacaatataatcgagtagtttcagaaagcatttcatattctaggcatagacaacaacaaccttttggctctatcatacaagtggggctaaacactattcacgggtactgctgtgtgtattggacaggactggcagcactgccttagaagaaaagaaaggaaaagagtaagaaaagtagaaagaataaggaagtggcggggagagagagagagagagagaaagagagcgaggaaagaggaatagcatggtaggaagcagacccatacccataatcgaacccagggaatcctgtgctacaggttagcctctcttcccttctgctcaacacttttagaccctgacagagatgaggaatgcctctgcctggagaaagggcagatttctcatctgagctcgcttcttcctgggcagactgtgacaaatttctcacttccccatctctcccaactctaggctttatgctgatagtgtttatgttcatttccagacccactcagacctacttcttccttagcctgtaagcttatgttaatttctgagattactctttcctgtgtccaatttactttatgagccagttgctcacttcctgctgtcttgtttgtagctgctccctctaaatgtttaacagtgtttactcgctgctccatcctagccattaatgaccattatgcagtcatctttcaactattcagaggctgatgcaagcactcagtgaaggaaacaggtttcttgcaaactcctcctcctccacctttctcctactgtatgttttctggccacttccctgtttgagaatcctgcgtgcaaggtgggagggaggcaatgatgttgaaaaacagttaactcatccctttgtcagttcgccagtaactgtgggttgttgttttattttttaaaggagttttgagagtaaaaagaacctattgattaaaacacgatttgtctctctgcttacatttacagagataaaaaaatctaaaacaaaacaaaaatcccatgatttgtctattcgatgagactcccaattatccatggtctgtcctacccagttaaaatgaacatttggaacttttttttcctaaagtgtaataaaaatcaatatttcccaattttctggaatcctagacatgttttgaatactcggctccacctcttaaagcctctgttgcctctgttgactattccagccctccccttctctagctctagatcctaccacacttaaactcttctgtgagtctagcaagctgcctcagtttccctactggactgagaaaagactgggtcccaaaagagacttttttttttttttttttttgagactgagtcttgctctgttgcccaggctggagtgcagtggcgtgatctcggctcactgccagctctgcctcctgggttcatgccattctcctgcctcaggctcccacgtagctgggactacaggcgcccgccaccatgcccggctaattttttgtatttttagtagagacggggtttcaccgtgttagccaggatggtctctatctcttgacctcatgatccgctcgcctcggcctcccaaagtgctgggattacaggcgtgagccactgtgcctggcaagagacattttaaagtcgaaagattttttaattcattgatcaggttctgcacactcacccggaagtgctcctgaatacccaaagaagcccccatctttcacctatagctgctatttacactaaacattacatcatggacatagcagttttatcaatggtactgttgctatcagtatcccctccccaagccgagaagtcttcattttcagagtacttcttcctgaccctaacgaatcatctttaccttcctgggacctacaggaagttggacgaaccctgtctggccttgggctttggtcccctgaagttatatatatagtctctactgctcatttggaactgagcagataatactatgtactgttaccagttttatgaaagtttgctctacccaagtaattctccaggaggtcaggaaaaatgtcctttacttctctgtattctccagtatgtctcagacagaaatgggcatgttgtcattgcataattgacaatttgactctagagcttggctctagagtcttgcttgggtttgaatcctggctctgctgactaaaaactttgtaaccttaggtgtgttctttaatctccctctgtctcagcttcttcatatgggaagaatatttacctcacaaggttgttgtggagattaaatgagtaaagacatgtaatgtgcttagaatagtgcctggcacacaataagcatcccacaaacattagctataaggaaggaggtttaggaggtcaaaagaattgaaacaagaatggagactctaattcctgaatcgccagcattttataggccctatgcttctctctccaaactttaatcctgcccttctattcttctcatttcttgtacctaggtccccactctgatgatggacacgcagttctctgaattcacaccggacatcactcccatcatgctggctgcccacaccaacaactacgaaatcatcaaattgcttgtccaaaaacgggtcactatcccacggccccaccagatccgctgcaactgtgtggagtgtgtgtctagttcagaggtagacagcctgcgccactctcgctcccgactgaacatctataaggctctggcaagcccctcactcattgccttatcaagtgaggaccccatcctaactgccttccgtctgggctgggagctcaaggagctcagcaaggtggagaatgagttcaaggccgagtatgaggagctctctcagcagtgcaagctctttgccaaagacctgctggaccaagctcggagctccagggaactggagatcatcctcaaccatcgagatgaccacagtgaagagcttgaccctcagaagtaccatgacctggccaagttgaaggtggcaatcaaataccaccagaaagaggtaagctgagctcatgtctgctttcagggaagcttaaagcctccaaagtctggagcagcagagcaagaatcagcatttttctaccatttagccccctaacaaacaaatggttgggcaggcctcacagctaggcccatttatccgaggcacagacaacctttttgtattttctttatggccagataagtaaccatctgattctttggtggaaaagcattcatgcatttaacaaatgcttactgagcactgttcggagtgtttgcgatacagaagacagacaccgaccctgctttcatggagcttacaagctggtggtggatatagagtaaatgatcactttaatgaatacataattacctactaagatatgtactctgaaagaacagtgctctgtgagagcacataacaaaggatcctatcctatatactggggacatagtgggcagtgattacaggagggtcgctgcctggatgctggtaattgttggcacaactgaatccctggcagccccttagcgagaaggctaaaaaacacatttgaaagatgaagtcatactcaaggtttgtaggtcaatgaaaggctgaagcaggatctgctatggtatgacctccaaaatgttaggttccacgtctttgagggaggtcagttcaagcaggtcacaggtgaggctttgatttccagttagggaagatttacaatcaaacaggtgtagttctatgccaacttatcagacagtttgggagagcctcctaacaaggctaacttagccctttaaggaagcagcatgataccacggaaaaagcagggactatggagccagagcaactgaggatagaattttaacccactagctgtatgacctaaagaaactcactcctattttcagggcattagttttctcatttataaaatagagatgaaaatagtttcttcacttcataggggattgtgggaaataagaaaagctaacattcagtgcatggcaccagaagtgctttgatgtccatttccatctcttttccatgctacctggagtcaaagcagctgaggggtgcctgccagctgaagggcaactggcagtgccattccttcatggatcaggctctgaggcaaacgtcattgtgtgtttatctggtccctttttctcaggcaaaaataaaactaccacgccttagaaatgaggcaaaaaacaaataccagggcaacctggaatgggataaaaaatgaaaaagagcaacatggagatcgaaagggctatactggaggaagtggtaaatggttaggcccacccatgagtccccttattttatttttgccatttacctgctttaagttatttcaataagcctggtgttgtgctcacctccctggagaagtgtaaagataaaataaaataggtaatatacttacgcacagcgaaataccgagcatacagtagcagtcaataactattagctgggcggggtgtggtggctcacgcctgtaatcccagcactttgggaggccaaggctggcagatcatctgaggtcaagagttcgagaccagcctggccaacatggtgaaacccagtctctactaaaaatacaaaaattagctgggcgtggtggcaggtgcatgtaatcccagctactccagaggctgagacacgagaatcgcttgaacctgggaggcagaggttgcaataagtcgagatcatgccatggcactccagcctgggcgatagagtgagactgtgtatcaaaaaaaaatttactattagcggctataattattcatttttatttttacacatggaggactcgtggtatatggtctaattctgtgcagtaaaatggcaggtaatagatatagtaaaggcccatccttctcttatccctccctctctcccacagccctgctgttgatgtgaagtatcagttatcgtgttaagcagtctgccgtatctacactttgatatatgtatatatttccattaaagatgtatattattgtttcagtgttttttcactttacataaattgttataatactgtgagaaaaaaaatcacagatatttgtagaacatgaattgcttccaagtgacagaatggttaatgggaataaaatagtttttaaaaaatagataattgcagaatacaactaaagtttacagtcctcaccccactgaatatgagatcaactttacaattttaggccccccgttctctttaaaattgagaatgcatttatttgcaaacaatttcactgcaatatttcatcaatttttgtgttggtaggtcaccttctgttgtatggcttgactccacttgctcatatgatcttcatttgccagttttagttaccgttgcatttgacaaccaatgtgatgactttctcactctcatggggatctgcttgtcatatgatcacttttggattctacattaactgccctccaatcctcattaaccttctcattattttttcctctttcttttagtccttttgctgtccagaaattttgtcccttgtgttctttattccataatttcttatcattgtttttacacaatatctttatgctactatattttcgtatctttctcaactctcatcccactaatctgaatgtgccacagggttttatttcttcttgttctcttgattaagcatcagagattccaacattgtttccagggtccattcctgtgtacattgaagtggactttttattgtggtaagatatacctaatataaaatttcacattttaaccacctgtaagtttacagttcagtggaattaagtacattcacatcgtgcatccatcgtcactaggatgcatttttgaagatgcacaagttttggagtgtctattttactttcaatagtgaacttatctaagcatagtttcatatttcacaaggacacacttaaaaaattaattaattaatttatttatttatttatttatttatttttgagacggaggctctctctgtcacccaggctggagtgccgtggcacaatctcagcttactgcaacctccgactcctgggttcaatcgattctcctgcctcagcctccatagtagttgggactacaggcgtgcaccaccacacccagaaaatttttggtttttttttttttttttttttaattaatttatttatttatttatttatttttagtagagacggggtttcgccatgctggccaggccggtcttgaactcctgacctcaagtgatctgcctacctgggcccctcaaagtgctgggattacaggcgtaagccaccacacccagcctatttttattatttttggagacaaggtctcactatgttgcctaggctggtttcaaactcctggcctcaaactcctggcctcaggtgatcttcccatctcagcctcccaaagcactgggattacagatgtgagccaccatgcccagccagctaaattatgtttaatccataacactggcaaagtagcacctcttaactattcaatattatggatattcagcagtaatttcaaaagtaagtaatcaaagtaatttcaaaagtaaatcactttttgaaaagtaattcaaaaagcactctatttatgcaaagatcaacaattttaggcctggtgctattcactgatatttgtgaatcaaataaatgaaaaccatggtatttagtagactgaattatttcaatcaggtcacatcaaactctagctccaggtatacagccgggatagtgagtgactgtcaacttcaatgtcaatagtgataaagaatataattccaaagagccaccgaaactcaaatatggcctaaagtttagcctcatagccagagacttcagaatcatttggagatttatatttatatattttgctccaaattttccaagataaattatcttagcaatggccatacatcaattttaacataattagtttctcttcaaactaagccacgatgattagaaaggcaggcttgagaaatcatatatatcttaaagtttacactccaaaggcattgcttcaggaatgtaaaacataatttatactcatcaaactctataaatcccttctgaattgtgacttcatttctagaaaaaaaaactgtaatccttcctaatctgtgaattagagttttttaaaaatatgtggtttcattgagtctcaaatgcatacaacctctaatttctctctattcaattcacatgtctggtttaaggctgaataatcccaccttcttaaacaaatcagcaatgtcctttttggggttgtgtttttgtgattttaactttagcatataaatttagctcaatgatgtgagctactgaggttccaacaattcaagtgtctgtgagaacttcattctcaaaagtccttgatttgaggaatcagactgataagtctgttcagtaaatatccaaaatctggtcttaaaaaaaaatgaaacactcacacagtgcttagggccacaagcataaaaaagtcatgattttgatctttattttatcacattatataatacacttgatttttgcagtataaactcttctcatgtaggattggatgaaagtaggcaaaccaatctttcctttcgatgcaaataaatgaatgaaacctaactttatgcttccattattattattattattatttatttttatttttatttttgagacagagtttcactatgtcacccaggctggaatgcagtggtgccatctcggctcactgcaacctccgtctcccaggttcaagcaatcttcccacctcagcctccttagtagctggaactacaggcatgcaccaccacgcctggctaatttttgtatttttagtagagacaggttttaccatgttggccagctggtctcaaactcctgacctcaggtgatccacctgcctgggcctcccaaagtgcttggattatagggatgagccaccgcgccagtcctatgctcgcattatgtttatggcaagttaactcagcttttccatgttagacaaaatttctcaaattctttgaaggcatatagtttatgtgtgctaactcatcaagaaaaaaacatattaacatcttaagtgggtcacaccccaggatctagtggaacacatttaccctgagggttacatatcaggagccccaaaccaagatggaaaggacattttcttttttttttttttttcaaatgaccttcatacccgaaagaagcctgtaggggaatggacaagaattatttcccaggaacagaattattcaaagagaaacagcctctagatgataatgaaataactgagctaaaagagaaaagttgtcttttccacttgattccatgcttaataacagttggactgtgaggttctgtcttcaaggataggtaggattacttcctcaatgtctgtaatgaggaataggacagagcagaagcattacttctccactctctagtgccatacctgatgacaacttgctaaatcttttaaagtgtgctgtgattccaactggggaaaaaaatgaagaaatacccagtacaaatggaatttttctcgatgagtcgaggtttgtgggggagaagcatcaagaactctggcacctgggataaggacccaaagataagccaattcacatcttaagtttcaaatagacaacatgtctttttaaaacttgagattaaaagctgtatttcacacagaacattttttttcttcataaaatgtgctgcaacagagctgatttccaaagctggaagttgggggtttgcctacattaaaaacttcgaagttatagtttcaagaaaggcgtgttcccccaagtttaagtaagaataaggttactagaatgaccagtatttccagaatctgtcataatacagaggtatgtgtatttacacgcgttcaacaacagattttgttaatgacaccttttttttgttttttgtttttttaaacagagtttcgctttgttgcccgggatggagtgcagtggcatgatcttggctcactgcaacctccacctcccaggttcaagctattctcatgcctcagcctcctgagtagctgggattacaggtgcctaccaccgtgccggctgatttttttgtattttagtagagatggggtttcaccatgttgcccaggctggtctggaactccagagcttaggcaatccgcctgtcttggcctcccaaagtgctaggattataggcgtgagccaccgcgcccggcctgttaatgacatctttgattagaggaatctgaaacactaaagttatgtttcataactgtggcccccttgtccaccttatatgaatatttgtggtaaacttaaaattatctttgagatgccttcagtatttttctttctttctttttttttttttttttgagacagagactcgctctgtcgcccaggctggagtgcagtggcacgatcttggctcactgcaagctccgcctcccaggttcacgccattctcctgcctcagcctcctgagtagctgggactacaggcgcccgccaccacgcccagctaatttttttgtatttttagtagagacggggtttcatcgtgttagccaggatggtctccatctcctgacctcgtgatccacttgccttggcctcccaaagtgctgggattacaggcgtgagccaccgcgtccggccgccttcagcatttttctagggtctttaagatgaaattgtgaccaggtataagacttcagtgattttccttatcttgtaaaatgcagttccaaccttcataagtataatggcagtcacctccaaggattatttattaccctgaagagatgtgatattggaaactgacagttttatttatcaatacaagtaattcacaaataactaacttcaggaactagaagtcattttttctttctttagggattttctgttggttggttggttggttggttggttggttagttggtttgtgaactttctgagggttaaatagacagaagaaaaccagttttaaatatgggctggagggagtaggatctctgaaaaaatataagcagtattcccaagaggtatcactaagtacatctagtctattaaggtaagactgtcaatacaaaaacacaatagctttcatgtaaaaaaaaaatcataaaaatcaagttggatcacaatgggttaataacgttcagagttacataaccccctcaggaacaaaatcttagccttaaatggaatataattatttcctgaagggctttttcatattgttttttcctcattattattcctactagaactcaagtagactccccaaaagaattcaatttggttaaaaaaaaaaaaaatcagctccaaagaatgaaacaatagctgattccaaactctaactttggcatgaagtagaataagaaagctcttatctcttagaaaacaggtgtaaaactattggataattatttcatatcaaatagactttcaggtattgtcatacaaactttttgcagatgggtgaattttctttttaagttctggggtacatttgcaggatgtgcaggtttgttacataggtaaacgtgccttggtggtttgctgcactgatcaacccatcacctaggtattaagtccagcatccattagctgggaatccattcttgatgctctctctccccaccccagcccccaacaggccccagcgtgtgttgctcccctccctgtgtccatgtgttctcatagttcagctcccacttatacgagggaacatgtggcttctggttttctgttcctgcgttagtttgctgagggtaatagcttccaactccatccatgtccctgtaaaggacatgatcttgttcctttttatggctgcatagtattccatggtgtatatgtaccacatttcctttatccagtctatcattgatgggcatttgggttgattccatgtctttgctattgtgaatagtgctgcaatgaacatacgcatgcacatttttcagatattcctgaaaagtcgtgatttcatatattctgtctcaatgccagatatgtcatgccaaaggctttgaaaactattatttcatttgttccttattatcactgaaggtaagcagaaaatttattaataaccctcattttgcaaatgagaaaggactatgtttagagatttgcttaagatcatctgacaaagccagaagtataacttcagaatcctggtacaacattctctcttattatgctctgctaccttacgttgagtgaagttcttgtgggcccatttggtagcctccaaattcaccaccaggtaatttaagatgaccacacgtttttttgatttgtgaatgaaagtttattagttaaaatctcttgaaagaaaacaataaaatggtttagatcaatagctaatacagattgtaaacaatcataagataataactagcagtaatcatcacacataagaatttatataggcacaactccccacatattttaacccaaacaaatagggatgaaaacttgtactacctaatctaatgccatctaccagcctatcttccttgattttcacacctttaagcttgtctcagaatgatgagcccctctcttttctgccatgctatataataattggctttaacactggtcttaagaagatacagaaaagggctaatttgcataaaggatcagccactcactccattctcctggaggagatgcaggatttcaatcagcgatatccagtcagtggactaaactagttaataattctccatctaattgagctttcagatacatgacttatgtcaatcgcctaccagctgtttatagcaacatcttagggttggctaatttgcagaagacaaaaacagggctttgttcataaacctgtttagaaactaactccatatcatggctttccatcataaaccgtcgcataactgttgacaatttattaatttgcttctctctcctgaaaacaccgtccccactagttcttgttcctaaatattttcttatttcctaaatatttcttttcactattaactctaattctgctccatagagcaaacatacttaatacaacaatccattccttggagcgggggttatatcttaacaatccttaagcacataaaattacagaatcaaagcaaacactggaatatatcttatctagttcctgaggtaccattacagtacaatctgttcaggtgacccaggaaaacaagggtccagccagctccacatattatggggttgtagcatcttcctgctttgatgcctaaggactatatctagtccatagatatttagtccaatatggtgagtgtttgtctttccattggtgaatagtccttgtagggctttgcttagcccttctattacttctctctttgattatttggtatagtgtgccttttccatttggggaataatagtgcaaagtagctacaatgtggtcagaatttgcaagaacagtcctgcactggaactcttggtcccagctttttcagttttctccttggcaacagtcatttgaaaacctttcttcacttttattatctggtagatagtactcttttaaaattacctcccttagtctgctatagcattttttgtcggacacatgctttcttaaaggataagtaaggagttatatcctttcaaataaaagtatcccaacactgtcttgttaatgtgaatgtattcatttactgtaatgctaccctgggggatattccccttttcatttgcattcattggagagcagtgaaattagtcccaagatgtgatagagttcgtcagttctccactccataattaggcaaggaatttcttttctttactattgtttgctcccatcatcagaaattctagcatgagagtaagtacaggtaaagggagacctacatggcaaaagacagaactttctgaataacaacaaagatgaaaaaagaccagcttttgctagaagtaaatcaaatctcacttgttatatgggttattagtaatgaaaatgtgcagaactatgagaaaacacatattgctaatatacagaaaataagaatatattaaaacagagaaatgatcagttttcacatccctggggacgggggcagaaattgggtcttagtcacctgttaagtcatcatttataccagagactgtatcttcatataagttatccatgtctaacatagcctgatctatatcaaatattaggtcttcatcctctcttggtgtaagtattgagtctaagtctgagagatcagggagatcaggtagcgaaggctcctcgggaagaggtgcatctgcttcagtctcttctgctctaccattttcttctacataaggaacttcttgtacttgtagaatgaattgtaaaagctcatcagctattcttattaactgggctacacaagcaacaagtccatcaatgagtacatgaattaacacagaatccatgctgcagtgctcttctaaatagataaaatatcactaaaagctctagcaaatggactcttggtgacaatggatagtataaggggctaacaatggttctgtggttggtttaggccagaaattaggatgttgatatgattatgatggtgatcaagtaaagaatgagaacagtagaacaatataactttttgatgatgttggtaaaccgcgcacagaatttatgtatggtactcttgtttgtactaatggtgaactgctgttataatgaccatcaggcggactgtcacagccaagagaaaacagcaaagcagacctaataataaaaaagagagatataaagattagtatctttgagcctttatccatcctacaggctatggctactggttacccctatcaagaattgctgttaaggttgaaacgatatgtctaactatagcccctcctttgttgctggccttgtgaggctctactacttctctttcctttgaaaacctcatggtctttatctcttgttaagagatttgggagaaaagtgagtataggtagtttgtctgtctttcttgagcatctcttttgaggaaggatacactcacgcagggtctgtcaattattagcacctttgcctcattgccatttatatctgggtgctgctgaattctttctgtgtttctaggaatccattcattaaagtttccagatgccctgcagcctggggagtttatggtaaatgaaagtcctatattctccatattttgccaaactttggagaatttcagttataaaactagttccttgataatttcctattactgccccacttccatatctagcagctagttcttccaactttatctaaagccatggttgtactattttcatctgcgtgtctagtgggctttgcaaacccactttctgagtaagtatatatttgtgtaaggcaatattatttgtttgaaaatctagatattggctcaatataatctacctgctacatttgtctggtttaccactccccaccacacttaaaatgaatctgctgaggatgcaagaagtttttaatattttgatatcactcatatttcttactcacttgtttatttgattcacaggttttctaactctttcttctctgctaacctggcacatacatgcccatatgccctgaggtttcacaagcccatcctacaaccttaaattgaactgaaaagggagctgagttgaaacttaaagtccccgaagcttcagggtctacattagttttgggggcctagattatctcccctctcattccaaatagattattctgcttttctgttctaatgagctgacacatgtctttataagaatttctaaattctttcaccaatttattttcatatctcccttcaccagattgtttttcctgcaatagtccaggtctatatggctgatcagtgtagctatatacctttgaccagtttttttcttgggtatatctacatgttaaatttctggctattaattctgtaaattgggctaacttcctttctccagtcccagtcaggcttttcctagttgaaagtcttaggaagtagtcatctatataactcctttaggattctaccaagtctattattgcccagttttcagcagttctgaccagagtggggcccagcaagccacaggcttcactttcagctgactataatccttgaatatttattggagtacagaaaatcatcagccagatggtctgtgatttgcacatacagcttgctggtcttcacagggccttttttgacccactcagttgtatagtatctccacttagcctaagtcctatcagatcactacattttttttttgtccaaaatcctaccagtacacatggggtttgtcctgatgataagggtcacaacgataatgaccagaaggcacgattttgttggaggcaattttccatatggaatataggagaacgggtactagaggcagagcagtttgttttattaattcaaaggatctgtttgtttgatttaagagaaaaacgtctcatgtaagaaaatatggagagaaatcaaggaaaggaatttggcatttatttagaacatgcatcagctcatcagaaggaaaacacagaagaaagatgtgtgttaaatattgtaagagagcaccatcacatttttcaaaggaagcaataactactagatggtatatacagcccaaaggcacaagaagatgacaggaacacactcacacaaaacctatttaacttctgacttcccattcacccagttttttttctcagcttctctatcttcctctgggactcttttattcctcctcttgatcaatatgcttccatttattcacttatgtgtttcattctatttcacaccctctctatctccatctactcttaaccttttccatcatcttttcttgtctctctctcctaaaactggaaaaaaattggaataaattatatttgattcatcaaatttttattgtatttattgagttgtacattacacaacctaaacataaaaagcagagaggtagaacattccatattttgctctcttataagagaaatgtagttacttattactttatgtggcccatgagtttttttgtggggcgggggactcagtcacttttgatgggaaaaaaaattagtgaccttgccttaactttcttgacccttgtattagctttttttttattttttattctcaatctcagaatttagcaactagtgggtgaggagagggcaaggagaaacttgaagaaactgctaagtattccaataataagaaagagtaagagtgtggcatcagcttatgccagttatggtaatttccaaagcaaccaactctggacaccttaactagcctaaaggggtcttttggatagtttatgcctagccttaactcactttaagggactttttattagctatatcctctgcctgggatccctttctccttggtgggggaggagtggggaatgatttcgtgtcattctgatatctactttaatattatctcctcagatttcttacccctcaacctgggtaaagcccctaatcattcctttcccattacacacaaatttcatttttgcatgatggtatctataactagctcacattttcttgcttaattatttgtttttctgtctctcaccttacccccacatacatatagactaaaatgtaattgtcatgagactaagaaatctgtctgatttgttttctgctatatccccaaagaacagaagagtgcttgccagcatagtatataatcagtaagtgtctttgaaaaaaagaaataatggaaggagggagggaggaacaactttcagctcattcattcagtaaatattatcaagcttcaaccatgcatgtgggaaacaggggatacaaaaatggacaaactcatcaaatcatacagttaataaaatgaacaggcaacccagagactgagagaaaatattcacaaaatatatatctgacaatgaactttcaaccagaatatataaagttcattgtcagatatatgtgtgtgtgtgcgcacacacgcgtgtgtgtctatatatatatatatatatatatataagaacccctacaactcaataataaaaagacaaacaacccaacttaaaaatggccaaaagatctgaacagacaattcaaatgaagagctaataagcacatgaaaacatcctcaacattattagtaatcaaagaaatgcaaattgacatcacactaagataccgcaatatactcagtagattggctaaaattaaagactgacaacatcaaatattgacaaagatgtagaggaaccagaattctcacacacatttatactactggtaggagcataaaatcatattatgtttttggaaaaacatctatcagtttcctataaaactaatcatgcacctatctatatcccagcaattctactcataggtatttacccaaattaagtgaaagttcacaaagtgacttttacaagaatagctatagaagttgtatgcataatcaccaaaaagtagaaagagctcaggtaactatcaagaagattatgaataagcaaactgtggtatattcacacaatgtgatactaataagcaataaaaagaaaggcactactgagagggacaacaacatggaggaataatcaacattatacttaatgaaagaagccagacacaaaagattatatgctgtatgattccatccatatacaattttagaaaatgcaaaataatctatgtagaaagaaatcagaatagtgcttgcatttatgggagtaggaactgattgggaaggggcataaaggaactttctagagtgatggtaatgatcatgtttaggtacggttgtgggttacacaggagaatgcgtgtgtcaaaactcattgaatggtactctaaagatttgtacatttcactatatgtaaattttactcccctcaaaaaagtaaccaagcacaatccccagcctctgaaagcatatgtcagatgcaatgatgtacccataaaaatttttctaataaattgtcacattaatgggagacctattgtgtgtcaaggactgtaaaacccacttttcttatattacaggttgagtatcccttatccaaaatgcttggtaccagaagtgttttggatttcagattttgaagtatttaaatatacataatgagatatcttaggaatgggacccaagtctaaacatgaaattcatttatgtttcataaacaccttatacacatagcctgaatgtaattttatagaatatgtttaataatgttgtgcactaaacaaagtttgtgtacgctaaaccatcagaaagcaaaggtgtcatgttggtgctcaaaacgttttggattttgaagcatttagtatttcaaatgttgagattagagatactcaacctgtagtacatttaatcctcacaataaaatcagcctatgaagttataggtggaaaaactgaggattagagagattcagtaatttgcccatgatcacataagtaaagatgcagagctggatgtcagcccaggtcggacttctaaagtcctgtgctagagggcacaaatttaggtgactacaggagcaaatttgccttattcagggccagagctgacatctcattctcctaagcaggaatagaactgagaatgttaatgtcatttgctatccctagaaactggctgaattccaagttgaatgtgacttaggcagatcagtcccctaggaaatccccaatatctgtgactgggaggttcagggatatatccattacctatctttccactgacctactgaattggcccaaatgttcataaactacttacctgtgatagagctgagagggatgcggatatcaaggctcggcctattaaacaatttgcagactttgtttccaaacaggatgtgaacgctcctgcaacaacaaaaaaaaccacacccgcccccaccaaaaaaaaaaaagataaattgcgaaatcgataggtttaaggataagcaaggacgagattaaagagccctttctaagtgaactgacaatcaggggcttttttcctttcctgtggcatttgctaattctgggcactgttgaagatgaagcttggctgtaaggcagaaggactctcctgaggaaaggagaaatgagcataactttgggccattgggagacactaaaataatgggctggaaacttgagaagcccaaaatgcagggctagtttttcttacctgaagtcacctgagttctgggctggtgtctgggtaggaaaagcacaggaaaatctcctgcagtctcctggtacttcagagacaaattctccctctagaggggaactgccccaaacaggccaccggtctccaccttaaaaggttacctagattttgaagttagagggacaaagggaaaactaatgagtcaaaaagatcaaaaccactcccaaagggcaatttggacaaagtgattctaaaatgcataagaataaataaaggctagtaatagtgaaacatcttcaggaagaacaaattgaaggacatatgctaccagatatcaaggctagttacagagctagagaaattaagacagcgtagtactggctcaaggacagacaaataaatcaatggaaccatgacccttacctcataccagataccaaaataatactaataatgatttgaaatgaatcataggcctaaaaatgaaagtcaaaacaacaaagcttctagatcacaccaccagagaaactcttcatgaccttaggtaggcaaatatttcccagaggacaaaaaacattaaccatgaaagaaaagattaattaattataccttaagaggataaaaagccaaccacagactgggataaaatattcacaatatatatctaacaaaggacttctatccactacattcatacattttttaaactacaaatcaatacgaaaaacataatcaatctaatttttaaaaaatataaaagaattgaactggcacttcatagaggagaatatccgaatggctcacaagcatataaataggtgttcatcactattgctcatcagggaagtgcaaattaaaaccacaatgagatatgcaaaacccaccagaagagctaaaatgaaaaagactgacaataccaagcactgaaaacatggaacaactggaactctcatagattgctggtgaaattgttaactggtaaaactaccttggaaaactatttggcagtatctactaaaaccaatcatacctctatcacatgaccctggaatgctactcctaagtatataaccaaagagcgtacaaatatccaccaagatacaggcacaagaatgttgaaatcaaccagatgcataaaattagctaccatatcactacatttacatgaaatccaagaacaggcacacaaatctacgggaacaaagtggttacctctgggtagggggttattgactgggaagggatatgaggaagccttctggggtgctggtaatgttctatatcttgatataatcacatatgttaaaaaataaaagcattgatatgcacccttaaaatttgcgcaatttactatatgcatgccatacctcaaaaaaaatagttttattttttaaattttaggcctacatcctataaaaactaatgaggacagcaagacagtgataagagtcttaccaggattcagcaagccagtcatcaaagttaatgaaaatggaatgaaatatgaatgtgcagggcagtgtccctttggcctgtgtggctctctacttcatggcagtgctaaggcaagagaccctgatagctaggccgagtttttaattgatacaagatgagataacctatatcttacaagtagctcataaagacccctgaggcagaggccatactatccatctggtaactgagatctttgaccccattgaatttttattaacctctcttgggactttttttgtctgcacaactaatcaaaagtcaccatttttcttttagctgaaagtcctacctggcaattttgcaatgctcctaactggaaaactggcaataagtgtctaacagtaggatggaaaaggagcaaagaaatccaaatcctctgggtctatctttatagttgataagcttctttgtattaggtaaggtaaattagttcatatccaaggagaacagaggcagttatgtgggaaagattaaaatgcacctttggtgagggtgggtgccagattcctatttacaaacaggaaaatttttttccatagtgttcccttctccggtgctgcagtaccatttggatacatgcattcaatatagcttgttttaaaaaacacctacagacatataacttctcgttaccctcttcaccccttgaggaaacatcaagagaactttatccacaaagggcaaatgttcacaattttgacataacagaagcatctctatgggaatacaatgaataaaaaagagtatttacactttaaactctttttgaaaaagctacaaacttttgcctttaaaaaaataactgtgtgcaatacagcatttgcctgttataggatctgacatttaaaaatccccatgaagcatctttaatttatcaagaaagaaaggaaagaattgtgcagctgaggagctaaacatggccccttcttgaaaatatatgaaaaattcaaaactaaaactaaaaaaagggggagtaggaaatgtccttatggtcaatttaaaccaaattctactgaatttctttcctcctccaaatttgttcattgctgcagagaaaaatcacagactggcttacccttcagaaaaacaacttagtagaaaaatacaactacttttgaaaatacatcttggttattttcctagacagatacagtgtttcctcaaaacactgttcaaacatgagaatagacactcaatcttaacctggtaggaccctacacaggcttgtccttgaggcttggctgctatgagaggctcccaggcccttagagagtctggaaagagatgtaatacttctagaaagatttttttggttttcaaatattacagcgcagatgacagggtctacaataagggaaataaaaacagaacttggaggtaacaggaaaaggggttctatttccaagtctttcttcagctttctgagagggaaaaaaagttgtggttgtttgtttgtatatgctttttgggagagatataaaatgatactagtggttataagaataggatctggtatccgaaaaaaaaaaaaaaaaccctatatttgaatttcaacttcaccacttactaactagaaggttgctaagctactctgtgtcagtttcctcatctgtaagatgaagataatgacagttatgagaattacattagttagttagcacaacgaatttaaaatggtgtctggtatataattagcacctaataaatgctagctgatataattgcactggagaaattccaggatctaggaaatagtatgtggtacatcatgactagtgaatagctgcccatggaagacaggagaagagatggctgcaggcattacaaaaattggaaggacatgccagagacacaattcatctcatagttagaaccaatattagatgatgactttgagcttgggtaaaaatgtgagggaacaggactgtcttgaagctgtagttcacaaatgaccctttcaggagacctaagaacaatcaaagactgtagggaatccttgaggattagcaaatcctcctagtctaacttcctctgaagcacttccttattctggctttgagctctggtggggctgcagctcacatgcaccactcctggcctggcgaaagctaactatattgtgggctacacattggctatgcctccaacacactgccagttgcacagagaatgccctccacctcgtattgtgacaatgattctttcaaagcattaaatctttagaaacatccacttggaaagtaattggcaaggtcattgagacaagataataaaggtccattatcctatatctagcatgacttcacccaaaccaacccaaagtttcaagtattcctttgtgaatcatttggataagaaggagagcattatgcaaacatcttcgtatactttttacttcataccatcctagcatggatttagtccctaacttcaggaatatatctcagaaatttgataagagaaagactaagcaccagttgtggcctcctctatgtttctgtggcaaatgccagcttgccaagaaagaacaggttagtttattttaccacatggaaagatgatcaccgattacagattgcttccctctgcctgcaaatgtgcttaatgcctgtccaccaaaggaaaggcccttctgtttttaatgatttcaaaataacattccatagcatcccttggtaactcattcaaatattttatagtttccttcttctggtaattatatcctcaaatatgttcacatacattaacttataataatcctgtgtagcggccaagcgcggtggctcactcctgtaatcccagtaccttgggaggccaaggcaggcagatcacgagatcaggagttcaagacgagcctggccaacatagtgaaatcccgtctctacaaaactacaaaactacaaaaaattagctgggcgttgtggtgggtgcctgtaatctcagctactctggaggctgaggcaggagaatcgcttgaacccgggaggcggaggttgcagtgagctgagatcgcaccattgcactccagcctgggcgacagtgtgagactccatctcaaaaataaaaaaataaaataaacaaaataatcctgtgtagcaaggattatacctattttacaattgaggatatgaagaaccaaagagggtaactgactcgtcaagattgcacagctggttagtagcagagcaagaataagaacctgatttcttggctcctattaaaaagtcaaaaaataacagatgctagtgaggttgcagagaaaaagaaatgcttatatattgttagtatgagtgtaaatcagttcagccattgtggaagacagtgtggcaattcctcaaagacctaaagacagaaataccatttgacccaggcatcccattactaggtatatacccaaaggaatataaatccttctatcataaagatacatgcacacattatgttcattgcagcactattcacaatagcaaagacatggaatcaacctaaatgcccatcaatggtagattggataaagaaaatgtggtacacatacaccatggagtactatgcagccataaaaaacaagatcatatcctttgcagggacatggattgagctggaggtcattatccttagcaaactaacaggaacagaaaactgaatacctcacgttcttacttatatgtgggagctaaatggtgaaaacacatggacacataaaggagaacaacacacactggggcctatcagagggtcgagggtgggaggagggaaaggatcaggagaaacaactaatgggtactaggcttaatacctaagtgataaaataatctgtaaaacaaacccaccatgacatgggtttacctatgtaacaaacctgcacttgtacccttgaacttaaaataaaagttaaaattttttatttaattttaaaaagaacctgattcttcggattcttggccttcttcagactcctggtctgactaatgatgctctgggaacctccacatcactagcagaataagaaccagtgttaagatatcagcaagaacacaatgtttgtctcttggtgtacaggaggattggttccaggaccttccacagatactaaaacccgtggatgtttaagtccctgatatgaaatggtttagtatttgcatataacctatgcacatcctccctcatataccttaaagcctgggtatccagttttttggcttcccagggccacactggaagaattgtcttgggccacaaataaaatacactaacactaatgacagctgatgagctaaagaaaactgtgaaaaaaatctaataacattttaagaaagtttatgaatttgtgttgggccgtattcaaagctgtcctgggccacaggttggacaagcttgctttaaaccatccctggataacttatgataccttacacaatgtaaatactatgtaaatagtttgttttacaatattggtttagggaataatgacaagaataaaaagtctgtacatgttcagtacagatgcaatattttaaaaatatttttgatccacagttggttgactccatggatgcagaacccacaatacagagggctgactgtatagccatgatagtttgcttaccaagtggatcaaaggccaaaagtccccttgaggacaaccatttcattattgtcatccctacatactatcgttcccagagtgttcctacagtagaaagccctactaaaaagaaaagatacaaaaagcctagctgaacattaaaatcaccttaagatcatatgctgatccatgaaaataaaaaataagacaagagtatgtggtttgctgctttctaacttctctatttttacctctgagatagatacactcagaataaattgaagaaaatgaggcagaaaaaaatttcctaatatcctaaaaaaaatgctttacccttggccatgaacttcctttccccttgaggatttcatacctctacctcccaaagtttctaagggagccaagggttagcattttaaacatgggtaaagagtgaatcccattgctttatatgcttgacactcagaaaagcacatcagggttacaacacagtcctctggcatgagccctcccaatactaaaccagcatgctgttcaagtgaaaagataaatggagttttccttataggatttcttacaagatttcttttttaatattagctagagccaggggaatctgaaggcaggctcactcaatgggaacaaaatttctctctcatctcttatgactgatattaccaaggttaaatacatatgtcctgaaacacacttttaattatggccactccaccttactacccttgctaaagtcaccaatgacttctgcattgctaaatccaattatcagctctccgtctcatcttacttgtcctataagcagcctttaacatggccaatcactccccaagtcctcttcttcttcatctatagtcacactcttggtgacctcatatgggctgcaaataacacctataggcagatgactcccaaatttatttagccagcttaggcctttctccaaaatctcatacttgtttatctactttcattacattgattcctgtaaaattcaacacagtacattcaaaactaaatccttggtactctctccaaaacctactcccttacagcctcccatctcagtagatggtaattctatccttctaactactcaggccaaaaaatccacagtcaatccgccaggatatcctgttggctctgccactaaaacatatccacaatctgatcacttgtcattgtgagacaccatcacactatcatctacatctcaccttgattattttgacagcctcctgacaggagtctctttgccttgcctcactacagtctcttttcttttcttttctttcttttttttttttttttttttttttttgagatagagtctcgctctgtcacccaggctagagtacagtggcatgatctcagctcaccacaacctccacctcccacgttcaagccattctcctgcctcagcctcccaagtagctgggattacaggcacctgccaccatgcctggctaattttttttttcttttctttcttttttttttttttggtagagacggggtttcaccatgttggccaggctggtctcgaactcctgacctcgtgatccgcccgcctcggcctcccaaagttctgggattacaggcatgagccaccgcgcccagctacagtctctttttcaacaggaccgacagtgatccctttaaaatggaagtcagatcatgtcactcctccatttaaaaccctctgataactgcatttcctttagcataaaacccaaatccttatagtggtttatatggccctgcataatataatctgcaacttcgttttctatttttctctctcctgctctgttctagctgctctggtctgtcattcctcaaattcaccaagcacacttcctctttaggttctttatactggctattctgcctggaatggtcttgactcaaatatcaaaagagctaaatccctcaccttcttcaatctctttgcttctatcttgccttctcaatgagtatttcacttaccacctttgtaaattttaacctccccctcccaacttggcagtcctgagtcttccttattccgctctaactttttaatttttcttagaaacgtatcactttctacacatattgtatagcttacttatttattatgatgatcatttattttctggttttcctctctagaatgtaagctccatgaaggcagggatctctgttttgtctaagtgcaagaacagtgtctagcacatagaagatattcagtaaatatttgttgactaataatttgtaaggactaataattccttacatttttatagcgttttatgtttctagtgctttcacatggtatcccatttaatcatcttaattactatatgaggtgggtagggtaacacagaatttatctccatttcacatttaggaaaattaaaatccagagtagtaaaatgatctacccaagagctattctacatagctggaatgtggtaaaaccagaaacctagttttgtaccctttttctgtagcctccaatattatactgcaaagcctgtagtccttgaggaaagaccttccagattctttgttaggaaggggacatgccctgcttgtgccactaacccagtgccttgaagcttaatgtgtttcaccagcaaatgcgaagtcaatcaaagacctgagcttatgtggggaatcaccttgtgaatatgagagaaaatgattcccaaatggcactctctccaagaaagaaagaaagcaacatttgaatatcccatctacttagtggaataaattatttgtttcttcctaactagctctgccttcctctggcattacccactaaaccaaacagttctccaaagcaatgtaatagcataaagggagatgtgagagtccaaaaaggcatctgcaacataacatatatcccagtggcctctttcactgtgccaccatctaagccactaactgcccatgttgaaagctttgccccattgccactggcacatgcaaagagtggagactgtccctttaaatgtaccaccaaacaggaagctggtatttacttggcaggggaagaacaagatactttcatgcttggcatactgctaccattggcatctaacccagaagctgctgcattctgcaggggtggcaactattttgtcctcaggataacatagtggaagatgcagctatatttacatacaggctttttaatagagatgcctgtcacccctggtaagctcacaggaggcgacagaaatggcacagtcagaaaaaggcaagccaagtcctcggtaccttctggcaattgaatccacagtaccagagagggaggccttgatctctttctttggcctccagaatgtcattataccaggggtatatccagaaaccctctgaagtattactgaatagaccaggtttgtcttcagtgcccttgtcagaactgtcttttccaagatcacgccaaatcgagtggttgaggcttgaccctactaagtcaactctgctgcaaggctcaacaaatatcccataatgaaacagcatgcaacaattcaataaataaacctcaggctgaaaaaaaagaagtgtcaatgcaagcataatctaccaaacacttaacagattttagataatacatggatgcaaacatcactgaaacatgaagaaacatacaacaaccttggctacatgggtatgtactgaagtatctgacactgaggaagtaggccggatggaagaaaaaacattattttattttattgacagagtttcactcttgtcgcccaggctggagtgcaatggcatgatcttggctcactgcaacctccacctccggggttcaagcaattctcctgcctcagcctcctgagtagctgggattacaggcgcccaccaccatgcccaactattttttatatttttagtagagacagggtgtcaccatgttggccaggcttttctcgaacccctgacctgaggtgatccacccgtcttggcctcccaaagtgctgggattacaggtgtgagccaccatgcctggcagaaaaaaaacattatttttaaggggaatattggctttggaggcagagaaacctaggttcaagtctaaaagttttcttgccttagttcacttaagctcaatatgactcactttcctgatcagaaataaggatgatgacaataagcaagtattaattttgtgatgtagacaatgtttaattatggggagatgccctattgatttagtttgtaaaaaagtgtggcttttgagtttaaacatagatttaaactgcacttctgatactaattgtatggcattgcagaaggtacttattctctctaaacctgagtttattcatttatattttgaggatgatgttgacacctatctcaagtggatgccataataatcaaacaagataatgttatgaatgtgttttataagccatgaactccaagacaaagaaaagttttctttttttaaaaaaaaaaaaaaaccctttgattagagtggccaaccaatctgattttccaggaataaggggttttccaagacccagagttttcaatgctaaatatagaaaatcttaggaaaactaggatgagttgggcactctagtcttgaccaacctttaattaggccaatgtcctcactagaccttaactgggatgactaggtcctaactagatttaggccctggctctgccttaactagactcttactaggacttaactaagcttagtcctttctagacctaactgggttaaataggccttaaacaggcccaggcccttgctacacattaaattagaaatgaataggccttctctagacttaggtcctggcaatgccttatctagactgattagatattaactaggcatagtccctggctaagctaactgggctgtggctaggacttaactaggcataagcctggctccaccttcactgagttgactaggctttaacaaggcttaaggcctgcatttgccttaactagactctgactaagctttaactaggctttggccctggataggccttaactgggctggccagatcttaactaggatgactaggccctaagtaggctcaaactctggctagaacttaactaaagtctgaccacagcttttctaggcttagaccttgactaggccttaactgggtccaggttataccttaactaaactctatgtctcctctagacttatgccctagataggccttaaccatgctttgtctaggacttaagtaggcttatccactggataggctataactggactaattaagccttaactaatattggcccttgctagtctttaactgggctgacgaggccttaattgtgttaactagctcttaactagtctcaggtctttgctctactttaactagactctgactaggccttatctaaacttaggttatgactagaccttacccaggcttagtccttggctaggcttcaactggcttctgactaaaccttaactgggctttggccctggttaggccttaactaggatggctaggtttaaactgggctcaggccattgctacactttaactatattttgatgaggccttaaccaagatggctagcctttaattaggcttgggccctgggtatacctttaaaagactctgtttacgccttaataagctagggcctggcactaccttaactagtttctgattaaatacttaagtagatttaggcctaaactgggctctgactaggcccctaactagctctgactaaatataaactaggcttaggacatgaatagtccttaaaaatactctgataataccttaaccaagtcagttagcttttaattaggcttacactgtggctgtaccttaataaaactctagccaggccttaaataaatgtaagccctggctataccttaactagtttctgcctaatacttaactagacttaagccttacctaggctctgacttcaccttaattaggcttaagccctgactaggccttaactgggctctaacaaagtctaatctagtgttaggtaatggctaggccataactgggctttgactcacacttaactaggctgaagccctgcctataccttgattaggcttcattacatcttaactaggcttaggtcctggccaagtcttaactaagttctgattaggactaaactatatttatgaccttgctaggacttaagtagactaggactacaacataattaggcatagaccctggctagggcttaacctggctctgactagacctaaattaggcttaggccctggctagggctgaactggcttctgactagacctaacctaagtttaggcattggttatgctttaacaatacaccgatgaggtcttaagcaagctagctagcttttaactaggcttagtccttggctatactttatcaaaattcggacaggctcttaactatgtttaggccctggctaggctttaactggcttaactagacctgaattaggcttaggctctagctaggtcttaactgggctaactaggccttaactaggctaaggctttgactcagtcttaactaagttctgactaggactaaactatacttatgatcttgctaggacttaagtagactgggactggaacttaactaggtttagactctggctagggcttaactgggctgactaggcattaactaggcattggccctgaataggtcccagttgggctgactagaacttaactaggctctgactagaccgaaattaggcttaggccttgcctagggctgaattgggttataactggaccaaaactagacttgggcaacaactatgctttaacaatatcctaatgaggtattaaccaagctaactagatttaactgtgcaatctagaccggaagtaggcttaggctgtgactaggtctttttttttttttttttttgagacagagtcttgctctgtttcccaggctggagtgcaatggcatgatcttggctcactgcaacctccgcctcccaggttcaagcgattctcctgcctcagcctcctgagtagctgggattacaggagcatgccatcatgcctggctaatttttttatttttggtagagacggggtttcaccatgctagtcaggctggtcttgaactcctaacctcaggtgactctcctgccttggcctcccaaagtgctgggattacaggcatgagccacagcgcccagccggctctgactaggtcttaactgggccgactaggacttaactagacttagactctgtctccacctaactgatatctgagtaggccttaggtgggcttagcccctggtgagattgtaaccaagctgccttggcattaattgggctgagcaagccttaactaggctttggtcttggccaagttcatggctagagcttaactatgcttaagcctcaggtaagccttatctaagctgaggtgctggctaggccttaaccagaccttggccttggccttgtcttgattaagctgtcatcagaccttggctaaattgcagctactctttcgtaaggatcacctcaataatatactacctctagccctcagctcctccagtttgtatctgccattacctcagttatcctgcagtttcaggccgtactctgggtcataaagaagtcagagacaagacccctaccttaccatactgcaacaggaaacagactgcttgtaggctctttgcagccagaggtacttacagtataaaacaggaagcaacccctgaattgacactcccaagaaaccagggggatactcttttatataacactccacccagaattatatttttatttcagccaatgagaatggtctgtaaaacttcttccaggacactgacattttgtaataagtttgtaacaaacttaaaacataacatagcattcctgagtacagtacagcagcaggtgactttacggcttttgcccataatgtgcaattggcagtttagaagagagatcttcttacctaccttaccacactgcaacaggaaacagactgcttgtaggctctttgcagccagaagtatttataggataaaacgggaagcaacccctgaattgacaccctcaagaaaccagggaacactcttgtatgtaacaccctacccagaagtatatttctatctcggccaatcaaaatggtctgtacaactgcttccaggacaccagcattttgtaacaagtttgtaacaaacttagaacatagcattcctcagtaggggaggagactctactgcttttgcccttaatgagcaattggcagtttacttaccttaaccacactgcgacaggaaacagactgcttatagtccctttgcaaccagatgtatttatagtataaaacagcaagcaaaccctgaattgacacccccaagaaaccaggggatactcatgtatgtaacactccacctgggagtatatttttatttctgccaatcagaatggtctgtgcaacttcttctaggacaccgacatttggtaacaaatttgtaacaaactgaaaacatagcgggccaggcccagtggctcacgcttgtaatcccaacactttgggaggccgaggcaggtggatcatgagatcaagggattgaaaccatccaggccaacatggtgaaaccccatctctactaaaaatacaagaagttagctgggtgtggtggcgcgtgcctgtagtcccagctactcgggaagctgaggcaggagaatcacttgaacccgggaggtggaggttacagtgagcagagattgtgccactacactccagcctggtgacagggtgagattctgtctcaaaaataaaataaaataaaataaaataaaataaaataaaataaaataaacaaaagaaaatcacaaaacaacagcaacaacaaaaaaacatagcattcctaagtacagtacaggaggtgaatctacaggttttgcccacaatgtgcaattggcattttagaagagagatcaccaatgcactagaattgcagtaacgggagtgtaagcttcaccaagctgaactttgagcatttgtagaacctatgaactctccacagttagttatcagttccattgtgaggaagtagccagtctgatatatgctggcttggcctgctataagatactgaaatacttggttaatgacccaacaacaggatgataaatccagaccagagcataggtagtcattcttgtctattagcttcatggattcctagtgatgaaagactggtaattggttccaaccttggctatattatttagtttgggagcatgtatttgtatatacatacacctcctagtaaaatgcatttgattcattgcacattaggagttcactttggcccaactaatcatttttgtcatctgtaccaagttataagttaaacttacataggcctgtacagtcctattaaccttttcaagtacacagtgacttaggtatcagtcctgcatggactaactgaagtttgtaggtactattcagagcaaagcaggtaagcagctctgttcacaggacagtgcccagacagggcctgtggctgtgggatgtaaccagtctttacattaagctatgtatagcagtatgtcaaaagaactgatctgggcaccagaactagaaagttaacacattcattcattcatcccacaaatatttattaatcacctactgtgtgccagatattatcctgagactgggaatatgatggcaagcacatatagacacaacccttaacctaatggagttctcattctacaaacaaaatcaggagaggatctgcacagccatgagttgaagcctagattaaaacaatctgtatgctacagggcaaggacagatgtgataggcaaagcctacaacgacagaatagctgtaggaaaatagccatgtggttaaaaaaaaaaaagcagcaacaaatgaatataatcttcattttaaaaatatgaaaacagagatttttcctaacatcaccaccaccactaccacgtcattctgagaaagtcatttatattttttggtcttcggttcttccttctataaagtggaatcacttacccatttgagaaaaaaaaaaatgaagaggaacttgactagataagtaaatcctaaatcacactagcacaatggataagagccacaggctttagagttgaacagatgggggcttgaatctcagctcttgtcaccttgtagctatatgcccctggcatgatttaacctgaatgagcctcatatttctttctctgtaaaaagaggatagatactaatcatgcctatctcgggctgtcatggggacaacacctgagaaaagatggaaaatgcttactgcaataaattgccatgctctgttaagaaacaggaagaatgagctatgccttgcacaacctcgattctttttatttggatgcatcactctttagtgtcttaagagtatttagcaggtacttgataaagatgtgctgactggtttattggacttcaccatagggcagtaagaagattcaagggcaatagcaaggaccaaagcctggaaaaggtgagagatcagggattttacttattctcactcctagttcagcttaacccacatccattcattccctgtgaccataacaaataaacatcttcctgggaccacaggccccattgggatgatacataaagtctcaggaagacatttcaagttcaacctgaagaacgagagtcaacgtctcctgagttctctgctctgaatgagcactgaaaccttctctaccttttttttacaaccctctctttttctgatgtctccattctctggccagtctctgaggaggctaccagcagagttacaatctcatatttgaaagatgctttgaaaagaataagtattattaactattagttgcactgtatgaacaaattcataaatacttcccttattgttgcagaaacattacacaccgctgctgtaactagacctctttctagcttaactttgatattccggatcataagggaagtatgttggcattgtttcagtacttgctgtttaagtgcaagtatggagccattcactcactccagggagaagcaaagaaaagaatgcctttaagggtctcaaaattgaaaacaaataaccaagaaggttacacatgtctttctgtaggctgtgaactgggtaatagtgtttctcactcaaggaagaatttggattgcccctgctgaaggacaaagggataaacagactaggcccagatcacctaaagcagttgttctcatgactgatttccctctccaccacccctccacccacccatctgcccatcaggagcatttggcaatgtctggagaggcttttggttgtcacgattgaggggaggtgccattgtcaattagtgggtagaggctggggaaatactaaacaccctacagtacacagaacagtctccaagaataaagaattatacagctcccaaagccaatagtgttcaagttaagaaaatctgacctgaagaatctttccatcctaacaaccagcaaatatttctgaaggtctttcttgtgggcactgtggtttactaaataatccatagtctctgccctaaggaagcttagagtctaacagggagatcagccaatcacactgaagcaatcaggaaataatgcagtatatcacttatcacttagttttttttttctttttctttttctacagtgtggtctagcctctgggtattataggagcatttttaaattttattttatttttaattgacataattgtatttatttatgggatacaatgtgatattttgatatatgcttacattatagaagggggagaacagcaggcatatgaagttcaggaaaacttccaagaagagttggatcttgagctgatgtttgaaggaggctactactctttcccttctcctcactgctggcagaaagatgaatctaagcttgctgcccatacttctttacttcccactctctatcagtatcttgtattctgatttcaggactccatagaaaattatttttcttaatcaccagaacctatcatctatcctcaaatattaatctacatcaaccctcatcttttaaaaatttcgctctttattgacttctatgacatcatcattgtgttctggtccacttttgacctctcgtggctcagcctcaggtttctttttacagccaacctacataggtaggtgtgccaccacctccagcctgctgcctttttctctctcaccgtttcctcttaattattttattcattcatttatgtcccttctcattccacaaaggatttgcagtagttacaatctcatgctatgcatttttccttaattattataccaactcctatggttttacccatcatctctatataggcaactccccaagctgtgcctctgactctgactctgatgtccttcctacacaccacactacctgcctgatcacctgctgaacaccatccatacatacctcaaatccaacatatcctaaacttgaggtttacccaggacctagttttagcactgaaagttccgtgtcctcggaattccctcaaccccaagcaaaccagaacactaagtcaccacaactaaaatgaactcaacagtgtctgttccaaacccattcttcctcatgagctcctaattcctctccatcattttgtagcagagatatcctccttctgcataaacttcaactcctctttgccttccacctactcatgcaactgattgctagatattgtcaattttatctccaaaatatcttctttaacgtcacttcctttcaacttccactgctctaattcaggtctttattacctctaacctatacaattacagtagactcaatcagtccacctgcctccagccatgctatcaccctactcccatcccttttgccaattcatcttccaaactgcaaagattgatcattctgaaacacaaatgtgatcatccatagatagtatttttctaatcaatattgaagttttacagaatgaactccgagaacagcattaaactcaggctcccaggcatttgagcatgatgactacacaatatgacacctaagaaatgttgttatgaatgactaaaatacacggagtattaatatgagctctaagtgaaagggaaaatcaaaacaaaacaaaaaccaccaccatacccttgagaagccaggaactgagtttgtcggttccagttttgcatcttttcatttcttcagagaagtatatgataaccacagttaaggaaagtaaatattgccagggaattctgggtggtagagactcattaaagccttgatattcatatgaaacagaatcatctggaagtcatattaaacagaaactaaacttgagagagaattcactggttccctcagggcattaggtcttaactgatctgtggccctactccctaattacctctgctgcaagagccataggctttccatctcagactggcaaggaaaaagagaatttacataaacgatgtttatatcagtgacaggaaatatgtatcccacttgaataaggggtacggcgtgcccaatatagattatgaaaaatgaaaaactgccaggagaagaaggcaagtgctttccctagaggagagagagctcatcctttcctctctcaggaaaacttacctatcctctgtcttctctcatagacttgcaagtggtaaattgtttatgaagcaactcaccttaggagtcaggggttgaccttcacagagatattagaaaaagatggctaccagaaacatcagagctgtaatccaaaggcttacctctctaatggtaggaattttcatcacatggtaggtaacctcctcttccgtctacataattaagagatagctcccacctcttcagaaacctcttccaactatggtcctgcagtttttgtttgccacatttgtcttttctagtttttttttttttctccctagcttaataggacattgaaacattgttgtgtttcatttatctcccaaagaccttgcctctgaaattcattatcctttcattttaggtacttcccagtcagaaacacacatgcacacacacacacaccacaaacaaaaacacatcccttctttgtttaatagcactaacaccctccctctccctcaacctgggagatgtgaacagccatggttgctaccctaaaggagttgaggatctaatcagaggcatcaaccaagcccaactaagaacaaagaagtatatctgacagtcattatttttttctacagttgctgcaggaactaggagaatggggaggtcagcataaactgcaatctttaagaaaacatcacattaatcaaagaatggaatcagagtccattgaagtgcaacacaagggaaggattttgaagacaccaaaaaaaaaaaaaaaaaaaaagaaagaaaaaagaaaaacatcacagaactggggactttcttcctgggccctacacatacacacttcattgtggtcatatatggttctggcttaaagcttttaatggcttatactagagtgaatcccctgctgtcagtccccctccaggccaaaaccaccctgttcactgccctgtcctgctaatcctcatacttctacctctggccctaaacttcagtcttttcttcaacaactcaaggcactagaaatgtcatcaagaataagaaacagacaaatacaggtatttggtatttaagtgaacattcactatgtgccaggcacacagccacattctatctgttctcattactactccaagtaatttaactaccatttttaagagtttactatgtgccaggcaaccagaactgtgctaagaacctttcatgaatagtagctcatttaatcctcatagctaccctatcagcagtattattattctcattttacagaggaggatacagaggcacagagaagtaaaagaacttgtccaaaggcatactattaataaatggcaaagccagagtcggacctcatgtctgtcttactccaatgcctacataccagagactatgtagtattatggttacagcagggcccagaactctttctatagagggcccatagcaaatattttagacactgttgaccttatggtctctgttgtaattactcaactctgcataaaagcaaccacaggtaatacataaacaaatgaatgtggctgtattcctataaaacttcatttacaaaagcaggcaatgggctagatttagcccagaggctatagtttgatcacctcaagttagagcactagtggtgtactcagatagacctgggttcaaaacctggctctcaccacttactagacaaaacatttagtctctctgtgtctcagtttcttcagcggtagaacagcaacaataccaccctcatagagtcatcatgaggattaaggattaaaggcatgtctggcacatagtcaacttctcagacagtcattttattaaaagcccaccacatgctggtccctagaaggaaggagaaaggacatggattagaataattacaactctctttaaaatcaagctaccagggcccctacggtcttgatactccacagaaataattactctctcgggattccagctaatttgattctcccttcagctacatgaactgtgttctcttgtgagtttagtttcctgttgcagtcattagcaagaaagtctcttgacttcattatagcttttgtcaggcactgggaaccctatcatggtagaacaggaatctgattttgttattatctgttaggtgttcccttcaggaatgagattctcaccactgaagtcatgcctgtgtcccaagtacttggcatggggcctggcacagagtaggtgctcagtgaatgttgctggcttaattgagctggctacatttggggtggtcttacctggaaacagatggaaaatgacttcttaaaagccatccgagcattgaggatccttcctttctctaccagagaaagacagaatgtgtggtgagggcaagaaaggtgtaggagtgtggtggatggttgcaggggcagggaagaacaggacacactgttcctggttacattaagcacacaggagccaagatgcattcatgtctttaggccatgttcctgaataatcacctggtaaaagccattttgagcaagttttttttttgcttttttatttcaaattttttttatttatttatttggagacgaaattttgctcttgttgcccaggctgcagcgcaatggtgcgatctcggctcactgcaacctccgcctcctgggttcaagcaattctcctgtctcagcctccctagtagctgggattacaggcactcaccaccacacccagctaatgttttgtatttttagtagagacggggtttcactatgttggccaggctgctctcaaactcctgacctcaggtaatccacccgcgttagcctcccaaagtgctgggattacagacatgagccatcacacccagcttcaaattttattaaagggcacacgtgtaggtttgttacatgggtaaattgctcagtgctgaggctaggggtctcaatgatcccatcacccaggcagtaaacataatacccaacaggtggtccttcagcctaagcccccatttctcccctatctagtgattcccagtgtctattgttcccatctttacattaatgtgtattcgatgtttagctcccactcataagtgagaacatgtggtatttggttttctgttcctgcgttagtttgcttaggaattacctccagctccatccatgttgctgcagaggacatttcattcatctttatggcaaagtattttatggtgtctatgtatcacattttctttatccaatccactgctgatgggcacttgggttgattccatgtctttgctattgtgaacagcactgcaattaatatgcaggtataggtatctttttgatagaatgaattattttcctttgggtatacacccagtagtgggattgcttggtcaaatggtagctctattttatgttctttaagaaatctccaaactgctttccacagtggctgaactaatttgtattcccaccaatagtgtgtgtcttcacttctctccacagcctcaccaacatctgttgctttttgactttttaataatcgccattctgactggtatgagatggtatttcattgtggctttgatttgcatttctctgatgattagtgatgttgagcatttttttttcatatgtttattggccacttgtatgttttcttttgagaagtgtctgttcatgtcctctgaaggtaagctttttgctttgaatcaaaaccatgcttaggcaatcttccatctcagctttgaaaaataccctaagatacctcaacttgtcagtcagccctgaaaaagccatacctcctgcaatcctgacttgccaatctttctcaatgaaaaattctctcttttatctaccaagttgtctccaaccctctaaaatgtgtcttgtataacaattcagtttgttcactctggaatttgttagacttatttgtaggatctgactatacaatgaggaccatactgactgcaattggatgtatttctccaacacgttattcctcccctacctcaccatccctaccgcctactaccaccactatcagtctcctttccagaattctaagccagtaattggcatgacagaacataccctcaaaacattcagaggaacaaataatggaaacagtgctgatgcatgcaaactctgtctaggcatgaactaggtattctagttcattctgtgttgctaataaaaaatagctgagactgggttatttataaagaatagaggtttatttagctcacagttctgcaggctgagaagttcaagggcatggccctggtttctggagagggcatttgtgctgtgtcacaacatggcagagaaggtcaaagtcaaagcagacaggtgtgaggaaaggaaagcctgaggggcatcctggccttatcacaactcactttcaaggaaacaaatccatccctgcgagaactaatacagtcttacaggaatgagaactcactcctgcaagaacagccattcataagggattacaccctcatgacccaaacacctttcactaggccctacctcccaataccaccacactggggatcaaattcaaaattagttttagtggggacaaacaaaccatgcccaaaccatagcacatagagtgtgtcaaatcacatatacagtcacttcaagactacatatccagaagtgacaattctacatctcgtaagtcataatgatgaaaagaactaacatttattgagtgctttcttgtttagttcctatagtaatccatcatgaaaaataataacactggcttcctagttgccaggcatttaattaactctcttaatcctcataatgacctcatgccatgagttactattgtaatcctcattttgccgatgaggaaactgagggctggagaggttaagtaacttgcccaaggtaatccagccagggagtggtggggctggaatgtgaaccccaggtcagtctgtctgactgcagagaccaatctcctaaccctaccacactaccttattagaaacatctttgagcatgcagcccacattatcctgttatgataaaaaaaaaaatgcatgaaaatgcctgcttccatctatttggtgttgagaatgtttcaaagcactttcccatccctgatgcatttgatcttcacaacagtcctgtgaggaagacaggcataggcaacaccaccattacatagataaagaccaaacacaaaagcttgccccaagtcccactccacaaatgagagaccaagccagagtcagagttcaatgtacagtatacattttcaaaatgtgttctttggtatagctagggattaagtctcctccacctccttcattctgatttcatcctgaagatttgaaaggaagtgggcagcccacagcaggtcattaaaccctccagccaagctttcctataaatgtaaaaactacttgagtatacctcactttgtcttccacataccccaacccttcaggatctgcagtacctgaccacatcctgtgtcttgaaagaaaaaaaatgagggaccttgacccttaaaaactggacacactgaaggtatgaacatatctcattgtggatttctcactttaaaaacatttattggacaattacaggtccaaaattccaaaacccacctggcaggtgagcaatactcacctggcaggggagatatcatgatcaccaagcccaccaagttctgaaaaccaaagtttttaaaaataaattccctatcaaacctctcatatggcagcaaaacctgacatgcactgatgggaggcaatttatggtgtttatttatcccattgcatctaagcatgcccaggtttcactgctgaaaatttattgtgtttgattatagtagggttgccagataaaacataggacatagttaaatttaaatttcagataaataatgaataatgtttttgtataagcatgtcccaaaattataaggggcatttagttatactaaaacatttttgctgtttagctgaaattcaaatttaattgggcatcctgtatttttatttgctaaattttggaactctaattatgggtgctgcctgaaacctcactgggagtgttatctaatatatggcatagacagcatattactgttctaaaatctgacaaatttagaattccaaaacaaatctgtccccaagagttttgtaaaagggattgtggaccactggacctatagcatcctcccagcactgggcttggtacttcatggggactcagctcccaaagagcaacaacctctcaaagaattatcccatcacaatgccttgcctcttgagctttcattagatttcccctctgctgtctttcataggtcattagcatgctttctgctttgatatatttattcttcaaggtatttcccctctagtgtcctgatttaaactagtaggactgcaacccacagctgacctaaccacactttctatgatttcttacttggctttagtgagtttccagcctctcctgttcaattgctctgacatgctatgtcactttcttccttcctggtaagaagctttccaacacagactcccctttacttccagaactctcctctgtagtaggcagtgagctcctaccaccctctgctgccatctcatggctaggataagccattgcattagtcttaattctgttgcactagttctttttagagtccatcaccgccaacacagaattataacatctgccaggaaaccccattgggctaattctgactgctgtatgcacttgcaaatggaaaattatactttaaaaaaatatgcgttctaaaacagttttcaacctcctccttcaacctagcctcaccttcctccatttagttctaagtagtgaggcttagccctagtttgaaatgaaagatagggcttccagttgactgattttgtgagtctgcacctgtgttgccattgatattggcagcccagcttgggaactaagtctgctagctaattgcaacaacagagccagcttagaacaaaatgtctcagtaatccttgggtaagaacatatcttctttttaaaaaataaaactagccatggattagtgatctgagtgattaaatattaaactgtgctagacagagagtacatgtaaaaggtaggggctatttccaatcattatctggacctaaacttttgtcaaaacctatttcttgatctcaaatgtctgctgcagtggtttacaaaaaaaaaaaaaaaatgctgcactgcttaatgaaagtatgactcagcaagctcactacaatggtgagggaagaaaggtgcttgaacatttcttcctcttcgggaacttttgcattgccactgatttccccttttgggcgtttttctcctcttcagagcccagcttgattggcaactaaaaacaaaactcattctcttgagggtcattcctgtagaggcgggtttttaaacacatccttaacacacaaccggactatcttctgaagaactgaaatctaacacagtacacattgggcccatttctatgtgcagccattcactgaagggagtaggatgcagttcttaaaagatcagtagactttttcaaacctcccagaaaggcccttacctcagatcttactatagccagtaactgctgtttcttcctgatcctcaccttctcctctggtataggggacgactcattctcacccttcaaattttcttttcctctaaatggactaaaggaagaagtgtttacagctgtaagtctcccagctcaaagtcagctgatttcttttaggaaacatgggaacataactcattgccaattactttagagaaccacagacctatactgctttataaacctctgaatattaaacatgtgtcaaggtgacttttctttcagtctcacctattgcacttttttgtacacacctaaaaacttaaaataatctgaaaataaccagttaggtgacttaactgtgaaactgacttgtttttatcctaatgcttttcttgctgatagctttcccagcagggaacagggtggactgagcagggtaacaaagatatttctcctctgaccattgtccattcctaatggagccactggaagcttactgctgtggcttttctctacctcacagcctggcttatttctcaaaagcccatccccacgaccagatcctctgcttctatgaggggactttcccttttttttcattgcctcctcaaggagtggtgactcaattaattatcagggaggtctatctgtacctcattattcttaaatgagcacttaagtacaatgtttgacatccagtagtcactcaaatgttagatgttgttattattactatttaacctctctgagcctcagttttctcatctgtaaaatggatgtaataatagtacaaacttcctaggtttgttaatacatataaactgcttttaaaagtatccaaaacttagaaggttctgtgtacattttatctatgactattaaaacttctattagagaaataatttaaggacatatagactgcaaggtgaaaagagaaacgtgtgtgtgggtttggggatgctacggcggggaagagttgtgtgtggattatgtgtttgaaatatgttttagcggccgaagagaaatgcccactaggcgttaaacattcaggtgtaaattttagcagggacggaatgaagaattttttcactttaacaaaaacagtaaatgcctgcaaagacctttgggggtaagaaatgacatatatagaagtgttcctccacttcctaagcttaccgtctactaagaaggctgagtcactgattctacatagaagtacatgtaacacaaggtaggctctgagaggtaccacagggaaaaagcaaagtggtatgagctcaaggagagaggtcacacctctggctgaagcaatcagggagggcttccagaaggaagtgattttctgatttcattattcaccgcagccttttcttaggactctagtgcctgctgattttttccatctctgaatgctctaagatcccaaagtgtggtgcctcatgacaaagcagtgagcttttcctaaagctaaatagatccagattgaatgactgtcctttattctgtcctttcttttataaaatggtggtaacaggagatcaaaggggtgtgggcttttctcatgtccttacttggcaaaacaatctcctgatttggagaggagtggccttaatcagtctgtgagagccaaccatctgggaacctgacatgtttaccatctgtaccatttatgtgggcgtctgaacacaaacattattgtcctgttacttgtttcgcatgagttaggctagtatcccttcaaaagagctcctgcaggccagaatcatggctggtctctcttgcgatgaccctctcccacaggccacacggagctgggcacagagcaggtactccaaaatacttgttgaaaggcctaaactgaatcacattaatcttgcacttcccttgcagtaagcaagtcaaattctattctgccttgagttaagcatgtgaatcaggcattaaatcctattgatcctttagacagctgtagaaacaaaagtcacatacagtagactggtgaggggctgggaagataattctcttcactgaatgaaaaaattcagaactctgctgcagtgaaatcaaagctattttgctagttttctggcagaggggtggtctctttccagtagaacctgacatttttcctatcaagaaatattcctaggaggggccaagagccattgggcccctccattgacaacacagctttatgtcaaagaaagccagggcttttccaaaagttgtgtgcagtaaggaaaaaatacaataatgttcagcccttgtctgggagtattgcagaactgaagcactgaagagggaaaacaatcaacaactgcagtgaggatcctagctcatttgtgaagaaaagatttagacagattaaacagggggattccatacagatctggcctggggcgggccccatcacttctgggctttgctagccttcaggccccttaactggctaatatgatatacccactttaagctgttaaggtagttgatagttttgtatattaccacttcctacaaacatgaatatagtttcaatgctttaatccaaagaaataaattatgtgggcatttcaatcactggccgcaaggccaatggggaagatactgggaaatttagctttctgcatgcctctgatcataccatccatggattgtcagagagtgcagtgtttgaaagcttggtctatggaatcaaccaagctagttccccagtcctggctccaccatttaccaagaaatgtgaccttgggctctgtcctatcagctgtaaaatgatataattctatatctgccattagcgttgctgtgagatgatgcatataaaaaatccagcacagttgctggcacattataagagctcaatctttgatatgtaatcttccaatgttaagagtagttcctagttgcaactcccaggagacttgtgttagctactggactcctttcacacactaaggaaggaagaatttggaaagagagtattccaccaagatttatccagcacagagctatttattcaatcactcattcatcaaatatctattcagcattcatcttgtaccaggcattttgcaaaatgttgggaatataataaagaataagacaagctcccagtccttgaccaacactcagtcttatagcttttaagaagctggccgggcacggtggctcactcctgtaatcccagcactttgggaggccaaggtgggcagatcacgagggcaagagatcaagaccatcctggccaacatggtgaaaccctgtctctactaaaaatacaaaaaattagccaggcgtggtggtgtgcgcctgtagtcccagctactcaggaggctgaggcaggagaattgcttgaacctgggaggctgaggttgcagtgaacagatatcacaccactgcactctagcctggcgacagaatgagactccgtcaaaaaaaaaaaaaaagaagctgctagaggccgggcacagtgactcatgccagtaatctcagcactttgggagatctaggtgaatggattgcttgagcccaggagttcaagaccaggctggggggggtaacatggcaaaactccctctctactaaaaacacaaaaattacctgggtgtggtggcacgcacctgtaatcccagctactcgggaagctgaggcatgagaattgcttgagccagggaggcggagattgcagtgagctagggaggtggagattgcagtgagctgagatcatgccagtacactccagacagagcggtactctgtctcaaaaagagaaaaaaaagaagaagctgctatattccttaaactttttaagcccctgaggaagggaattcgttgggcaaggactatcatttgcactaacccacacacaaatagaacaacataacttcccatgaaaagttaaaaagttacaagggaaagcacttccagaatggcagagttctgaaaatctacccttccacaaaagctacaagacgttgaaaatttttttaaattaactttcacaattccggaaattaagcaaaagtttacaacgatcagaggagcatttactcaagtaaaacagccaagttttcgaagaaaagcaagttttgtggtattttaatttgcccaattcccatcttcctttccccagctcaacagcagctttgaaaaccaacagccttggaaccatggtagctgtaaaaagcagcagcctggcacccactgaaggggagcaaactgggtttggagcaccccaaatagacccatccccagagaactgtcattatctgtcagtcaacttcgttaagaagcccaattcccaggactggtcttcatgtgatctgactcagtaccaatagttcttttcctgggggcatttgtttaaaaaaatcagcaacagttgtttaatatgaaggctgcctgaggcagtagataacaattgggtcaaataataggctaaagaaaaagcaatctaaatccagcaacatagaaaacgaattagacactatgggccaggtgtggtggctcacgcctgtaatcccagcactttgggaggtggaggcctgcggatcaggaggtcaggagatcgagaccatcctggctaacatggtgaaaccccatctctactaaaaatacaaaaaaaaatagccgggtgtggtggcaggcacctgtactcccagctactcgggaggctgaggcaggagaatggcgtgaacctgggaggcggagcttgcagtgagctgagatcgcgccactgcactccagcctgggcaacagagcaagactccatctcaaaaaaaataataaaaaagaattaaacactatgactgagtagaatttatcccaggaatatgagggtgattcaacataacaaaaatcagttaatgtaatacattacattaatgaaaggaaagacaaaaccatgcatgatcatttcatttgacacagaagaagcatttttcaaaattcaacaaacttacatgataaaaacacatggaaaactgtgaattgaagagaatttcttcagcctgataaaggccatctattaaaaacccatagctgacatcacacttaataggaaacttgaaagcttttcttctaacatcaggaaaaagacagggatgtccactgacagcacttctattcatcatcatactgaagattctagccaggtcaattaggtaagaaaaagaaataataggcttccagtttggaaaggaagaattaaaattgtctctattcactgatgacatggaccttgtacagagaaaatcctaaggtatcaacaacaaaaattattagggctgataaatgagttgggcaaggttgcaagataacatacaaaatcaatcatgttttgttcaacaaaaattatggaaggccattgttttggactgagctcccatactaggccccaacagaccagaccaaaccaaaatggaatcacctgctaaatgccatataatcaaactaaaactttaagaaagcaggtacatccccaaacagaccagtttttcctgaaaataggagattctactccacctgagtccatgtaatatggaagatgcctctgttttaacccttgccaaaaaaagtaacctgatgttaaccgattttttttcccctatgttctctttcctttttcccaccttacaaaacccactgttctgctattgcctagtagaatggaatgtctcattctattttgtagaatggaggcttccctgattcatacatcatgaaaaaagccaattagatctataactaaatttgttgagattttgtcttttgacagtttctatacactagcaatgaacaatccaaaaatgaaattaagaaaacaattccatttacagtagcattaaaaacaattaaatacttaggaataaattgaacaaaagaagtgtaagacttgtacactgaaaaaaaccagaaaacactgttcaaagaaactaaagaagatctacgtaagtggaaagatattccatgttcgtggactagagacttcatattgttaaaatggtaacattctccaaatttttcttacctttatggttaattgactttcaacaagggtgtcaaaacaatataatggggaaatagtagtgttttcaaaaaatagtgccgggacaaatggatatccacatgcaaacgaatgcaattgggcctctacctcacaaaatatgcaaacggattaaatacctaaatataaaagctaaagctatcaaactctgagaagaaaacaatggtgtgagtctttgtgaccttggattgggcaatgatttcttagatatgacaacagtaagtctgtcagattagtatctatgtagcttcagtcaaatctaaccatggattccagttattatactatataaccctataaaatacatagaagtattattactttgcctttataacaaaacccaagagtctgtttcaatttataatttcagcatttaagcgaagagattttagttcccaaagttggggaaaataaaaaaacaataagggaagaaagaatcaggccttggtgccatatatttttctcttgaggttgtaaggcagagtatccttctttccagaacactttattatatttcacttacagacctaattttctgtgtcaaagtataattcccatgccgaagctctaacctaaaaatgcaaaaaaagttgtcttcattgtacaaacatatccatcactttaacgagataataagggaacaaaatttaggattcaagctaagtaagaatactgtttcaatgaacatgtccctaaaataaaccagcattagcagttaatttatgcatctagaaaatctcagttcccaccagtaaaaatatcctcagtggctagtgcaccttgaaaaaaaatctggcgtactaaataaataatgttcatgtgggagccaggagctgggtaagccttgcctttagactactctgtgactataaaaataaagccagcacttttggaactaataaggcttcacttgtcagtatcataaagagtattgctcaactaaactttgctcccaccggttcagtagttacttatttctacctaagtactcatcttccgattttacccaggtatttaaaatcgaaagaaaaaagcattatatttcagcgctactttgcccaaattacaaaataagtcattatttttagtgtcaagtcacaaaaaaaaattaacaggttttacattaaagttaaaagttgctaaaagttaccattataacgtgtaattaaaactgctaaacatgaatttgcatgcaaggtgtataaaaacactaaaaattgtttttcttaaaaattataagaaggcataaaaatgtacattttgcttaaaaataaaaaattgtcttaaaattaaataaaataaagtggatggtttaagcaaattataaagacactataaaaactaatcctgcaaataaaactctgtgtaaacacattaactaaactcaaaagaatattatatgtcttttctgtaaattaaacactaaaataaaagcaccacaaagttttcttaaaatgctaatctactcttaagcaaaacttgtcaagggttataacaggtatgtaaaaatcttacttcatggtcaaactggttaaaattaaacagaattatctataaggtttcattaaaattaaggttaacattaatagcaaactaacacaagggtaaaatttaactttctctcttaaacacaattttcatgtaattgaaaaggctaataaatggtttttggttttccagattgttatctcattttggcaaaacaaaacaaaacaaacaaacagaaaaacaacttatgataatctaaagttctatttcataatatcaagggttttaaattttaaacatatttaacagccttctcaaaatcaaactttactttcaaggttgtttttcctaaccactggcttttgggtgctgcacaggacccctgaaccatccaaaaaagaggtaaacaggattatttggcaacataaaattgcgaaaataatgtctaatacattatattttagggaatattattaacatatgttccaaaactgtatggaatgtctaaggttcttatgtctgaatatgtgctattaatcacaattaaagttgttatgttgggttattgtaagccacaaaaataaccaaatttctttgtcaattgtgtttctaactgtatccaaactggacattttgttatttacagacaattgttattttgttttaattctcttcaaaacattgtttatattcaagctttggaactttaacaaatgctctcaaatgtaggttactcataacaacaacaaaacgtacagaactcataaaaagctaaaatgtttataaacataaagcaaaacaaaggttaataaaatagaataaactaataaaaaaaccaatttttaccttttacttagaacactgctaatctttatctcatttttcagagtcaagaaaacttgtcttaagctagctacagctttaacaactaagtaaagtatactcctgtgaatagaatttaaagcgtgtttgtttctctctgcctagttcctctagaatttaaaaactggctataagtaggccaggcgtagtggctcacgcctgtaatcccagcactttgggaggccgaggtgggcggatcacgaggtcaggagattcagaccatcctggctaacacggtgaaaccccgtctctactaaaatacaaaaaaattagccggtcgtggtggcgggcgcctgtagccccagctactcgggaggccgaggcaggagaatggcgtaaacccaggaggcggagcttgcagtgagctgagatctcgcccctgcactccagcctgggcgacagagcgagactccgtctcaaaaaacaaacaaacaaacaaaaaaactagttgtaggtattcttaaattacaacgatatagttgtttgcatcaatgcaataagaatctattttcttttctaacagaacacaattaaaaaaaaaaactggttactttaccaaggcttttactgcaatggtgtgctctcctttaaggaatcaaacttgacttacggaacgaataaaacccttggaaactggcctcatattttgtgtacatagtccctgtacaggatttctgatctgtagtaagtaaagaatgtcactttctgacaggccaggaaccccaagttatcttaaaaccttaataagaaatgaattcacccaactcataggtatttaatggtacaaatacatggctgggcttggctttaacaagtcttatctcaaattccttctatataacagagttccatcaaagccgatttaaaaggcctgtgtggcaaataattattcttggtgcattgtatacaaataattaagccaaatataataaagcagaccactgctaccataatttgtcttttaataaaaataggaaactgaaaagtaaaaattatgtttcaaaaactatagcacacctgttgttaaattctagtcttgcctaatgtttttcaacttgtattatcttctacagtttaaattatatccattaccaaaatcgacccctggatacatcacactcaagtcaaagcctaaagagctgagaaagcaacctctaacatcccttctggggctaacaatgaaaacgtcctaacaatgaaaaaaaaaatttaagctggaaatcataaaagccaacagaatcatggccatttcgcagacaactatccaaaaacatctacaaacggtgttgctcctgcagtcaatccaagaccaaaaaactttctgctccccccatcagcaggaagtagccagaaagaacacgtcgccccttgtccttttataactgtagggtctggaatgacagagcaggaccaccatcatctcagacaaacaccgccactttaagttccagctgcctttccagcttcatgcatttcaaggaaatcacttcttttctaactacaagcagccaaaaaagagcagacagtaaaacacagataagaaggctggggcacagaggaaggcaggggaaagtctcttgggtaactgccaaacttcaccctcatacaatgggctccagtaaaacagtggcccttaataagcacattcctttcccttcaggtacactaagatagggaagccaaaagcagactcgagggatattcctgcagctgcacaaagatgtaggggaacagacacacaactctccctcccagataagcacaacaaagagacacagaagcagtccaagcctctgataactctcccaccctgaatccttaaaaactcttagtctgtaagagattgctacttctgacctaactcaatcagacgtccctcccaggttggaagtaaacctgttgactgtcgagccgaccttcttgtttctcctctttccttaattcttacaacaacaacaaaaactacaaattggacttcattaaaataaaaacctactgctccaggctctggacagttcgggtttttgtgcaatgaggcatctagtgggtacgcactctgcagtttttcctgtaattcttctttctgaggcgttcttagaatcgactagagattgattaaataatctgtcaaatgtgaacttcactatgcaagcagaatcaggattgtgctttcaaagctcacaaatgtgtttagattagatactacatggtggcttaataaaaatttcctttatcatattctaattgcagtttgttctgccagaatccacaccaccctacactacttctgtcagatataaaaatagaagataaaaacctgtccaactttaaaattgcccagcttgagccaaattgaaaatcagagcagaggcattgaagataaaggttggatgttatatccaccattaaaagaagcttcacttctgcatttgtgccttagcagaaagtgatttctggggttggagtttctgggaatacataaggggaagtcacatgaggtcatcaagaccattgctgaagagctccaaatgtctgtttggttcaggctgatgcagtagcataggacagagtttggcaaactacaatttgctgcctgtttgtgtgaataaagttttattggcacacagctaagcccattcatgtacatattgtctatggctgagtttgcactgcaacagctgagttgggtagctacaacagtgacagtgtggcctgcaaagccacactatgtggccctttacagaaaaatctgctaatccctgccacataacatcagtatttgatgtcaatccggatatctccatttagatgtctcacagacaaatctaatttgacagtcttaaaaaggcatgcacttccataaacctatttcatcttcagtgttccctctgtcagttaatggcactatcatcaccaattcacctgaatgagaagcctccctcccctttacctcccacaccccatccattactccattccccatccatcagcacatcctgccaattctacctcctcactgcatttcaaatctgaccgcatctctccatttccactgccatttccttagtctaagtcaccatcattttgttcaagattgacaacagttttctaactaatctttctgcctctagttttgactgccctctgcttctaatccatcctccacccagtaaccagaaggatcttttcaacatctaaatctaattttcttacatgcataataatatatgtagctaagatttaatgagcccttactatgtgccaggcatagttctaagcacttcgtatgtagtaactgatcttaatcctcacaccaaccctacaaggtggatattattatctccattctttagaggaagacattaaaaaacagagtagaacttgttcagttgcacagttagtaaacaacagagccagttgcaactgctttattatactactttacatacgcacacacacacacacttcttatggcttctcattgctcttaaaatggttcatcctatggtttttttttttttttttggagatggagtctcgctctgctgcccagcctggagtgcagtagtgatgcaatctcggctcactgcaacctccaccttctgccctcaagtgattctcctgccccaccctcctgagtagctgagattacaggcgcacaccaccatgcccagctaatttttgtattcttagtagaaacgggatttcatcatgttggccaggctgacctcaaactcctgacctcaagtgatctgcccgcctcggcctctattattattattattattattattattattattatttgagacagggctcactctgttacccaggctggagtgcagtggcactatctctgctcactgcagcctctgcctcctgggttcaagcgattctcttgcttcagccacccaagtagctgggattaaggtacacgccaacacgccccacaatttttgtatttttagtagagacgggtttcaccatgttggcaagattggtcttgaattcctggcgtcaagcaatctccccgccttggcctctcaaagctccaggactacaggcatgagccaccgtgcccagctgagtccatactatttttaatggccaaagaccatcgtcttgatcttctctaacccctgtttacctctccagcctggtctcttgccattcacagacttgcaatttaagctgcagccaccctgactgctgtagccctccacatacaaggcaggctctttttcacctctatgccttagccatgcgatcctctctgctctggcggtttactctcttttcttttcctctcccacacctagccaactgttgcacatcttttaatgctccagtcaggtatcacctactccaggaagccttcgctaagcaatccagatttgtccctcccttgtgttcccattatgccatgttcatatcgttttcggtgtccttactatacaattgtataactctccttttgtgcttctgtttccctcagtagactgagctcccagcagttcttctactgcaaaggtcttgctttactctgacttttctgtattttcttggacttcatcatcccagcctttggcataggctactgtggcaaaaaaaagagtagaaagggactataggatattgtctttttgtgtatgaatgcgtggaagggaagtgtgaggacataatggagatcatgaacatgtttggaggaaatgacatcacaggatgaaaacattttagagcttatttttggtagtttcataccagtaatcttctttaggacaggctagactccaaaatatataatggctcaaacacaacagaaatttctccgtgacgtaacagtccaaaacaggtattcttattcagcaggctagttctgctaacatggttattgagggacaggggctgacagaagcccctagatcacaccaggttatcacatcccagtcagtcagaaaaggaaaagaacatggaggagcacacataggaaacttctataggccagacctggtagtgccacacagcatttcccacagtgagaagttagtcatgtggccacacctcactgtaagggagcctgggtaatgtagtccagctgtgtgctcaaggagaagaagaatggttgtgctgggaaactagtgaccttcacagataaactaacagtaaagttaggcaagtttacctttggtgttgggtaaatgatgaaagaggtttatttcctttgtactagtaagctaaatggtgcagctctgtttaacctgtcccatgggaagctggggtagtcaaatgtaggcagtatttaaaatcatagttgacagttgagctccctgttgagtcacttaccaggaagtagcagctggataatgatttgcaatgctgatgattccttaattattaatcactgacactttgtagattgcctttgagtaaaatcccagctgggttagtatacaatatcgtaatgccagccccaaaatattttttccttttgcatgtctagactagagacggagttaaatagatggcacagtagcaacctgattcattacaagctaaccaagaggtgctcaaaacaaaatcaagaaaaataaaaacaaaatataacagagaactcattttcatttcaaaccctagctacaggcatgggcttattccctgccagtttgtgtttgcccaaacagagtgcacattgatgatgacctcacgtagactaagggaatgagcggatgtgaatcaatttgaaatgaaatatctccatgattctctgctaaaaggcatgtaagttcccaggagagtttgtaaaacagctacccaggctctactctctcctccatccacaccccagagtctcatttagtcagtctgtggaaggacctggggatttagattttttaatgttccctggatgattctgatgtaaaaccaggtttgaggaagcacaactctgacaaggtgggagggacaataggaaggtatgccaaagcatgaaccagacagagtgattttgttttaatatattaaaaaataatgaacactaaggaaaatctagtttcatagtttgacatgaagagccgtctccggggttagatgcattcacaggcacctagaaaacaggcctcttctggggattggccatgtaactccttgccagagctgactgtaaactaggaaaggtattatgacagtagactttctcctggacattccagatgcctaacttgttttcttcttttcccagtttgttgctcagcccaactgccaacagttgcttgccaccctgtggtatgatggcttccctggatggcggcggaaacactgggtagtcaagcttctaacctgcatgaccattgggttcctgtttcccatgctgtctatagcctacctgatctcacccaggagcaaccttgggctgttcatcaagaaaccctttatcaagtttatctgccacacagcatcctatttgaccttcctctttatgcttctcctggcttctcagcacattgtcaggacagaccttcatgtacaggggcctcccccaactgtcgtggaatggatgatattgccttgggttctaggtaagtcaaagggaccaggacctatggccagactgcctgatggtcctgtttaaataaactactagaacaggcagtcagactagctctgaactagggcacccccaccccacccccatgcagtgtggtagtcctttgttgagagtctcagaaatgtagttccttctgtcccgggcactggtccatggtgagattggcagtacacctagggcttgcttttgctaacttaatatcttcaaggacagagaagctgtctgtcagttagtctagagacaaagccaagtatcagtcaggacaggcctcaagtaaggtaagcagagcaagtgctgatcagtctattcaaagcaccttttcccataaccaaggggcacatgaatctgctcatttctcatggctactccacacgacccagttcttgttcagggtctacatcctatttggacactgacttcacaaccaagggggaaacctgggaaattcacacatcatggtaaaagcagccctaccagtagtctccaggcataattagattgcactggactcttcaacacatggccatcttctaagtccttgctactcaaactgtggtccccaaaccagcaatatcagtaccacctgggagattatttgacacaaagaacctcaggtgccacccgggatctgaattttaacatgatcctcaggtaattcacatgtactttaaagtctgagaaagtgcagccctagaccacagccacagcttttactattttctttattccaaggcagaagaaacatctatgtcatcaggtaaaattttacaaaacttctacatgatgagagaaaaaaggaaaaaaaaatgagttataaattattttgggccccattgcctagctttagccccaacatctggtaatttgatccatgatcagcttgctcacctcaaaacacattgagaagttctctttcctgaacccagtggaaactaaggactatgggataatactgatctaattaatttattgatgaaattattcccattccaaaatggaaaggaagtagaatcaggcacccaaaattgcaacagcattccagtaactatagtaaaaatgctaagagtagtacccagaaaagtataacatatgggcattttcaggaaaagcctaccaggtttggcaagttcaaaactgggaggtggagtaggaaagcaagtgattattgtctctcaaggcttcactccactgagaccccaattcattccttaatttcatccttattcacctggaggggggaatccttctatgatgagcagggctgaccctatgtagaaataaactgttttcctccattcttcaggtttcatttggggtgagattaaggaaatgtgggatggtggatttactgaatacatccatgactggtggaacctgatggattttgcaatgaactccctctacctggcaactatttccctgaagattgtggcctatgtcaaggtaaattggaatgtctgccatatttcctacacagcgattttggctacattaagcttttgcactgagagcataaagagttttgagaaaaagtgatgatgatgatggctcaatccatgtgggaaattaccatataaacagacattctttcagtggtttgtaagcagtgtccacctaagcaaagaaagtggaaaatggaacaatttgcaaatgaatcattagcttctgagactttcagggtaaaagagtcttcagctttcggtgtttaaatgctctctacgatatccgtgccaacacaatggcccagtgatgcttgcatggggccagggcagaaaattcactgaattcactatctccaaaagcttctcttaatccttgtcacttcattaaaaaggactactttatatacgtctaatattattctctctgtgacacaatcattagtaattcttcctccctgtggagtcatacagaacaagactgtttcttcctaacagtgcttctgatatgatgccatctctccctaaccctctgagttgtctcttctcaaagctaaacattcccatttatctcaactgttcttcatataatgacaagtagcagaatcccagaaacttgactacaggtggcacagacttttaatagccccttcctttctcatcacttccaccaccagaataatcactcgagcagttataaatccagcatttttagtatcacccaacctgtgcttctctaccaattcagataatgtacacacacacacacacacacacacacacacacacaccaccttaatacttttcccacacaacattcagctcgaattatcctgaaaatagcttcatgtttgacatcttactttgggtaatcagaggctctgagttcaggtctggtgcttattaaataatgggattgctgtcctccttgtagcctgagttaaacttctccatgagaaaaggctgacaattcagtctccaagattgtatagtcagtcatgctttttggcactaaattccacattaaggacttttagaatggaaatatggctgtcccccaaatctccaacaacttagtttatttttgtatccctaatatgcatattgcataaattttaagaccttgggagttatgtagagcatgcatattgaatgcagtcatgaaacatttttgaaaagagcccaagagtaggccctatacatgtggtgatcatttaacacatacttacaacttccttaagagaaaaagctggtgaggaaaatgtttgaatccctggttaatgtgcctgggtgaaatccatgtcattctggcactctgctgactaagtaacactgtaaagtaaagggaaaagttcttcctttggaaatggtatttatacactggagggaccttacattatcaatctagaaattggtgggttttgtttaaacaggaaagcttagaataaatgatgaagaaaaggattaacatttggggatgtgaaaaacgtatctgtagattctcaacattagctaatcacataacctgtccaactttactggagaggcttccaaagagttagatacttctccatcacaaagtataaggataaatctgctctattaagctgggtaaatgccccttaactggcaaacactttattcaaaggagacctttgccaagaagttggagtccttcccaaaaaagaatttataaagcaagacaggccacatgcaaaatttggatttgtaatgagaatttataaatggggataatcaggtctacccatccacagaagtccaggctggatgaccttccccaagcaggctgagccaacttctatgacacaaagccataagaactgcgacataggctccttgaaatgttttcaatcaccattgtactgaagcagtacagaagcaccaaggaatgagctgtttttaaagatcctttattttattagagtgcaaaattagtcaacaatatctattccacttcacatgatctaaagcaagtaccaaaaggtacacaccaaagtactcaaaaggaacaaatatatataagattgaccctcattgcccccagatgattctacaaatggagtataaccattctttgcttttctaggatagtaccacctagatctattccaccactgcttcgcttccatgtgtgccaagtaaatctggactatgctacccactgagttatggcctttccttcagtcagtgcttagctaaagacataataacacccccctcaaattcttattactattgagtccccacattaggctgttcctcttcatattttgctttagggtttataaaatgcaatttacatcctttgaaaggcaaggaggccaattttctaactgcattccatttcaaaggatgtaagaaaaatcatttgcctccaacaacaactaactcaagagtcaggagatctgaatttaattcccaatctgatactcatgagcagggttaccatgggcaatccctctacctttctgagctgtagattctgcctctgataaataagcagtaggttaaactagatcagtggtgctcaaccttttaaaaaattttttcccatggtaccacatctttaagcaaaaactcacacagtaatccaatatataaaaagcccaaaggactgagtttggcttgaagaatgagtcttctaagtctccactttggctcccacagtagctatgagatgcctccattgaacccccaggctctaaggaacacagtttaaaacgactgtgttagatcaggggtcagcaaactatggtctgtgggccaaacctggccttctgccatgtccttgtggttgtatattgtctagggctccattaggattacaaaggaagcattgggtagttgtgatgggaaccatagagcccacaaagccaaaaatatgtactatctgattcttgacagaaagtttgccaacctctatgctagatgagctccatgtttattccctgcacatacatactatatctttctccaaaggtgcaaagtatctatgttcaaagtatagatttgccatgagaatcatgttttacacttctgagtgttccacaaattcagattcaccatcccatgggcaacagacatccctgaggttacagttctggatgaggagagagaaaatcccaaattatgagctatacatgttccagttgttgatttctagttttaaaacataggtctgttttgttatcagcaaagagactatctttcacatatacctcaaacctttaaaggctgatctatcatctgtgctgtgatatcaactatcatataagtaacatttaatagaaatagtgctagactgagtgtctggagacccgtggataacttcttgctggctctgccaccgacttgctgtgtgatctttagcaagtcactctgcctatctggacttcctccatttgtaaaacaggcataaccattcctacccctcacagtaatgcagtgcatgtttgttgggggaggaaaaatgtagaaatataagatttggccaagagtacgtaaaactgattggccgcctaaaagtctatccgaagcagaagcacaaatgtggcacagtttctccaagctcctctgacagagaagaatattggatacacacaagtgattttaaacgcaccagtttcctcagttgttggaactgaagcacattttagaaatgctaacaatataatttggcccccaatgcaacattttctcaggaaagttgtttacatttagtcctgagaaattgtgatatttaaatgtgagctcaaggcaatatgcttcaaattaaattccaggcaaaatctacttctgtcctgggaaggtaataagtaattccttgtatttccataacatctccacttatggagtacacagacttttgcatatggatacagaatcacaaacatgtgcagtgggtaggaggcattatcctcattttgtggtgaaattaaaagatacaggcagttttaagtgacaatgcccaaattggagctcagatctcacaatgaagtcatctttctacaaggctactcctaatatgccgggggctggaaacctgggatgggtaaccaacccaataaatattggttcttcccctccttcaagcccctggttcttcatgtgtgctaaaggaacattctaacttacagagttgtcaaatgaactgtaaaatacaaccatacaccactgtatggggcagtactaaattcattacctgaaaggttgacatgccatttgcagtaatgtagaatacattacagcctgctaaaaattcagcagaaagctccagtgaatggctccctaaggatcctccatcagccccaaactgcagtcagcaagggagtgagaatgaacactgcataccgagaaggctgcgtctactccttgtctttcagtaacagcacgttgtccatggtgctcagagcccagtgagggattgaggaagtacatttggcttgaaatctttaggaagcagggtgatttttccccactatcttgggcatactagtgcctctgtttcagtgacactccccaacaatctgttaaacccacagttagaaaatgtctgttgataagccacaggtggttgctgcagatgattgatctaaaatttattcttctatgtgtacatcccaggtatagacgtggatgggagtgggaggaagagagttgttagcagcacatgttaattgggtggggcaagaaagacaaatagtgtcatgcatggggcctgttgcataatgaatgcttgatgcatattttggtggctttgtttgggtatggaagcaaggaaaaaagggaaagttttataaatgttcactgtacccctcatcttgtgcacttgttgtttctttcagtataatggttctcgtccaagggaggaatgggaaatgtggcacccgactctgattgcggaagcactcttcgcaatatccaacattttaagttcgttgcgtctcatatccctgttcacagccaactcccacttaggacctctgcagatctctttgggacgcatgctgcttgatatcctcaaattcctctttatctactgcctggtactactagcttttgccaatggactgaaccagctttacttctattatgaaaccagagctatcgatgagcctaacaactgcaaggggatccgatgtgagaaacagaacaatgccttctccacgtaagacgatcccctttcctttatttatttatttttttttttgccattttttccgccttctccatttttgtcctgttttcagcctacagcttcatcactgccacttgactgtgaaggcagtgctcactgtggatccacccgaagggtcagaggtggaggaatgttcttctcttgctacagggtactaggggatgaagtgaagttaggtgaggtaggaaagaaacaagcacacacatgagatcccaggaagtcatctaaagagttggttctgaactatgttggtagcattacatatttttaaaagaattaattggggtgaggtagataattcctcactcgaaatgtggcaccaaggtaatgaaacagcaaagctattcctctgaacgagtggctaccaaagctaactttactattgtgaatcaaggaaggatgcaaacatatcttaatgcacccccattcataggtgtaatctcgagaggggacaggctgaaggtaggactagaatccactctcctgttacattaatttaaggtttcaggtgggccaagtgtcacccagcactaattggaaatgtctcaggacacaagagataactcatgattctgtccacgagtccactgcctctgaacacatggaactcctgtgcctttgcttagtactgtcaagacctactttttgggggaccttcaagccttcagaacggcttttattttctgataaatcaatgccaggggaaatagacaagagaaaacaaataagta

SEQ ID NO: 1257 - DNA, 235730 bp, mus musculus; identical to SEQ ID NO: 1256

SEQ ID NO: 1258 - DNA, 983 bp, mus musculus
agacccagagcctggaggttgcacaggtctccaaggctctggagaagaccctcctctcctcctcccatcctctagtgcctggcaaactgaaggaagctcctgctgctaaggcagagagtcctcttgaggttcctcagagtttctgctcctcttccattgccgtcacaaccacctcatcaagtgaatctgatgaggcttccagcaatcaagaagaggaagatagtccaagctcctcagaggatacatcagaccccaggaatgtgcccgcagatgctctcgaccagaaagtggcttttttggtgaatttcatgctgcacaagtgtcagatgaaaaagccaataacaaaggcagatatgttgaagattatcatcaaagatgatgagagccacttctctgagatcctcctgagagcttctgagcacctagagatgatatttggccttgatgtggtggaggtggaccccaccacccattgctatggcctcttcatcaaactgggcctcacctatgatgggatgctgagtggtgaaaagggtgtgcccaagactggcctcctgataattgtcctgggtgtgatcttcatgaagggcaaccgtgccactgaagaggaagtctgggaagtgctgaatttgacgggagtatattctgggaagaagcacttcatctttggagagcccagaatgctcatcaccaaagattttgtgaaggagaagtacctggagtaccagcaggtggccaacagtgatcctgcacgatatgaattcctgtggggcccaagagccaaagctgaaaccagcaagatgaaagtcctggagtttgtggccaaagttcatgggtcttacccacattctttcccatctcagtatgcggaagctctgaaagaggaagaagagagagctagagccagaatttgagtcagggctgactccatttccacagccactgtgagttccagtgctatgtctggtagcttctcccatacc

SEQ ID NO: 1259 - DNA, 120 bp, mus musculus
ggggtgtgctcagagcagggggcccaaagaatggctcctctgtttacaacacacccaacaggaatctggggtcattgtgatgagggcgtcaaacttgtggcttccctatgaacaaacgtc

SEQ ID NO: 1260 - DNA, 47664 bp, mus musculus; identical to SEQ ID NO: 202

SEQ ID NO: 1261 - DNA, 47664 bp, mus musculus; identical to SEQ ID NO: 202

SEQ ID NO: 1262 - DNA, 47664 bp, mus musculus; identical to SEQ ID NO: 202

SEQ ID NO: 1263 - DNA, 3472 bp, mus musculus
tcctgcggaccagatccccggaggagttgttgctgggcggagtcagagcagttcttgaggttcaaggaggcgggggagacctgagctcacgcttgctgagacagaagtcacagcaggattatgcccctcagggcaagaggaaggtgggagctcggctgtggctttagcctggccagctttcaaggctaggacaaggacagggtcgggaattggaaggacccggggggagcggagagctggacgggaaggaggggccaacgggaggattcagtgttaggtgagctcagactttgctaatggtggggtgggattggtggcgggacgggttgcgaaggcggacgggttgtgaatgggactggggctactcccaggcaacagggatacaggctggggaaggctacggcctgagatactacccctatcccctgcctccctcctgttgtaccaagcagagttcagaaactgccgccgtaacccaagaacaaagttgcatgcagagccaacctaagagcttcaaaatcgggattccttactgagaaaggtattttgtgtgaacccccaggagtcagggtccctaagccagcgctctccacctccacctacctctgcctccatgcctctcccccatcccattcccacagctctataccacaatgccaccttacctctcttccctctctgctctctatcattaataaggcaggggccttagcaatccaagaagcttaaaatgtcagctgaatcttccccttcagtgaccttatactgtaatggcaggtgaaaccagtaggtaagttggtgccattctcagacttaaacatggaaaggatctggtggttgccataattattcctttaactatttattaaattatgtccgaaggctagaaagagtcctaaagacttaggacaagtccaggaaagtgaggaagtggctgggcatggtggctgacaactgtaatcccatcgtgagggaggcaggccaaggcaggaggatcacttgagaccagcagttcaagaccagcctgggcaacatagtgagaccctatctctactaaaaattaaaaaattagctgggtgtggcagctctcacctctggtctacccaggatgccgaagcaggaggatcacttgagcctgggaggttgaggctgtagtgagtggtgtccgcaccacttcactccagcctaggtgacagagcaataccctgtctcaaaaataaataaagggaggaagcttggtagatggaatctagtaggggagccataaatgaagttcagctgggagaaacaatcaggctgaggggataaaatggctaaaagacagcaatctcatgtaatccatggggaaatactgttcccttttaaaagatgagatggtgagcctgggtaacatagcaaaacccaatctctacaaaaaaattttaaaaattaggcaggcatggtggcacacacctgtagtcccagctactcaggaggctggggcaggaagatcctttgagcccaggagtttgaggctgcagtgagccatgattgcaccactacactccatcctgggcaacagagagagaccccatctaaaacaaattaaaaataaaataaattttattctctgcctcagccttccaagtagctaggattacaggtgcccactgccacgcctggctaatttttttgtatttttagtaaagacagggtttcactatgttggccaggctggtcttgaactcctgacctcctgatccacctgcctcggcctcccaaagtgctgggattacaggcgtgagccaccgcgcccggccaaaaataaaataaaattttaaatttaaaaaagatgagatggcacttggggggaaaattaaattggatccttatctcacaccatacacaaaatgcaactccaagtggattaaaaacctaagtgacgccgggcacaatggctcatgcctgtaataccagcactttgggaggccgaggcaggagaattgcttgagttcaagactagcttgggcaatatagtgagaccccatctatattaaaaaaaattaaatggggccaggtgtggtggctcatgcctgtaatcccagcactttgggaggccaaggagggcggatcataaggtcaggagattgagactatcctggctaacactgtgaaaccccatctctactaaaaatacaaaaatcagccgggcatatatgttcaactacttcacagttacaaaatggaaaacaaaacaaaacaccaaaaagatccaaatagctataggaggaattaaagaatcacgctccaaacaaaggaacagcacatacaaaggccccggggtgggaacaattactgtgttggaggacttgatcagcttgcctggagcactgtaagcaagggagacagtggtttgagacaaattggagaggtgtgcaggaactagatcttgaaagcccacagtaaggagtttggatctgattctaagtatagtgggaagctagtggaggatttaagcaggtgagagacatgatcagatttatgtttgctaaagtttttttggctgcagctttggctgggttacatgccaaaagtgagcttcccaaaatatgaaggaacacaggcaaatttagctttctagcctttcatttgaccagaaaataagtaataaaagtaaaaaaaaaaaaaaaaaaaaaaaaagggtggggggacatatatttcagaaaagaaagctgcttctggtttctgtgattgggctataggagtcaatagaggaagctggaataccaacatggagacagttgtggttattcaggaagctggcaatggtggcttggataagggttattttgaaagaagaaggagtgagggaaaggaaggattaaaggatgtctcctaggtttttgaccggagcaacttggtgaatggtggtgccacttactgaaataaggaaaactgaatagagtataatgaaaaaggagtgttgtagatgtgtttgaggcttagaaaggtgagcaggggtcagatcatgaagaaccttataaatctggcaaagggggttgggccttataagcactggggagccattgctttaaaggtgctttcaaaggctttacgctgaggagtgccatggtcagatttgcttcccaaagatcactctggtagccagtgcagagaaatccagtgcagagagggtaacgttggagcaagagaacccagtggggctcctgagatactgcctgacaccagattgtgaggcctgaattaagctggtgacagcagagatggagggcacagatacgaaatatatcaggaagtaaaatcagtaggaatcaataactgctgaaatattatagggagaaaggaatgggggtggcgtgtagtcaaagacggtggtcggcactgatgggccattccacctcccttttgctccagatgtataacataaaacagtcaacagataccaaggaagcagcagccatcgaggctagaa

SEQ ID NO: 1264 - DNA, 3472 bp, mus musculus; identical to SEQ ID NO: 1263

SEQ ID NO: 1265 - DNA, 257 bp, mus musculus
ccggagccggcttcccagccttacttgaccccctccggagaatgtggggacgctggtagctctcccgtggccttcggtcccaaacggtgcacttctgtttcagcccagcgtcctctctcgcctcgcattggtacactccaactcctttctactcttctctggaggcggcacttttgaatttcagacccagcgctccagtctttagaatgcttgaggtgtcgatccccaccccccaccgctatgtcagaggtagttgc

SEQ ID NO: 1266 - DNA, 214 bp, mus musculus; identical to SEQ ID NO: 205

SEQ ID NO: 1267 - DNA, 301 bp, mus musculus; identical to SEQ ID NO: 206

SEQ ID NO: 1268 - DNA, 13417 bp, mus musculus
ggagtgggaggatgaggcgatgatagatggctgttctgtaattaaaatacaggaagcaaggtttctctcctcagcacccgaactatttcctttcattgggcacagaggagcggggagctcgggcagcgctgcattgtagccgctgatcgtcgtgtatatgtcttaatcttccagccacaaaaagtacagggccgccctgaagaaggagaaacgaaagaaacgtcggcaggaacttgctcgactgagagactcaggtgatggactctttattctgttttctgtgttgtgaaattgctctgtccactccagccctaacttgaagccccagtgtcagaaggaagtcaaatattgtgtcggaggaaaaatagctgtgacttctgcccccaagtagttatttagaaacacatgtcagaaacaatgttaacatactaaaggcaggaagaggaagtcttggtgaatgatcgcccactgattctgtgtaacttataaagtatctaatattacagttgcaagcttcatgaattacagcagctagcacagtccttgcacacgtagtaagtattcggtgaatgtttttcttcgtaaaaccagcaggagttgaaggtattaattagacgttttgcaagtttttctcaaacttgactaatatgagacccttggtttacccaaattattatgttattcaaatatatatcaacataatactagttatgaagctcatttatttatttttgagacagggtcttgttctgttgcccaggagggatgtgcacaaccacggctcacagcagcctccacctcccaggctcaagcagtcctcccacctcagcctccctagtagctgggactacaggcattcaccaccacacctggctaattttttcttttcttttctttttttttttttttttttttgagacggagtctcgctctgttgcccaggctggagtgcagtggcacgatcttggctcactgcagcctccgccccctgggttcaagcagttctcctgctgcagcctcccgagtagctgggattacaggcgtgcgcaaccacacccggctaatttttgtatttttagtagagatggggtgaaaccccatcatgttggccaggctggtttcgaacttctgacctcaggtgatccacccacctcagcctcccaaagtgctgggattaaaggcgtgagctaccgcccctggcccacctggctaatttttaaaattttcgtagagacgggatttcactgtgttgcctgggctggtctcgaactcctggcctcaagcaatccttccacctcggcctcccaaagtgctgggattataggcatgagccaccacacctgacctgaagccattgtttgactataaaacaatatatgggctgggcgcgtggtggctcatgcctgaaatcccagcactttggaaagccgaggcagatggatcacctgaggtcaggggttcgagacctgcctggccaacatgatgaaaccctgcctctactaaaaatacaagattagctgggcttggtggcaggtgcctgtaatcccagctactcaggaggctgaggcaagaggatcagttgaacctgggaggcagaggttgcagtgagccgagatcctgccactgcacttcagtttgggcaacagagtgagattctgtctcaaaaaacaaacaaacaaataaaaatacatttataaattataaaactaaatgaaattacacattcggtaaaatttaaatctacatcaggtaatgctagggatgatgtgaaactaatgctcctcacaatatgtatatggcactgatgggagtttggaatgcctctactaatgttgccttatagttatttaccactttttctatgaaattactgtagaacctttatttgtacagatggtcatttgaccttcacatggcaaaacctaacatttatgtattaaatctacctgcttaatgcaataaaattaggacttagttataaaattatgtagtagttataaatccagatgggagcactgaaatcacacagtagtactggcttataatgattgtcatccgcattatccagaatatgctcatgaaattatcctagacaattcttaaaatccagagaccatggcctcaagtaactaggattcttggaccttgagaaacatagccatagaggttttatttaccattggtgttcctgagtaattattttagtgtcagtactgggatatttagaatggaaggagcagtgtgtttaactgcaacctgtgttagcatttctgtcttattagttgaaaactcatccactagaggcagaacaaagcatcagggataaaaggaaaagtagaataggttggagttattgaggcccttattgtacttcgtctctccccccttgaaattttcagctactttactttgttcatttaatctgttttattctaaatattatatattctaaatttgttttaacttctttctctttttcttttcctgcactaaatcctataacagctggtatttgtattgttttgattttttttttcctttttacttagcaaaatgtgttcagaatgagcctctgtggagagtcaggcgagtcatgtcccatggtagtttagcccattttaatggactaaatccaggtcactggtctgtcaagattatgtaactaatggcatatccaagactaagcacctgtctctgcacttctgctcctacttttgcccactccaactcacaattctttgcctagtggtacttcatgaatactgtagactatggaacactcctggtttttttttttgagacagagtctcactctctcgcccaggctggagtgcaatggcacgatctaggctcactgtaacctctgcctcccaggttcaagtgattcttctgcctcagcctcctgagtagctgggattacaggtacccactatcatgcccggctaattcttgtacttttgtagagatggggtttcaccatgttggccaggctggtctcaaactcctgatctcaggtgatctgcccaccttggcctcccaaagtgctgggattacaggcgtgagccactgcgcccggccaggaacactgctgtttattgtagcacacgttagatgggtaaacattacccagaaggctagaatgttgagtgtaactatgagagtgccttggcaaatgattggagtgccttggcaaatgatttctggaatagtgagctcttaattacagatagcttctttggcatccattctacttcagataactggaaacaagctacctcgtcagaaattaagatattaaaagcaagttgcaaaactatagcatgattctgtgtgtacagttacatgtacaggttgagtatcccttatctgaaatgcttgcgttgtatttaccagttcagcatcccaaatccaaagatccaaaattcgaaatgctccaatgagcatttcctttgagcattgttgtcactcaaaatatttctcatttttggatttggggtgctcaacctgtataataccattggatatacatttgatccttgaacaatgtgggagttaggggactctgaccgccccccgcccctccccacagtggaaaatttgcatataacttttcactcccccaaaacttactattaagtgcctgctgttgactctaagccttaccaataacataaacagttgattaacacatactttgtatgttatatgtattatataccatattcttataataaagtaagctagagaaaagaatgttactaagaaaatcccgaggaggagaaaatatatttgcccttcattaaatggaagtggttcatcataaaggtcttcattctccttgtcttaatgttgagtaggccgaggaggaagaggatgatttggtcttgctctcttgggtggcagaggtggaagaggtggaggaggtagaagggaaggcaagagggtagacggcacttggtgtaactttgcagaaatacattataatttctgtctgacatttttgctttttcatttctctaaaaatgtttctatacagtaccaattcttccaccacttgctttagtttaaatgcattagttttcagtatagaagggtccataaaagaagtcaaaagcagtcttgaataattggcccttctgccagattgtctagtgtcaatttgttttctggcactgcttcacctcagttttcttcctcatcaccttgcactggtttggaaggactcatccccatcaaattggcttttgttaactactctggtgtgtctgttagctcttgaatttcttcaagatatcttgagacccttcaccccgacccccctgcacttttcccccccccccatatttacaatctctttcacgatttccttgattggctctgtcttaagtccaatgatgccatgcacaatatctggacacatttttttctccagcaggactttgttttgggcttgatgattttcatggctttttctataacaacaatagcatcttcaatggtataatctttacacactttcttgatactctctgtattagggttctctcccatagcattgacaatcctttccgtagagtaccacgtgtaatgagctttagaggttcttacgaccccctggtctagaggctgaattagaaacattgtgtttgggggcaagtagaccactttgacaccttcagtgttgaactcatggggttctgggtggccaggggcattgtccaatattaaaataattttaaaatccagttccttattggcaaggtacttcctgacttcagggacaaagcatcagtggaaccaattcagaaaaaaggatttccattgtccaggccttctagttgtacaaccaaaagacaggcagctggtgctgatcttttcccttcaaggattgggggtgggggttagcagctttatagataagggcagttctgatcataaaccccactacgttttcatgaaacagtagagttagcctgtctctttttgttttcaatcctgctgcttgcttctcttcctactaaatgtcctttgtggtgtttttctagaataggatactttcatctgcattaaaaacctgttcaggccaggcgcagtggctcacgcctggagtcctagcactttgggaggccaaggcgggtggatcacgaggtcgggacttcgagggcagcctggccaacatggtgaaaccctgtctctgctaaaaatacaaaaagtagctgggcgtcctattcacgcagatatcctttctcctcagtgattttcttttttgttttttgtttttttttttgagatggagtcttgctctgtcgcccaggctggagtgcagtggcatgaactcggctcactgcaacctccgcctcccgggttgaagcaattctcctgcctcagcctccagagtagttgggattacagacacgcaccaccgcgcccggccatcatgacttttctctgcttcttgagagcacttccagcatcgctagtcgcactttgtgtgagtctcatgatgttattcaaggtttaccattttgtagtaaacacagtgaaaaatacgccagagatcacttcttactgccatacacaatttactgaagagatgaactgctcatgcagagatgagtagtgtcacaaggtgttttaagtgaatactcatagtatttgagctcactgcaatagcagcaggaggtggctatgaaattattgcagtagtgcagtgtgtactacagttaatttttttcttccttctgtacctcattggatgcgtttttttccttgttttgtactacagttaatttcatgcagttatgatttaatactgcatatttatgtttgtttacatttttctcaactgtgaatgtgccatatatggtctataaatataagttttgataaattttaactttaaaaaaagttgtcaatgattatgttgtagcacaacttttatagtaatattcaaggaaaaatgtttgagaccgaacttctctgtcttagaatggaatgaagtcagagatcattttgtttcaaatcgtttttttttttttttttttttttttttgagacagagtctcgctctgtcgcccaggctagggtgcagtggtgcaatttcggctcactgcaacctctgcttcccagtttcaagcaattctcctgcctcagcttcctgagtagctgggattacaggcgtgcaccaccacacctggctaatttttttatttttagtagagatggggtttcgccatgttggccaggctggtctcgatctcctgacctcaagtaatccgtccacctcggcctccgaaagtgctaggattacaggcatgagccaccgctccctggcctgtttcaaatgctttaagcaaggaaacaataaaacacttaacttatattgtaacagtatctgtatatgtgctgctcaagccagcacaatattgcttaacagtatctgcattaactttttttttttttttttttgagacggtgttttgctcttgtttcccaggctggagtgcagtggcgcgatcttgactcactgcaacctccacctcccgggttcaagcaattctcctccctcagcctcccgagtagctgggattacggggggctgccaccacgcccggctaatttttgtatttttagtagagatggggttcaccatgttggccaggctggtctcgaactcctgacctcaggtgatccgcccgccttggcctcccaaagtgctgggattccaggcatgagccaccacgcccagctctgcattaacgttttataatagatttatatttatggtagcaaatgataaaatagactagtatgtacatatattttatgcattcatgacatacctttttcttaatttttttcagtgtttctaggccatgccacttacctattttttttttcaaattgttgcaaatatcccctaaatgttccagtgtgtttactgaaaaaaaatctgtatttaaatagaccaaggtggttcaaacctgtgttgttcaagggtcagctgtattgtatgtatatgtattgcatatgtccgattgtacacgtggggaaaatgctgtacccagaactgttagcaatcacttctgtggagtatatgagcttggtttcgaggtgatggggagttgagtgagtcagtcaacaggtgtttgtgagtgtcagctgtgtctatgccctgtctaatctatggcatacctctgcaagtagtcaggccatatcctctgtgccaggttctctggcgctttaagtacattagatcatttaattatctgaacaattagatactattttatatgattgagaacttattctacatttgttgcccattttaattccagctgctgaaataataaagtttacttacttaagaaaagtaaattattgtaattatctaagactggatgagccttcagttagaactgtactcaacacatgtgacaaacagactcttttttctttaagcctgacatctgtaacatttctttaagattatttcagtcttccatttctcttccactttcactgatttttttcccaaattttgaatgggagaggatgtaaatgtctattctattaaaagttgttttttcatgtttttatttgggaaatgttctaatctacagaaagttgaaaaaaagagcacaataaatatccatgaacccttcagcaagatttgccagttgttaaagtttggcctttctttctttttctctatttaaagagatacatacatagaacattttttctgaaccttttggatggcagttgcagatagcagcacctcacccctaaattcttcagcttgcaactcctaagaataaggacattctcccgcagaaccacaataccaaacttgcacctgagtacatgagcaagtaattcaatggtatcatatacaggccatatttaaacttccccaaaccaggattgattgttttgaaaaactcaagccagttatcttgtggaatgccctgtattctggattgttctgtcttctcatgattaacttcaggtaacaacactctttagaacaaaggattacagagcagatgttgtaaacttcttattgcatacatcatgagacctttcacatcaggttgttgcactcccggtgatgctaactgtggttaaggtgttacccacccagggccggacatgctggctcatgcctgtaatcccagcactttgggaggccgaggcaggcggatcacgaggtcaggagattgagaccatcctggccaatgtggtgaaaccccgtctccactaaaaatacaaaaattagctgggcatggtggcgcgcgcctgtagtcccagctacttgggaagctgaggcaggagaatcgcttgaacccaggaggcggaggttgcagtgagccaagatcgcgccattgcactccagcctggcgacagagcaagactcccgtctcaaaaaaaaaaaaaaaaagtgtccagatcgctccattggaaagcattgcattttttcttttctaattagtcctcatgtctggggtgatatgttgagatagtgtgaatatactcttcctagcaagctttcattcgatgtttttaatgtctttgtctaaatttttacagtgggggttgcaaaagtgatgatttttctacttaagtttttctccattttttagttaccattcttctgtgaagatggatgttcccttccacacccccaccaccttttttttttttttttttgagatggagtttcactcttgtcgcccaggctgtagtgcaatggcacgatcttggctcactgaaacctccacctcctgggttcaagtgattctcctgcctcagcttcccgagtagctgggattacaggtgcctgccaccatgccaagctaatttcctttttaagtataattgtggaaccattgattaatttttaaatgtaatgtgctatctgccacccctattgtcctttttgatgcttgtgttgtaccaaagaaggttgatcagagacctttttgttagaaagtttaagaaaaagatttttaccataattttatacattaaagattacatgtatttttttcctgaatttttgaccaaggatttgcagcactcagtttaataaaacatttaaattccctaggactctcacagaaggaggaagaggaggacacttttattgaagaacaacaactagaagaagagaagctattggaaagagagaggtcagtgctaattgaaacacttaaagtgaatgaagttattttattggaatattatcaacctttactaaccagtaccagtcttctgtataaaatcttgtaccaaataggtcttataaaatatcctgtataaagtatttaaatctgtagttgatgggctaaaactagatgttattttttttaaaaatggaagtacttttcttctgtttttgctaatttataattttttttctttcttttttttttttttttttttagacggagtctcgctctgttgccaggctggagtgcagtggcatgatctcagctcactgcaatctccgcctcccgggttcaagcgattctcctgcctcagccttccgagtagctgggacaacaggtgtgcaccaccacacccagctaatttttgtatttttagtagagacagggtttcaccatgtcggccagggtggtcttgatctcttgtgatcaagtgatccgcctgcctcagcctcccaaagtgctgggattataggcatgagccactgcgcctgacctgtaattgtttttgaaaacagaaaaaaaacaaaaaaaattaacaaatgtaaaaagggaaaagactttaataattgcaacacacccaaagatagccactgttaagaaagagaaaaagaaagtgtaaatgtactttacgtgtgtctttctataatggcatgatatttatacatatttttctataaattgctttcttgctaaatatatagtgcatttatttcagtactgatgcagggatctaattcagccatttcagtggcaatacagtacccactgtacagatgtagcataatttatttgctattcatagtttattcatttataatttatagttctctactgatggactttcaggttatattggtttttcactcatatgtaaaaagttgcagtaagcatccatgcttatatatccttggtaattgtccagttatttccttaagaacatgactaaaaatgagattgttggaatcaaatcataagtccatgtaaaatgtagatggccaggtagaaagggcttcctggtttgcagtttgcagcccttctggcagtgaatgtaggggcccatctccccataccttcactcatactaggcattatcagtttataaaactataatgaaactgtttcaaatgcacatttctgaattaggtagagtatctttttatatgttttattacctatttgtagattgctcaagtctcacacctttctcttttgggatacatgtttttttaaaatttgtttttgttttgttttgtttgagacggactctcgttctgtcaccaggctggagtgcagtggtgtgatctccgctcaccgcaacctccacctcccaggttcacacgattctcctgcctcagcctcccgagtagccgggattacaggcacgcaccgccacacccagttaatttttttttgtacttttagtagagatggggtttcaccatgttggccaggatggtctcgatctcttgacctcatgatctgcccgcctcggcctcacaaagtgctgagattacaggtgtgagccaccgcgctcagccgaaatttcttaatgtctctaagcttctatttccttgtctgtaatatggagataaagtcaatcacagtatccacctcacagaattgtgaagattaaaggaggtgatggatgtatagtgtttaacacagtgtcagcagatgagaggtgctgtgatagctctagttcttattattatagatttctgttatgatgaagacaatagatacggtatgaaataagagagtaatttttttcctgtttatttgaaatgcttcttttaaatcacatacatgtatctttgtgctccttagatctttatttctttatgagttgcatactattattgaaaagcaagaaaattatgtaaaaatactgtatgactttatgtcctatttcaaagcagatgtatattcaagttattaaattttaaaatttttaacattttactttcttgtggtcttaatttatatatcatttggttcatttatatacaattatatgtttttcaaaagatttgtaaatcagagttgtgcccactgaaacatctatatggtaccctcacacatggcataggaacactgatagatgcaatgtgccagcctctgccatggctaaaagatgtgttcctggaatctgtatttggaaatgtaatatattttatttaaaattgtggttaggtccccagactagacataaaactttactgaactcctaatactgctgaagtaatatagaacagtttctcatatttaatttcccttttataaattcagtggaagaatgaatttgaggttctacacacctaattggcaggtagactttggcaatctaaccccctctttatattagaaatttgtgatattggatgtctgagacacttgccactttaaggtaataccactcattataattggtcatataaaaaatagactagacactcactaatttatttttattttttcattttttgagacgaagtctcgctctgtcacccaggctggagtgcagtggcatgatctcggctcattgcaaactccgcctcccagattcaagcgattctcctgcctcagcctcccaagtagctgggattataggcggctgccaccacgcctggctaatttttgtatttttagtagagatggggttcaccatgttggccagcctggtctcaaattcctgacctcaggtgatccgcccgcctcagcctcccaaagtgctggattacaggtgcgagccattgcgcccggccctcactaatttatttttataactccatttcttaaaacctgtagctttattttaaaaacatgattacaatgtacttttattttccttcttttggctgtttaggtgtttggaggcaaaccacaggagtctcttaactgtgtgtagtagtagtccaaaggtttatggcaaaggatactgggttttcagcgtgctgccatcatggaattgctacttttaagaataggggctgggtgcagtggctcacacatgtaatcccagcactttgggaggccgaggcaggtggatcacttgaggtcaggagttcgagaccagcctggccaacatgatgaaacgctgtctgtactaaaaatacaaaaattagccttgcgtggtggtgggcacctgtaatcccagctactcgggaggctgaggcaggagaatcacttgaacccgggaggcagaggttgcagtgagccaagatcatgccactgcactccagcctgggcaacagagtaatactctgtctcaaaataaataaataaataaaaataaatgcatagaataggaagggaaatgctttctgaatatgaaaaggtagatgctgctttgaaacttgctacccattttattgtcacctaaacatcactgtgatcagtctagagggaaagtcatagtgtccttttttctgtaaagtatgtcacagccatatatacctatgaaatgtaagagagattttaagttattacccattaggaagatagttgctgacacgtggtgcttttccaaaagctctgctcttctcgttctcttacacccacttgactgctttaatagaaaatagctttcgtgatatttgaatcagtcccaaaatgtgtcattttgctctcgtgtgtgtgtgtatttgtggattaatgcccatttcttttatctgattacatcattatactgataggcaaagattacatgaggagtggttgctaagagagcagaaggcacaagaagaattcagaataaagaaggaaaaggaagaggcggctaaaaaacggcaagaagaacaagaggtatggtaggaatcacgtaactagtgaacaaactgattacttcaccataataactctcatgaagagttgcctatcttgggaggttggagtgagctgagatcacgccattgcactccagcctgggcagcaagagcggaactccatctcaaaaagaaaaaaaaaaaagagttgcctatcttgaacttaaaaaaaaaaaacaaaaaactgatcttattcagtttgccagtgttttaagtttttcatctatgtgcgctgtatgtgaaatgtttttaaaaagtgactgaaacaaagttactttttcttcccctttaaagagaaagttaaaggaacaatgggaagaacagcagaggaaagagagagaagaggaggagcagaaacga

SEQ ID NO: 1269 - DNA, 28366 bp, mus musculus; identical to SEQ ID NO: 941

SEQ ID NO: 1270 - DNA, 9354 bp, mus musculus
gctcccgcagcagcagcctcccgcgtcgctgtcgctgttgcctccgccacctcctccgccgccgcgcgcccctcggagttccgcgccccaccatgcccaacatcgtgctgttcagcggcagctcgcatcaggacctgtcccagcgcgtggccgaccgcctgggcctggagctgggcaaggtggtcacgaagaagttcagcaaccaggagaccaggtgggggccgcgccggcggccgggctagggagagcgctgggcacgcggctgcggggccgggttgggggccggcgcctgcccgggccacctccgcggacgccgcgctcccccttccggggcgggacggtggcaacgcggcctccgcgcccccgcgcccgcgcctgcgaagaaaccgaggcggggcgccgcgcgtcccgatgcgcgcctcggctgtgcccccggttgcagggcctccggtcctgggaccgcggcgacccggcggtcccgagccgctcccggcctcccagcggtgccgcccggcctggcgtccccagcccggaagggagacgtctgggcggtcacagaccgtcggggagagagtgggcgcagcgggcgggaaccgcatcgggtcagcgcgcggtggagagacgtcctgggttggctggtcccagtttccgcgtccctacaaagctgaacctcagaccagtgcgtgcgactaaaggtttccccccgtccccaactctggttgcacgctgggtttacctggggacggtccgaacgctgcttcccccgacctgcccccaagggtttgatccaacgggcggaggatcagcgattttacaagcttccctggcttctcctgagcagccagggcgcagaccactgcgttatccagagggtgcagttgtgccaaggtttgaaagactgtgagaaccccaggacgcacgtgctgggctcccctctgctcccactactcttgctgctttaaagatgatggactttcagcttccttcttgttctaggactctgctgtgtccagcaacaacgccgtgattcgactgtaactttcacccatttctcaagtccaggagagcctcaggtggtggccatcctcggaagctgacctggggggctcctttgtctatctgcctgagtccacacagctccttgactcatttcaaattggtctcatttttcccccttcttcctccaatgtctagtaccgttaactgtccacagttactgataatttttatatctttggcaaaggttcaattttaccaacattttctagaaatggtgttggaacagttggacacccatatgccaaaaaatatgaacttccatccatacttttcaccatttgtaaaaattaactttgaagtggatcatagacctaattgtaaaatctagaactataaaatttctagcagaaaatcttgacttggggttaggcaaaaatttcttaaggaggagttatgttaatactgatggggaagatgctatattttggcaagtcagctttttaggatatgtgaatcttacgtgacttcttccaggtggcaaattccagttatggctccgatgataatataagcgaagaaacattgtgaatgagtggcaggtggactttggctaaagaattccactctgcagtgtttaatgcagaagtctgagaggatggtctagggctctggagaaggatagagctaggtttgagtgttgcagtattttgccagtcttgttcaagtttcagtcgctgtaagaacacgagaagaagaatagtttttgttcagaaggtgtcgtcatataagtaaaggagaaatttgttgatgaagtaaattttgaaagcaaatatgttgcccttccaggtactcagtgcagcatgatcttttgctaaggagcatggttaatctagatcagttcactgctaagtcagtgttgagtttctcctaaaaataccacatgtgccactgggcaaaactcactcagacactgaagtatgattgtttatacatttggttcaaatataaagcagactcacttttattttgtttttggcattttataaccatcacttgataattagaaatcgtgggacctcaaaaaccactcagcatgaagtttgggaattgcctatatagctacattttatgtttttaatgtatagagtataaaaggttcactgcctgacttttctcttttccatgaactgtacaagtacagagcttaatttttataaacagccctctctggaccagttactgtgctaggaatccagcttttagctgtgtaatcgtagagaggaaaaactgaagggcaaaatgaagacaaaattgattcagttcatgtaagggccccttcttgaatctgtcactgaactaggatcagaaatctggtttgctgtctcctggccatcaatcctcccattttgcgttttttatatgctactttactgaacatagagccttccaattttaccttcttatccctaaatcatttcagatatgcagggagaggtccgctccagcttcactatagaccatggaaattccatgatgacatcttaggacagcaggtgtctagatgtctctgttgtaacattttactatggtcagttaacctgctggcagaatctttagctatactgtgagacaaggttatgcaaagttatacaaggttatcggttaccatgtaataaataaagagcttaatggcttaaaacagtaattgttgatttggcttacaaatctgcaatttgggaagggctcagtgaagaaagcttgtttttgccgcgtatggtcacagctgaggctggtcacagctgaggcggctaactggggctggagggttcttgaagatggctcacatgactgaagttgttactagcttttgcctgggagcttggttaggaacctcagctcctcttcttgtaggcctctccatggggctgcttgagcttccttacagcatggaagctgggttctaagagcacatgttccaaaagacaggacattgaagccaccagtccattaaggactgggcttgcaagttggtgtatcataatttctgtcatatgctgttgggcaagtacagagccctctcagattcaagggcgggagactagaccctgctccttgatgggaaatgtgttaagagtctgtggctatcttttagttaccatgcccgtttattgttgagtcagtgacgctcttcagcgtttttatttgggggtcaataaagatcctctggcagaatggcaaatggatgctgccttctagccacaattttttaaagacctagaataaaggtagtcatgatcatctttttgagtagaagcaggactagctttaggggaaaagttgccatggtgatgatattctctgtcctcccctggactgctagtcatatgagaactgaggttcctgagtaaaaacaggccaaagaatctaatcttgtgggataaacgtcataagaccaggagttggcaaagtttttctgcaaagggccaaatcgtaaatattttaggcagtgctagcacatgtagtctctgttgctgcggtatcttacagttctgtaagttacggtaatgtctgtcacaggttagcagggctgtattctcttctgaggctctaggggagaatctgttcccgtgccttttccggtttccagaggcagcccacattccttcactattggcctcttcaccttcaatgtcagcaacaaaatgttgctctgaccctgcttctgctgtctccctcttgcatttttaagggccccatgattacaatgggccaatttaaataatccaggataatttccccatgttaaggtcagctgatgagcaacctgaatgctatctgcaaatttacttcccctttgccatataaactcacatattcaaaggattaggatgtagacatctttagggggccattattctgcctaccacgccattcttaactcacaggccatagaaaaacagcctatgtgctgtgttttgtcaacctctcagctatataatactgtacttgatttctgctgtagttcattttgtgctgctataacagaataccagagactggctaatttataaacaatagaaatttgtttctcacaggtctggaggctgggaagtccaatactgaggggctggcatctggcaagggctttcttgctgcatcatcccatggcagaagggtggaagggcaagagagcatatttgagagagagcaatagagggccaaatttgctaatataataaacccattctcaagataatgagcacactctagcaatgatgacgttaatccgtttgtgaggacagagcccttatgacctaatcacctcttaaaggtctcacctgtcaatactcctatactggggattaagctttcaacacatgaactttagggaacacatttaaaccatagcaatttccaaattaagtttatgtcatagttgatgtagtgttcacaaagcagttagatttagctccttagatcttcaaataggagggagcacatagaactctttctatccccctcatcctgtgaggttggcatattttcatccatagtagaaggcgtgcaagaagatgtgtgaatgttatcaaaactaattttcacaacatgtcaacttgaaaaactttatttttattttccttttctttaaaattttttttagagacggggtcttgctatgttgcccaggctggactagaactcctgggctcaaacaatccccttgcctcagtctcccaagtagctgggactgtgggcatgagccaccatgcccagcctgtttttaaattttcattaggtataattggctcttttttttttttttttttttttttgagacagagtttcacttttgttgcccaggctggagtgcaatggtgcgatcccagctcactgcaagctccgcctcccgggttcaagtgattctcctgcctcagcctcccgagtagctgggattacaggcatgcaccaccacacctggctaattttgtattttttagtagagatggggtttctccatgttaggctggtctagaactccagacctcaggtgatcagcccaccttggcctctcaaagtgctgggattacaggcgtgagccaccgcgcccagccttaattggctcttttaagaaaacaatttcattgagtatctgatagcaggagaagagagaaggataattattcatgttccttatttgtaattttaaaatatttcattttgggatgaataaatttacagacaattctgccataatgtgacatatgtattcctaaaaattaccacgctatgcaaaatcaggcaatccaaaaccacagggcttatgagaaaaatggggttagggacataacattcaaaaacttcctcagtgacccattaaaaaatcataggaatgttatatagattgagcatcccttatcagaaatgcctgggacaacaagtatttcagattttttttttttttttttttttttttgcattttggaatatttctattgtacttactggttggacattccaaatctccaaaaatccaaaatccacaatgctccaatgaccatttcctttgagcatgatgtcgacactcagaaagtttcggatttcagaatttcggattagggttcctatcaaaatggtaaaacactgacatgtattacatgctcaaaaaatactggctgggtgcaatggctcacgtctgtaatcccagcactttgggaggctgaggtgggcggatcacttgaggtcaggagttcaaaaccagcctggccaacatggcaaaacctccctccactaaaaatacaacaaattagccaggcgtggtggtgcatgcctgtaatccgagctactcgggaggctgaggcaggataatcacttgaacctgggtggcagaggtcggagtgagctgagatgtcaccactgccctccagcctgggcaacagagtgagactctgtctttaaaaaaaaaaaaaaaattacataaatattatgacagagatggaactttccattgaaaaatgcctgaggtttagggttctctgaaatgacatgaaaagttgtgacaccaaatgtgaatgagtgtggctcattgtcctcgaggtgtgtacatgtgtatgtttgtgtatttctaagtggctccattcagctgggtacactgcagttttctgcagtctcgggataagaggttgtgcataagaaaacatgaaattcatgctatgctcaaattgttccaaataatatcaatcattggaacaaatttgccttttcaaaacatagcagagctgaccatcttcttggtttggacgcagagctctgggaaggacatgcctgagcacacagcactattttctgtttcttcccaccaaaggaatatgccagggatgagctggctctccctctcatgttggacatccagaattctgtacctggaaatacagaaacttccagacatgcaattttcaaaaacttagctgctatttactctttctccagaagctacgcaaggatgccaaccagcaaaacaaggaagtataccaagaaagaggatacagaaaatggcaaatggagtgcaggagagggggcagggaatccccggatggcagctgtgcacaggcagagagataacccaggcctgccacccctgggagggatgcctgcaagacgatgaaatgcagatgggacttgaggcctctgatcttgggagattttgattgttagtgaagggtttagggtggaatctggattcaggattcagaaaacttagcagataaaaaggtaagagaatgacctccagggaaaataaaaagaaaagatgtgcataaaaagaaaatacaagcattcgtttaagttaattgcatggcagagctctgagcagcatttgcgcagttaaaaacgtacagtcaatctttaatgtgaatattgatctatattgggatgatggcgagatgggaagtttacattgcaagtgatggaactgaatggaaatggagttcagtcctcatcttccatagtgagaagtcaatacactttgcctaaaatgaaaaatcaagacacagcaatacacacatagtagctagacttgaaggaaagtatccaaaaaccctatcaagagttgaaattggtggcctctgggcactttctctgttatacgtcttacagaatggtttgaattttttaagcaatatgactgtataactttaataaaaaactaaaactaaatgtagtattttgcagaaaagagttaacattagcaggcctgagacttaggcctgttcgcaaggttggcccttggctggcctctgggagcttacattttgcaagggtacccaccatttcccagtaaggatggctcactgcataaactcttaaacaattgataaacaatgtggttcatgctgaatgcctgtgagtctgacattttggtacgtgctaggcagagggtgcttatatgaccagcccacaatacaaaccctgggacttgagtctctaagcagcttccctggtagagagcccttcacacgtgttgtcacagctcactactggggcattaagctctacctctgactcccctcagggaggagtcttggaagcttgcaccctgtttcccccaacttcaccccatgcacctttttccctttgctgagtttgctctgtgtcctttctctgcaataaattacagccatgagtgcaactattaggctgagtcctataagtcatcctggtgatcatcaaacctaggggtggtctcagggacgcccaagatgcaaatatgcttcgatattaaccgatggcagttttcttttcctagcgtggagattggtgaaagcgtgagaggggaagatgtctacatcatccagagcggctgcggggaaattaacgacaacctgatggaactcctcatcatgatcaatgcctgcaagattgcgtcatcatccagagtaactgccgtgatcccgtgtttcccatacgcccgacaagataaaaaggacaaggtaggagaggtgtgtgccctagaaacctgctgtgggccactgtcaatgttgtttttcctcatttatccccttgattagaattatctggaaaatgttggctttttcctttgatgatcaagtaaatatgctttcttattttgtttgttgaagatttggctttgaacctaccctgacattaatattcaaagaaacaggtaatgcatatttttgcaggtattaaaataccattattgtccttgttataatgaaattattgtatgtctttgtggtggtggatagaactaaatacacacacatacatgcacaagagtacaagtcaaactagagcacatctgaatcagatcactggattgtatcaatttcagggtcctggctgtgatactgtgttatagtttcacaagacgttaccacagggaactaggtaaaaggttcacaggatctctgcgttgtttcatacaactgcatgtctatctacaattcccccgaaataaaaagtttaattaaaaaaaaaacccatgatctctttttaaccttttaaaaagaacagaaatagtatcattgaattatgtttttcacaacattagcatcagaggaggctctgtgagtctttagaaaaaaattgaagaaaatgtggttggtctttgcctttcagagcaacagagaaatcggaggttgagaagaactttgaaggagattgtattagttttctaagctgtcataagaaattacataaaccgcgtggcttaaaagagcagaaatttttccctcacagtttcggaggcccagaagtgtgaaatcaaggaatgggcaggggcacgctccctctgaaggctgtaagggaggctgcttcctcgcttcttccaacttctggtgtctccttgcattccttggctgtggctacatcactctggtccctgcctctctcttcacctggcctcttccctgtgtctcttctctgtttcttataaggacactgtcattggatttcaggcctaacctaatccagaatgaactcaacttaatctttaccttggttatatttgcaaagaccctatttccaaaatgaggtcacatgctgaagttgtgggtggacatgagttttggggggatattgtttgacctactacagtggtcaactcccagctgttgtgtgttccgtatcttatggatagatagatgttcagccaggctcagcgagaatcctgccagttttcaagacacactgctgttctgtgatttggtaactcagtgcaagaaaggttttccccaatatgctgctttttatctccataattcatttctgaaacaacacagatttctgaagcagcacacaagatcccctcatatttgaaaaaaaccctttataaat

SEQ ID NO: 1271 - DNA, 9354 bp, mus musculus; identical to SEQ ID NO: 1270

SEQ ID NO: 1272 - DNA, 18102 bp, mus musculus
ggtctcaagaattgagttaaataaagtcagtagtttctatgtgggcatttttagctgtaggccagaactaatgagttgtaacagatttttaaaaagatgtatagaacatttctgacttttgattgactctacatttattttttgcattttgctattttgaagactatgaaagtgatgacgactcttatgaagtgttggatttaactgagtatgcaagaagacaccagtggtggaatcgagtgtttggccacagttcgggacctatggtagaaaaatactcagtagctacccagattgtaatgggtggcgttactggctggtgagaacaacgtctttttcattaaatttcatttgggggcctgacactgctgtcctttcatacatgggcaagaatcaccgtgcacaggcagtaggtctacactgttaattccagaagaggcttttctctgagttaaaattgatgtaatctacattcccaggctccctgttgagttttggcgatcccctcccccatgcccaccactgttcctcttctccctcctcatccttcttttgattctttatataatttccccattctcatgttcagcaaatgtcgtggatctgattcagtgatagtagataggaagaaatatatgagttaattatatgtaaatttttacatttcattcagtgctaactgctgaaaaaacctaagaaactcccacggtagaactggcctctagtattgtcagccctgtacagagcagtgtaaaatgctcagtatgaattattggtgatgatacagatgattctgttttttgtgggctcgttcagattatgataactctttgaaaaagagctgtagaacgttaattctgtgtttaaaggtctgattgcttacttgataatattgtggagtccattaagaagtagttaataaccatcagcctgaccagttaacatttcagaccacgtgataacacaatggctactgtggatctaattctgttcttataataaaaaaactagccagataacaaggggcagaaacaaatttgactgttttgaaaatgttcgtgactgtagagaaattttggagttagtgagggtacttaacttgtgcataagcgttttttcttagattcttatttaaattcatcttacatagatttaattgaaatatttacctgtttccacttgataagtataacgatgagttttttgatttgtgttttacatgcaccttggaataatgacccactcttctatgcctttttttttgcaaatgccattttatgatagaagtactcattgtgaagattctgtggtgcagaggtgcggcatttattcatgatatgtacttactagtgctgctgcaggaaaaaagcctgcaattagaagagagatgcctgtcagggcctggtcattcagataattctccacaggctgatagttcctctagccctgtaattcagggtatggctctgcttaaataagctcacaatttggttccatgggtgattggttaatgtcagtcagggcctaaagcccagtcttaaaacagactcaaaaataattgagaatagaattatcaagtcatttcattgtttctccttggagaccagactccttgtagatgaagccccatcattggcagaagtttgctcggaaagcctagagacagagcagcaggagataggttcattttagtgactgatgccatcaagcaatggatacacatgcttgtggaacacagtccaagggacattgtggctgctgcctgccttttctgttcccttttctgagcctttgttgctgacatatatgtatatatacatacacacacacacacacacacacacacacaacacacacatttggattacagccaggtgttggtccaggagctgtataatacaactctaataattatacaggcgatttgttgcaatgactatattcagtgtagtaaatttttgcaattttcttaggatgtaaaactgatgtgatattatggtgtatattaaggaggaacagttaataggcactaacctaacaagttagcaatttagaccaattcaagacatgtataggaggctgaggagattttattttgctgtaggtagctgtaggcttttgatcatgacaaaaaattaaaactattaggatgggtccttgctaggagagatgggaggtgttgagaccagttagagggcccttaaagtgttctggaagcaaggtaatgatgaccttgagagtggaaaggagaagacagtcaaataatgttttggagataaaatatatagaactgtggaggccaggtgcggtggcttacactggtaatcccagcactttgggaggccgaggcgggtggatcaccagaggtcaggagttcaagactagcctggccaacattgtgaaaccccgtctctactaaaaatacaacaattagctgggtgtggtggcgggcatctgtaatcccagctattcaggaggctgaggcaggagaattgcttgaacccgggaggcggaggttgcagtgggctgagatggcaccagtgcattccaacctgggtgacagagcgagctccatctaaaaaataaattaattaattaaattaaataacagaaatttattctctcacagttctggaggctagaagtctgaaatcaggatgtcaacagggtttgttccttcttggaggctcagagggagaaatctgttttatgtttctctgctagcttctggtggttgccagcaatccttgtcattccttggcttgtagacgtattactccagtctctgcctctgttgtcctcacatgtcgtcttccctctgtgtgcgtccttatcggattaaaggcccaccctgtccagtatgatctcatctgaacttattacatctgcagtgactctgttttcaaataaggtcacatttagaggttttgggaaggatatgaattttgagggggacaccattcaacccagtgcagaaggctagagttagaaatataggattcatttgcacagtgtggatctggaatgctgaagggaatgtgagctcactgaaggagcgaattaatgacaaaagaagtatgagctgacacagggtagatgagacacaaaaaacatttaatataaaaataggtagatatagataaggaggcctttagaaatgtgggctgaagtatagttattgagtggaacaacagctggacctgaaagggtaggaatggtaggaaagctttagataggtagagctaggaagaaacccctagaagcagggagattaatagcttgagcaaaggtgatgacctatttggaggttaatggggttggagccgaaggtgggggtcaaccaggtgtatggaccatcttgactgtattaagcaaaacatcacttttattacgggaggtttcagcttatacaaatgtaggaggaatataatgaacccctgagtacttgtcgttattttagtagctgctcttttttttctataaattctcctcctcttctctccgtcccttattttgaagcaaatttcagacattttagattgtgcatttttgactagcctgtataactgaggggtttctgagaaggtttctgagcaggtaagggatgtgatcaaaagaaatgcaaagacataagattttattaggaaagcaatgaaaagtagaagagggagagggtttagtacataattgattgttttcatcttttgttatttgattaaaggtgtgcaggatttctgttccagaaagttggaaaacttgcagcaactgcagtaggtggtggctttcttcttcttcaggtatgtcagagctttaagcacttgcctttgctttcatagaaggtggaatttttcttttaggcatcagtttatggaagagctacaatgagttttggaagctgacttttgtcttgaaagataacaatttaaatacttctgagttattaagcatagtttgatcccagctattaaaaagacagccattaccgagcgcattggctcacgcctgtaatcccagcactttgggaggcagaggcaggcagatcccttgaggtcagatgttcaagaccagcctggccaacatggtgaaatcccgtctctactgaaaatacaaaaattagctgccatggtggtgcacgcctgtagtagtcccagctacttgggaggctgagacaggagaattgcttgaacccaggaagcggaggttgcagtgagccgagatcgtgccattgcactcccgcctgggcaacaagagcaaaactctgtctccaaacaaaacaaaacaaaacaaaaatccataatcttatatctgaggcagatagatttgaagttttagttttgttcatattcttgtaagtataagatctaaaaatgctttgccattagaggatgtttatcagggcatcatctggcattcatgtctgtttggcatgtattttttcaaaaatatcattccttgaagatcaaatatagtaaatccaaaaattgaaaatctctacgaatgaatgtgagcagcacttttaaagatacagagaactgtcacttgtactagattttaaaaatgattgatgttcatagccaccagaatctgaattcagcacctaagccatcgatcatgtaataactagtgtagttgtagtacaaggggactagatttgtatgtatgaagcacagattttgagttgttcactaaacagccttttaaaaatatatatgttttctttcttttggtgacattattacgaataattgcttattacttgtggtaagaggtaaaaaaaatgattaatacctaaatttagttctttggatgaatatgccagcattagtacagatgataattttacttaagctgattttgacttggttttatatggaatcaagagcatattttattccatagctattttgaagactcagttgtcatttctgttagtgtaaaagggtactggactgaagcagagtttcctaaaatgttcacagaatggagagaagtgtatattttaatccactctgcatgtcagtttttcagaagtccatttcagttcactcaatatgcaccattcaaatccacattttgtcattgccacctcccacttttccgcatttagtacacgtagtctttgaagtttttaaggcagagcaacataggacctatctgcatcaaaccagtttttcccacaaatacgactaaccttgaaaactcagtagaaggaaagtgaaaggggaaataaagtaacaaatggcttttaggctaattgcctaatattctttaggcccactttcatatttttatgacctttcttatatttaaaggtaaatattagtttatttagaacttaaagcttttctagtaacaatatcaagtgttttccaatagatatttattacactgccatcttaaagtacacagtctcttcgttttaattttttggagttatacatccttataattcaaagggccaagtacttgtgcaaggcttgttacagattagagtaatcctccacctctctcactacccccatttttccatcccttgagacatccagtttgcactcttaactgattcttaaggtagtaatctctttttccctaaacaagttaattggacatttcttgatctttcagttttaggtgtgaactattggcttcccattatggaatgggaaaatttagctgtcatttattgacctgttttgttttccctatacttccccaaatctcacatacctgaatgctttcttccctctccctcaatcgtctgagtgtagttacttcccttttttcataattgtgttagatcattcattatatggagttcactgagattgattacttggagttcactgaacttcttgagcctgtgaatttatgtctttaatcatgtttgggaaggttttggccattatttctactaggaagtttgggattttttttttttttttttcgagacagagtctcgctctgtcgcccaggctagagtgcagtggcgcaatcttggctcactgcaacttccacctcccggattcaagtgattttcctgcctcagcctcccaagtagctgggattatagactacagctgcctgccacagcaccccgctaatttttgtatttttagtagagatggggtttcaccatcttggccaggctggtctagaactcttgacctattgatccacccgcctcggcctcccaaagtgctgggattacaggattacaggcgtgagccaccacgggcggccgggattatttcttttcttcttctttttttttttttttagacaagagttttgctcatgttgcctaggttggagtgcaatggcacaatctcggctcactgcaacctccgcctcctgggttcaagcgattctctttcctcagcctccgaagtagctgggattacaggcacctgccaccatgcctggctaatttttgtatttttagtagagatggggtttcaccatgttggccaggctggtctcgaactcctgacctcaggcgatccacccgccttggcctcccaaagtgctgggattacaggcgtgagccaccgcgcccagccaggattctttctttttttttttttttttttttttgagacagagtcttgctctgtcacccaggctggagtgcagtggtgcgatctcagctcactgcaagctccgcctcccagggtcacgccactctcctgcctcggcctctcaagtagctgggacaacaggcgcccgccaccaagcccggctaacttttttgtatttttttggtagagacagggttttgctctgttagccaggatgatctcgatctcctgacctcatgatctgcccgcctcggcctcccaaagttctgggattacaggtgtgagccaccgcacctggcccagtattatttctttagacaactactagttgtgtaaatcacctttcattgtcgtatgtatcaaatagttcatcagtttaaccgtctgggcaaacttggtcccagagtcatctgtcctgtttgctttctaggcctggtatacggctctcaccctgggatctctcttcaataccttctggatattccctttttgttttgggttgtttcttgtatgttatgtcttttgtttgtttgtttgttttttgagacagtcttgctctgttgcccaggctagagtgcagtggtacaatctcactcactacaaactctgcctcctgggctcaagggatcctcctgcctcagcctcccaagtagctgggattacaggcgtgtgccacatgcccgctaatttttgtatttttgtataatagggaggtcttgctatgttgcccaggctggtctcgaactcctgggctcaagcattccacccgccttggcctcccaaagtgttgggattacaggtgtaagccactgcacctggcctatcctatgtcttgatgtattctcttgttttggtggacacatcctccaatagctttcgtagaaaatgagaatgggaactatagtttttgagactttgcatgtctgaaaatttcttcattttatcctcacatttgtttgataatttattaatagctgtgtttaggtattgctccattgtcttctgacttccagtgttgctgttaaaagtttaaagtaattctaatttctgaacctttacatgtgtgggtttttttttttcctttcagttaatgcttataggattttcttttgtcctcagtattctgatttttcccagtgatgtgccttactgtgggcctattttcatccactgtgctggaaactcaaggggccctttcagtttggggaaattttctttatatttatttagttaatgatatcctgctctttaattttcccatctttttttctgtagttccagttatatggatctcctggaccagttgtctaatttttctttctttatttattttacagttttagacttatttttaattttttttaaatagagatgaggtcttgctatgttgcccaggctggtctcaagcaatcctcctgccttggcctcccaaaatgttgggattacaggtgtgagccactgactgcttggcctaataattttttttttttctttcttagatttggtagaacactaataatcttttcaattttccacttctatctttttggtctattttctgggagatttcttcaacttcaacaagttttttttgttgtttttgttttttgttttttttttgagacagagtctcactctgttcacctgggctggagtgcagtggtgcgatcttggctcactgcagccttgacctcccgggctcaggtgatttcttcacgccagcctcccaagtagctgggactacaggcatgcaccaccatgcctggctaattttttgtatttttagtagagatggagttttgctatgttgcccaggctggtcttgaactcctgagctcaagcgatccacccacctcggtctcccaaagtgctgggattacaaatgtgagccaccatgcccggctgttgttcttttaatgtgactttagcattctgtttcttgcttttccttcatggatgcagtgagcagtatcttttttaaaaatttttaatggctaatacttggatactatttttttgttgttgttgttttgttgttttttttttttttttttttttgagacggagtcttgctctgtcacccaggctggagtgcagtggcacgatctcggctcactgcaagctctgcctcccgggtttgcaccattctcctgcctcagcctcccgagtagctgggactacaggcgcctgccaccacacccagctaatttttgtatttttagtagagacagggtttcattgtgttagccaggatggtctcgatctcctgacctcatgatctgcctgcctcggcctcccaaagtgctgggattgcaggcgtgagccactgcgcctggccttggatactgtttttttaagagattggtgggatgtatttattatgtgtgacttgtcctcctccaacccattgtttcaaccaatgcaatggttagaagaccgtcccttcaataagacttttagaaacacatcatattactggagcactaacattcttggaaaccattttaattgcatgtctatagaccaagaaggcttgtgagagatggtatagttgaatgtcttctctaattcgaagatagaagcttcttagaaagtggcagagactgaaagttttccttagatcaccagatgctagttggaagtgactgccttaatagactgcaggttcagagtgttgatccaaatagtctgtcctacaagcaattcttagcatctacacagaatgttcatctagcagtttattttttcagctttacaaacaactctgcagtgactagccatttatatacagctttgcacacttgtctaagacaaagcaaaaatatacatatttaggccaggcatggtggctcacgcctgtaatcccagcactttgggaggccgaggcgggcggatcgcctgaggtcagaagttcgagacaagcctggccaacaaggtgaaaccccatctctactaaaagtacaaaattagccgggcatggtggtgcatgcctgtaatcccagctactcgggaggctgaggcaggaggatcatttgaacctgggaggcagaggttgcagtgagccgagatcatgtcattgcacgccagcctgggtgacaaaagcgaaactccgtctcaaaaaaaaaaaatatatatatatatacacacacacacacatatatatatttaagcctcttgattgtcaagtagccttccagaaagtattcctactatccccatatgagaggatccaccagcttttcccccttttcatactgtactcttggggttccttttttttttttttttttctgagacagagtttcactctgttgcccaggctggagtgcaagtggtgtgatcttggcttatggcagcctcagtctcccaggttcaagtgtttctcgtgccttagcctcccgagtagctgcaattacaggcgcacaccactgtctggctaatttttgtattttccgtagagatggggtttcaccatgttggccaggctggtcttgaactcttggcctcaagtgatccgccttcctcagcctcccaaagtgctgggattacaggcatgagccaccgtgccgggcctcatactgtactctttggaagggagtcactgtgtatagcccacatttcaggagtgtaattatgctccacctttctgaaggcagagtagctacataaattatttagaaatagtctgttggaaggtttgtctcttatttattcagtcatttatttatatcaatatggactcatggatatttattttatactttggtttataatctaatgctcttttattgctcaaattttaccagctttggccattaagagctctttcagttgtgcattgtcttttttaagctctctgaggacataaatgatcaagcttctgtgtgtgtgtgtgtgtgtgtgtgtgtgtgtgtgtgtgttttaagcttcttcctaccaagtccctgtttgtctaaggtgttttgttccccctccccaacctttttcctgcttgtttattttggtttctagttttcaagttaaaggccttcctccaagtctgatgatccttggttgtctgctcatatttaagaattgagcactaaaagttgatggaaagctctaaacaatatggacatgtggattgggctttcccttctctgggaaatctgaccagtccaagaaaaatgatctaaagataaggagttgggggtgggcagaatttcccgcagtgaaacagcccaattagatcagcatatggtgaagttcacaagcaaaaagccccatctacctgtttagagctttctggccaacatgaatcttcatctgaaagccgtgtgtgtgtgtgtgtgtgtgtgtgtgtgtgtgtgtgtgtgtgtgtgtgtgtgtgtctggccaacatgaatcttcatctgaaagccgtgtgtgtgtgtgtgtgtgtgtgtgtgtgtgtgtgtgtttttctggaaacagtctcactctctggcccaggctggagtgcagtggcgtgaccatgggtcactgcagccttgaactcctgaggctcaagcgatcctgccacttcagcctctcaagtagctgggactacaggtgcatgccaccatgtctggctaatttttgtattttttgtagagacagaatttcgccgtatagcccaggctggtctcaaactcctgggctcaagcagtctgcctgcttcaccctcccaaagtgttgggattataggcgtgagcaaccgagcctggcctctggcattattatttatttatttatttatttttgagacagtctccctctttcacccaggctggaatgcagtggcgagatctcagctcactgcagcctccgcctcctgggttcaagaaccgcctcctgattcttgtaactcagcctcctgagtagctgtgattaggtgtgagccaccacacccagctagttttttgtgtttttagtttcactgacatagtttcaccatgttgacatggctgatctcgaactcctggcctcaagtgatctgcccaccttggcctcccaaagtgctaggagtacaggggtgagccaccacgcccagcccctctgtcatcattattattattattttgagacagtgtctcactctgttgcccaggctggagtgcagtggcgtgatatcggctcactgtagtctctgcctcctgggttccagtgattcttttgcctcagccttccaagtagctgggattacaggcatgcgctactatgcccggctaatttttgtatttttagtagagatagggtttcaccatgttggccaggctggtcttgaactcctggcattaggtaatccgcctgcctcggcctcccaaagtgctaacattacaggcgtgagccacggagcccggcctggaattattttattttatttatttatttttaacttggaagcttttattctaataaaagtaccttatgtaatcccattaaatattttagtgttataggaagtcaaatgttcaaaaagcagtcatcactgccccattccctccccagtctgttggcttgcatttccttgtagttgcagatgaattttgtgtggacaagactgaattgggtcctgtatgtattggttggttaagttggttgtacctgaaccccacttggggcagattgcttgtccttggtcatctctgtactggagcagggtgctcaatttagactggtattcttcggtttgatcagaagtgtacttctcagctgggtgccgtggctcactgtaatcccagcactttgggagaccaaggcaggaggatggcttgaggccaagagtccaagaccagcctgggcaacatagtgagacttcatctctctctctcttttttaaggcattaatatctttagcatctcaaggtttttcatttttcctgcaagggaacagattctcaagggaatttgttcagtgatggtagatcactccagcatcaaagatcattctcttgttagtagacatgctaggttgggtcctttgggataatctagctcatccattttgttgctgagagtcattatttgagccaggttggttaatacagcttttgagatttagtctttattcattgtctttgttatcatttatttactatgtctcattcatctggcattagttgggactctagggatatagagattcacagcccatatggtcagtgctgagctagaagggtgtgtttagtgctgagagagcagagggaagacgctctgtctgcttggaggtgttagggaagtcttcttccaaagaggcgttagtatctttagcatctcaaggtttttcattttccttgcaactgtttgacattttcccccaaaacgtagagaattctttaaattatacaaaatctttatctcagataacactgggtttactaattatcagtgacaaatggctatgtaaaaatattttgtgtatagaatgctgtttgtgagaatttgtttaatctgtctcattaaaatggtttcctttattcatttgctggggattggggggtggataaggggtctcacccagggaatatagttaaggtttgttttttgtttttttaatttcacttccaatttaactcatggcatgaagattagctttttaaaaaaaactttgtaacttaaaatgttaagtcttgaaaatgacagttgaattgggagttgctgatgagtggtggtatagataatatttttgttctgccgggcgcggtggctcatgcctgtaatcccagcactttgggaggccgaggcgggtggatcacgaggtcaggagatcgagactatcctggctaacacggtgaaaccccttctctactaaaaaacaaaaaatcagccgggcgtggtggcaagtgcctgtagtcccagctactcgggaggctgagacaggagaatggcataaacccgggaggcggagcttgcggtgagcagagatcacgccactgcactccagcctgggcgacagagcgagactccgtctcaaaaaacaaaaataaaaaaaattttgttctaaccaaaaaataaagccatatacatacataaaatatttgtacttctcacaagctttggattaagaagaaatgttaagattcagcaaaaagtaaaattctgcaaaagcttcaaagtaatcaactattttgattacttagtgcaagccaataagaagtcttttcaatttatatgtagaattttcctaaggttcatcatcacctccatgcctgtgactcaaattgctgtatcaagtactaacagaaaaagccttcacttgccatttgatttgatcaccactgttttgctgaggctggagtttgaagtgatagtagatgaataaatacaagaagaaatgcagataaacaaattcttctatggagtcattcacagacaaaatagaacctaagatttctagtcagcctgtttatgcaaaatcagatatttttattatttaaagtattttctgtgtggctaaaagtcagtgtgttcattcagggtgcaaatggcaaaagaaaagtgatgcactaaaaaattacaaagaaagcataagcttgacagaagtgatttataatggtatatatggctattttattatttggaggcactgagttactggactggcttgcacacacactgttgttcctgttcagatattgcagtctctcagtagtaccatatgataatttttcttatgataggcatttagctatagttttattaaaaggatttatggcatgaaacttgtgtagagtgcagtttgttttatattctactttcaaaagcaattaccagaaagtattcttaatttaagtaaagagagctatttaaatacttaccaggctacttaaatttctttagtgatctaataactgattggcttatgatcccttataattaaagatctatttaattaaaaagtatttttaaattagctatataatctagataatctctgtatctttttaactaattccctattccaaaaggtgtgacagaatgatagtatagttaaaagacagtttttggaatcattttcccatcatgtactaaacactgttcatcacatctaaataattagttacttacttatgcttaatatctgttttccctaacagacctgaagctctctgaggataggggcttatgtctcccttattcagtacttagcatagggtaggcactagtgtctgttaaatgaataaactagtggagaaaaagcaatttcttagctataagttttataggttactagaactcttaagtgtttatatattcttggctattatagtcagcaacctagttggtatagtattgataatttttattatattttttgcagattgctagtcatagtggctatgtgcagattgactggaagagagttgaaaaagatgtaaataaagcaaaaagacagattaagaaacgagcgaacaaagcagcacctgaaatcaacaatttaattgaagaagtaagatgatatataattttgactttttttttttttttcctttttttggttaatgggtatcccttagcagaaaatgtgaccgggggggattactgtcttttttaaaaatggtgtttttggttatatatctagagtgttaagtaaaatttgagatcacaccactacttaaatcagtcattatttttttttttttggtggttatcatagattcccctgcatatctctagctcactttgatcttgttgtaaaaactaagaacattcttttcaacatatttcctctgcctttataaatgaacatgtacaggtgtagtaaaacttaaaagtacacattttttttcttgaggatagtttgaaaatatgtttttttaatatgattaatatattttattaatgttttcaggtgtaatttgaccctttacttttgtactgtttaaaatggaattgaatacttccttgcctttgtttttgttttatccttttacctccctcaactttttagtttgaaaaaattcaaaccagttaaaaagttgaaagacaaatatagtgaatatctcaatacccttcatctattcaccaaattgttcatgatttgccgtgtttactttatctgtgtgtgggtgacacacacagataattttttttccaaagtatttaagatgtcataacttttcatccctaaatacttcagtatgtatcttctaagagtacagatattctcttatacaactatgaatacgccccccccccttttttatttttttactgtgtgggaactgccacttcagaaactttttttttcttttttgagacgggttctcgccctgtagcccaggctggagtgcagtggcgtaatcttggctcactgcaaccttcgcctctcgggttcaagcgattctcctgccccagcctcctgagtagctggaattacaggcacgcgccacctctcccagctaattttttgtatctttagtagagacagggtttcaccatgttggccaggctggtctcgaactcctgacctcatgatccacccgcctcagtctcccgaagtgctgggattaggggcgtgagccaccaggcccggccaactgtttttttttgttttttttttttgttttttttgagacaggtctcattctgtctcgctgtgttgcttaggctggaatgcagtggcatcatcatggctcactacagccttgactcccctggctcaaatggtcctcccacctcagcctcccaagtagctgggactacaggtgtgcatgatgcctcggcctcccaaagtgccaggatcacaggcgtgagcccccatgcctggccaaatgccattattaataaaaaaaaaatgtaacatgagataatagtatttcctttctttgttaattttttttagacagggtcttgctctgtcacccaggctggagtgcaatggtgtgatcacagctcactgcagcctcgagcacctgggctcaagtgatcctcccacctcagcctctcaagtagctgggactacaggtgcatgcccagctaatttttatatttttgtagagatgaggttttgccatgttgccaggctggtctcaaactcctgggctcaagcagcctgcctgcctcagcctcccaatgtgctgggcattacaggtttgagccaccacacccagccagtattttctaatatgcagttcatattaatatttttctacaaaatatcttgtgtggctttttttttcccaattaagaattatatgccaggtacagtagttcactcctgtaatcccagcactttgggaggctgaggcaggaggatctcttgagcctaggagtttgagatcagcctgggtaagagagagagaccttgtctctacagaaaatacaaaaattagaacggtggcatgcacctatagtctcagctacttgggaggctgaggtgggaggattgcttgaggctgtgagacgtgattgtgccactgcactccagcctggctgacagaatgagaccctgttcccactcacccccccaaaaaaaattatatattgttttcggttatcatgtctatgaagtctcatttagtcttaaacagtcctttcatctgttaattttattcccccatctttcatggcactgacatttttgacacctctaggcagaatatcccacagtctggctttgtctgatggcttcctcatgattttattctggttaaacattttaccaaagtaatttgttttggttttgatcctgtacatttttttttctgttggctaaatggactattaataaataccattgtgcctgctgtgacaatttattaaataatctgtgttaataacttgatgatgggccattcatctctaccttacaggtagatttctttttacttgtgagatcattgctgcccatatacttattatctcaatagccaaggagcttactgggcatgactgtgttctctagtctccttcaattagtcagggacatttctgggatcttgcatgctatttgatacctgcagtagtaggtgcacaggaatttttgctgaatatttattgaattgaggaaaatagctgaaactgctacttggctctggattcagtaagaatttttttttgtgcatctttttattgtggtaaaatagttatacaaaaattttaccagtttaaccatttttaagcatacagttcagtggcattaagcatattcacatttttctgcaatcattaccactatttccagaactttttcatcatcccaaactctgtgcccattaaacattaattttcagtttccctctctccccagctcttaatgatctgtattctgctttctgactactcatacgagcagaatcatgtaatatctgttcttttttgtctaccttatttcactttgcataatgttttcaaggttcatccctgttgtagcataattaagagtatttttgtttaaactttgtttcaggcaacagaatttatcaagcagaacattgtgatatccagtggatttgtgggaggctttttgctcggacttgcatcttaaggacatgaatattctcccataacggattcaactatg

SEQ ID NO: 1273 - DNA, 431 bp, mus musculus
cggacgcgcgagctcggctgcagctcccggctacaccgggcaggaattgagcgccataactgttgcggctctttcctccggtgccccctcctggcgccccctcctccgttcctgccctttgcctggcttcggggctgacggggccagacccgtggcgggaggacctgctctgtcggccgccaggggtcggatgctccagggagcgagggcgcgccctggctgtttagctgttggggggcggaaagaaccgagtgcctggagaggggagaacgggtggtgctgggtgcggcgaggcaccccgggaagcccgggtgcccacccggcgggagcgggagcgcgggcgcccggcgggctggcgaactttccctcccactggcggcattgttcgaactgcgggtccgtggccgccgagcgtcgggcggtccgggggt

SEQ ID NO: 1274 - DNA, 39884 bp, mus musculus; identical to SEQ ID NO: 207

SEQ ID NO: 1275 - DNA, 39884 bp, mus musculus; identical to SEQ ID NO: 207

SEQ ID NO: 1276 - DNA, 39884 bp, mus musculus; identical to SEQ ID NO: 207

SEQ ID NO: 1277 - DNA, 39884 bp, mus musculus; identical to SEQ ID NO: 207

SEQ ID NO: 1278 - DNA, 43577 bp, mus musculus
gtggcggcacgtcacgtggtaccgttttatataacactttgctgagacaagacagttattaggcggcgcggggcggccggcatggagctcccggaggcgcggcagggtcaggagctcggtggcatggcggcggtggctgccccgatttcctccagctgccactccttgcttcgtgtccccggtccctagacgcctcgtctcctcccgtgtccctcttcccatggagtcagtacggatcgaacagatgctgagcttgcccgctgaggtcagcagcgacaacttggagtcggcggagcgaggggcatcagcggcccaagtagacatgggcccccacccaaaggtggctgcagagggccccgcacctctaccgacgcgggagccagagcaagagcagtctccggggacctcaacgccggagagcaaagtcctgctcacgcaggcagacgccttggcgtcccgggggcgaatccgtgaagccctcgaggtgtatagacagctctccgagcggcagcagctggtggctgagcagctggagcagctggtgcgctgcctggcggagaaagtcccgcaaggcgaggcgctggcgccggcgcccccggacgagggtagcactgcaagcggcaccgtggcggcggaagagacgggggccgccgcggctgcggcggccaccgaggtgtgggacggctttaagtgccggaaatgtcatgggtttctatcagaccccgtgtccttgtcgtgtggccacaccttttgtaaactgtgcctggaacgtgggcgggccgccgaccggcgctgtgcgctgtgcggggtcaagctctccgccttgatggtggccactgggcgggcgcgtggagcccggcgggctgggcagcagccgccgccgccgctgcgagtcaacgtggtgctcagcggcctcctcggcaagttgtttccaggcccagcgcgagcgtcgcaactccggcacgagggcaaccgactgtaccgcgagcgccaggtggaggcggcactgctcaagtacaacgaggcagttaagttgggtgagtccaacgcgctgccgggccggggctggggctcggtggctacatgagggagcgggagaacaaaccccgcagcgagaagggatttggaccagggcagaagagggggcgggggacccatggactgtggcggggtgggggaggggtgattctggggctgggtctctgagtttgttctgttttcactgcttatctgtgtttcactgtgtttgtgttgatctcggttgctttttgtcttttcctgctacttctgttagcttttgtgttcctgtctctcagtccccgttcctgtctgtgtctccttgcttctggttctttttctccgtctcttcgtatctttgtcactgtttctttctttttcggtgtcactgtctctgttcctctgactctccttctcccgctgcactcctggtctcctcttacacctgctcgcaccttcccagcgaggagaggaacttcgcgcgctcctcgcacttgcgcccggtcctctgggctgtagccagcaggagatgtccggtcggcgcctgcgtccgccgctcgcgccgccgggtgttgccccttccggggccgcggctccctgtggggtgggtccggcatggaattaggtcaggagagcactggttgcataagggccgcgagcggcccgggtcgggcgcccctcccccgcgcgagcgggcgggattgtgtaaccgctgaggtaactgaagtgggccaccacgctcgcttcggaaaccatcccacgagcatgtgcggggggagggggagcgcttgcgccccgctgccctgtgactcattgtcaccgcttcctatcacacgatcctcggctgaaatagatgcccccccttgcccgccccgccaacccgtagcctgtgccctcgcctccaacccctttaacctggccagcccggcgggaggccggcgcggcaactgcttggggatccctggggaccgtgggctggctacgaatgggtcacgcctctgtcccgcttttcagtgccgcctgggagggttgggtgggctttgcagcttcaagggtaacgtgggcagtcccccatctccagctagactagggcacccgaatttccccagggagccgctctctgacccaccacgcctggacccaggaagtggctgctgagccgccagccggtgttgcccagctctggcagtttgccaggagctcggccgtggggcgcggtgtctggcgaagcatgccggggaggaggcagcagggctgggcaggcagggccctgggatccgagggtgtcctggacctgactctgtggagtggaggaggggtgtgggccggagtctccacgtgtttaatctccactcaagcttgcaacaggtaatggggggaggaggaggaggaatgaggactgaaggggcaaggctggcagccggagaaggggacccttctagctcctgtctgtgcacaagcaaggcagactgtgagctgccaccaggctggagtgtgctgcagaagaaaaaagacagaaaagactaaacaatttgctaatgtcttaagagcaagtaatgggcacgcaagcaagccctgagcacacccctggggaaaaaaaaaacatcaaagcctgttgccacagaggaagctagatcccagatcttggggaagagcagggcaatatgaatgaggcaggtggaggtcacttaactctagatctctaaggcagattccataccttttagccatcccccaggggccaggaaagccccttcctgccctcacccttctcctctgttgccaccacattcccctggaagttcttccttgcatctttgttaatcccctcagagaagtcagggtgaaaatgtcaaggccagctttacccttctaagaggaaaggaggctctctgttctggaagatggccattgtgtccgtattattccaagtactgcacacaccttcagaaaaaggaacctgctccccacatcccagcttcaaagcttcaaagtctgaccagttatcagtgactgcccagctagccgtgtgaccttgagaaaatgccttcccttctctgggcttgattttcccatctgaagaatgggttgattgagccagataatctctaatagcctgtccagctctgacatctagtaattcagagtttttggtgagagccggcctcaccttattcccagaaaccttgtccaagttcatttacatttggccatttgaaatgagaggatgggaccatgtaaatgtatttccattttcttcaagaaatcttcatatgtgctgggctttgtagacaaaggtgttactaatgtcatcagtcattcccacctggaaaagtaacttggatttgtcttcttggtggttcagataggggtcacatctgcccacctctctctccttcctacctggcctgttttcttgttggtaatactgcactcataaaccaggctgccggacactagccgtgtgtagccacatctcgcctatgtcaaagtgtctaatgcaccactgacaccacggggcctctaatgaaccacttgtgagcgggggcaaaaatgactttgcagttggggaacctcaggcccagagtggctgggggtatagaaggcaggacaatattaggactagaaatagagcctaacccttttgatctccagtagaaaagtcctagaaaacttatcatttgctcaagatccatactcatacaggacttaacacctgcttgcgctgggggccattaataaaggtttttctttcttattttgacagctccaaatgaccacttgctttatagcaatcggtctcagatttatttcaccttggagtctcatgagaatgcactgcatgatgcagaaatagcatgtaagctccgcccgatgggttttaaggtgagtgtgggatggaagaggtgggaaggggttgtactgtagacaggtattggcaggaagggctgcctccctggagcataggggcactagagctcaagcagaacaggaagaagactttgcaaaggagccagggtaaagatccctgggcaaagagtgactcaggtctgcaagggagctggattcttccccaattcagtcttcaactcatgaccttcagagcagcctgggcatagtgactctctagaatatgcacttgggagccagactgcctgggtttatgtcccaactctgctaacttttatgacctttgtggccctgggcaaatgacttaacttcccagtacttcatctcctcatctgttaaatgggggatattcaaagcagctactaaagagggctgttgtgaggattacataagctaataatgtaaggtacttagaacagtgtctggcatgtagcactatataaacgttctctttcttcccttccttccttccttccttcctttctctctctctctctttctgttttctttcttttttttttttttttttttgagacagagtttccctctcgcacccaggctggagtgcagtggcgcaatctcggctcactgcaacctccgcctcctgggttcacgccattctcctgcctcagcctcctgagtagttgggactacaggcgcccgccaccacacctggctaattttttgtatttttttttgtagagacaggttttcaccgtgttagccaggatggtctcgatctcctgacctcatgatccgcccgccttggcctcccaaagtgctgggattacaggcgtgagccaccgcgctggctttttttttttgagacggagtctcactctgccactcacactggagtgcagtggcgtgatctcagctcactgcaacctccgtctcccaggttcaagtgagtctcccaccttagcctcccgagtagctgggatcacaggcgtgtgccaccatgcccggctaattttttgtatttttagtagtgacggggttttgccatgttggctggtctcaaactcctggcctcaagcaatccacttgcctcagtctcccaaaatgctgggattacaggtgtgagccaccgtgtccagcctatataaatgttttctatcgccatttttatcattttccagggacattagaaagaggaaggtgagagtggtgttgctgccctggtgctcctgaacctctactgataggctccttggcagcttggccagttttctctgaagggatcctcacactcacacaatggttgtgccatttcaagtccttaatatagtcagtcagcctgccagtatccccaaggatttaggtcacatggggggtgagaagaaaaacggcctggacacctctcaggatgccaggatgcaaagtgtcactttctgtatctttgcctggcttcaggactggccctcagccacatgtcagtactttgtttagaagattagatttgagcctgtgctctactacttgcaaaccatggggaggtggcttcactctctgaaccccaagtatccttgtttgcaaaatgaagctattgatatctgccctgattgcctcgcaatgatgcaatgagggtcaaaagtgaacgtggccaagaggacattctgcaagctataaagcttcctggatgtagtgctctgtctctacacaacccaaggatgccttcctcagaaaaccaatgtatccaagttcaagtccatgatcccttatctgaatcttgtaagaccagaggtgttcagaatccagaatgttttatattttgcaaggaccatatattaggtctcagtgagctctggacagcttcctgtaatccaacacactattcagcagattccatgaaaattcacactcagtgggacaaatatttttaaacactttatatcagtttaggtcaggttttgccatctaatgaattttgatgtcaagcttatgaaaataatggattatcagaacttttttggatctggaaaccagataaagcatgtggacctgtgtactgtgcaatgaatgtcaggtgaatcttgtatgttctttcttgagaaggttttcatgagtgatgatggattcatttttttttctgagaaggttttcttgagtaatgatggattagtatggttttttttccccaaagaacacatttagtgtttaatacaagtcaccagtgtcttaacccaaaggagctttagtgggggcactttcagcctcccagtagtgcaagtcagggagctgcctaggagtaagaggacttgcaactctttccacctccaccctaagcctagatcctagggctaaggaacttgatagtgtggtgagaagcagagctgagaagcagtgaagcattttggatgaaatgggaaaagtgacttctccagtgaaggaagagttgatgaaagtattaaataggagtttcatttccccatagtgatgaagtgagaggtgggggcagtgatgagataatttattttcttggaggttaagagaagacgaactgatgcctataattcaaaaccacctcccaccctgatttgcatatttcccaacatttctatgtaaaatgccccaagtgtaggggtttatctggcagccctattctctattccagccatccaaccagagtgtgtggtactcagcacatcctgcaggtgatacagctctcagtggtgtgagctggttgccctgagcaggtagagtatatgggttggccgggcatggtggcttactcctgtaatcccagcactttgggaggctgaggcaggtggataacttgaggttaggagtttgagaccagcctggccaacatggtgaaaccccatctctactaaaaatacaaaacttagccaggcatggtgacgcatgcctgtagtcccagctactcaggaggctgaggccggagaatcgcttgaacctaggaggtggaggttgtagtgagccgagatccaccactgcactccagcctgggtgacagagcaagattctatctcaaaaaaaaaaaaaaaagagtatatggattgctacttgataatatgattagtgggatcacacagaggcctttccagtctcccaacacttctcccctctagctgccctgtgatatcatgcaagcctttcccaaacacccttggtaaacactgctgggagaagcaacaagggaggccatcaacatccatgtatcagccaagacaaggcttcagaaggagctgggggaatgcggaaaggtcttcaagaggtttggagcaggggccactgctcaagaaggcagcttcagggcagcctctgcagcgaggccatagcctgagggctctggggcctgcaaagaggcatgttagaaaggggggcaggggagtatccagcagccacaacctggatcacttcattcactaagttaggcttagtactgccaatggaggaggcaagggagcaggccactgggtggagggacgtcctagatgactcaagtgaaatgctcttcaagccaagttgctagtgtccacctgtctcaagacacacacagagggcagccctctcccccgctactcttttttcttccttcttccccaggatgttcctctgccctccctagagtgtctttcccagagcagttgggcttgggccctgaggagccataaacttctttatactttctaaagtatgtggtgagggagcagaagtgatccaggcccctaggagagtaagctcagcccctggttagccctctgaagggcagtctgctttgtggagaagagcattctgggagtcctgagactgcagttctagttccagctttgccactagcgacctttgaggtcttggagaggtcagatcccttctcctgggcctcttctgaaaactgatcagttagtgtaggtgctctttcaagccactactgaggactggttctctgcttgagagactagttcaaacgaacgcatacctgggcaggccctgaaagctggttagcatgtggtcaaatgggggttcttgctacatttgatggtcactccgtacaatggtggggcagagacaaggtagtatggcagagtggttaagaatacaggctttggtatcagtcagtcccaggttcaaaccctgattccacaatttaccagctgtgttacactgggcaagttaacgtttttgggtttcagttttgtcttctttataatggcattagaacagttgcccgcattttagggctgtagataagagagtccttttaaaatgtttcacacaacagtgagtgctgtgggttagttattgttagagcagtagtgttaataggctgaataaaatgggattgaatgctaatgtttccttccaggcacatttcagaaaagcccaagccttagccaccctaggcaaggtggaggaggcactaagggagtttctctactgtgtatcccttgatggaaagaacaagagagcaagatgtgaagcccaaagagtgagttgaaatgacatcaggtccagctgcctactggaccctcccctctctgtcttatctaggaaggggagtgagggtgctgtcctccttggcatttggggtcctgagtgggtggttccctgggttaaggggacaaaagggagatgggagtgttaattgattgcccagaaacaccgtccttctggtgtgtacgatcagtttgggcagtttctacatttttgtaggagcctgtgaggaatgttcttgcttctttgactcagggtctggattgtcagtgggagaaaaaccaaaatcaagtacattaatatggggattgaggctcactgaggacattctggctgttgatgagagatccagggcatggggctacctgctgttacataacttttctttggctgaatcacagttttcaccagccacacatgacagccagcccctgggaagggacgttggtggtccccacctcccctatcaccatacacagaactccaaccttcagctcctttgctagaaataaaacacactgcctcacaaatgctagtcagagaccattacaatataatgcaagcagtcgttccaactcttgggtcccagcagaatgtggtagttataaaagaaaaatggtgtgaaatactgagagcattagtgaaggctcagccatcttcaattcatggactttgttgcttattgttctacagtttactctgctggtgtctgggtaatcggcctgtaagttggattctgacagttggcggttgtctctgctctccttgtgccccacccactattcaccgcggagccttacggtttctgtcccagtgtggtttggcagagcagtggataaagaaagtgagcaagagacagaactggtttctgaaggctctagaaaggaatagttagcaaaatcaatgaaataagggaactggccctggattttctgtctcacaaaagatctcctttctgggaagttgctttgaattggtttgagtatgtgaaaaaggtgtgcttgagaggagcacggttcggggagaattgcttcaagctgtggacccttctccaaatcttaagtgtagtccatgatgtaatgataataataatagctaacattcgttgagaatttcttctgcattatacactgtgctaggcattttatgtggagtatattatttaaatcccactacattcctgaggctaggtttggttagttatcctcaggttacaggtgagacagatgaagctggggcttgctgactttcccaaggtcatgcagctggtgattggtgggaaagtattcaaacccaagtctatctgcttccaaagcctggcctcttagctgctctgccatcctgcttcccatgaggacatggccacagccttagcactcactggtgaagctggatcaatagtagcaatggaactttccagttccaggatgaacaaaggcagttagaagaaacttatctttggggacggagcgtgcaaaggccagcagaggcaggtctcagacccaaggaggaatggtttcttgactcttgtttgtccatttcccagctagcctgagatgtttttggtgtcatcagttgggctgacctgtctctccagtctgcttttatagagaaactgttgtcatttccacagctgcctaatggttggaggcaaggcattgtgtgaagctctggagacccaaagaggcataagtcacagttttagtcttcaaggaacttaacaatcttgcatttgttaacataaatgccagatgatgcaagcgagtgtatgcccgtgatgagtgttacagagttctgaagtgagggcgagaatttagaggcgaatttccactgggtgtgatgaggccatggcggcgattcagaacatcaagagtcctcagttgtgtttatttactagatcattccagtttcagggctaaagatttgacagagatgatgcaggttcagttgacatttataagctgccttcgaactcacaggctgtgtttctttttaatgtttgtttttactgcagattctttttccctcttcttgacctatttgggcctttctaaggctgaggctgaagtggaattgactttcattcatgtggaatgatcattctcactgagaattgaccccaacttttgttttccaatgccattgagaaggcctagagagagatctcaagtagtaaaatgaagaagggaactgctgttattatttctgctttgtttcctttgatttctcccttggccttcttttccttcccaccaccctctgccctttcatccttgcaccttgtgatgctgtgtggctgccactgaagagtattatgctctttttgggagaattccaaggatactgcctcctcagaactggcttggtcctgttgagtcacgcattagggcttcagaggaccaaccttggctcctgtggaggagggacctctgaaagctggcatttatggccccgggtgctgtgagtacctccccatttaactcctgtgccaactcataactggaaagtgggtttctcagagctgaaaggaaacataaggatcaatctgaggactttgggcctgaatgctaggcctctccctgggccctggggtggataagtgtcttaattcaattccatccagtgtgatgagcatttattgggtatctgttatgtgccctctagaagctggccgtctggcaggagagaaaggcttacatctgtgacacatttctaggataacataacgtggtgttgttcaagatgctatattatggtgcactctctactactgtgtagaacaggactggaatagtgagggaaggtagcacttgagctgagctttgaaggctgagtggggtttggcttcatggcaagtgctggcatctgaaggaacatcatgaagagattgctgggggccagagaataaatcaaactggagtttggtgttctgtcaaattttgttgatcaattaataccctaactatgtaccctcagcacgggactggagcttcctttagtggatctccaaacactgcaggagctgctgggtggtaagcactggagcaggttttagaagcaaagtcacctgctctccttgtgttacatgtttcagtatatggaaacacacacacacacacacacacacacacacacacacacacacacacacacaatccttgctagtacaggggaaacttggggcaagaatgtggacagtgaatggtgcaagctacattagaacgcacgtctaccctcccagcttatccaattgcaagggaaaccagcaagagactggaacctccttgcgcctagtacttaaacttaacctaacatcctctgggaggcaaaggccagcataggggaggcgaggttgggagaagagggaggaagctggagttctgtttttcctaacagttaactgctcaggttcccagctttgaagggattaaagatccaggggtgatggtggggagaggaggaagcaaaatgggtagtggagaaaagaaacagtgaggatcctagaagacatttgtagacttctacccactgaggtattatgaacttcaaattccccaagtgaggtttctctcctgactttacctctctgtctctttcctcctagatgagttttaaaatcccactgcagatatttctgcggagtgttagcactagcatggtggctcttaaccttggctaggcaacagaggcatctgtagtgccttctcaaaatccagattcctgggccacactccagacctgggggagatgggagtacaaagtagagacctagatttttcataagttccccagttgattctgatgcccgctgaagcgaggacccctgccctggtgtggtgtgttagggacactggtccaaggcttcctccctggagttctgccctgcaagctggctccctccccccttcaccctcctccccttcacctgggcacctgtagaaacttaagtagtgaagtcttctgttttatgtcacagcttctccttagtttcttttcaccatcagtcccgggggattctcaggaacattctcccgatatcctgaagctgttggcacctcaccctagattaaaggaaaacgtagagtcaatgactactgaagttaccagccataatctaccaaggttgttacaggtaaaactcaactcacccagctcgctcgtgacgcttcgtttggctgttttgtgggcaaacgtggggagtgagccctccctctcctattttggttcctgagaaagaagaaattgagtcactagtggttctgttctttgcaaagaacctcttaaagatgcaactgtgaatttcaggcatggtcccagagtttattcattacattgaaaaaaaattatgaaacagggtctctttctatcacccaggctggagggcagtgatatgatcatggctcactgcagcctcagactcctggtctcaagagatcctcccacctcagcctcccgagtagctgggactataggcacgtgccaccatgcctggctaagttttttttttttttttttttttttttttgtagagacggggtttcaccatttttgcctaggctggtctcgaactcctggcctcaagtgatcctcccaccttggccttccaaagtgctaggatacatttttttccagttcttggttagatccagccgagagagattttacagagctagaaaggaattggctcactgcccctgggccataccatttgggtgggtttataggctttggggatgagtctgggaagagggcctaacaatccctcctttcgagcttttgtttgttcaagctgctggcctttgagtgccagcacttatcctgtgcaaagacaactctgatcctcaaatggatgtaatttcatattcctgcactatgccttatacataagtaagcttccaatacgtatttgtaacagagaagaggaaagagatgttggaaagaaagttgagttgaaggacctgggaggaagacaggtatttgtacctttctttgaaaaccaggaaacagaacacaagagagatgggttccaggccctggctttcccggcagagggtaagtggtcagaagttgaggatcagaagcgcagactccaaggcagagtttagcactgaatgcctgggcatctttagggggcagttttccctccattcatgcccggtgttcttctcctgtgtgtaagccctgggctctcataaaaggactgaaatgcaggtgcgcccaacttttcttaaaaaatggcagaacttagaggatctcctgaaatcacagaacccccagtgatttcaataattaagatcactattaaatgattgagaatgctaatactgaacccaaatgcctggagtgacttctaattgcagctccatctgaaaagaagaaaaacagcaaccttggctttccaatgtcaaccagctggggaacaaggattggatttccacccaaactttgctttgcaaagcagtatactcctgagtggccaatgccttgggttcatggaaagtcaaggttgtagtattgctgtagtgctggagaaaaccccaactcccaagttagacacagagaaaacccacattatttttgtcctcacctcattgttttctcccagctatatgctcccctttttcacctgtctgccagtttttttttggtagggttagagggaaacaacacgatgagtatcttgacctatggactatgggtttagattagagaggggttctccatgtaaatctgcataaacatgttgttattgcacttatttctaaatcctttttcaaatatccatctcctgggaaaatattcttgaaaaggctagagacattgttgattttttttgccaggtgattttgtctttttttttttttttaatgcttttcaccccaaatctagtaaaaggaatagtttgtaccttgttcatttgaccagtgtaacatacagacctggagcatgaggtaacttggcaggcctgtgaacagacctgtgccaaagccctaccaaaagtccttttggagctggagtttggggatcgcagacggccgtgaatggcagtgagggcgagaggaactattgagtgacaggatctgccgtcactgcctgccttggttttgctaaagtggttactggggaaggattttataggaaggggaactggtgcctatccctggcatttcccctttttacacctgcccaaggaggctctcctcctacataccttcctgtccttgcctaaggaagttccctaactccacccaagctgggaatgccttggttgcagatactgtgcagaaaagaagtaggaaataatgccttatgacggcccccaagttgagctctgtgtccactatgagttcggggtggggatcaggactctatagtttccctttgttcctctgggtaggaatatgagaggacaatattagtcctaagaagattctgatatgtggccctttcttcatccaggacaatctggagctcccacattgttctagtcaggaggaagcagcagccaggggagatggcagcagtctgatggacccagctaaagtgaagggggatggtcagcagcaccacatgaaagaccaggaagaagaggaggagaagtgggatgctacctctccaaaagctgcttccagcaagactggaaaatgccaggaaaagaaaaggaaacattgccagattgaatcccaagaagaaacggggatgcctaataaagcctccaagcaaggtactggctctacccagagagaaggtagcttggaggagatccccgggctcaccaatatatacaagttacttacctctgtctgggggctccttaggctctgggtgtggggcccagctctggcatttactagctgtgtgacctcagagattgctatgaggcttctgtgagatcatgtacagtgcctagcacactgtaaaaagtgttcaatactaattattaatataatggaaagccaaggcatcaggtcaagcacagtatcaactaatgacatcccatacccatggggatgccacttccttctaggtcagcctcttgctacccccatccccattctaggaatgcaggatgaggaaagtgaggtcaggcctcaccctgctcattcccagttgtgttcccataggtaggcatgtgagaagcagcagctgtggcttgctatctttccacgagaggttggcagtgccaagattcagttttagctttgaaggcctggctcagtccattgagttgctgtagcttctgctgttgacagaggtgcatgttgcatttgaatgaagtccccagggctcctggacattgtttgacttgcatttctctttctgttgggcctgctggaaacctctgagagcctacttctgagtgtcccattctcaacggctcaggtgtccactaaatcaactctctgggaggtggtggtgagagtggcaaactgaaaaacgcattggattattttgcctcagaagtactatctatgaaaccggggtggctccagcgctgacttcttgctttctaaatcgcagatcctcccactgatcagggggacaaacctgctctcagtttaccacttgcatctttcgacgcatctgaccttgaatgcgctctatgtatgaggtacgtcctgtgtactatcatttacttcctgatgtttcttcatctctggtgtctggacctttctgctagtgacctactgctgggttggttagcatgtaaaaagcatagctctaacggaatggaaatcacaacgttgattgtcacatgggtcagcttgtgtccccttcccagagactgcattccctgcattcctggctcctgacttggaaaaacctggagagtgggaagggaacagtctattcacaggtcacaaactgatggcccactgggctgaatatgtctgaatatgtcttttttttttatgtcttttttttggagacagagtcttgctctgttgcccaggctggagtgcagtggtgcgatttcagctcactgcaacctctgtctccccagttcaagcgattcacgtgcctcagcctcttaagtagctgggattacaggcctgtgccaccacgcttggctaagttttgtatttttagtagagacagggtttcacaatgttacccaggctggtctcaaactcctgagctcaagtgatctgcctgcctgggcctcccaaagtcctgggattacaggccactgcacccagtctgaatatgtcttttgtttggccctcatggggtttgtttttcttaaacgtgaatgtcttgagacaggacatgtactctccatttgaccacgcccccgccacccacctgccttattccaacctgtgtgtcacaattgcattacattcttagcccctagagataatttaaattttggatcccagcactaatctcagttacatgggcaagagctcaaagttcaaggactactgtcaccaccacagactattcttgggaagccaagtggtgggcctgactagcttttgttttgtgttgtgccatgaatattagtggtgggcctgagatacttagccaagtatctccccaccaaacagtgccacatcatctctactttctcagatctctggagaggcaaattattcacatgctcccccaccccaaaagaaagaggctatgattatggtgtgtgtaaccatacacaattttttaaaattgcttacatgtctttgatttcacagctgtgacttactggcttagaggagaggctccctgctctgtcatttactggctgttgacctggatggagcaagtgacattctctgctactgttttcttgtcagtaaaatagagaacagtgtacctactccatagggttgtcatgattaattgagaaaaatctgtttaacacctggaatagtgcctggcatataatagatactcagtaaatgttaactatttttttttccttgtagaccagaggtccagaaggaaactttgggtctatggacctctgaggatgttctatatatggattctaatagatgtattaatgtctcgaagttgtatgttaaagtatgtgggttttccaggacaaggtccacatcctttagcagattcacaaatgtgtctgttttccaaaagagcattaaaaggaggctgagatatttgcacaaaaattaagacggttggcaggctgctgttcgttgtgctggcgggtcctgcggggagggctgtggagctccagatggactaaagaacaaaccagcaatcccgagagggcccacagtccctctgaaggaagcgggttgcttctgcaggacccaggagacaccccaaatactctgggaggcaaatagcctcggtcgagttctcaagtccctctcactctcctcctggaaacagacttggagctgttggggagggcacggtggaagtgagactggcccttcagtttgcatgggagctgggtgaggcctgtgactgctgtatttccccaacttccctggtaacctgcatgactcagcaaaggcagccataatcctcctaggtacacaactccagtgacctgggaatctcacccccatcccccacagcagctgcagcaagacctgcccaaggagagtctgagctcagacatacctagccctgcccccacccaatggtccttccctaccaaccctggtagtggaagacaaagggcatataatcttgggagttctaaggccctgcccaccgctggtccctctccacactaccacagctgttgttttctggaaagcaccacctcctggcaggagaccaaccagcacaaaaatagagcattaaaccaccaaagctaagaagcctcatggagtccattgcacccaccaccacctccaccagaacaggcactggtatctatctactgagagacccatagatggctcacatcacaggactctgcagacaacccccagtaccagcctggagccgggtagactgtatgggtggctagacccagaagagagacaacaatcactgcagttcagctcacaggaagccacacccataggaaaagggggagagtactacatcaagggaacaccccgtggggcaaaagaatctgaacaacagcctttagccctagaccttccctctgacagagcctacccaaatgagaaggaaccagaaaaccaaccgtggtaatatgacaaaacaaggttattctaacacccccccccaaaaaccacactagttcaccagcaatggatccaaaccaagaagaaatccttgatttacctgaataagaattgaagaggttagttattaagctaatcagggggataccagagaaaggcaaagcccaatgcaaggaaatccaaaaactggcacaagaagtgaagggagaaatattcatggaaataggtagcttaaagaaaaaacaataaaaaattcaggaaactttggacactcttttaaaaatgcaaaatgccctggaaagtctcagcaatagaattgaacaagtagaagaaagaaattcagagcttgaagacaaggtcttcaaattaacccaatccaacaaagacaaagaaaaaaagaataagaaaatatgaacaaagcctccaagaagtctgggattatgttaaaccaccaaacctaataataatcggtgtacctgtggaagaagaaaattctaaaagtctggaaaatgtatttgggggaataatcgaggaaaacttccccggccttgtgagagacctagatagccaaacacaagaagcacaaagaacacctgggaaattcatcacaagcagatcctcacctaggcacattgtcatcagattatccaaagttaagatgaaggaaagagtcttaagaactgagacagagcaccagctaacctataaaggaaaacctatcagattaaaagcatatttctcagcagaaaccctaaaagctagaagggactggggacctatcttcagcctcctcaagcaaaacaattaccagccaagaattttgtatccagtgaaactaagcatcacttatgaaggaaagatagacattttcagacaaacaaatgctgagagaatttgccattagcaagctaccactacaaaaactgctaaaaggagctctaaatcttgaaacaaatcctggaaacacaacaaaacagaacctctttaaggcataaatcacataggacctataaaacaaaaatacaagttaaaaagcaaaaacaaaaaccaaagtacacacgcaacaaagagcacaatgaatgctacggtacggtacaccacatttcaatactaacaatgtaaatggcctaaatgccccacttaaaagatacagaaccgcagaatggataagaactcaccaaccatctgctgccttcaggacactcacctaacacataaagactcacataaacttgaagtaaaggggtgaaaaaaaggcgtttcatgcaaatggacacccaaaatgagcaggggtagctatttttatatcagacaaaacaaatttttttttttttgagacagagtctccctctgtcacccaggctggagcgcaatggtgtgatctcagctcactgcaacattcgccaccgggttcaagcgattctcctgcctcagcctcctgagtagctgagattacaggcacgtgccaccatgcccggctaatttttgtatttttagtagagactgggtttcaccatgttggtcaggctggtcttgaactcctgacatcatgatccacccacctcggcctcccaaagtgctgggattacaggcatgagtcactgcacccggcccaaaacaaactctaaagcaacagcagttaaaagagacaaagagggacagtatataatggtaaaaggccttgtccaacaggaaaatatcacaatcctaaacatatatgcacctaacactggaagtcccaaatttataaaacaattacgaatagacctaagaaatgagatagacagcaacacaataatagtgagggacttcagtactccactgacagcactagacaggtcatcaagacagaaagtcaacaaagaaacaatggatttaaattatgccttggaacaaatggacttaacagatacatacagaacattttatccaacaactgcagaatacacattctattcaacagtgcatgaaactttctccaagatagaccatatgatagaccataaaatgagcctcactaaatttaagagaactgaaattatatcaagtactctctgagaccacagtggaataaaactggaaatcaactgtaaaaggaaccttcaaaaccatgcaaataacatggaaattgaacaacctgctcctgaatgagcgttgtgtcaaaaacaagatcaagatggaaattaaaaaattcttcaaactgaatgacaataatgacacaacctatcaaaacctctgggatacagcaaaggcagtgctaagaggatagttcatatccctgagcacctacatcaaaaagtctgaaagagtacaaacagacaatctaaggtcacacctcaaggaactagagaaacaagaacaaaccaaactcaaacccagcagaataaaggaaataaccaagatcagagcagaactaaattaaattgaaacaacaacaacaatacaaaagataaatgaaacaaaaaatgttctttgaaaagataagtaaaattgatagaccattagcaagatttatcaagggaagaagagagaaaattcaaaaaacctcactaagaaataaaacaggagataccacaactgacaccactgaaatacaaaagattagtcaaggctactatgaacacctttatgcacttaaactagaaaacctagaagagatggatatattcctagaaaaatacaatcctcctagcttaaatcaggaaggatgagataccatgaacagaccaataacaagcagcaagattgaaatgataacttaaaaattgctaacaacaacaaaaagaagtccaggaccagacagattaacagcagaattctaccagacattcaaagaagaattggtgccaatcattttgacactattccacaagataaagagggaaccctccctaattcattctatgaagccagcatcaccctaataacaaaaccaggaaaggacaaccaaaaaaagaaaaccacattaaggtatgtcccttgtatgctgattttgctgagagtgttaatcataaagcgatgctggattttgtttaatgatttttctgcatctattgagatgatcatgtgatttttgttttgatttcttttcagtattatgttggttgtgggtttgtcataatactgaacggggaaaagttgaaagcattccctctgagaactggaacaagacaaggatgcccactcttaccactccttttcaacacagtactggatgtcctagccagaacaatcagacaagagaaagaaataaagggcatccaaatcagtaaagaggaactcagattgtcactgtttgctgatgatatgatcgtttaccttgaaaaccctaaggactcctctagaaagctcctagaactgacaaaagaattcagtaaggtttctggatacaagattaatgtacacaaatcaggagctcttctatacaccaacagtgaccaagcagagagtcaaatcaagatccccttttacaatagctgcaaaaaaataaaatatttaggaatatatctaaccaaggagtcaaaagacctctacaagaaaactacaaaacacaggccaggtgcggtggctcatgcctgtaatcccagcactttgggaggccaaggcaggcagatcacgaggtcaggagatccagaccatcctggctaccacaaagaaatcctgtctctactaaaaatacaaaaaattagccgggcgtggtggcatgcacctgtagtcccagctactcgggaggctgaggcaggagaatggtgtgaacccaggaggcggagcttgcagtgagcagagatcacaccactgcgctccagcctgggcgacagagctagactccatctcaaaaaaaaaaaaaaaaagcaaagaaaagaaaactacaaaacactgctgaaagaaattggagacaacacaaacaaatggaagcacatcccatgctcatggatgggtagaatcaatactgtgaaaacgaccatactgccaaaagcaatctacaaattcagtgcaatccccatcattcttcatagaattagaaaaaaaacaattctaaaattcatatggacccaaaaaagagcctgcatagccaaagcaagactaagcaaaaagaacaaatctggaggcatcaaactatctgatttcaaactatactataaggccatagtcaccaaaacagcatggtactcgtataaaaataggcacatagaccaatggaacaaaatagagaacccagaaataaacccaaatacttacagccaactgatcttcaacaaagcaaacaaaaacacaaagtggggaaaggacacccttttcaacaaatggtgctgggataattggctagccacatgtaggagaatgaaactgaatcctcatctctttgtacaaaaatcaactcaagatggattaaggacttaagcctaagacctgaaactataaaaactctagaagataacattggaaaaacccttctagacattggcttaggcaaggatttcatgaccgagaaccgaaaagcaaatgcaataaaaacaaagataaatagctgggacagctgggacctaactaaactaaagggcttttgcatggcaaaaggaacagtcagcagagtaaacagacagcccacagagtgggagaaaatcttcactatctgtacatctgacaaaggactaatatccagaatctacaacaaacttaaacaaatcagtaagaaaaaaacaatcccatcaaaatatgggctaaggacatgaatagataattctcaaaagaagatacacaaatggccaacaaacataaagaaatgctcagcatcactaatgatcaggaaaatgcaaatcaaaaccacattgagataccaccttactcctgtaagaatggccataataaaaaactcaaaaaacagtagatgctggcatggatgtggtgaacagggaacacttctacactgctggtgggaatgtaaactagtacaaccactgtggaaaactgtggagattgcttaaagaactaaaagtagaactgccatttgatccagcaatcccactgggtatctacccagaggaaaagaagccattattcaagaaagatacttgcacatgcatgtttatggcaacacattcacaattgcaaaatcgtggaaccaacccaaatgcccatcaacgagtggataaagaaactctggtatatatatacaattgaatactatgcagccataaaaaggaataagttaacagcatttgcagtgacctggatgagattggagactattttaagtgatgtaactcaggaatggaaaactaaacattgtatgttctcactgatatgtgggagctaagctataaggatgcaaaggcataagaatgatacaatggacttggggacttggggggaaaagtgggaagggggtgaagaataaaagactacaaatacggtgcagtgtataatgctcgggtgatggtgcaccaaaatctcagaaatcaccactaaagaacctactcatgtaaccaaatacctcctgtaccccaataacttacggaaaaataaaataaattaaaaacagaaattaagaagattgacccaagagaaaatataacaaaagtctttttatttatttcatttttaaaaataaagttaaattcattttgtttttgagacagagtctcactttgtcacccgggctggagtgcagtggtgtgatttcatctcactgcatcctctgcctcccagttcaggcaattcagcctcctgcctggcaaatttttgtatttttagtagagatgaggcttcaccatgttggtcaggctggtcttgaactcctaacctcaggtgatccacccgccttggccttccaaggtgctgggattacaggcgtgagccactatgcctggccctaaaaaagtattttcatacactacatggtgggatccagcgagcagaaactgctcagatatttcctcgccctttatgagcacatatgcttctcatatcgatcatgtgcatttgtattctgaatgatcgttgttggatgactgaaaacgagtaacacagccgttacctgaaatgtggaccttctttctcttaaaaaaaattttaggtgccagattttctcataagctttggcagacctgataacaaacagctcagcaggtggaatgttgaagcactcaaagcaagcctcccatgctgtcaggagttggtgtgggtggagtgggctagggtgggaggggctaaatgagcaggttcctttcactacttccctcaccccctcatgatagaatggcaggtgggttctggcaaagccaaggtagaagatagagaaatcctgcttccaggcagagcaatgggctcctgcaggtaacaccgttgtggctctaagcccatgatgtgcgctgtggagtagacttgacttagcctgctcagagaccaggtctttgttgtgcgtatccttcttaacactccctccaacatccaggggacaagaaatcaaacatacagactcatcctgtttgtgttttctctgaaaactaagaatcctgaggtgtaagttcttttgttcctctgctttctccctttcatcttgtttgtccttgaactcaacagggggctttggaggaggtctcaaaatttggtccaagaaataaacaccaagaggataagacccccttccagttggctcactcgaaatttaaaagccatcatttcccttatcctgcccctccgttctaagtgagacttcaaaacaaaacaaaacaaaaccctctgtgcctggagtagccattgcatacactgctaagttatagctggcctctcactgcttgatggtgataagaaacctactaaatctagaaagaactttggatcttgaggttctgaaaactgcagccattggtcagaagcatgtagttccctttccaacagggtttgtctataagttagacattggatgttgacagaggctatttcaaacacatgcttcagcttgaattatgatagccttgacaaagcttttgattccacctctccagtgtttttcttctctttcttgttgttaggaatatgattggttctcttattaccctcatgtgtccttgggggagagtgtctgagagtaaagaaagtgtctgaaacaatctgtggaggtcatgaaattagacatttgtactacttgtgcaagattttagtatgaaatccagtttcatggtgctgcattggtagaaaaacaagttagagtatgaatttgtatacacggattctagagagaaaattaggagaagcaggttgtaagttccacagggaaaagggtgaaaagagtgaatggaacaataatcggaggtgtgtaagtgaggaccattccaatctccaggtctcccttgctgaactgggggagctctgttgagagaagttaccccctaacttcaacccttaagaactctgctcctcaatccttagtggttgcaaattctcctttgatatttgcctcgtgtggttaccttagccattgggggccacctctggggctgctatggagcagaacttttggggtgacaaagacattttgagatatgcagtaagaatgtttgatatttgaaccagttatctaatggcccagtgacctctttgtcaattctaacaagaagcttcatatttaacctagttttagctactcaagtagcttggtgttaaggatcttgtcagttcactctcattctctctctctctctctctctctctctctctctctctctctctctctctctctctctctctctcactgtcactctctcttcctccctccctctctctccctatttctccctctccttctcccctccctcctctcctcctcctttcctctttgctctcatttgatagcaaaagaaaacaatacaaggatgtaactggtgggaaaagatagctatttccagacaagccaaacattttatctgggctgacatcaaactgaaagcatttattattgctattgtttactccatcactgtaacaatgtaaaatgttttttgtgtgaaaatctggccctgctctgatttataaatacctcttggatgtgttttctgaaatcgttacctaaagtggtaaaaaaattctagtcaagttctctctgtctctctctttttcagaaggagggagagaggagagagggagggaggaaaatgtgcatatgagtgtgtgcatctacatgtagatggatgatgtctatttggatgcagaaatacatgcacacatttgttgccgcatcatagagtgaagaagaaagatgggcttgagagtcagatctgacctgacatcccaaagccctgctacttaccagctagctgtgtgatcttaggcaagttattttaacctgtctgggtttaaattttctcaatagtataatgaagctaatcataattaccacctcttaatatacaaagttaagtattgacacaccaagaaatacagccagaaaaatatattccatctgttccagtcactttggctgtgcagagaagcagagtagccctaaatatagaaatgaattgagtattgaaaagtgtaatgtattctaagcatctgaaccctgaactatttcaaaggaataattatgcagcatctgtggccgcatttgtgtttgctaccactcagtcaggggcattttaatcacagcttttgctaagagattgctgtgtccttttgtgtgtgttttattcatctgctcactaaatgtcagtatttattgcaattaattagccagctatatctttgttattttagatagattacattaggttacattcttaaatgaacaataggcccaattgcaaaattctcaggaaaaatggttttgcatattagttgtagatacagattcatcaatcatcttcatcattagtaccatcaaataatataaggcattcagattcacaggactaagttaccaaggaaatgagatattttggtttggctgctctgataattagatcacagcagtggttccaaatcacacttttgaaaaacattttaaattgtgaaatacacacagtggaaaagtgcataaaatataaatatgttctcttaacaaaatattgtagagaagatacttatgtaacccctctcagttcaagaagtaaaatattgccaggacccaagaagctacccatatgcctcttcccaatcaggactatcctccctaccccaaccactatcttgacttttatcttgtttctctttttagctttactacccgaatatgtgtatctaggcgatgcaatctagttttgcctatgtaaaagctttatataaactgaattatccagaatttattatttcaatctggcttcttttactcagtattaggatttatccatgttattgcatataggtaaagtttgttcactttcattattgtataatatcccattatatgaatccaccacagtctgtttatcagttctcttatggatggatgtttggattgtatctagttaggggatatcatggacaacattgctataaacattgtttacatctgctggtgcttataagtgtttgttcattttctgttcgcttccttctctttttcttactgacttctagggtgtctatgtatgctctagatacaagttctttgctagtcgtatgtgttgcagataccttctcctactctggcttgcctttttgccctcttaatgacattttttgatgaacttaaaagcgcttcttcttgtttttttattttttttttattttgagatggagtctcactctgttgcccaggctggagtgcagtggtgcaatctcggctcactgcaacctccacctcctgggttcaagcgattctcctgtctcagcctccccagtagctgggattacaggcatgcaccaccacagtctgctaatttttatgggattttgccatgttggccaggctggtcttgagctcctcaccccagatgatccacccgcctcagcctcagagtgctggggttacaggtgtgagccactgcacccagccaaaagctcttcattttaatacagtcaaaattatcaatcttttcatttatagacagggtcagaattcattttttttaccttcaggtcataaagatattctcctattttatctttattttcttttatttgactaattaatttatttgagacatggggtgtcaaactcctggtctcaagcaatcctcttgcctcagcacccccgcctcaagtagctgggattagaggtgccagccactgtgcctggctatttcatcttatgaacgttttattgttctgcttttcacatttatttttacagcccacatggaattgatttttgcgaatgatatgagagatgatccaatttcatttccccctatagatagccaactctcctaataccatttattgagaatgctatttatgtattgaaaatctttcccccatctgctttgaagtggcacatttgtcataaatcaagaatccacgtctggatctgtttctgggctttctgttctgttccccgagtctatttgtccttgtgctagtcatatactgttttaatcactgcagctttatatgttctgtaatctggtagagtgagtcctcccacatcgttgctcttcagatgtatcttggctcttggccctttgcttttccttataaagtttagaaatcaacttgtcaagttctacaaaaataaacaaatgaaataacccattgaggttttttattgggacttagttgtttaatttctttcaatgaggtgtttgtagctttttccaatagaggtctcctacaactgttgttagatttcttcctggacacttgatttttaaaaggagttgcaaatgttatctttaagatgatgacatttctaatgtctattgctggtatatagaactataattgtgtgtgcacgtgtgtgtgtatttatctagtaactttgttaattccattcttattctaataatcatttgtagattcttttagatttttctaagttcaccatcatatcatttgtgaataatgacagatttgtttttttcctctccagttctcattttttttcttgccttagtgcactgagacctccatagtaaatagtttttcttttttaaataactttgctttttggccaatttgataactaaaatttattagttttaattaatttgttaaacaaattaactactttttaaacagaatcataaaattcaaaaagtaccaaaaagttgaatacatgaaaagtctctctcctcctccagacctccattggcttgttaaaaatatcccatttctgctggtctccttgacctgctgaatctggaactttagccagtggagcttcacaatgtatgggtttttttgctccacacgtaactgatatttgaagaccaatacagtaagtttgcctatgcagagattaatgggattgtgtaacacagtgatcctcaatcttggctgtacattaaaaccactgggaggcttaaaaaaaatttctgatgcctgtcctgtacactgggcctactgatctgaatctctgtaggtgctgtagtgggcatctagagttttcataggctccccaggtgactgggggaggcaggaaggagggcttacaaaggggcatgaggaaacatttgggagggatgggtatgtttcctatcttgattgtggcgatggtttcataagtgtgtacatatgtcagaacttatcaaattgtacactttacgtctgttccatttattttatgtcaattttgcatcagtaaagctgtttaaagataaagctgttcaggtgattctgatgcacagcaatggttgagaattattgttgtaatagaaaaggcacatgactgaagtggaagttggatagactttcatctgtcaacagttggctgtgcgcacttagacaagtaacttcaacccctgtggacctcaggttcattctagttagtgggttcagtttcttctcaagtacttttcagctggcatgttgcttcttctactcagtctggcagtgctggccaggctgctggtgcacctcctggccacacgagggagccgtgcagctggcagcctctgactctccactgaacactcttgtgaggtgaaaataggctggtcaggcaggggtctttcccttcttcctgtgctgctcctcttggtgagtgcaagccccactcctcaacggtcatcttcagctaccctcactcactgatctcgctgcaggtgagcctttttttaagcaaagcaaatccattaatttctgaaggtacagaacaaatttataaaaggattcccacattgctttgaaaatatcctgttctccccaagcaattaaaatagtaccaaattgaagtatatgtatgtatatatatgtatgtacacatgtaaatgtatgtatatatgtgtgtatatgcatcaatatagatccatatctagtctatatcagtaagcacactaacaatactattctcctgcccctatgaaaattatctatataaaaggcagttatgtttgttagaggtacaattttgatatccttcaggcattaacattgcttagacgaaaagaggaatcaaggttagcaaacggtttttttccatggtaatatgatgtaaagtgcttaaatgggtaaatgtgtaagagagagaatgtgtgtgcgtgtgtgtgtgtttgtgtgtgtgtgtttacatatactcaggtgaacaggttggctaaatattttcggaatggaatttatccagacactctgtgcattaatctctatttttcttggaccagacagggcaaaaaatctgaattccccagaagagatagactagaattgatgttacaaaatgatctagctatgccctaaactttaataaatgtattttaatccagctcaaaaatgaaaggcaaatgtttatctgaagtataacaatagcgactttttaaaaagaactcctcccccaccctaaaatattctaaataatgctttaaaaacttagctttgagtcactcttttatttttggtcttattgcagttttcttccattttgattcctaaatttcagattattctatgagccagtcacaacaccttgcgggcatactttttgcttaaaatgcctagaaagatgcctagatcacaacgcaaagtgtccattgtgcaaagacggtctttcacaggtaaatcaatatttctttcttgtttggtttaaatcagtatttctttcttgttttgtttagtttatttggaattgggcactaagacagtgttcaactggacccccagccacggcactgtggtagggcacattactccctcaaaccatctatttctcctgtcttctttttttttttttttttttttgactgagtctccactctcccacccaggctggagtgcagtggcgtgatcgcgggtcactgcaacctccgcctcctgggttccagcagttctcctgcctcagcctcccaagtagctgggattacaggcgcatgccaccacgctcggctaatttttgttttgttttgttttgttttgttttgttttgttgagacggagtctcgctctgtcgcccaggctggagggcagtgacgtgatctccactcactgcaagctccgcctcccgggttcatgccattctcctgcctcagcctccccgagtagctgggactacaggcgcccgccaccacgcctggctaattttttgtatttttagtagagacggggtttcaccgtgttaaccaggatgatctggatctcctgacctcatgatccacccgcctcggcctcccaaagtgctgggattacaggcgtgagccaccacgcccggcctaatttttgtatttttagtagaaatggggtttcaccatattggtcaggctggtctcgaactcctgacctcaggtgatccacccacctcagcctcccaaagtgctgggattacaggcatgagccaccacgcccagcctatttctcctgtcttatagccactgtccccctctccataaagtccttcaggaaaatgaggcaacatgcagctttttatgcagtgtaagtagggaaattaatttgtgttggaaacgaaagtattaaatagatgataaacttggatcctggttctaatgtcatcgtggcacctgatacactgtaatcttgagtaaatcttttgtcccctctaggattggactaggtaagccctgatgttcccttatcatcagtgtttattctgtggcttgaagataacagctccaaaggccccagaagaacctcacagaacttcagtgtgatccttgtccaacccatcaggagccactgtacctggaagccctagagcttttgcagaccgcagccctctaggacttccaggttctctaaaactaatcacacaaactcccacctttgtttttcaagtgaacctgaaggaatttcctacagataaagaagacctgagaatctatcttgttttccctccctcagggacttatctgccacattttacaatcggtgttaatgttccttgacccctgtcattcctgaggagaggttggagatgcaaggctatctctaggtgactacaggtcaagagaagtcacatgttgagctttaccatcaccccagtatttaaattaagggaatggagtgaaatcatcatcactggtagccctgagggtatgcgttgggattgggaggagggtcaatgtcatacctttccctggataaagttgtaggatttgcaggcctgattgtaggtgagaagtccttgatccttatactgaaataatacatctgtgttgttgtagcactggaaaattcagattaagtggaaagaagaaaaatctacccatatgctcagtacctagagaaaaccactgttagttaacattttagtatgtgccttttctggctttttgttttagtatcagcagaggagtcacctactttttagactgactacctcctcagtcaatgcttatcccccacaactgggactgggaaatgcagttgattttcccatagccaggcaatggcagtgacagtggcagataaggcatcctggagacagatgctatagagttcaggacttggggtctagaagatattctcatctatctctgtttattcacatagggtcacacttgcaccattttacatagaattaaatattccaatcattttcactgcagaatagagacacagcccatactgagaaaggaacaaaattgtttgaagccaacagttttatactcaggcgctccccctgctgggactgtaggggtagtttccatagcaagcaattctctgcagatgttttaacatcagttgtttgattcacaccgttaaatacccactacctaaacatccctgggtatgcatcggacaggggtgtttgggaggagagtaacagtgacaattgagcctgagtccagttcttgaaatcatgacttttaatctcagtgatacctagatggtatattagaaaggcaaatagacaaatcaatatttagctgtttgtgtttttttaaactaaaattaaaagagaaaaaataggtatatttggcaatatccagaagccaagcattgggttaggctgggagtgggacagggcaggaaaggttcagtgattgaaaattgctttttagttccctgaaacttttggccactaactttgagcatatcccagatggagacaatttctgtgagcttgtaaatacaatcatcagaaaatggaaagggaagaattccccccaccctactttttggacaagaacatgatcttgatttcagtgtttcagaaaaactgtgagagttttaaaacttcaatgcaggttttacccccttgttaaaaatttttttctaattataaagataatcaattgcatgtgtgtttttttaaatgaaactaacatccagaaaatacatatattatgatggtaacagctgctaatttgtgggtccagattactccaatatgtgggtcatttgacttgttcactgattacatcagaagtgttttgctgattgctacgtattacctaattgcatattgtctaattgcctccccccatgtagtgcttggcatcaagaaaatacagcaaaaatgtaataatggaggagctcatagctaaattccttccagaagaactgaaggaacgaaggaagctttatgaagaggaaatggaagaactttctaagtatgtatatgcatatttctgttttgtttcactcataccagctcaatgagagctgaatgtgcacattacttcccagcttccgacttagtgatgtcatgctagctgcttgaaattggctatggtgagagtatttacaccatggaaattggcaagtgctacaaaccagggtttccgctgcacccagagagccagttgttaaacataccagcataccactgaagaagcataagcgaaaccagtgatgagggtacgccctgcccccagtaacagggtattgttggcaagagtaaattggagtagcataaacaggggaacttaacgaaatgtccaaaagattgttttcagatacataaggagttgctatgaggttaagaactttggtgtcaaccagaaccgggcttaagacccagttctacctcaaagtgagtctacttcacgaccctaggcaggtcatttaacctttctgggccttagtttccttatctgtagcttgagaataatttaataacttgagttcttacctcatggacttctttttttgagattgagtctcactctgtcacccaagctggagtgcagtggtacgatcttggcttactgcaacctccgccttccgggttcaagcgattctcctgcctcagccacccgagtagctgagattacaggcatgcaccaccatgcccagcgaatttttgtattttttagtagagacagggcttcaccatgtttgccaggctggtcttgaactcctgaactcaagtgatcctcccacctgggcctcccaaggtgctgggattacaggcgtgagccaccatgcctggccacctcatggacttcttatgaaaatcaaatgagtttgtgcatagtaagcacttaattaatggtaataatactaatacttgtcaagcgctttctctgccgtgcacaggtaatgtgagaggtgaaggggaggggcagaggcgtcattgaggctctcagcactctgcctggctgtaagaacagctcccttagcagaaaaagcaggaggcaatcactaatttctgcctctcttgcttctgccctctcctccctccatccgcagtagaatcctaacagcattccagaggcaaggttcctgacagcaaaaatggttctggtttcatgcccactgtgtagagaacattcgtaaactctgccagtggcttgtttgaatgcactcctcacttagactaatgcttttctcagaaactagaaatcgttttttttttctcattaatttacattggaactactcgggggatctttatctttatttctgatctgtaaattagcattgagcctctctgagccctcatctcaaatctcatttaaggtcttattaacaaatactgagatgtattagggctttctatgtaaatgaatcctgaacttgatccttttgagatttgggcagttggtcttatatttcttgataggtttaggttcagatgttcctgtgttggatttactagacaaataagacaaggatcccagaagagctggctctgttttggttccccaacgggttgtgtgtgtgaatctctgggggtacttattgaaaggcagggccgggcatggtggctcatgcgtgtaatcctagtattttgggaggcagaggccggtggattgcttgaggtcaggagttcaagaccagcctgcccagcatggtgaaaccccatctctaataaaattacaaaaattagccaggcatggtggcatgcacctgtaatcccagctactcaggaggctgaggcaagagaattgcttgaacccgggaggcggaggttgcagtgagccaagattgcaccactgcactccagcctgggtgacagagtgagactccgcttaaaaaaaaaaaaaaaaagaaaaagaaagacccttgggtcccaattccagagctaatgcatcagtatctctggtaatgtggtgtccaagtcatcttgattgaagagcccctgttgattctgatgcaaagaagcatttgagcatcactgggctggattattcttgcctatctcttggtccttcctcctttcagctgtgcctcctttgcagactctttggggtccttgcaaatttgagatgccctagggaccttacagagaatttcccaccacccttctggagagctgagtccacttctatcatcagcaaccttccccatgcagcctgaaaaacacctgaaaagattgttttgagtggagagcatgaaagtaagaaaaaatatgaattatagctatcatccacaatattaagatactagagaacttcttcagccaaattaaaatgtgtagaatgccaattttaatttcttagaccttaggctaacctctgcatcagatcatgggactcagcccacactatcaattgcatttcaatatttttctattagccatcaaaacttgatgtatctttggcaagtgacactgtcaaaaaacaaacttggtgtctctgccttcccccaggggtatcacatgctaacatttgaccaatatttttgtgttctgtccgattgctttgagatccctgtcattttctctttctgacagccttaataagaatgtgcctattttcgtgtgtactatggcctatcccaccgttccttgtcccctgcacatctttgagccttgttaccgcctgatgattcgtagatgcattgagacaggcacgagacagtttggcatgtgccttggagatcctgtcaaagggtaagtgaggagccatgcgagcaaagggaggttgtgtaatgagggatttctgttttactttggggtactcccaggagacagggaggcctagctcatgaggtttagccaactgaagaatatgagcatttgtaaggatcattgtccctttggtggttagtttaccatgtgagaggctgtctatttaaagaaccctagaattaatatttggttaaacaggtggtatatgttataaaacttgtaagaatgtgggccttggagtcaaactgcctgctttcattatctagttgcagccttggagcaagtttgagtttgagcaagctatttaacctttctgtatcccagtttccttatttgtaaagtgggtacaataatagtacctacctcattgggtttgcttggaagattggtgagttaataatgtacataaaatgctgagcacagttcctggcttccttagtccattttgtgctactataacagaatgccacagactaataatttatgaacaatcaaaatttatttctcatggttctggaggctgggaagtcctaggtcaaggtgctggcatctggcaagggccttcttcctttatcataacatagtggaagggcatagcagaagggcaacagagagagagagaaagaagggggtcaaacttgcccttttatattaataacaaccctactctactttcaccatatcagcattaatgcattcatgagggtggaggcctaatcacctcttaaatgtcccacctcttaataatgttacaatagcaattaaatttcaaaatgggttgtagaggaggcaaacattcaaaccatagcactggcacagcacatagtatgtgctcaataaatggtagcagttacacgaatacattacgaattttttttcttcacacaggcactgcctgttgtgtaattgaagctgtaacccagggacaggaaaataggcagaagtcccttgagccacagcatggggctacagaaatggctgggtgccagcccagggaaacagaactcatcaaggatctagtctctcgactccattctcaataaacaggtttgcagaatatggctgcatcctagagatcagaaatgttcaattctttgctgatggccgctcagtggttgacagcataggcaagaggcgcttcagggtgctccatcagagccagcgggatggctacaacacagccgacattgaatacattgaagaccaaaaggtaagggtggccagtgccaagaatcccaaagccaggctatccttgtaacttgatacacaaagatagttgtgaaaggatttctcagaacccttgagggccttgggatttcacaccaaattgctgcagcaacattgaatgctgctggattgctgtccagttgcactatggcagtgagggcgcctactgtcctggctctgcttagctgctgagttgcattcatgcataggaaatgttatcctagatcaaccctggggctcattcagcttgggagttaagtctctgccaaagattgcaaggaatggatctggggtgggtctatacatatatattttatctatcgatttatgtatattttaaacttttttcttttgagacaattatagatccacacatgcatttgtattttaaagtacgtaacctggctaagagcccttcccaataatccatcatcccctaaggcagaaagatgacacatctagttaatccttggttttctgaggtaatgggtggaagaagaggtaaataatcctatattcatttatatttacatttgttacatagtagattaataaatatctgatgactgagtaaatgtgtttgaccaagatagttacatgctgagactgacatactcctgtgtcttttccagcaagtaatgagaaaacagatgtaaaaatgaaaagggcaaaggcatggaccagcataacctggtttaaccacatgcctccactcaggccggtttgaatctctggttttctgcatgttttgctgtttcagctaatctacccagctgaacctttctccttcctccatggtcagcagtatctacacactgtccagcacttgactaaggggcatttcacatcaagcaaaggagaaagctgaatgggtgagccttcccataggaaggcaggatggatgctcaaagcgaatcaggtgtcaaaagtgactctgggaatgatggagagggtacagaatgtttcacttccactttgatactttcaggttcagggagaggattgtgctgagctcatgggattacataactgtgtctatcagcaagcatcattgtggtttcattcgctcaaattatccctaaagaatcggatactcaatcactttggtcccatgccggagaaagacgccgatcctcaggtatagaaaaatgtctatttttaaacgggttgtcccactagaagagagtgcctagtgtttgtgattagatgggtatgtggctgccattcagcacatcgaatgcagagaggaagatggatttaatttggtgttgtttggctgcacagtgagcgtcatgagtaagaccaaaaagatcccaagttagaatcggggtaactaaagtaaagcagtaggaacttggatccaaggcaggttttgagaactaagtaagataagagaatgggaacatagatatcaccaacagaagaaccttccatgggagtccagattcacaccatggtagtgttagggtgacaagttacatgcaaaggccaggacttaagagaagggtatcctgggagctgagaccaaaagctgctgctttcaggtaacttcataaccctctccctcattgctttgggaactaggggatagggccagctacccttataagattacaactgcaagaccacaaaaacttttcgtgcctcggtctatctatgcttcgccctgcaagtctagacccttgctattgtcctcaccagggctgaacagctctgttcatcattaaatactgttagttgagttatactagacagtagtttgttaggttctactgatcagtgttcttcctgggggataggcctatttgaaagatcaagctgcagatcagaagctccctaggagagtggagatggttaagtttcactaagctttgcttgcctggaataaatcagggaatactgtctttctaggataaggctggagatatcctaaccacatatttcctcacgaccatctcttcctatgctccaagctggctctcctacattgattctttacttatgctcatccccaactctgtcacaaaagaaaaaatctcaatatgcatattctgaccaaaagtctggtcctgcttacctcactagcagtatgaccttgggaagattcctttccctttctcaacttttgtcccatctctgacatgaggagggttctaaagccccctcttcctcttgcattctgaggttctaagacaccagtctgttccctaaatgaaatgtcttgctttcctcagaccacaaaggtggcttctttccccccccatgcaaaggcatcatgagttttcaagggagaaaggccagttagtgcttcctgtgacccagctcctggctctgggccacgatgagtcaggactgcagcatatacctctgagcaaactcacgatcaagcttaatgttccccttcaccttccgggaagcgttctcccttaggcaaaagatacagatcagcaatggtaacgggaaaacacagatgctacagtgtgattcataaaggctaatgacagagaaagttgaaatcttgggtttcacttccttttttcttagttctgttattatgttgctttggcagcagcagcaccagcaaaaaagaaaaacccatacccatcccagtttgctccagtcaatgctgcatccccagtggtcccacaaataagcatgttctgtcaggaggatgtttcttagaaactgccacaagtgttaataccagcttaaatatctttgttggtgatccttggaaagaaagttcagaacatcagtctaatattcagaactgatcataggagggagagcatattgccagcttcagggagggacaaaaaagaatgcaaatgaagttagaggcacaaagaagcaaagaaggcagtgagatttggtgacgatcagaggaaccaatttggagccaaataatttcaggtgtaggcactttgaccagaatggttctctatagtcctaaaaccaaacttgtgaaagttgtgggcagaaagctcgttttaggcttagaaggaaataagtacccaatgtctaaaatatgtgccagggaagctgctttggggaaggatttatgtggaatgggaaagctctttattaaaaggaaatctaggggcagaatatatttctttctttctttctttcttttttttttttttttgagacggagtcttgctctgtcgcccaggctggagtgcagtggcatatctcagctcactgcaagctccgcctcccaggttcacgccactctcctgcctcagcctccggagtagctgggactacagaagcccgccaccgcgcccggctaattttttgtatttttagtagagatggggtttcgtcgtgttagccaggatggtctcgatctcctgacctcgtgatccacccgctggcctcccaaagtgctgggattacaggcgtgagccactgtgcccggccctggggcagaatatatttctaatgtgaatgttttctaattggaatttttgcaaagtgagattgtgattctttgggactgtaaatcatagcctttggtttcaggggagaagagagctatggccctgtatagtgacatggtatacatggactattgccttcagccacatcaaggaaatgaggggacttaaaagacatgcaaaggtcaaggggtcatgggaatcgaaggcctgaatgttaaatgcatcagtccaaaggacctcaacagaatattagaagtggaagagactacatagtagataccagcttgtaaaatcacattggctaggaggcatggtgtatctgttaggatactggttggtttgctttaacaagaaacaaaaatgactggagcttaaacaagatggaggggctaagtcttggacagttagggcagctctattccacaagagcattcaggcacccaggctccttcatcacaaaactctaccatccttaaaatgtctccctcatcctcttgattgagaaaggctgatcctcaccacgtccatgttctagctaggggaaagggagagaaagaggaaggcagagggcatatgcttctttcccagagcatgaccaagaggttacacatatcacttccctttacatctcattagccagaactttgtctcatggcctcacctagctgcaagggaagctgagaaatgcagtcttttttctgggtggctatatgccctgctaaaataagggggaaaatagatatagggtcaattagcaatctgccacatggagttgttctacctggggtctttaccttgagcatttggaactctgcagactgatgttcttggatgggaataggatgactccattgtgtttctctgttgcagatgaacccgaatggcccagcctggtgctggtggatgttagcagttcttcccttggaaagccgagctcagctccccttcctagcaatgaggtccttaaaggacagactgaatggtattcgacgagtcctggccttcatatcccgaaaccaaaactagtgagtggattgccgaagaggagctcccaccttccccactgccgtcggggggagtcttcttgtaaatatatctaattgcaataatatcttaacagaagggggtgtcaaacagaggcatcagcctgctgttgatcacagagagaaattgagtagaaagaccaaaagaatgtgacctatttgaaactttctgtcttaagatgcttcttgacatgctgcataactacataaacagcagaggtgtttaagagcccagaaaaacataatttgattttaacattaaaatttccaaaagtttaaagtggttttgctttaatattctttctttcatagatcaatgactgtgtggttgaaatgtgaaaacaaagatactaataatgttgctgtataatttcactgacttgaggtctcattccaaatggttcaggttttatagagcattgtgtaaaat

SEQ ID NO: 1279 - DNA, 43577 bp, mus musculus; identical to SEQ ID NO: 1278

SEQ ID NO: 1280 - DNA, 43577 bp, mus musculus; identical to SEQ ID NO: 1278

SEQ ID NO: 1281 - DNA, 43577 bp, mus musculus; identical to SEQ ID NO: 1278

SEQ ID NO: 1282 - DNA, 304 bp, mus musculus
ctgagagagggaagagtacagaaggcagtacacaaactcaggcattcattttagtctcccagtccaactgatcaaaatcagatgtgttaaggttaaggagctcagttttttcttgcagacatttatttattataaaaaataaattttatttattttttagagacagggtctccctcctgtgttgcccaggctggtctcgaactcctgggcgcaagcagtccttccacctccatttcccaaagtgctgggattacaggcatgagccactgcaccgggcctgtggatattttagaatacctgcttt

SEQ ID NO: 1283 - DNA, 4976 bp, mus musculus
tgggggatgggcgggggtgagaagaaagggggggatgaggggaggggaattcctgaggaatcactcaagacagcccagccctgccctctgcagcggcgggatcaacattctttgaatttgattgttactctgctccaaatgcacggaatgtgcatgagtgtgaaaagggagtcaggggcaggagtgagagcgcgagaaagaaacatccagcgcgagcccgcgcatcttctgaagtcgcgcttttcctcgcagggcggaatggagggggaggggcacccttcgactcctttccttatagaaactgggggacagctaccttcgggcaccaacttggctgcccctcgaagctgctttttggtagttacaaaaaaaaacaaacccagtccccctcagctgttaggcaccttcccaagccctgtgatttcactgggcggagaaattaatttggagccctggagagcgggaggggattgtaaaatcatgatcccacctaatcttttaaaattcgcctcggatacacttcaatcaaatcgaattctctctttccaacatactttacattctgcaaaatccctctgtcccgcagttcctgccatcagtctgctcaggtcttctccgatgaatttgcgggaacatctcgagtggagggggcagggagaagatcgaaccccctatataatctccctactgcccgcagaagactcagtgtcaacaaaactcgttcaccggaggggccccagaaagtgttatctcctggatggtggaaagatccgtatcctcaatggttttgcatattcagtataagaatttgctttttcatttttaagggcgtagttatttacaacggggtacaaatgaggccaaggacttggtccgaatcccgagcccagcagtaccagactcccccttactcccagctcgcgcgcgcgcactctttctccaacacacacaccacgcgcacacacatacagagggagagggagagagagagagcgcgagagcgagagagagcgacagcgagagcgagagagagagagacagagaggtgggaatgcactgcttaccttggccagctgtggcgccaacaacgcagccctggctccccgacgccaagctgttgcgcttcgcgagggagggcagagtggaagagtgctggggttccgcagcgtccattcccgctgcggacgacaaccacctaaccacctgcaaatcaagccacagcgccccgggcccgtctgccttcggggagtgggctggttggtggcccagggcttaaagagtcgctacttggcgcactgctctgtgggttggggaacaagatgaagagctttctttcttgggctcccaggggccctcagcgatcttgtgtttctcgaaaggtctgcgcaacaaacagctgagtgggcttcgcccagcccagtctccacactgcgggaaaggaatcataaatcccagatagaagcggagccggcgccacgcattccactttttgaagtccgcagaccgacggcactggcaaattcctgagtccagtgctaacgctgggtttccacagtttggacaggggagtctccccggagttccctggccctggtcccgcacagtccgggcctgaatcagcgtctaggctacttaggagctactcccacttagctctggcaacaccaccttcccttgcgtggggggaagaggacagtgggtaggtaggttagtgtttcagcctccaagggcagcatttctgaggggactccctttattgtcaagacacaaccgcaaccaaaacaataaaatttaaaacacgcagacacactgcaccaaggtgcctgcactctacgcttgctggctgcctgggaatagagcagtgcgtccaaggctcagagtggagcaggcgctttgcaattaagaagatggtaatttgactccagtgtccccccatcccctcccagcaacccccttctcccttttggcaacaccgcccccaggcgcaaaggcacctctactacagtagggcattccttcctcccaaataacacatttgtaattcgcgggcggcctcggatgttctccattcagagaactgtctaaagtggggagggatggatttcagcgcctttaaggaaatgtttgggagattggcagggtcttgaggcccttgtgtgggcagccacttgtttctagggatactcaaggctgggatatccggggacccaccctgtgtggcaaagctgactcaggtaagcaaatcctaatcggttcaaaagatcaacccagagaactagccaggcatcaacaacaccgtgtacaggacaggatactgggttcccaacttttctgtgcccaataaagattatacaccttatctactctcttgggagaggataatcaagaacgtgtgcaaggtaaaacaaagtaacagagacagcatcctaccttctagcaactcacatcttggttccctcagatacacaatcctgggactggcagatatcatatgggttgtggaccagacccacggttacaattgtaatggtaccagttacaattaatatacttattgagtaaggtacctgggaatttagggacatgaataagtgattaattttgatcaagaaaaactttttggaggaggggaattttgagcatgtttcaaaggaagggaggcacccaggttcaaagaccgcaatgcagatgggggctctgaccagggggaatacccggatgagagaaaagctggttgtttttggaagggtggagatagcaaataattgggtgcttctagagctaagcatcctggtcatcaggaatctggggtggaggtggggcactgcagagagggagggctgcagtagttctgcagggaggctgctgaggaggggcaggcaaggccaatgaaaagatttcagactctctcactgctgttggttgcagaggtggttgttgtttaagcagaaatatactgggtgccaaggagacagagtagtgagagatattgtagttttcacactagttagccagaaggcttttaatttgagggaaccctcaggtgtaccctacattaaaaaatcaattctatgagactagcccatatttattcacacaattcctcccacatccttcttgattaaaagggaaacaattctgagatgttgcctcttgtttattcaacaagtaccgattgtttattaggtatcaaacactaggtataaatcgtaataggcatgattttcatatacctgctgctttatttaagtacctcctggtgcctgagtttttttacgtgtcactttactaaacaaaatcagaataagatggtcctgtgtttacagaaacatctaaggcaagccccaaattgtaccagaataagaacacggctgtacttctcccttctaaaataaaacaaccaccaggaaaatgtcctaagcagacacaataaactgccttttaggagcctgggccacaccttcagaaaatgggtatatcttgctctaagtagatgtgaattttattgagtcgaattgacactaaagataaattgaggggtgattcttcattttcaaaacgagtcaccctgggagggggttttcttaaaacagtcaattccccaagtgcaactagaaataatttcatgttacacaattatggtccttataaaataagtggtgacagggaaggacgctcgtgaggggacagagattagatattcgacctggtgatcagagagttttcttaggaattttatccaaagcaaatcctatctggagtcaaggcccctgtggggctgtgggatatttgcctgggttgctcaagtgactgaattttcaattcaggttctaaagcaggaaaaaagattttcaaatgacactatgtggtttgctgagtcacttttctgacctggctcttcctgcgcttttaaaagttagagtgatatttgcaaagaagacccaagagctgtgaataagattaaaggccagctggtggggaaggagcaggcaaatgaaacaaacaaacaaacaaaccaaaattaaaaagaccatgcatgcacacacacttctccaatttagtctgtcaggttacatgttttctgggtaaggtgttgagacacttccatatcacaaagatatccgtggtgtatccaaatgttctctcactctcttttgccagtttggggcaggggagggctagagattgtgtgagtgacaaaagagaagggaagacaagaatgggaggcaatgttggtaagtttatgttagagcccctctgtagaaccaactcacagattcactgagaagtatctatcatcaaataaacttaggcaccctggtttagagactaatttagggtccctcaaaatcaagaggaaggataactaaacttcaggtaaccagaagaaataaatcctggccttcccccaaccctctactattcctttcccagtaccatgcagtccagagctcccggctttgctcctgtgtttaccattagtcagctcccatttgcatccctaatagccctgtcatgaaagggccccgatgttacaggtgtctctagtgggcctttatgtttttgtcccatggaggctggactcaggtctctttaaagatgagtctcatttgccaactcttcttacctcttccccagggtgagacatggtgctttagcattgtagatgcctataaacgttcaaaccacttctacatttcaacgaaaaatagtcttagattagtcccatattagaaatgaccctgatgagtcacatccctcattttcgaagctgacgtcaggggagaccgcctgcccctcccacctcccttggagacttcagcagggacagtactggggaagacaggatggatggtggggttaagcccgggtgatactcccagtgcttttcttccatacaggaggggatatctgcagtggactgcaaggccagccacaacccctcccgtctcaccaccaccttgcctcctgggtct

SEQ ID NO: 1284 - DNA, 4976 bp, mus musculus; identical to SEQ ID NO: 1283

SEQ ID NO: 1285 - DNA, 22650 bp, mus musculus
ctcccccgccccccgggcggctgcagcgcttccctcacccccactccctgaggttgacaccgcccctccctcggcgccgcgtgaccggaaatggcgccatctttagcctcttgtgctattgacaataacaagccctggttctttccccctccccctttcccccaaccacagcctctcccctcccagggagagggagaaaaggaggaggagctgcagcctcacagactcgctgagtcgctcctgcagaaagggggggagagagatcgaaaagcaggggagggggacggcacggccgtttacctgtctgcctcctcattcgctctcccccctcgttctgctcactcctggtgtcagcctatccgccttcccaaaccctcccattcccccggtgtagccccccccttcactttccttctcgtcctctgtgtttctcctctcttctttcttcccttccccctctagcattgctaccttctctcctacacgcacgcaggcatataaacgtaggtttttgatgctcctctgcctgttgaccccgctattttcatgtttccaacaggtttttcttcccccagtccctcagctgctgctgctgctcaggaggtcagatctgccactgatggtaataccagcaccactccgcccacctctgccaagaagagaaagttaaacagcagcagcagtagcagcagtaacagtagtaacgagagagaagactttgattccacctcttcctcctcttccactcctcctttacaacccagggattcggcatccccttcaacctcgtccttctgcctgggggtttcagtggctgcttccagccacgtaccgatacagaagaagctgcgttttgaagacaccctggagtttgtagggtttgatgcgaagatggctgaggaatcctcctcctcctcctcctcatcttcaccaactgctgcaacatctcagcagcagcaacttaaaaataagagtatattaatctcttctgtggcttcggtgcatcatgcaaacggcctagccaaatcttctaccaccgtctctagctttgctaacagcaaacctggctctgctaagaagttagtgatcaagaactttaaaggtaaccaaggccaaaatccataatcacctaataaggatttgacactcgaggggtcacgtgctctatttatgttaatatattaaacagtttggaggtggcctaatgttttatgcataatcaatgaggtggaggggaggtccttttttggtggagggttcattttccgggggtggttaggatccttgtgctgaagcatacaccgggtgtttctgtgcagtattttgaggtctttttcaacctattgtatttaatctgttattccttataacactgacaatcggtatgattgatccggattttgcaggtgagaaatttgtattctaaagaggtttatttatttcaggtgcatagcgagccttggcattgctgggatttttatttttatgcttcagtaggccacattatccaatgcctagaaatgcaggtagcaatagtgatctttttatgctcaaataagatttataattagatttatactgtattcatgaaactcatttggaaggaatatttgaagaaaaatttatgttctctgcatttctttccaaaggtagggtttgaaagtgaaaaacattgtgtatacacagaagtagtaactctgtgtaccactagtctaaagataggaacaattactacatctattttttccatcactaaaatggattttaaagtatcgacctgcagcttttaggaaaatttgttcagaccgtgtttgagatatgtgaggagagtattatgaatacattgaggcaaatataaaatcagcaatttttaaaaatgtatttgagctgaattaatttttatttgttgaatgtgtttctgtttttctgacttactttttcaacacccgtaactgccaggtaatcagtgctacagtgtttattaaatagagaagtaaatgaatgaacttaagtaatatttatgagataagtgctttgtggctgaatattagtattgagaagattaggttctctatgcttgtgtttttaacattgtgtggaaatcaggagtatgctctattttgtctcaagcagagggctatggtgttgtctatttttaaccctttcttttttatatcactaccttcccatacccaggctctcagtttctgatttaatagtagagctttctgaagtcaatatgaattgtaattgagtaacgttttcattatttcacttaaaaatatatggattttgtagctaaagatttttaaatgagttatgatcctggttgcattttcaaattggtttcagagatttttttctctccctcctaaaataaaagcatattattaaggcatttggatattctaattaaaacttttttccccacactcattgctagtcagtgaagtttaaagcctagagtaagatgtttctttctattctgaaaatgcaacatggtttctggagtcatttctttcagtctttaaaaatttcactctgctcgtaaatgtagtttaaaacctgagttaagatgtttccatttctatagatgctgcataaatgtgggggtcaaacagacctgaattagaatcccagctttgccattgactagctatgatgaccttgggcaagcttactaaatgagttccagcctcagtttcctcggttgtaaaatagattcctcagggtattgttgggaagattaagaggcttataaagtaccttgcacatagacagtactttaaatctcaggttaaaaattcatgtcgacttaggttttacacatgatgaaataagatcaggattgttattttttatggtcattcttgaatttttatttttttgaagcaatacaatcaataggagaaaaacctcaccttcaattttaataggtgagtcaaaatgacttaaacagtattatggcatttcaaattttattctttatattaagcttaaatacagtggttactttaatgattaggtgtaatagttataaagatcacaatttaccctaaaattagtaatgctattatattttatgaatctttggttactgtatctgacatggtattctgatgccaaccttttacatatcatctagataagcctaaattaccagaaaactacacagatgaaacctggcaaaaactgaaagaagcagtggaagctattcagaatagtacttcaattaagtacaatttagaagaactctaccaggtatgtattaatatgcataaccagatttgattaacataaattgaggtgggatgtatatggattttgctttctgaaataggttcttaagtagacttttggttcccttctaattttagtttctccattaattgatgaactctataattagaccacgtattctcacataaaccatgggtacagtcataccagtataagttgtgcttatatttgaccctcctgataagaaattacagttacgtgtaccttggtgtaatagaagttctacctataatgtaatcctatagcatgaatcccaaagatgatttctggtgacatgtcattctattgtgataattgtttcttagttgtgttacctacccataggaaaggcctcaagacatgcagatattattcatatcctttattctacctccttcttaatagtagactttgccatttctttttcttgctctttacatttttctaatacctgggctacaagacgcaccttagcccagaaatgagtagcagtttgtagtccagcagcttagtctgaggttcagattctttacttagcaaatgggtccttacacttaaatataattttaagggcagttcctaagggcaatcccttgctaccaagaaatttttccctactgtgtatttgacacacaaccaattcaagaagttactttcattagagtgtcagggatttggtgttaaaagatacttcaggccgggcacggtggctcacacctgtaatcccagcactttgggaggccaaggctggcagatcacctgaggtcaggagttcgagaccagcctgaccaacatggagaaaccccgtctctactaaaaatacaaaattagccaggcaatgtggtgcatgcctgtaatcccagctactcaggaggctgaggcaggagaatcgcttgaacccaggaggtagaggttgcggtgagccgagattgcaccattgcactccagcctgggcaacaagagtgaaactccatctcaaaaaaaaaaaaaaatatatatatacttcagagtacaatagcttgaatttttgtattgatgagtaccttgtaagaaattatgttggttttatttatcagtatttgtatattttagttgcagagctagtatggtgatgggtaaacctggattaggagtcagaagatgggtttgggatctagttttgactgctgttaccctcataatcttgggccaggtactaaagccctctcagttttttttcctgtttttttaagagataggggtcttgctatgttgcccaggctggtcttgaactccagggctacagcagtcttgtcacctcaacctcccaaggtgctgagattacaggcatgagctaccaaacccagccgtcactctcaatttaaatttcctcctctctaaagtagaggaaataatagtttgccctacctgtctcacaaggttgctgataagaatcaaataagatatttgtggaaaacgcctccaggcactataatcttacaaatataagatggtatcacgagtcaaacttttttacaagccacattatagcttcttcacttgtagtatgacaattgagatcaccagtttctgttgctgtgaaaattagtacacgcaaaatactcaaatcagtgcacaacacatagtaataatgccgtgtaacattataagcattataatgctatgcaaatgtcggctagtagttgtagtactaagctattacttaagaataagcccatttcatatggctcttttggcgtattatatatgcgtctcttaaaatgtacaacaataaaagccaaaatatgaaactgacttggaaaggccttaagagagcatgtggtccaatattttttctttgtggtgtccatgacagcctgcaaaggggattcatctcgtattatctcatataagcattatggaaaccctttctggggtacgtagggtagtagttactatccccacttttttttttttttttttttgagatggagtcttgctatgtcactcaggctggagtgcagtggcgtgatctcggctcactgcaacctccacctcccgggctcaagtgatcctcttgcctcagcttcccaagtaggtggaattacaggcgcctgccaccacgccctgctagtttttgtatttttagtagagacagggtttcaccatgttggccgggctgatctcgaactcctgacctcaagtgatccacccgcctccacctcccaaggtgctgggattacaggtgtgagccaccgcgcctggcctatccccactttattgatgaggagactgagtctcagagaagttgaataacctgcccagagtcacatattggcagagcaggggcaactcaaactgagatgctggatttctagttcattgcacttttactcctgtaccacctcactaatataccctggtactttgaataccactgtagtgcagtgtttgaaacaattaaattgttttactttagggaaaaagctctttataattttagtagtatttttatctgtgcatgcataagtggtgtttatttggatagtatatggtgtttatttggatatgctggtatacagcatatttaatttcaataatattttatatattccatatttgtaacaaatgtttattgtggttattaattaaccctatttactttaccttgaatatttttccagagcttttgatttgaaaatacttttcctgatacattgattctgttaaatctttttctttcaagagcatagagcttgcatctcttgtttttgttttcttgtacttcgtaagttttacctgctgttgttcagttgcatttctttagcctagtcacaagtcttataacttcactgtttgcatttttcataataccttactgcttttgctataatgaattcaaaagcattggtttttagctcttttactgtttttgaccttaattttataaatgttcctttggattgttctcagaaagattattttgagatgttcaagttcaaacaggaggataaaggaggtaaagctatttcatataatctggacttcaggtgcttgtttgattttgactcattgaaacgtaattagaagtactctctcaatctacctgagtgggaaataaaaacataagaaaaagtactcttctaaaattgaaataatgtggaaatatgtagttatacaaaagttctccaaacccctgtcccaccctctttctctgaggtaaacacttactggcatatatctgcttagaacttacttctgcatgaaaaaacattttgctttaaagctttaagtatggaagtccctagtgtgggttgcatgtactgcctactaagtttttaatttctataaaagaacatgctgttctaagtacacttgcagtaagcaaacattgtctttttaaagtaattttaaattagaattggacctgagttttaaaattatctttccttgacaaccttgagatcctgtgggtgtgaggcagtgattaatgttttcatttgactgttttgtttgtttgcgtgcttgtttttaattgactgcaaataagactgattaaatgcactgacttttgagctgtccagcctgccttaggttacaaatctgtcactcatcatataactttgggcgagttacttctctaagtcttggtttcctcatttacaagatggtgagactaacggctacctatatggtagggttttttagacgtaaatgaaatattgcaaaaaagtaattatcacagttcctgctatatattggtatgtgtcatcaatgatagtagatatttgagtctttagaaaagaaatctttattttaaaattacattttattttagagctctgaagccacacgattttaaattctaaatctacactgggccagagcagctgtctgataaatagattacattccaaatgtgcttcagtagacaccattagcgaaattgaaaaaataatagaaaaagacaggaactctctaggaacagtgtccctctacgcttaaaaagaatgtgtcttgttttcacatgtggtatcatacagttggaattttggttttggtgtgagtttttttactattaataagtaatattttaaataggattattttcataatcctattatgagctcatgttctcaacttttgtatgagtagccgcagtgttttgttttgttttgtttaaatagagatatgggggtcttgctatgttgcccaggctgttctcgaactcctggcctcaagcagtcatcccgccttggcctcccaaagtgccaggcttacaggcatgaaccaccatgtctggcctactacagtgtttaagatcagctaccttttttggagatgctggaagtttgtacaggagcgtgtaacatttatctttcctataaatctctagctatttttaaagtcaagcctaggccatacttcaattctgatgaaaataattttatttattattaataatgggaactgtagttacctttttgtgaaataaaccttaaatgatgaacctttctattaacgattcatttatagagtagatgaccacaggactagaatcaaatagtataggttattatcaattgtaaaatctggttgcttaagcagtcagtgattattaagaaagcagttagattcttagcattgttgatgactagctgttggagtctgtgtaacttttgtcaccctgttgatgtcttaaagcttagtctattatgtattatgtatttctctttttactgaatcgttaatcagtactattgttgctgttttttaaaatgtacaactaaaattctactctttgttattttgaaatatacaatagattattaaataataaaaaattttaaaatgtgcacttacaaattcttagtccttgataattttcagtcttatttaagtcctgtttactggaagtaaaaagaaaaggagtttaggtttcattgtatagttggtttcctttaaacagattcttagtttttgaatacttagagtatcttagccatatttacttgacataaaaagagagataatgtagatcttattgctatatcagttgttgaattttttgttatgtgctttacttactatctgtaaacatagctcgaaaactaagactccactccttagaccagtgaccagagttcaacaccctggtggaaattcagtatcttttttattgtctgttgttcagtaaatatttgcatatgtcatttgctacacgtttatatatattttttgactgtgtttttttttcagacacttttttttagctcatccttgtgaagaaagacacattttttatgtatcctgtggattttggaggggaagggctgggatttggaagaataagggttagaagcttgctagaatgcctgtattttatacctaagtaccttcaaaggatttaaggcagcatatttactggtaattagtgggagcttaaataaaaagatagttttattaaaaagacttgtaaggctgggtgcggtggctgacgcctgaaatcccaacactttgggaggccaaggtgggcggatcacctgaggtcaggcattcaagaccagcttggccaacatggtgaaacccagtctctaccaaaaatacaaaattcagccaggtgtggtggcacgtgtctgtaatccgagctactgggaaggctaaggcatgagaatcggttgaacccaggaggcagaggttgcagttatctagaatctgtttattacaaatagttgtttgtgaggcaagaggttacttccagagattcccaaagtgttttattagtgtaaataataaatacgtaatgcataatatgtaaaaatacataaataatacataatatttaaataaaacaatgcataatatgtaaaaatacataaataataaatacataatatttaaaagaatatatttgtaaaagtgcttttcaaagatctagagtaaaatagagcttatctcaaacaccttcttattcctgtttccatcccagcatgtaataggatgaagagtacttagtaaacagtcattccttgttcaatccatgactgcttactgtgtccaaaactggactgataccttggggttatggaaagcacttagtactagtaagagagcataagtacctaccctaagttacttatgttctaataggttcatgaaattaatagttcgtgaccagcattttttaaaaagaaatgaaatagcaaatatcagaatgcatcacatagagtaatgatgtgtaggttcgtgaagattttattttagttacataaatttatgtatgatggattgtgacattagatttcctactgtggctttgggtcaaaacattttggaagccactgttttacagacaccactccaaatcttgcctaaaggtgagaaaagtagagtacttggatcaaaggatgtgtgaaaggttataatcgggtggccaaggtggctcatgcatgtaatccagcactttgggaggctgaggtgaacagttcacttgaagtcaggagttcgagactagcctggccaacatggtaaaaccccatctctactaaaaatgcaaaaaaacctagctgagtgtggcggcgcatgcttgtaatcccagctacttgagaggctgaaacaggagaaccactggaacctggaggcagaggttgcactgagccaagattgcaccccaatctgggcgacagagcaagactccatctaaaaaaaaaagaaaaaagaaaagttataatcagacatgagatgaaagtggtaagatttgccttgaacaccatgctaaaaagtatggtggtggggaagttagaaaggcttttattggggaaggcaagtatttaagttttttgaatacctgatatattcctctggttcaaagccccgaaagtattgcagagcatgtagtgagaagtctcacttccaccccatcctccagtcccctagttagttctctttgtgacagacattattagttttttgggtatctttccagagatgttttatatacgtaaaacgactgtgtatgtttttattttgttccttttttacataaatgatagcagaccatgtaccggatagttctttttgtttgtttatttatacctattacgagattgctccatcacagtacaggaaaagcttgatggaaggttgttgaggaaggaaaatgactagatccggtctataggttaagcagtcaaggctaaattagaaaaacagaatgttccctccgaacttgacctcaaaactcaccttagatgctcctgcctttcttgccttaaagttcttaaaccaccctccagccaaacacaggtgagactctgtgctgtaaagcccagcttaattctcgatttctcactatttccactaactttttatctgtttccctgtgggtctttgggactctgtccctttacctcttcccaggaaggcttttctgacttgccctcccctaaatgctgggttaggggcctcatctctctgcttatcctcatcatagcatctagcacactcaatcgtaattacacgttttctggcaacttttctcatactagaagccctttctatgtgcaggacacattgctagagttttttttgaatacttcatgtattcacttggttcaaagctcaaaaagtattaaagaacttatagatagatgaacacacaatgtctttctgtcattaaggagtcagagagacaagatatacacataaaaagataagtagttttgtgtaagaagtgtccagtggttgggagataaatagtgttgactcaatgactaagtcagtgtggtatgatgggtgcgagtgccatgtgagtcactggtagctgagtcaattaagaagaacttattggaagaagtgggacctaattgagtagtaagggaatatggtatcttgtgtgagaagataagtagatgtgccgagaactgttttatttgagaagggaacatagcagaaggaaatgggataaataggacttagagaagtaccggaagtgcacaatgtggaaagatgaagtacgcactaagtcatatgacagaatctaagcaaagcgataagaaatgctgagaaaacagtcattcagaaggaacggtgagatacaatgagaggaatactaaaggtggaagggggacagtccacaaaggacctgtgtgaacagagaggcacatgaaataaatgtaaattcccttaagcatttgtggcctagccccaggtcacgtgaaaagtgggcaggccagcagggtctcagccttcttattcctccatagctgctcaatctaattggcctgctgtttcctgatgaggtgtggtgacttgtctcgtggtgtaagaggtttcctttaagctctgctctgctctgctcttctcttcttttttcttctcttctcgagacagagtctcacactgttgcctgggctggaatgcaatggcacattctcggctcactgcaacctccaccgcccgggttgatgagattctcctgcctcagcctcccgagtagctggtgcacaccaccacacccggctaatttttgtatttttagtagagacagggtttcactatgttggtcagagtggtctcgaactccagacctcatgatctgcccgcctcggcctcccaaagtgctgggattacaggcgtgagccaccgcgctctgccaagctttcttttcatttgctgatttatttactggacctgcatattgggaatgtgacttctaactacatatttttaaaattccactccaacccacagaacttggatgcccccctagagttcattttaatggaatttttttcttctgttgtggtgagaaaggaattctggtgttacatttaagtcattaccacttggaattatagattatatcagagttttcccaaagagttttagcatgcctgttgttttaaatttgaaagtcttttatatatgcataacaggaaacttacggaaatctgaaggtcatccttctggaatctgagtataaaagaagaccaattcagttattaaagtgaagtaaaaatgcagttctttcttttgtaattggcgttaattcagttgtacaaattttatttattttttattttattcctttttgagatggagtctctctctgttgcccaggctggagtgcactggtgtgatctcggctcactgcaccctccacctcctgggttcaagcaattctcctgcctcagcctcctgagtagctgggattacaggcgtgcaccaccatgtccggctaatttttgtatttttagtggagacggggtttcactatgttggccaggctgattttgaactcctgacctcaagtgatccacccgcctcagcctcctaaaccgctgggattacaagcatgagccactgcgcccagccacagattttaaaatctatatttaactattcttaaactgaaatgttggagaaaattccttggtattatatcatactcattatcatactactagcaataatttctgctttgttctgttcaggaaaatccaagaacgtttaagtaaattttaattcaattgtagtaggactgcccaacccatctgatacataaacaacaggtgaaattcttttttaaacccaaaatgaagctctgcttgtgaaaatgattaacattttaaacaagacagcttttttatttttgagacaaggtctcactttgtccccaggctagagtgcagtggcgtagtcatggttcacttcaaccttgaactcttgggctcaagtgatcctcctgcctcagcctcctaaatagctggaactacaggtacacaccactgggcccagctaatttttaaattttttgtagagatggggtcttgctttgtttctgtattagtcagggttttcttagagggacagaactacagaactagtaggagatatatataaaggggagtttattaagtgttaagttacacgatcacaaggtcccacaataggctgtctgcaagctgaggagtaaggagagccaggttgattcccaaaactgaagaacttggagtctgatgttcgagggcaggaagcatccagcatgggagaaagatgtaggctgggaggctaggcccttctctccttttcactttttttggcctgctttatattcactggaagctgattagattgtgcccaccaggttaaggatggatctgccttccccagcccactgactcaaatgttaatctcttttggcaacaccctcacagacacacccaggatcaatactttgtatccttcaatccaatcaagttgacactcagtagtaaccatcacagttgcctaggctgttctagcctggcatcaagcaatcctctcaccttggccccccaaaatgttgggattacaggcatgaaccactgtacccagcccaagtaggattttctttgagcagcatgttggcactcaaaaagtttcagatttttgagctttttggatttcagatttttagattaaagatgctaaacctgtaatttgttcttttttgatacagtgcattggttatgagaaagtttgccacccacattgatatattttgttgttttaccttgtgtcttaagtggatgaataaccctttttaataagctgatgtggtagaaatatcaaattaataagaatctgatgtaaatagttgagaaatccttcatcctctccttaagaaagtattttaaccttgcaggctgtagaaaatctctgttcttacaagatttctgcaaacttgtacaaacagctgagacagatctgcgaagatcacatcaaagcacagattcatcaattcagagaatatcctttttaaaacaaaaaatcgtgaatagttttgtcttcctctctgtccctacccctcactgtttaacccagcttgaagtagaatgcctgtattttgtaggtttgtcattttttgtgccttgtgtttctcgagaaagaaacacattttgacttttcagccttaattcgtgtccaggactacgtgtggtattcatgtaaataagatgtccttatgtctttatcctttttgccctatcagatttccacttgaggaaaaataatctcctaagggaaatagtaaactgaaaacacgatgttcagttatgtctaagacttgtttttaaaggtgttttttagtataaactatgttttttttttcttttacaaattaggaaatagcactttggtgcataatcaagtgccatttagtttcacttagtgtgcaaggtattcatgtttaagactaatatgctctctgtcacatggcacatatgacttgtaccaaacgctttaaaatatccttaacatatgtttcagggattcattggatagcgttctttttttaaagaagattgatagatgctggcaaaaccattgcagacaaatggtaagctggaaaaagtattgtatttcggctaaacattgtattaatagttaaaaacatttcttcaaatacaggaatgttagtttttaaaacttagcaatagggagattgcttcaatatctattccttttctttttttttctttttttaaaaatttatttattttttattttcccgtaagttattggggtacaggtgacatttggttacatgagtaagttccttagtggtgatttgtaagattttggtgcacccttcaccagagcagtatacattgcaccattgtagtcttttatccctcgcccccctcccactcttcctcccaagttccttttctgaattggaaactagttttggttgagttttctattttaaaaccacaagttacaggtaaacctgcatttcagaatgtcttgcaccttaggttcatttttatttttgtcacacttaccaaaaatgtatttatctcattcattaaaaagctacatttcgtctgtcactcttatttttttttctctcttgatgattatcctgtccactatttgattacctgtgaaggtgcctgatggtcctgtgttttagtttattcagataacaaccttttccatttttcttaatctggtttataccttatattctacagattaaaatcttaaaatccatcacccctccccacccccaccccctgccaataaaaaccctcacatgtgcaatgtaaggcagcttcattccctagcactgtggcgcaggaagaattatatgagcgtccccttgatttttcagttacttctcaagcagtaaatcagagggccattttaagtgtcttttttctagaaaacacaaaaaggattgactgttgagtaataaaaactatatgggcatattctcagatagatgtgtttatctgcatgtttgatcttagtaatgtaatatatatacagacaaactcttcagttttattcttattgaaagcaaatatttcagcttcacaacatacaaaacttgtttgatttctttttttttcattggcagatcatgatcaggagcatttttttgtttctggatagaacttacgttcttcagaattcaatgctaccctccatttggtaaggatgccagaaaaatatgaaaagattgttccaaatcatactcaaatcttaattacactaatgaaagtgtataagctatactgtgaatattctaaaaattcacatttggttctagactttcctttgtagcagttttatcttcctaataatatgttgcctatgctaatattgaagatagctaacattccctgggcatatattaatttatgaagaagttttttgttagccgaggggactaaagtttgctctggaatgtctatgattgtgattcattttgctgctgaccatcaagagttcactcatttaacattatgcaaaagtccatgtatacacgaaaatagaatagtatcatgaactcttccccctcccatgtacctatcatctgcctacagcaatgatcagaattcactgattcttcagtattgaaaccagttgataaataaccaaataagctttcaataccagtacagtgaaaactgttttatgtcttagaactaattttgtctgttgatttgagcaaagaagaaatccacaaaaagaaataatacaacaaaacttagttatggaggaaaataggaatttagcttcaattctcagtaaaggcaaaatgagtttcctgtgttctttaatctaataatgttattcaaaattaaatgtgtggattttattttttgacaattgctgcttcaaagccctggagccctaattagcatgggaacatgtggtaagaagttaagcaaacctcttcagaagtggtattgtcaattaatttaggttatatgtgttttttattttagggacatgggactggagttatttagggctcatattataagtgatcagaaagtgcagaataagacaattgatggcattcttctcttgattgagagggaaaggaatggtgaagcaattgatagaagtttacttcgaagccttttaagcatgctgtctgatttgcaagtaagttaactactacacctactatacagagctgattgctatcctagttttttttccccccacatcagacaggtaatgtgctgatgtcataacaaggtttgaaggaagcacatctcatatatgagcataaaaacccaatcatcatgcttctcaactacaaaaggatcctagcttgatgtttaaaaaccaaattcataatgctgtttacatagacatagaggacatttagtaaatatttgctaaataaatgatctccttcattttgttccccctccagatttatcaagattcttttgaacaacgatttttggaagaaactaaccggctctatgcagctgaaggccaaaaattaatgcaagaaagagaggtatttaaaaatcatgactaataaattctcactgtctctcacaatagaccttactttgtagaatataagcttccctttgcatttatcttcccaacattgtgatgctcttctctcacttaggtgctcctttcttttctctcttcttaaaggccagaattctggatcataaactctacctataaatttttacatatgattctaccctgtcacatttgacagggccacttccaggatcttttggacttgacattttctgaatgatttatggggaggaaaacaataatgtaaaaaactatctttgtaggttcctgaatatctacatcatgttaacaaacgtctagaagaagaagcagacagacttattacttacttagatcagaccacccagtaagtaccacatgctgaatttaatagtcttaaactgtcgttaaatcacttgcagcactttagccatcctaaacatgttagtaactgttttcaggtgtgatttgaagtgttaacagttgttttcataatacaaacttcaagttattcttttccctagttaattagttttcatccaaggattcgattattaggggtgtgtgtgtgtgtgtgtgtgtgtgtgtgtgtgtgtgtttagaaggtaatttagaaataatactagaggctgatgtgacctttaaactcttcaggccaattaaaattcagtggattcccctatttctgtgctttcctaagtattaatattgccagtcgaggggcctctgtatgtagtacttctttaccttcctaataaaagtagcaaaacttggaaaaagccgactacagcaaggtcttggagatatttatttcgttatgtaaaccaaattctaaaatatgcagtgtttttttaaaatttttgcctgtcagttcctttatgtctttttcttttaggcataaagtatagtaactctgagcaccaataaatttatacataggataggaatcttgaaatcaacataaaatgagctatttgatttttttcccccctcaggagaggctttacattttctggaagtcaaacgtcaataatactaacctttttttttttccttgtaggaagtcattaattgctactgtagaaaaacaacttctaggtgaacacttaacagcaattcttcagaaaggtaattggcaatttgtaaataagagattgctttttaaatggtagtggcaaactagtagggaatttttaaagatgttgcccttttaaaagtttgatagcatgtggctgcatttctgaggatggacacaatccttattaatcacagtaaacttcctggaggtgccagttttcttatctgaaagatacaggaactagaagagagggatccacaaataccaataaaaaaacagtggttgatatgtgcctgtagtatcagctacttgagaggctgaggcaggaggattgcttcagcccaggagtttgaggtcagcctgggcaacatagtgagactctcgtctctttaaataaaataaaagaaaaaaagtgggaaattcttgacttaatatgtaagctttcagtaaggaaaggtattcctttttacactaaagcggtgagggttttttgttgttcatggcatgtcaaaccaagcacttctaatcccaagtgaatttagagtataccctacattttactttgagaatgccgcaaataggtaaaagccttacctttctccccaataatattttcttttgtataaaaatttatatatttagaaatttaatgcagttatactgttatttcatcctggaaatcaaatatttattagagcctcatttaaatttgacctatttatgcatggcttttgatatatcacaggctatatccagtattctgaaatataactatgtacataatatggctactacatatatgaggtatttataatgtatatttatgtaagccagtttttataagtttgtttttgcctctaatctatcatgctaaatggcacaaaccattatggagttaaccatttttctttttctttttaatttttttaactttttgaattaaaatagagagggggagggggtcttactgttgtgcccaggctggtcttgacctcctggcttcaattgatcctcctgcctcagcctcccaaagtgctgggattacaggtgtgagccaccgtgcctggcctgtttttatttttatagcgactaaagtctctatatttagtttttacccagaaagatggttgggtttaattcaaaggaaatcttacattacaactcacatacagactagtcatagttcaaaccagtatcacaataatgattataactcaaattttattaaaatgtctgataatcttgttcacttttttgttcactatattttaatgccaaaatgttttaaaatacaggtttaaataacctccttgatgaaaaccgaattcaagatttgtctcttctgtatcagctcttcagtagagttcgaggtggagttcaggttcttttgcagcagtggatcgaatatatcaaggtattaacaatttacctgtgatttttctctcttatggcttatctacacatcaagagtgcatattggcaagcatttcttgtttgatccaatttttttttttttgagacagagttttgctctcgtcacccaggctggagtgcggtggcacgatcttagctcgctgcaacctctgcctcccaggttcaagtgattctcctgcctcagcctcccaagtagctaggattacaggcatgcaccaccatgcctggctaattttgtatttttagtagagacggggtttcaccatgttggtcaggctggccttgaactcctgaactcaaatgatccacccgccttggcctcccaaagtgctgggattacaggcgtgagccaccacacccggacttgatccagttcttttaagggaattttaaatttgtttaaaaagtaatgggaattttgagaacagtcaacctgagaatggtagctgtgtggcatatcagctataaaacctgattgatggctgacataatttctgtctctaccacttaaagcagtaaatgtagaaaaagactttgaaccccaaatttctttcctttcttcaatcttacactaaagccagattgccattttaaggaagttgaaagctgacttctttaaaaataaggaaaagatcccagaggcttctaataataccctgttatgatatcatatgcccagtgatcattgcttactatttttgtgattatagatgagtggttaacagtgtggatatttagcactttatttttttgtcctcatttcactatcagctttattttgccaggtgcagtggtacatgcctgtaactccagctacttgggaggctgaggcaggaggatcctttcagcctaggagtttcagactagcctgggcaacatagcaagattccatcttaaaaatagctttatcttactttttaaagatctttaaatatatatgccacttaaaatatgatttggggattgttttcattgtagacaattcgattacagtaaaaagtggtaattttttgttttaggcatttggcagcactattgtaattaatcctgaaaaagataaaaccatggttcaagaattgctggattttaaagataaggttgaccatataattgatatctgctttctgaagaatgagaaatttatcaatgccatgaaagaagcatttgaaacgttcattaacaaaagaccaaataaaccagctgaacttataggtatgttttccagtcctttttccagttgtttaatgatgttctttgagtcataaaatctcaatctgaaatttttaccaggttgtagtattactaattcctgatttgtttgaggttgcttagctggtatatcaagtttgaagagtgtttctaaaaacctggatgtaagtactgaaagcccacatgtcaaacataatgtgctttctttcaaagacagtacgttggacactatttacctttattgataataagctaatctgttttcctagcctaatgatttaaaaatgaggcagggtgttatttcaagctacaaaaaagggcagcatgaaattacagttgtcagtgaaaaagaaaaaagtccagggcaaaaataaacctaataatctgggcccatttagcataaggatgtgatatacactacagtgcttctcaggtttttccacccaagtacccttagtgtcagaggaggaggtaacctgagaaggtctagggtcctctgccaaaaggatgaaattttgttgcaacctatctactatgtatccgtaaacatgtagcaaattttaccttctactctacgatgtatctggtttattttaatagaaaagtaatgtttaagattgcttactattcctataaaatggatactccagaagattcctcatgtcttttcgtggcttggattacatgatgccctcacagggctacatgagacctcccccacaggatatccgtatcctattttcataaacatcagtatagtgggaagtacatttgatctggagtcagaacacttgggtttgtgttcaggccctgatgttattagctctatggcactgaacaagtcagttgatcttcctgactttggagacttttaaaaatgcatataaatttctgaagtattgaaaaactcagtgtatcatactcctctttgggtatatatagtgcccagtacctcgtgtattccccggttattaaacaacaaacttttcccccattttagctaagtatgtagattcaaaacttcgtgcaggcaacaaagaagctacagatgaagaacttgagaaaatgttggataaaattatgatcatatttagatttatctatggtaagtatttactaatgttttaatatttttcttttaaaatagcactcaacagagaagctagcaagtatattcaaactggagggaatatttatttggaaattacagatttaaaattgtgtttaattcattggggggatacgtgaggaatgttacctgattgtcctatgctttggctcttctagtattaagtgccttgatttttgctacttggcttaatctcttaaatattggcaccaaagctaccagtccacaaaagcttttctgaagaaaagttaatgcaatcaagacagttacatgcaaaaaagttttacaataaagacttcgaaatgtctggcacaaaaatggatctctactgtttcttgcatttaacaaacttaaataaaatgtgtaaagtaaaataacttggaataatggtgtgctttattaaagcactttaaagcagttttgtcagtactttttattggaatattataaattttgcatttctttttacataggcaaggatgtttttgaggccttctataagaaagatttagccaagcgcctgttagtcggaaagagtgcatctgtagatgctgaaaaatcaatgctgtccaaacttaaacatggtaggtttctcattctttctgttccttttctttgattcctgaaggagaatgttagctttttaccctttcaatcgatttcctcttttgtcactcatgtctatgtatatatgatgaaaacataaatt

SEQ ID NO: 1286 - DNA, 3387 bp, mus musculus
attctgcattatttccatttctaccatgctgtttcagctattttctggattaaatagatttttgtgactattctggacaggagaacatcttctcctttatcatagctaaagtagccatttgcctcgggtatagaaaaggaatggtacttggtgggaatagggaaactacttttagagtgtgtttatcttattttagtttttgagatggagtctcgctctgtcgtccaagctggagtgcagtggcacgatcttgtctcactgcaacatctgcctcctgggttcaagcaattctcctgcctcagcccctcgagtagctgaggttacaggcacccactaccacgcccggctcatttttgtatttttagtagagacagggtttcaccatgttggtcaggctagtctcaaactcctgacctcaggtgatccacccgctttggcctcccaaagtgctgggattacaggtgtgagccaccacacctggccaggggtgtgtttaagaagaataagaaaaaaaaatgatattctctgttggggcagttatagcgaagaggtagtataagtagtatgtttatattctaggaacagcttatgttgacatgctttttgcctaataggtgctcacatatttggaacactgagtgaattgaaaatcaagggagaaaagtgaggacgggttttttgttgttgttgtttgtttttaatatttattaagtgttggtaaatttatagttctggagttaaccttaaatggaaaatttccttagtacctagtctttacttttaaaaataatttttattttgaaacagttacagatttagagaaagttgttaaagaaaatggtacagagaggtcttgtgtaccctgaatcttgactttttaaaatatgtactgcagtgtttaacattccagaaacttcatatgttaaccaagaccactctggtttttctagaaaggttgaaactgttatatcaggctcttaaagatagactgggaatttacctattattttaaaacagcctttacataaaaccaccattcaggccgggtgtggtggctcatgcctgtaatcccagcactttaggaggctgaggcgggcagatcacctgaggtcaggagttcgagacaagcctggccaacatgacgaaaccctgtctgtactaaaaatacaaaaattagctgggtggggtggcatgcgcctgtaatcccatctactagggaggttgaggcaggagaattgcttgaactcaggaggcagaagttgcagtgagctgagatcatgccactgcactccagccgggtgacaaagcaagactccatctcaaaaaaacaaacggccggctatggtggctcacgcctataatgccaccactttgggaggctgaggcaggcggatcatgaggtcaggagttcaagaccagcctggccaacatggtgaaatcccatctctactaaaaatacaaaaattagctgggtgtggtggcacacgcctgtagcaccagctactcgggaggctgaggcaggagaattgcttgaacccgggaggcagaggttgcaatgagccaagactgcgccattgcactccagcctgggcaacagagtgagactctgtctcaagaacaaacaaaaatccccactagtcagtgatcagaataattaatcagaacaattaatatttattgatttcacagtttttagtatttatgtgcaagaaattttactccttttttgtgtgacttattctggttttgttagcatggggttatagtattaacatttgacttgaaagaaaaggggttattagatttattcatttagcatttactgagtatttacagtgtacccacagactctgctaggtctctgctctcaaggagttaatggtctaggagaagacacaagaggggttccaagtggcttaactagtaacatgatcattatttgacacccttcccttgatggggaggccccaaggcattttgataaatagttttcttagctgtgttctttcaggctatcatggcagaaggaaaacagcatgctctatgtgttggagtcatgaagatgtctgcagaagacatgtaagtcttactttaggcccccttaacttttgatatatgggtaaccaacccaggaagcatcagaattacaggtgaaatttgctatcatgcataccacattacacaaatatccaagcacagaagcttcatttctgatatttcctaacacttaggaagccaatgaaacctattttgtcttcaggattgtagtctttcttaagcactgaaaagaacccatgtgccaacacagctgttttatatgtgtgtacgtggtactttaggaatcttatttagtatcatttaaattgggggaggagggaagatgttttactgctagcttcattttatttatttttatttttatttttttaagtttttttgagatggagtctcactctgttgcccaggctggagtgcagtggcgcgatcccgcctcactgcaacctctgcctcccaggttcaagcgattcttgtgcctcagccttccaagtagttgggattacaggtgtgcgccataatgtccagctaatttttgtatttttagtagagatggggtttcaccatgttggccaggccagtctcgaactcctgacctcaagtgatccacccacctcggcctcccaaagtgttgggattacaggtgtgagccactgcacctggtcattactgctagttttaaaaacagtgatatatctcaccaccacacagtatcttatatcctgacctggtaatacaagaaatgtagaatatttagagaactagtaaagatatattatcaaaacataggcagtatatttaaaaattttagaacccatttgatgaccaaattagtggtattaattttgtttcagggttaatgtagcactttgatattcccctagtcttgtgacattgttactctggttctatagacccactagttagatcactaaaatcacttttagatatgagctgccacagagtaatgtagtttaatataaacaacaatgtaattgtgatgtcaataagttctttacttgtggcttaataattaaaaaataacaatatactttgaattatatttatcacgagtaagactataaaaatgcataaaagtatgtttatgtgttttttttccttctacagtgagaaagtcaacaaaggaattggcattgaaaatatccattatttaaatgatgggctgtggcatatgaagacatataaatgagcctcagaaggaatgcacttgggctaaatatggatattgtgctgtatctgtgtttgtgtctgtgtgtgacagcatgaagataatgcctgtggttatgctgaataaattcaccagatgctaaa

SEQ ID NO: 1287 - DNA, 236979 bp, mus musculus
ctattattattttgacgactcctgagttgcgcccatgctcttgtcagcttcgttttaggcgtacatggccaggcagaagaaaatggggcaaagcgtgctccgggcggtcttctttttagtcctggggcttttgggtcattctcacggaggattccccaacaccatcagcataggtaagcgcaagcgagccagccgtcggtccaggctctccctcacccgagaccactgccccggcaaggctttccctgcggtgggtccctgtcctgcgtggcctgggaactgggactggggccgggaccgggcagagatggtgcggggcggggggcggggcggggggaatctgagcctcaacgaggtggctggtctgaagagcctctgggacaagagaggggtctcctggggctagtgggggtgaactgctaggttttccgagccgagaggagcaccggaggcgagcaggaggctgggatgctgcaagggggtgaagagtcgaggcttttcggctcgctgctctggactttgccatggcgtgcgtgcagctcctggaagttgtcccagggtgatgccgactgtctggccgcgccagggcgcataacccgggcccggggtgctcagtccgtggtctccggctgtcgggagacaggctggtgctgggggaggtggagcccactttggatctcccagacccgggcagcagcaggcgttggtggtggatggggtaggaggcgggggtgagactaggagctgagcgggcaagcggcgaagtcacgcagaccacgaattcatgaattgccgctgtgtctgtctggagcccggctcctgggcgcctggagggagttatcttggcttctgtcgtatttacaagtctagaagttagaatttttgccattactgaaccaaccccctgtattgtcacgggggagggtggctatggggaacgggttggggtagcagggggaacaatattgtttttcttcccaacctttcccttcacacaatgaaaagatgaccagctgtgcggatgggcggggggcggagggggggggcgactaaaaaaaaagaaggctgccgactaagaaagaaccaagtctcactcttggttccatcgtcctaacccaaaacggctccctcgtctcttctcccttctctctagcctcttcttttcagtctagaaaagccaggtttctcttggccaaaatctgagttcacaagtcttgaaagacacacaggttgaatatcaatcctcaatcccacaccccagtatcattgagaggtatccggtatctatattgttccccaattcctaactggccctagtgtgggggaacacaagccaaatctccgttccctttgcttataggtggacttttcatgagaaacacagtgcaggagcacagcgctttccgctttgccgtgcagttatacaacaccaaccagaacaccaccgagaagcccttccatttgaattaccacgtagatcacttggattcctccaatagtttttccgtgacaaatgcttgtaagtagatctgcttttcctccctttgggacgttggggacctcatttgcatctttcttgtggcacttagggtctgtgtatgtgctgggagatgattgcttcagtagatattttaggggctctaatccatccggtttcatgttgcataaatcaactccaaatgatactgctgaggggcttaagacagtgggaaaaactcaagacagtgggcaaaagtctgctccaaatagtgtttgatgcaaaagtttcattttcctccatgctaacctagtgtgttccttctccaacactctctctcttttttttttaactggggaaaaaaaaagaaagaaagaaaaaaatagcacggttgttcagagaaatttcttcagatgagatttaaaaaagcagcagcagcttcttgattgagtcaattcaggatgtacatcacttgactgttaaagctagtgcctggctctaggaacgagctgaatttgacaattgcctaatgtgtaggaagcaaatatgagaaattctgcaaacaagtgaccttgaggggcagaacaggctgggttccctggcctctttctgtcctcaaatattaccttacttactgagagagctctgataggaactcataagactacaaactgattgcaagtgatgaatgcctagcaaactgaggggaggggagaaaatggtgatcaggtgatgatttagaaagctagttctgcctcccctagtgttgttcacccccatgatcattaaagacaacacagttcttaatttagagcaaagagggggcaggaggagaggaggcttggagcaggaaaactgaatatggaaagagaagaaattcatcaggcccaaagccggttctgaaatccttagttgtaccgggtgattattcctctgaaaaggggacattttgtaaaatacaaccaaaggaacctaaatggctaatagcctgttggacatatggttttacttgaatggaatgtttcgtgagaaagactgagaatacttcatgtaagcttatttcactaaaagttttcacaacaatgaggctgaatatggtataaaatatgctttgcttttatggctgatgtagtttggaatttggggtttttcttcctttctcttccaagggagaaatgatatttatgtttggatgggtgaaactttgtatatgactttctttaaatccttctgcctcaaaggatgcatggtttccagaaaccactgaaagggtctctccaagggcacaggtttcttggctttgaagacttgggccaagaggatgggggtaacatactctgcaagaaatatgacagttgtcagctttaagaaaattttagctgaagatacagatccttatatgaacgtgttctgagatactccatatttgactttctttggctttctgacattgacaaaaataggaatttattaattccagctagtgtgaaagttacgaaatgtctgtctatactttgcatcttattttggtaatcccagcctgtctccacagcatttacaacacgcatctgactcttaatcctgcagcactgtgatcttgtcaagaggctgaatctcaaatgcagcttcctaaatatcaattagaacagatttaaaactaaatacattaaactaccagggtttattaccattagtaacaaataatatttatttcaactcccttcagtgtcttttcactgatgagaactgggataagagaaccatttggtttctcagaaatgattgatttccaaggtttttggtcctgttcttatggtcaaaccagattgacacccaccagccctggactgtcagaaccccactcaagaagcaatcagaaatgattcttgccatgtgaaaatctcaggtttaggaaaaggcaataagtcatccatattggtattgagttgccttattgccttacctctcagggcaataagagaacaaccaggggaaaggaaaagaaattgatcaaaatccctcaccgtaaattcatagcatttccacttacaaggctgggttgtggctaggggcttgagagttcgggagaaggagtgtggctcactgggcaacaagaaaaagaaaatgaaaacgtgaccttgcccttagttatgtcaaatacacatgtatgcatgcacagacatacgcaggaaaaatagctagaaaccagtgttgtgtatccagctgcctgttgctttctctgaagacagaggaggaaagctgtcatcttctctggtccctgaaacagtcatctctgaatgtcacaatcattgaatgggggccagatctcaaagctgtctctaggcagctgctgcttggtagcttagtatgagaaagatgactcgtctaaccatagtcttggaatgcagaaaccaagtatttcaagggaccaaagaagccctggaggtgtttctcatttctacccctggctttaattgttctttttcttgtggaagcggagatcaaatatttccaactgggttgaaattctagttcagtgctggagcctgacaggtgacccccaggttccactcctccaaatgattgccctgattgtgcaaagagaaacctctgtatcctccggcctgtccttctctggagacctagggagaattccagaaaacaacagatgagtctcaatctggccaaccacctctcctatctggttcaatatggaatgggctggcaaaaattaaagaaactttcccttattcctatgcaaaattcctagtttcaacttcccttagcactagaattgatctcttctcatgatctttcctgcaccctcaatcctgaggcaggcacacactttctagggtgtaggtgtgcaggtaaacgaatacacaaagaataaacaaagggtaattctttcatatatgtgtccctgttctctgttctccctccacatcacccacccctacaacctctgacaatgtgtttgaaaggtttccttgcgatgaatcccaggcatcagttatttaaagactcttcttcatcagaaaccaatttttttgcacaacccccaagaggtttgcttaagacagactccaactttattccatgtcctacgaggccaataagagccacactggctttgaaaggtgtttaatttgggatctcaactcagagatggattgaagtttatctaagagacttacctgatttgaagcacatgttcccatttcatgaggattaatagagtttgctgccttacttttcaacttagctagataaccccagaaccaagagtggtgtgaattctttggcttcaggatatatacattcatagacacacaatcaatatatatgaagagagatgtatacacatgtaagttacatgtgtgttttttaaaaaacagattcaatagtcctaaggctttcagggcaggggtgtggaaacaccaagggactgatgtgtcccatcgtgtggctttgctgtcctggttcctcaggaaacatcgccgattcccttgaagtcccctcctgtgtctttctgctgtgcacttgtagtgcactccacactacaccgccccagcctctgcagtgtcagctcattagcacacagatctcatattccctctccgcactgtcattgcaaaaattgctgttgtacacctttacagccaacaaatgtgcttgtggattacgcactgtttgcaagaagcagggaaaaggcaaatgtaaccttaaaggttattcaccacggaattgtactctaaacgcattggcttaaataaaaatctgttgatggaggcacaatggtgatggtgggattgagaataggacttaggagtgcaggctttaatggagccccaggtaaaatcccttttgctggctaaacgtaacccatcagatgcaaaattttattccattaatttttttcaagccatttgaaatataactgctgagaacacactccctttacaactaagcgcatttcactaccaaatatacttagctgagacaggtttctgtctcttgcctacagagtcacaatctaattatctaattattataattgccaaaatcaatttaactatttatgtccatttgggaaggaaatgtctcctttgatcccattctttgcaatttggtgggttttgttttgtcttggtttggctttggtgtctgtcctttccatgtaagatttggaaaccaggtgaagactcctgggatcaagatcaagcctccttcccttaacagattttgccatactacccaacattgactgctctggttccactccctccctcactccccctcttccctgcctttgtgcctttgctgctctccctctctcctctgtctgctggccagccttcagtaagcacgccggcttagctcacttctcggcccctctggcttagtcccctgaagcatgaagaggttgccttagtggtgccagtcaaaaaattaagtcacgttttcacaaggtttattacggtttttaaaatttatttttcatagggcgggggagggaagaagctgatgctgttcatttgggccataaaaatagatggcaatcagcaggctgtaaaggtgagcttcctgcaaagtgtattacctcccctagaaggcagcttcctattgatctactaaatcaggggggacagcagcaagaagggtttgaaggaaaggaataaagggaattattttgttctccatctacatttactgcaaaatgggccatggtttttctccctctctgcaattttaactttttttccctaaaatgaaactagttttccacattttcctacttctgcccctacagaggtaatttccttaattctgcatttccctccctagtccctaagactgagtgataatagtggaggatcgatgagctttttgttatgtttttggctcctgatgtatttttaaatttcattgttatgggtagtcagaggtgattggctggtttcattttaacagattgaaaaataaatgaagctcctgaggcatcgttatttgtcttcctttttacagttaaagagatttgtcatttttatacagttggtttaaggattaaatgatggcatagattttaagacagggccagaattttagacgatagaattccataactttgggggagactaataaacatgcttatccagatgatttccctgtcaacttcttagattgagactgcaaaataaatttgaaggacctttcataaaaccatctatcttcaatgaaggtcaagcaaataatctgtatactttacctgctccattaaaaaatcaagttttgactttattcctttggctttgttactttgggtcttattagataaaatatccacaggagggtgcaattaaaaccccaggtgggggtgataggtattcttcagcagcactgtgggagttgtgcagacacaaaaggaattccctccatcttgggagctgctcagaaactgtctgggctccagatacagagctatagatagcctcagcccgtgtgtgggatgagccttgagctaaggcagcagcccccaaaaagggtcagtccttgacaaaggttaacatggatagaaattgtcttcctcatatttctacctcttctattgccattattttcttctcttgctctatccgtccagctcgtctaactcccttttgctggtctctgcctactcactgaccagcccctgattctagcatcccatccacactaaacttacctagggactattttctaccccggacttttccagacctaattcccagaacttctccttctccaccagaatacctttactcttggtccatgctccaaggatgtagagtgcagtacggcctgcactctactttgggggtgacagctttatatctaatataggtatatatttcatatatatgaaaatgtcagataaatggtaaagggttaatatatgtaacggggagtatctgcttcaaaactagggactatgggaaacatactgcctcaatttcaaggaaagatacttaaataggagtgtttctggatattactctcagagtggctgttcactctacccaaactaaaggtcagctggctttggtcatagaagacttttacaggccaaagtacaagtctaactgcccatagtaggttgggtgtaagtacacccgaggcataggcaggttcaacttcatgttgaatctaaaagcctttgcgggtaatttgggaagctgcaggttcaacttcttcatattgaatctaaatgcctttgggggtgatttgagaagctgctaaagttcataggtatttattttattaaagaggctggtgtggagactgaacctgcctatgtgggcactgtcaggagatgtactggcacaaaaggaaggttataggagaggataagggtgggagagaagctatctctccagctgtaagtttcctttccctgggatggtatgtggaatgccacgtttaagaggtaacatccctctcaccgtcactaaatagtatctctggaggtatttggaagtgtagttaagcagtatctcctcctccctccatccttcccttaccttgtctcaaacatacactctggcctccctcccagtggaaataaccagcatattctcttctggatttccaattgctcattggtcacagaagtgtttacatcccatgctctatctggacctccctgttcctcaattcccaaccgtcactggcttcttaagcaattatcctcaacacaaccatcatttgtccttatttggagggtgcaggggagcaaggataagaataaggagaggaaacacagctgataatgatccctcaaccctatgaggcgcaattcagggtagaacagcacttgttaatttttcatgtgcacaccaatcacctaggaatcttgttaaaacaaagattctgattcactaggtctgtgatggtgcccaagaatttgcatttttagcaagctgccaggtgatgccaatgcttctggtcctggaaccacactttgagtaagaagagcccagagcaaggagactgtgatcattaaaggaaaaggctctcgcagaccagctcttatccatctttgtatcttcttgccctccaaagaaggttctgtaagagacacatttggctcgttcttactcaagtatgtatctgtcacattcccaacaagtccgtgtccatttcagccaggtctgtaggtggcattactagatatctgatgatagcatttagagttgttttattgtagggatgtggagtggggactgaaaggcaggttcagcgaggaagtagctcatgagcccgggtgacactgtcttggcttcttgccataccccaaagtgccccttttagaaacaacctgcccaagagagcgaaggttggcatgcagttccaactgcctttccactttgcttctctgggtcaaggcatgccagaaggaggaatgtaacatctgctcctcagctgtctgacttcccttaaacagggttagaaacaagaagtacaacacaacctgaattctatctggttccctaagagactgaaaaattgactccattttcaaggcctgtgccaggcactcactgatgggagggatgggagggaagggaagtaatgtcactttctagcagacctgagccgagaactgctccagggaagccattaaaagcttacccagtgtcatttgaggatcgcaaaatagcaaaattccccagaaaaattgccccccaacagtgtgccattagtctgaaattccacaaatttgtttatttgtattactgcactgaaagcctgtgccaaaatgcaagcgtgctatctggaagggaataaattaaatccttatcagtcattaatatttcaaccagaattctctgttcagattaccacctgttaccttgcaggatcctcagagggggctttccaagacaggtaaatgacccagaacaagatacctgcccaaggaagtgaggcaccaaatggattgcgggcattcagaggggcgctggtagactcttgaggataaggaagattccctcaaatacacttcacctatttttcaacatttgaccttctccatggataaattctggtactttattcactaagattttagttatctttaactattttagctgcctttgaccgaagtcatacccttctgatggtagtgggcctgctgcctgttctgtgtgtggtgtttgctgcaataggtgatttcagcttcaggattttccacagttactgtggaaaattttcagaggtaaaatcagtttgtgatgaggtatggtgagaatttaagcttttaaaaattgttgtgatcaaaaataattccctctcaattatccatgattggctaatctaccttgccaattactcattgcaaccagggccttcatctttgtagctccccagaaaggggtcaagccacaggcaataaatgagatgggaagggatcaggatgcagctcacagaggggtaagtgtatgggtgtgggtacaggtctttgtgtaggtgaacacctttgcacaattaagattagtaaagccattaatgtccaaagtcagtcagaacctgttaaacattctcaaatatcctagtacctcactgcagtttccaaagctccttgttcattaaacagtgtttcttgaattgggccacttgctttagaatcaccagagatgcttgttaaatattaattcctgggtcataccctagatgtattgaatcagaaactatcaagataagcattttaccaaggtctatgggcgatactaacgcatactcagtttaggaatcacaggtttaaaaagccccagtactacagagatatacagattcagattgaatatttattgaatacccactgagcaccaggtattatgccaggcactttcacatatgttacttctctatgtaactgaggtgctattggcctatgcaagcattagagagtttggctttcaggctggaaatctaagacttggaagaactaagagactagcctcaagtcacagtctctgagggaaataaaacagaatgctctttgagatggtaagtagagacaaaggaattattttcattttgacaatgcttcttcctttctttgcttattagctaatgattcgtcctcagacatgctctgaactagacgtcatggcaaatgccaactcacttattaaaaataaatgtattgcaatcagttcatatagcaatcactgtgccttcctccccatccttgctatcaacaaatttaaaaccagagctaaaataataacagctaccatttattaaagccgtaccacatggaaggcactgtgctaagcattttacatgccttatctcatggaatcatcacaatattgccacaagcgaggaactctcatccccattttctaaaagaggaatgataggtggttcaaaatgcataagcaactagctcaaggtcccacaactagctaagtagtggagccaggattcgacctgagatcttcctgtctctagaggctgaatcaatttcaacttgggttgaaatttcaaatgcatataggggctacgcagaccacataaaagtggtaggtaattggaccaggtgtgttataatagggagtggtggggcctatgacaatccagagagtccatgcttctgcctgaagacattcaaattcaattttcttaaaccactatgggacaaacaaaatgcctgcaacaggacctagaaggactgggagtggaaagtacacatttctgacctctgcactatactatatacctccttttagcagctaggttactggttgagggaagctctattaactggtagttataactactgagaacagcagagagaaaagctcttctcagtaaaaactctattttgactttcttcttatagtgtgccatcaaagtatctcaatatggtagaattttttctcctttgtggaaatacttgtggtgccatgtacatacactctatatctagtagcttttcatgactgagtgccagcttgactctaactaaccttcccccaggcaatgcggaggccctcagcaaggtcagaatgctggcacaaggtcattaataagcgcccagcagatcagaagaggtacatcaccattggtggggggaggctgtgctctgggacaacttcttaggttctagaacatgcaaaccccaggcccacaactgggaggccactgggtcaagtaaggctatgtcaacagccacccagggtaggaacttcccatatactctgagaaagaggctcaccaactttagaccagggtctaaaatagagatgtaatagttgtctggagttgtaaactaacctaacccaatctggtcattgacaatcattacgtactttttgttggatattaatagcctgccatagttaaagtgaggctatagatcttctccccattaacatcactaccagctataacagcaagactcagacaatattctacttcccattaaaataatagcaaatagacataaaataatttgatatccaattctgtagacccagacaaattcagctccctttgcttctaggtgctacaacaacaccttgcatgaaggtttacttgaggcacacaagacaacattctagtagcaggattcagctaaccaaaaatccccatcagtggctgtccacaggacaatttacaaattgaacctacagtaccattttttctaagggataatattatagagcttactagatgcttatgttttctttatgctaatttgggaactcctctaccatatttctagccaatccacatatgttgtacactattaatttcaccaatgagaagtttaatgttaattaacaaagcctctggtgctcattggagataaactcctgaggtgattgttacaatcacttcttgattagaattctttaaatgctaaattactattcctggtctatgtatttccaaatgagggtaactgaccacctctacagtatagattaagactaactgacccatatatacaccacacaatttatgttgaagtcttatgaaataaactataagtaacagaacatttgagatatcatgtttcttatggccttggaaaacagtaaaagttgtaagagcaataggagggtggtggaatgaacaatgggacagaaattaggagatctgggttccagtctcagctctgatatccactgcctggatgaccttggataaatcacacctatctctggctctagtttttatcatgtgtaaactagggaggttcttctggatgatgtttgtgacttctatctttgacattctatccactgggcatggcagctcaggcctgtaatcccagcactttgggagaccaaggccggagatcacctgaggtcaggagttcgagatcagcctggccaacatggtgaaaccccgtgtctactaaaaatacaaaaattagccaggtgtggtggtgtgtgcctgtagtcccagctactcaggagtctgaggcaggagaatcgcttgaacccaggagacggaggttgcagtgagctgagatcgtgtcactgcactccagactgggacagagtgagactccatctcaaaaaaacacaaacaaaaacagcaacaacaacaaagacattctgtcattaactcttgtccaattcttaccatctcatttcatttcttactgagaaaaggccatccaaaatgaagctcctcaaattctatatctagaaattcctcttcatattcatctactctctgcctttatgagagcctgtgataaaaatattgaatccttgaaatcaatggttagtgtttcagccagttgtggcttatccttgcacatcccaactcttccacttactagctgtgagaccttgggcaagttacttaacttcattgtgccgcagattccccagttataaagtggtgatagtaatagttcttacctcataggattgttgagagttttaaataaaataattcacaaatgcatgtaaacacttagagcagtgccagggccatcagtgagctttcttcgtgggccctggagtcaagagcccgagagaggccctccatactgttcattctcctctggagcaggcactgccctggcacacaaatggcacatacctatttctttgttcttttctacttcctagtgaccacttagcagttgataatccttttagtcacttgccattcatatgatgaaagctcaacagagatgcacctctggaacatctctgagtctaggcaattcttccactaatatattacagtctcttacagcattcagtatactttgtgcaagagctactaaatgcattctaatcttggctctcttactagccatatgaccgtgagcaaattacagaacctctgtgagcctcagttccatcatctgttcaatgagaataaatataatagtaactatcttataaagttgttgtgaagattgggatcatccacgtaaaatattgaccataatgtctaacatatgtgttcaatatattaacacagagtagcgaagtggttggtaaggaatagaattagtcagaaccaaactgtggaagatattcttaactatccccaaagcccttcaaactaacctgtatgccctgtgaatttgtagctgaaaagaagctggatgagatcacctttgaatacccacaatgctgccttgggcataagaggtttgcttggggacaaaaaaaaagtggggaaagaaagaatttgcttgatacctcaaaaaagccagggcacacataccactaagcctaatcatgccaccattaagtggaattgtccagaaggacatgatcccttctgatattttttttctctaaactggacatgatttgggtaaagcagcatggatagtaatatgataaccttagcacttgctggctcaaaggaaagaataatctttcttcaaatgtgacctctattttaatgtgtttaaagtgggagcatggaagagtggatcccagatcctggatcctgatcctgcactcagactaggaaaaatgtagttccaactgggctctcccagccatgagttttctgagttttttaattaaggctgatgcgtgagtggaagttaagaacgtattcgtttgagtggatggatttttttcttttgatgttgcttgcctaagtcagattgaaaatagcaaaggaaggagatatggaaaagattaaaagagaaattttgctaatgtgattttccagcattttagtctctctctattctctccagaacaaaggttaactagctgattccataagcatagattcatgagaaaggatcctgctaaggaccaccagactttttagtcttttaaatttttttttttttttttttttgctcccctctcttcttctgtattctgtatctaacagcatggtgtatccagcaggccgaaacctgggttatgaccaaaggcaatttttagccacttcctatcccagtgtacccataatccatgagtatcatctcctcttctcatttcctattcaagcctattcctatattttcatgtggaatcactgatctttttttcagatgaagaaactgaagaggaggaacagagatgctcagtgactagcccaaggtcacacagctaattgataactgagctgaggttgtaatgcaggttttccaacttttggcacttctctaagatgtcttcccaacataatccttattctcttggctttcactgctgcacaatgacatacataaaaatgacaacactgtcagttttaagtaggtggcagagaggaagaataaatccacagcaagttaattagaaatacagtaaaacatgagtttcaggcgccacaattaatcgtatctaccatttagtgcctccaatgttaacctgtcatagtttaccaccctctgatctatagtcaaaaatgagcaaaacaaagtcttgaagtcctattacagatcatagaccgttggagctggatcaagtagttttaatctaattacctcattttgtggatgaggaaaataagaacaagaaaggaaaagagatttgccaaaggtgatgcagctccctagtagcagaagtaagttgagcatctagactaacagattatcagagcggggtcttttccaccatgttttgcagccttatcagcagaaaactgtactaaagtaacaccacagatttattactttactaccttctgttatctctttttctctaattgtctaataagagaatcgtctaattctcttattctctagtaagtcatattacccctacctgatttttttaatgtggaaaacacttgtattattatagaatttaaaatgtaaaattaatttctgctcattgtcaacaaacaaaaaacttcaaaaatatagagaagaaaaattacccaggtaaattaaaaatcacccaaaattaagttttaacatgtgttcagatttgtatcctgcctttttactttatattatattggaagcatttgtccagactctttaaatgttctttaaaattttgatttttaatatttgtgttactgtatcacagttattttatgacacatatgtacatataaaaccattaccttatgtacatatatttatatattttatatatatacatataagtcattatatatgagcccatatatatacatatacacacacacacatacatacacacacacacacacacacacacacacacacacgcaaccattatacaactttatgcattgaggtggattcccaattcactaaggcttactattatacctcaacttcctctaatgcctacattctatcacagatctgaacacacagtaaatatgtaataaatacttgctgacttttagtttttctggtcttttttgggatgatcattattcctccaccgggtagggcaaccaaattgagaacatgactttccatcctctttaaagcacatgttatataactcaacaggcagtatagcaatggtggttatgatcagaagccagactctctgagttcaaatcctggatctatctctttcttgttgtatagccttgggtgaggagcttaacccctctaaatctcagtttttctttctgacaaatgggggaaatattagtatccactgtggtaaaaattgaaagataaaatatgtggaaagtgaatactcaacaaagattagttgccattattattacatttgccaaagggaaatagagtacagatttggagtcaaaaaacttgagttcttgttccatctctgctattatctagccctatgtccttgcatgagttattttagtagtccatgtctcagtttcttcatctacaaaatggagatagcaatacttgagctgtatagcttatagggatgttatgaagattaaatgagagaataaatgtgaaagtcctttgaaaactatgaagttaagtataattgctaagtatataaaggtagatgtaacatgattgtcgtatggtaggactggagatgcagagggtgcaggagactaggctgaatacagtgagcctgggaagatatttttaaaataaaattccttgtattggaaatatagactgttatagacagaagggaccttagagatcatctagtccgtcatcttaatgttatatttaagaaaaaagattcaaagaggagagagctcaaagtcacaaagccagtcacagaaatgaaactagaattcatgtctcttgatttcccaaacacattcctaaagcaatcactgcagatccttgtttgttgaccttcatcaaaaaaaaaaaagtagtaaagaaaaaaatacagttatttgtggcatccatgttggtagtaactgattatttggggttttatcacaaggataagccacatataacatagctttattatatttttaccaactttattccaggtgagaaaagtaaaggcgcaggaaagtgatgggtcgggggaggattcagtcagggcgaatgacctcagacttggccagattcccaagggattgctgtcatccccggcaatgaccactgtagcacatggtctttctttgattgttaatatttactttgcagtcagtccttagttatgtgtttttggaaaactcggtatagtagatgaaattatcagttgcttaaaaatacaattgccaattgtttgattcatgtaaattgattacagtcagaggactattcattttatgctggcatgcatacagcccacgtcaggcaagggctgcatcactgatggcagctcagatatcgtcgcatttcctgaattatatcccgtcaggtactcagtaaatatatgtgttggatactttcatctttacatttttttagctgagatgagagcacataaacatttccatctgacaaccttttcaacttcaacagcacagaaggttattttcaaaagaaacaagaaaggagtttttcaatagcgagctccaaaggtgactaaaaatgccttccaacaaggcagaccattaagaaatgtagtgtgaagtgtgttaatacaataaactcaaatgtggtctcactagtcttagctcctcagaatgttggctgccttccccagctgccactgtggcctggacagtgtacatcaaggttcaccctctttcctcaatcttgaagtgccccctttccacccttccgctgaaggagacctatggccagaagcagcttcccctcaccttgtcacccccacaggtcctgctgaaagggactacctgccttggccaggaagcatcagggaaaacaattggacagctctgccgtgctgcaaagatcatgggctgctgcacctaaaatgttcaccaggtgggcccgccaaaactgggcctattgtatctggggtaagtgcccatagtttgaaatcagcaaggtggaaggaaaggggaaagaatcttgttcaccaattcctgttatgccgcaaagaagatctccccactctggaagcttgaaaggaacaaattccaggcaagtcaaagtcaagcctactttacacagtgggaagtaaacatatggaaccccttagcccagagttggtgccagctgaaaatataaatactgtcagataaggttcaatacatttatgactgttaaggcaatgataggttattaaaggaaacgaggctgtttggggacatgttaaatctctgagctcaaaattagtgaggacaagcggatcctctgacagcctcagtgaatgagtcctgaagatatacatggtctcagaactgtgattgtgttctccaattaagctaggaaaaaataaagatgtggtatttagggctgcttggctcaaactgagatgctaaaatctctggtttgctcagagttaaattcttcaatacatgtaagggaagcaatgcgttatggaagaaaaaaaccctagtatcctccctttgcactgctgctactaactagctatgagactgccccctctttaggcctcaccttttcccatttgtaaaataagggaattagagtaggtgatttccaaggtcctttctagcttcaactaggtttaattcaaatgatatcacgaggttcccttgaagggtttggagcgggggagatcctgcatctttccttgccctcccttgctcaggagctcagagtcttcaagatgtttgaaagatgcccctgattctaccaagacttgactccttcaagtctggcctccacagcagacgtccatgctctgaaatttatatctcatggcctattcccccactcatcaagctcccaattgcctggtaaagaggtagaactggttagatacaggggtttgttttgttcagtgcgatagcaaggttggagaaagtttgggctccaatattagagacagcattgtatgggctttaaagctagagctagcccgggttagaattctggttctgccatttctgtgctcatctatagaacttatctcatctatagaattacagtgataatactgtcatccctctagggtgattgtcaggattaaatgacagaattcatatcaaatccttagcataatgcctgccataaagtaaatgctgccactagtgggcgtcttttcctgttctccactaaatagatgttgagttaaaaattaaaaccaataaatcaataaatattgagctaataatcaaggctcaacttttaagttgtggcaaattatttggagtctcagggcccccatgttttgataactataatggcgtatttgcaatttatcaggggcattctggaaactgcacaagccaatgagagaactaattctggtgggtggcatttaattttgcagtaaccccgcagatcacactacttagatgagtgctactttgaccacctcatggaaccagtgcagcctgtgggcatcctgcagggaggctgacagaaagggaagttccaaaaggtgaccccatgatgtggctcatccattcatagtgctgaacaatattttacctttcctgttcaaggcgttacaggtgaactgtaagatgagaacaagatcacaagtcagcactacctcctcccttcttgagttctcaactgagtgagcatcatggagggagaagaaagaaagaagttcagcctgggtgtgtgaagctgtaaagttgcaggttgaacccaaacccattttagagacagaagaaactaccctctggagataaaataaaaagatgaagctgagatgggacaggatcaaagttgatgaaatatcaagagaggttaataaaggaacattaatttattcctcaaatcctgtgttcagttgtgtgggtgtatttttgggagttgaggggaaaatggaaatagatatgataaagaattaacttttcttaatgcacttccagttgattattattatgaatgtcagctttgacctggaaatcccatagctcatcttacacaggttgcctaaagataatttctcttcttaggcttttctgagtaagaagccctcagtctttggtggaaaaacctcagtaattaattggaaacatgcatgaacataaaatggcttaagagtttagtggatcaggtaaggaagtcaagagatggagatgatccctaaaggtgtgtaccaggtccagtgtaagggagggtgagagagatggtgacttgcagtggttggcggcactttactgggagcatcgggtagaaaatctaatacataataaggtaggtcaggctgatagcattactatatccactttacagtttaaagaaacaggctcgaaggagttaaagtgtttttcccagtaagtggctggggtgagactcaaaccttagtctaatcttatgctccttccatgcaatatgccgtctccattcaactagcattataagggaatgagtggttctaagctaattttccagatatttgaagcacatgtctttcagcagtgcaagtgctatttttattttaatcatttttgaagaaaaaactttctacaatgcatcaaacacctccacaccttattatgcagaagatacagattactgtgcttttaattttctgtctatttccatagccttctatctcttttcccactgtagctgacaatgttcagtacttcctaggctactgaagatagacagcatattagaaatgaagcactcctaaaagtagatatactaaaatgtgacagctgacaataagtgaacaccatgcagaatcaccaactacaaaagcacaacagtctgggattaattcaggtaggggcaaatagacctaagaggccaagtaaccgcatggacaacgaactcagtaccggagctggagttgccagtaaagaccctgaatcatccatagaaaattgaattctgttcattcttctgcactggtatactgtggggaaggggtgatatatgaggtccatcccagctgggaggagtattttttcactgatatttagaaatgcctgtgcatatgataataaaaaagcaagtagacagtttattactgtctttaaattctctacacactaccctcttattgtttgcaccccagacagaccactcctactgctcctgcgttggtatgccagtgctttactgtgtttaaaaagatggtcgtgggggagggtttccactttagaaagatatccactatctcaaatggctcaagatttggtatgtctaaaggggtaaatgtttactgatctggaaaacataactcatgtaagaagcatggcaaattattgtgtgtttagcctgtcacttctctttccttgttccacctgtaatttcaaaggaaaaaaaataacactacaagcaaatcctccatagaatgccatcctattggcctgctgcaagtacttggatcttttcaaattccaatcagaatgggccgtgctttgccttctccatctctgtctcctctgacccggcaaagtttcccatcttttatcctgtcacttagctaatggtgtgtgtccctcttgcatatattccatagtcaccggcttctttcgctagtagagtcgtcagcgagatgctcggcagatggctcactggctgccgttcttgtcccctcactgcagcaatctgctgttctaaatcaaaatgttaatgaaaaataaaagaacgcagtgccaatgtctgtctgatttaaattaatacagagtcatacctttggaggcaggttttactggcacgaggttctccatacaggctacccatattgtgtgtggcttttttttcctctctaattaaaattaagcactttcatttatctgagtctctcttggtacccccaacctgttctttttaataataacaaagacctaacaaacagtggattttagtgttccagggaatggcatctcacctggtggaacataattttgagagatattatatgtgatgtctaattataaacatactttgattggattctgttctcaatactgaaatgacacatttactaaatgcttcaagtgcagctctaagttaggcatgtagttattgaaatctctttcaatccatttgttttaaaactggtggcaaaatcactgctaatttgctactttatttacaagggcccttcactttctatgtactcagcacagtattcatttctgttgctgcaacaggactgctcccctctttggggaaaatgtatgtgtctgcaagattgactatgcaagacaaaattttaacttcaatttagagacgaagggaccacggtgatgttaacagacatggtggaggaaaatcacctcagtattataatttgcaaaaaaaaaaaaaaatctatgaaccaaaagaacagcagtttcaactgattgcagaagaccacacctttcattttttcttcctatgactcctttgtagatactgctaggaatagtattgagaataatgagttaacatagtgcttcttacataccaggcatccttctaagtgatttacatttatttattgttccagtcatcaaaattctgtgacttaggtctatttcacagataaggattctggggcacaaagaagttaagtcacttgcccagtcacataactggtaagtgacagagccagagaagaacacagcctggccccagagccttctcttttaaccactataccattctataatgtgctgaaagggccacgaaatccagcctacttgaaagtaagctactgtttcctttcagattcggcaaaggatattctctttgctgaaactgctgtgtaaaaatcaggtttctacttcagtggggcttggtccttgttaaatgcatgtactatttgcatgtgtcaccaccattaagattaaggtgagccaggtaaattaagctgaagcagcaggcaggcaagcaggagaaaagcctgggttttcaggtgggaactggggtgctagtcattaggtcagtcatctcagggccacctcacagttctgacaagagaaggccaaaagaggtaaggcctacaaagcccacatttgaaccagccaagtatatagggactccctcctggaacacaacaggtcaggtcacctggcttcaaactcagtacttattcctacctacaggcagggccaacacacaaaccaaacactattgaagatcagccttcctcctgctgctcagaagccagctcaactggaaaaacaaacaatagaagatgattatctctaattaaatatatgcatcccaggatacatttactggggtatcaagttattcaaaagaaaaagcctctagtcggaaggggctaagtagagaggcagtcatttcccttgctaaacctcattttggtggttgcatttttctggccttaccagggactaaatgaaaatatgagatttgaaaagaatattaccagacagcaggataggttacacagaaccctgggctgggagccagttgtcctgggttccagccccaactctgtttctaacaaaccatgccttctctgggtttcagttagatcttttgtaaaatgaaaagatcctgtgagggcctttctaacattaaataatttctgattttagccacctcccccaaccaccagtttttaatgaaagatgattctccctacagaaacaaggaaactcagaggataatttgaccaaatgaagcaaagatttgagctgttttggggtgtttccaaggaggcaactcaaaccattgaagtcagaaagtagatttctttttggcctgatctctcccagttgatatcactagataattgctcacccctctgagtcatcgaatcataggctgattgaatctctgggatataaaggaccttaaaggtcatcttttcccacctaccctcagagatggactccctttctccaaacacagctagtctaagtagtgggacatgtctgttttataaagcttgtgtatatacaggtgctgcttacctggatggatgtcacaggtcattggaccctttgactcctatttccaaatagctctcactcctgctcactgataccagagcatatttaacagagggactttcattctccactgaaaacatatgatataaattccctttgaagaggtggcactgtctaaattcataatgcaatgcatgcaactctatagcagatcctatcatgagagcagatttcaataggaaaggtgcccaaagacatggaattcttgaagagagtgaaacaggtttcagtgagaggtaaaaattatatagaatgggaagacagcaagggtggaggccctagagtgatagtctaatagaatgtgtaacaacctgaagtcagacttgggtttatagctcaactctgccacgtaactaaccatattagcttgtacaagtctcaacctccctgaatctaagtttcccaaactgtaacacagggataataatatctactacataaggctgttgataattaaatgagataattattcaaaggcataatgacagtatgcttgatttaagtacattttcagccccaaatctacaatgttgtcatagtctgatggcctttgatgtgtttgttcttggttatgcctctgcaacactcgtgaatatgaataatgttgatgaccatgtctgcagccaccagtacaaattttaactctcttactcttctatgcaactaactacacaactgattctagtaccagccaggatatcaattgtcaagcaactgaaatgcccacctaaactttgatcaagatttgcaagcacaaagagattagctccatgctcataatttcagaggagctcatattttcaaacctgtttcaatttagcccagttaataggacttcaaggtagtttccctaattaattagctccaaccaggagtaaatatgtatggtggctttttgaaaaatattcccaaggtatatttcaaccttattatgggagaaaaaggttaacaaatgggatggtaaggtttcagtacaaatttcaggttgtgtgggggaggtactgagtccatatgcctgtcaaaaataatgacagacagattacaggttgcctctgaacatactgttagatagccttgaagcccccgacttctacactattattagcttaaatgctgtcaagcttggagttgggttttaccgtgattttgtttgtttgtttgtttgttggttggtttgtttttctctaggaggtgttgttggtttggagaggctcatcaactccatgatttattattttctatcagagaaacatgaaagtttggggtccagcattgtcttccttttcaaaaacatgctcaaagctccatattaaaaaaaaaaaaagtttcaacctgctcctttttttttttttttgccatcctccttttgcttcctaaatcccctaatctgagatttgtgtgagttgcctttatttcctatcccacattctgttcctaactcctacactctgtttctattctcactaatctaccaacatttctcttttgagttcaccagtgatcttcttgccaaatccaagagctgtttttcaattgtttatcttcctcaatctctttggtgtatttgacacactggttttatccactcaaagtatctcttgccttagcttctgctgacacttcactttcttgattctcctctgattttccatctaattccctttttgcctgtaacattaggcaaaaatgttctccttctcctttctgggcatgagtttcttcctcagtaaaataaagggtttagacagggtaatatccaatgtccctttcatataaaacattctatggctctgagggtcagtgagttatttgactttaacatgttatcatgtttttaatgttgaaggttttgtagctattccagtcgactttagtgttccagtaattgatataagtgtctgaacttcataaggctaggcctttgctgatttatacatgtttaatacatgcttgcttttcttctttatctaagactatgcatattcgaaatacctagatactacactgttcctttcttgaaaatagatgtaaggtacattctagaagaatatcctgttgcttattattaatactagtctttcaaaaatgtatttggatcagaaatccttcatcttgttccatttaatttggatatttagaaaatgaaacaacaatcttttcagccaagtgaaggcattatgaccaaccgtgagagccagaattcaccaatgtcatcaacaaagggtcaaaaataatatatttgacagcttaatactgaattcatatgttacacagaaataggtggtaatgctttagtgaacccttgtatatctctgagaaacataacatcacttaaagacactcaaaaaaatgtaaaacaacacaatttctattgatacttcttttccttcacccatattttaggtgctatacgtgatactgccaagagttgcctgagaccccagggcaaaagactggctataaataccttacaagtcatccccacaaatccaccaaataagaagtttcccttctcctaattaaaaggcagtaatgcaattactgatcccaagggtatacaataaatatatgtcagtaatgagaaggtcagaaaaagtaaattgttagtgtacaaaatagaaaatgcctgtccctgctaaggaagctagtcaagagtggggattagggtcctttagctgctcccaatgcaagacacataaaaaagtagctgaggttttgttttcttatttatcaccaaagaatatatgaatttgaaagaccttgcacacaggagctctcttgatccatggaacataaacatgtcagtgtcttaactagccatgatatactatcatcttcctctaacaacagaaattcagtgacttatgcaaagttgtaagagtcagtggctgagtcaacagtccccaaaaatctctgtcaaaaattcaaaacttgttaatttatacaaaatattacaatgactgccactctcgctctttcttcgtctccttctccctcttcctctgcatttctctctctctcatacacacacatactccaccctacctaagtgcttctcaaagtcaacatgatgggctaatttttattgtaccgtatagtatcgttattgagcatggactagagcattcaaattaatagacttggtattcaagttattagaaaccactaaatatgtcatataaggtttaccaatttttaagagttagaataaaataaaatttactcatgactaaaaatatattgtgtatgaagttatctttcattgatgattcagcactgctctggaaagacttcacacagttaagtaaaagacaccatctttggaatgacaggaccatgaaagtttgttctaggtaaagcaactgatcctaaggtctctgggaaaagaaacaacctagattatttctcaagtgagtaaacattgtcagaattgttatataaaatgctaaaaaaaaaatcttaccttgagattgcaaactcaaatattcttgacaccttgccttctattttcaaatcagaaatcccaactttctgcccttaaaagtaatattgtggtatctcattttgtagatcagaatgtttacttctctagaagtatcttcatcttttgggcttttaagatattaccctgagaggtcaaatttactatatggcattgtcacaacttcaggcttaaataggttcaacaaaatgccaatttatctatcgagagctctaggtgatattgtgtgaatgacaaagagtttgctgttgtgtgccaagagttatatttaggtttctggcacaaattaataattacttataacattttataaaaacaagaaatcatcttgacagcctttcatccaaagcaacatcagtcgttctattagtattggagtttttgcagtgacaaggagaaaatgatgggtaataatatcagaaataatagcaaatgctaggcatttgctaaatgcttttacatatattatgtcacttaaatcttcagcaaacctatgacataggtactattgttagctccaatttacaaacaaggtcgccaagacctagagaagtgagggtgtccacagcaggggtccccaacccctggtaccagttcatgacctgttaggaaccaggacacacagcaggtgagccatgagcttgcattactgcctgagctctgcctcctgtcagatcagtggtgccattagattcccataggaatgcaaaccctattgtgaactgtgcatgtgagggatctaggttgtgtgctccttatgagaatctaactaatgcctgatgatctgaggtggaatagttccatcctgaactcctccccaacccccgatggacagtccatggaaaaattatcttccatgaaaccggtctctggtgccaaaaaggttgagaactgctggtctacaggatcttttgctcagacaaaatgacctgggtgtagaattgcattggttgtttcatatgacagagcattaatgtttagtgagcatctaccatgtgccaggaactgggccaactgctttacataagttgccttatttaattctgccatcagccttatgaggttgttacttttaaacatattgtacagatgaagggaagaaggatacaaagaagttaagaaattttcccaaggtcatgctactagtgagggcggagctgggatgttaatctagataggtttgattctacagttcacactctttccactatgaagtaaaaatcaaaccagcaaaaggcaggaaataaatttagtttaagaataatttccatattgtttccttggagttaaaactttaatcatgaaagctaatcccagtgtcggtgccaagagtaacttcctgtacacagagcttttatcctatggaacacagggttacagcattccgatcacttttagcttttagagcagagaatgggaacaggttgaagcgattctccagaattcttttcaggccaaataaagggaaaaaatagacacaaaatgcaaaatcgtccaaacttatccatatgcagcagggcagctttctctaagacaatgagttaactcttccatcccattagatctccctctgagtacaagaagtcagtccctctagcctcagtggcctgaaagctttaatagcctacccaaacagaaacaccccatcagcatttctcattggaatcccttggaatcattgttaaaaattgcagttcccaagcccaagccttgaaagcaggacttaggaatctgcattttaataagtatcccagatcacttatatgcacagtaaagtgtgagaatcactacacaaagcaatgaaagtctcaagccttgtgttctgaatttaggatgctcagacacagataagctgaatttattttcaaggaaggaaagtctcctttaatttaattaatattaacaacctacttaacataagcttttaaggttttcagaagcagtaaccggcaaacagatttaaggtctgttcacatcctttgtatctatccattatagcaggacataggatctgcaacacgaccatatgtagatctcagcaaccctctcttagcctttaaagttccctatataaagttcaatgttcatctaagaacattccataacccagactttaccctaaataagactgatcttacataaatttatccctaaataatgaaattgaactatatttcccttctcacagttgaaatcagtctaaagcagggaatagtagtctccataataaatagcaattagttgagtgtttactgtataccaggccctattacaaaacaaaatactccctggattaaaagggcccacaagatgattttgcctactgtaaactcctcttgaacattcataatgcacatgaacctattaaggactgcaagagggccttgaaggaaagaaatcaatttatttttcttaactcagttacaaaaacctatctgatagcataccccttttatgaagaaaacctgacatacactttgagaatgtgctgctacgcaacagtgtttctctaagtgtcagtggcatcaaaatgcaaagtcaggagccctacctcagacctaaagaaaccaactctgtgaggggcttcaggaatctgcattcttaggtacactgctctaaggtataccaggagaatcagcagttgccccaaagatgacagttgagggaaattgttatagctacactggcaaggctgactgaaaattaaacaaaaaattccaaaatggaaactaccaagtgactatatttcaacaattgatagttcgccaatctaaaaaacttgggctttttatagggggagattcttgcccatacataactgggatccaagaacaatgcacagaacaagtcccactaaattgtccagcaaattctgctgccgcctcaaggtataataggaaaacataggtgggtagatatgctctcccacttgctaagctgtaggactttagcaaaaccactttacctctctgacttagttttctcatctataaaatgagaacaattatctctacctcagggagccactgtgagaactaaatgaggcagcacacacaaatcttctattataaatatgaagttcacaaactgttcgttccttttccccttctctccttcccctcctcccctagtacagtacagcactatgatgtcagcatcattagcgtggagaagacaggaaatgttgctgtcagttttagtgtagttactctcttctgagggtagtttcctttaatgaacccctatgtcgcaatactgaagtagccattcaattctgctaagtaggagtcaacacccactggggtacacagagatgaaaaggcaagtcctgccctcaagttgctcatatcatagtagtgaaaatacctagtgtgtcagaaaatgggaactctttttctggggggcagagagatggacgcagctggtcacagaggcaagccaaactgatgcaaaatgcattatggctaagttaaatcagagaatccaaggacacccaatgtcatctttatctgtccagaaaagccaactgctgacctaacccagggctgcagttccagggctcggttccagcaaccagcacaaacccagtcacaggctgctttgtgctttgtgcccggtgctgtactacatatcagctaaagccagtaagctgagctgacctctgctctctaggaggaaaagcacagatgaaggcaaacctctaatgcacacgaaaataagtgaaaacttggtatcaaacaagcaaataaatacatttgctcatatcattctcttctcaggttcctgttgatttttctctaagatgaaaaagcttaggtgagactgaaataaatgaacctcaagtccccagcctcccctacctcagcaacttgtcaagagagttggagattttttccatcgttatttttcaaaaccaatttcctaactgttgcatgacaatcagcagtcaaactaattggaatgttactttaacatttcttcctccttttagcattttttgtgctgtgttgtggggaggaagggatgtgaggtttcagcgatgcttacatagaaccttacctttcctttcctttcttatcactgctcccaactgggtcttcagcttcttgggtcagtgggacaaactacaagcaactgctacagtgtccctttcaacttgcatctcttctcatatctagtggggttttggggattgacaaggttggcacttctcagagatggagggaagggagaggcagtggttgaggagcaggaccagaggatgaagtgcagacttggctagtaatttcttgtaccttccatttaaccctatgccaagcctccaccaccaccaccactgaggagaaggaatgtcataattaaagaaggctctacgaatagcacagatattgtttctaaacaggaaaaagagtggtaggggaaggaattctattaagcaaacattgttggtttttctccccctgattttcttcgagaaatgtgtgtagggagagactacaatgaagggtcataatctattaaatacacggactaaactaagtatgccatctcaaaggaaaacataagtagtgtttaaaggtctggtctagtctcagctggtcagcctagaatccactggacaactgcacttcattactaacatctaactcctcaaatagccttttagtactatgtgatgctgctaaagggcaaaaggtgctgacagggaccatggacatttctgcagtgcctgtccccccggtagtgttcagatcttgcaaagccaacaaaactgcagcataggtcagctgcaaactccccctcatcagagacctccctgagccagcaaagtcaaggctgtgagctcagggccttcagaaggtcactggagaggacagtgagtctgcaggatgagtcaggagaattgagaaagcccagccagtccccagagccaggcctctcgtaaggcagccaaggaaaaagctctgtaagaacctggaacaccctgataatggagaagagggtggaggaaagaagcaacagacagacaaactccctgtcctcagcatcagcaaaagaaggaagtagaccagctttatccttgacaagtccttatcccactttcaataccctctccaaattacctgagacacccacagaaatgccagccgaccaggcatttcctaccacccgcaggttacccctttccccaacaaactcacctttctcagagcttccccagtatttcatgtcttgtttcctcagcatttctctgccttgtcattttatcataactgatctgggccaatacaccaattcctgagttactgtggtccccagcagggtcacatattggcaagtaaacagttgcctcttagcaacagagtacttgtaccccaaagggtatgtgtggtgaaaggatttccaatgaaggggggacctcaggcagataaatcctgggggaccccacattcaatttcatgtgtactgttacctctctctctccttgttaaagtgtaagccagctcaacagatatctggccaaaagcctaaaaacaaattaggtcccagagtaccaagataccatcttttgtgggccccaagataaaagagcttcatctgaattatttccgacagattgcaaactgctcatttgtgatataatcgtttgggggaggggaagaaaaaacaggagttaagaaaactgtagaggaagaaaacttttaaagcaacacatagtatgacaaaaattgtgtgcttaaaagtttttgaaaccttacattgttccaaagatgctaaataagaaagtgtataacctgaaaggcctacccatggcatcagcttgtatgcctggcacctgggagaaagttgggaggtgggactttggtggaaggaagaaggtaatgattggcagttgaggctttttctgagatgactgaggataagacaagcagctggtattcaggttatccagcttattagaggctgtagacaccatttgacttgcgatgggtctgacttcctaacatactgttctgagttgcagctgtgttttcagaataaaaacatctagtcgagttttgagttctaaactatctaagaaagcatctaatgatgctgatttttttgttttgttttgttttttgttttttgtttttttgacacggagtctcgctctgtcgcccaggctggagtgcagtggcgcgatctcggctcactgcaagctccgcctcccaggttcacgccattctcctgcctcagcctcccgagtaaatgatgctgatttttaatggatattactgtctctttaatgagacttctctggagaaagaatactgtgacctcaaattacttgtgcaagtggacttagcaggcctggcaaatggaccaagcttgtctttgggttccttctccttcctacttcatagctctgtctctctacacccctatcattgggacccatttttttcctggtaatttagggctccccgtgactccatgctttctcccatcacaagaatctttcctatgagggctcagttgtctgctttccaaagtgacagctgggggctaatgagctaaagtggtagtggctgacagtgagttaaattcttgacccttcaaattagagcagtttgattggcaaggaatgcctttctaatgataacattttaagcttgtactaggctggaggagatggcacttgtgtgtaacggggtgctgcttgacacacctccagtcacacagtggaaatggctgcctactttaccctgaacatagcacagaggaggtgccttggctgtttagaggatggaagcaaccagctaacaaaaaaaaattgcttaatttacaaataacctattagcattgtcaagaatccactcacaggcaggtgtccatccctaagaaggctgtgtattttacctatgattcttgctttgtcttttgcacttctacctttcttaactgagtctgaggcaaagtgaagttgccaaactgttagtgcatttttcctgggtcatctataaacttgccttccttactaatgttttagaatgagtctacctctaatccccactttcttttaaggttcaagaagtagacctcactttactcaacagctgcattactgaaaatatgtgtatatgggaagggcaataccaataaacacacctcattgaatcgatctataatgtaaagaattccattattcagtaaacaagcataaggctgacctttggccaaattgaccagtaatacacagctgtggtcaaaatattatatgctcccataccagttggtaaatagctactacaccttgtcctggatgccagactgtactctgagatccctagacctccacaagatccagcagctaatacagtaatgcctgacacagcaaagggcctccgggtccttgctccagggctacagctggaacctagactgatttgttgtttcctgtgctttcctatgtgaatattatccacaatttcaaagctactgagtagcaggcactaggtgtggccatgaatgtggaccataattactttgcttaaaactgtaatagtgacactgaggtttgtgtcagttcactctgccccatgcattcccatggagcagaacgtccacgaccttcaaaagatggacgacatgagccctgtttccaaaatagcacttggcaggcagcctagatttggatgtgaacagcagacacaggctatgggcatgatgggccagccccctgtcacatcacctcaggggatcctcagcctcatgggactcactagaaaatcctttacatctgaaaagcagaaattatctagtccacctgagtgccctgggagtgggtctgtattcttagcctcatgcttccagtgctgagtttagaacaaaagcctctattcaaggtcatatggtgagtcagctactgaacagggagtgaaaagaaagggggaacaaacaacccacaacaggattagcttgagctgcctcaacctatgagaaaggcctggtcaaaccatttatagtcttcatatatagatagcttgaagaattgcctctgaagggtgttaatgaacataggtaaggaagaatggtgatagttaatcagcagtcctggagacacaaatttgtggtcgccttgtgatacaggtaaattatacaatgagtttctgcttgctgtccttatgtgtatcttaagaaataactccttcattctacctcaggtaaaagctcactctttctcccaatgcaccttggctactgtcaaccttgcactaatataaatggattcctccttgtgctaaagggaagcagaaagagccccatgtctgaatttggaaggtctgaattctactcttgactctgctaactctcttggtaacattcagggagacacattctgttgtttcattttcctctttttatcaaatagggatgacactacttcctacttcatgggctggcataggaagaaaacagtattatacataagactattcgaacattccagtaccctccaaatacatgaggaaatatgactgtctcagagatgctcaatgagtacatggaaaccagcacttatagcacttatcaagcacctactatgtgcctggcacttacacactcatagttttgttgatcctgacaacaattctatggagtagatattagttgtggcatgttaaatgatatgggataaaaatgacaataaaatatgtcagtgcattcaaattttaactttatttttgaagtaagtaaatttgatcccccttaaataacaagcttgcacacacacactaaaatggaatccaaactacaaatgacacaacagatcagtttagcatcaacttgcatttctaagataaaattgaaagtaaacgtgtgaatcattccataatttatatcacagaagcaaaatatggtttgtgaaagcttggaaaacatgtagggtaaggattattaccctggaaggaatgcataggtgtttaaaaggtagacaataagtctaaacaactcctcacgttaaaatgacatagtacaaggaggtagaaatacagcttatattgggcttaaggtagcagcactgtggggcctcccagaggggcacacagaatgccttaagaaaggtactgggtggaaacccaggtggagatataaaatgaggcaacaaagaaaggaaggctgatttatataaattttcaaatgcaagcatgtgtgagactatccaggatattgcagacctgtagtttcctccctgaccaatgacaggctacagccgaagctgaactctgttccttacaaccttggccaaaggagggatgagatgcttgaggggaggggatagagagagggtggctgttaacacttttatcctcatcttacacaaagaaaatggggcccagaaagttgtttcttcaggcatgcagctcataacaagggacactgggagtcaaacaaaagtatatatgaccttcctatacatactttgtgtaaacaaagtatatatgacctttttatactataaaaatccatgttttttccaagaaaatgcaccacttccccaaatcacattctctttctcccaaaaatggtgccaaacccttgggtgatagtgaaacattgctccaagccctttctaacttaagcgcccctcacaatgaccacaccactagtcataaatgatgaacatctgtaagcattcctacaaatgctaaatatcaccatttcattggtcaataaggggagactatgtgaccaagaagcagagcagttctctattaacaaagctaacctaccttcccaggagatcaaactcatccatggctttatcttgtctctcttctttcctcagcctcccaggcacagagatccctgaaggccaagactctctctaaaacattccatccaaatagcccccatagcatccagcacagtacttaacacatagcagacactcaaaatattttatgaatcaatgaactctgtttctcccaccatgtgtataacagtatgtccttaatgtcttcatgttattagaatccttgtgaaatttaatcagagattataatgcaaaaaatataagaaattgagatgaaggtaatagttggcttctgagaaactctcctctttctcaatcactaacctagtaacattcgttctagtctcatatctaataccaccaaccagaggaactagaagaaaacatctcagcttcaccatttttaaaattaatcgtatttagctagagcagaagttctcctccctaagttttcatgagaattacctgggaaagctttaacaaaaactgatgctagattctgttcccagggtttctggtttagttgatactgggtgagacctgagcatcagtgttttttaaaaactccccagtgaatctgaaatgttgctagggttgaaaaccactgggctagatgatccttgaggtcccttcttactctgaaaatcaatatgctgactatagctgggtgtctgttgatgtcatgggttgttctgactgttctccactttcctctctaatactgcacaccacgagatctatatcaagttgctcaacagcctaacatcttgtttccctccatttacctattgacttaaaactttgtgtactcttggggctcctaagcacaactattgagatctacttttaatgctatgtgggtcattttgccaccaaagaagctcccctggcaccacgatgtgtccccaaagcactatctggcctgccctgcttccaggcgggaaagcccaacaagcaagcatgaacagctggagtgttcccactgatctggaaggaatccgtaaggacaatgcactactttctatttcactggactctttcatggcactgagcctgcctattccattcggccctttgtcaagaatgtccttgacacttaaggaattgatttcttcttcctttcctttaaataataagccaacagatacgcaggagttttataaggtatcaatttaacatacaaactgcattatggcctttgaatgctacagcaagaaccaatgcctcatcagccagaaagaccaatatagtgacaacctaacgttttcttaacctgtcaaaacattcctgtgctctgggcttactgagagcagacatgccaaggatttagaaatgtcaaattaaaatagtctgggctattttcaaaaagacatgagcctttttaaccactagcattctatcagcaatgctttttcagaatgtagggctgctagaaggccctctttctgaagaacggtgtgaacattacacagggaacagagagtttctcaaggtcatatgatggttttctagaagcacttcaacacaaatgtttgcctcatctgtggttagatgagaagggctggaaatgtggggcaggataagggtggaagggagcacagggcaggagtctaaatgaaaaattcccatactacaaagatcctaaaatacaaatttgaaaaaatagaatctggcatggccttttagtgatacacagctaaggtgctcttcaaggatgggaaagtgcagaggtgctttgttgtagacccttggtcaaattgccaaaagtacatgaggtcattattcttttcattgccaaatgtgtgggaagagtaatcatctcaccttgcccatttgttcttcagatttacctcccatattcaccactctgctgcaactgctctcattcagacaccagtgatctcctaacagccaagtcctgtggttagttttcagttctcattctgactggcacatctataactatttgatactgttgaccatcctttccttctctgacttctgtgatggggtctctctctagattctcctcctatttctgtacttttattttcagttgctttcttaagctagtcttcccatatccagctcttaaatgatggagatttttcttagcccttttctcacttttgcaaaagcttccatgctatgacttacatgattctaagtctttatctcttgtcccaaaatccttccaaactctaagctcatatagtcaacgctctttttggacatcttcaacccaacagacacttatccccattcccagtctgctccttctcttctattatttcagtcgctacaataactttctaactggtctcccaactggcattctttttctcatctctaacctattctcctcgtttttttccagagttttctcttgaaaacatagatatatatctgacatttccactctgtttaaaaacttttatcggggcttttttctacttataaaataaatctactcattatcccataacattcaaggtatctaacaagccagtcctgttttacctttctagttttacttctgatatctcccctgtcatccctactacttcccaacacctcaatcccacctatcttacatatttaaattatctaaattatttaaagcagttaaatatttaaattttaaatcatttaaatatttaaatgtaaatccttaaacatgccgggctagctcatggctcaatgctttctttcacactatttcttgtagctggaagaattcccccttcccatatccaaatcatagttttaaaatgtcaccttgaccaactaaaatgtcacctcctgtgtaaaatctccaggcagaattaatcgtggtttcctctgaactttctgcaaaccataactgtagcacttatgcacattgttttacaattaggtgcgtgaaacctctttaaagatggggattctgccacagacttcatgtttaatatgtctggttctggaatcagagacttggattttagtaccagctctggcacttactaggtatgtaatttggggcaagtcaaccggtgtctctaagcttcaatgttctcatctgcaaaacaataacaatagtgttgcaagtaaatgagataatgcatacaaaacacctatagtgcctgacacataataaacactcaacaaatgttagctatgactatttttctgtgcctggcatatggtcttgcacggagcgagtacccaataaatgattactgaataaattaatcatagcatggaagacctaagaacatttgctaaatggacagtttcttcctttattgaatcttggaattcctgtcagaggcataaaaaatgggttacataatgaatttatttctctgtagtcaagtaataattacagtagcaattgggataaccaaaagctttgtctgtgcagtttatcttttgaacctgaacctattacatctttagtcccaggaactacatgttttgaagtgtacatttcaaacttcctttccaagataaatccaaagactttttttctactctaacatttcacaaataggatgaatcaattaatgtgataattatttaatacaccaagcaataacttttaaggtgtaatggtaattgagcccagcatgcttgaaaataccattctctgagtcaggttcagcaacatgtcttgaagttgggaccttagaggcttaattcattctaaaccccctctaccaatataaaatttaaattaatggtatttctgactcttggtccctttcacctataattcttcttaatctcttgacctctatttcattcatgaaatcccaaaagattatctttcacagtgaacccacagtaatctgtttaatatcccttgataagaaatatccctttaaaaagccaaattctgccatgctttaaatagaaaccctatttgctgagacaagacaaacacttatagtctttttcctttacttggtcctagaaaaggcccaaaataaaacatacatgtcaagtccattgtaaatggatgtggaaaccagacatttgaagtgttatcatcaccatcattagcatcatcatcaccatcatcttcatcatcattatcataaaaaacaacataacaacagttcaagaagtttggaaaatgaggatatgggtttatctaaaactccactacccacataaaactagaattatttttgtatatttttccattctttctcattggcctacattttttcaaagcttgctcccaagtattcccaggtataccaaggagattttaagaacttcagaaaaactgtgattctaaatgtataactgcctagaaagtttcccattgcttcagtttttcagagaaagacactctgagagtacagatggtataatggcccaagtctacaaaaagtttcatttctgtgcatacataccacccattctacgataaggtgttggggatcagctgatgagctgaccaaacatgcccataataatcctggacaaaggctgagaccagcactttttacttcaatttggactctgaaagaaaaattatatgaggaaaggtgaggattccctaatgataataacctcaatcttcatgatattaaaacataataattaaaaggcagagagagactttaaaaaccccattgagatttcaaaagaacaatacaatatgcaaatagtcattcttgtatgcagttcatcattgattatccatgagaacagaaaggagctgaagctttggggcatgttcagtaatatttatctgcaacttctagcttcctgtccctctccctgaccccctccaatacacacacacacttagaataatatttattttagattatgttttgtatgttcacgaaaatctaatatgaccactaataaaagctgaggtttatggccttgttacctttgtctctcaaatttatattccttcattatcttctgcacctcttgaaaaccacacagattcctcctcctctttttcccttttcccacttatctaggctaaatgatttaatactgcattttataatattttatgttgttcttgaatcatttaatgtcacttaaggttacttccttaactggatcatgagttctttgacaatttatgcatggtacctttttttctatctgctgtgatccttgtgacatagactatgagttacttgaggccttattttcctttgtctcctcagcacttattacagtacctaacagtggagctattcaataaagcaaatatttaataaaggaataaatgaatggacgaatgaatggatggatggataaaaagacagcatccaagaaatgttacctagctgatgagtggacttcagagcacttgccagcaagaagggtggccagcaagtgttgataagtcagtcagcaattacttattgagcacctactatctgccagacacagatattctgtgggggaaggggaggggaacaagagaaagcaggcctagaattgaaaatcagatgtgtacaagtcacaaagtggaacacaattgcccaattgtctgactttttgtcattattttctgagtgtagcatgggtgaatatttttctctaccatgaggcaaactaatttgggaggcagagtattaccatcttttctactattctcttgtcttaggttgagttgaatagttcaagtattgagatgtgtagtttcttctgtagtatcttccctgctctgtcaccatccttttcagacaatagaacatgagttggagagacattctgagttctagtgaagtcactgaagccaacttgccaatgagtaagaggtaaagacctagggtgtgaggaaggacttgcattcaaggctgtttgaactttccgtgttaagccttcgcttccattttggagactggagcctttcagctcctcctgtccttctggcaactcttaggaaaaaatgcttaaataacaataacagagcagcagaaaggaagaatggaaattatcgtaatagcatggacttgttgcgccaacattgttagcctctcagcagccaactccatggagctgccctatgcttgtcaatgaaaggataaaaaggatatgaaggagacattttatggggccatttcagctgttcactgtaaatacaccctccatcaaatatagtgagctgggacctagagatcacagacagctgggttgcttgaaaagagaaaagacattatagtaaattgtattattatacatttactgagttccagggtttctgggagggcctcaaagatccaagggagcatttccaaccagtggcttgaagcactgccaggctgggggtaagctcaaggccaactaatgggtccaatgacatgagactataactctggtggttgcgaatttggttaggggctagtatggacatttttttagggtagaagcacttagcaggtgagccaaaaatgaatattttttatagaaagattcaataacaccattgagtgtactgcctggcctcagtgatgccttctggtattaaggatccattcaaaagcagatgtctaaatctgaggttttatgacaatgcctcaccatatccaaaatcattcactctcatccctcacccctcagtaactaggcaaggacacataaaacatatccagtccaaaggcacaaatcaggcagttgtcctagtagggttggagaaggtgggggatcccttggattgccagagacctatgaaaatcagtatattgctgatggagtgaagttagggttgccataggagggcagttcaacacagaggtcagtaaatcagttgatttaattatataacacatattacaaaatggggccacgctttattgaagcctgattgccacaggcaacacacttgcttaattcaaaaggaggaatttctcgctggggttgaaatgctagaaactctgtgttcaacacaccagatcgtgcccatctccatgatgggtagcaggaattggcagtggaaaaaaatctgagagccggaagatttcttacagattagacattgacccctactcttgcagatagaaaaactgaggccagcagtgtactcaagggtgcattgcaggtctacaattcaggtcctgactccccagattgatgtgctttccattataccatattacttctcactgtatataacattcatcatgatgaccgtgaaactgtaaaagacttggaggtactttctgatttattagagaaaaaccatagtctgttccttctattgccagtctgtcatgaatttcatcacagttactttttttgcttttttgtatctataaaaattatttattaaacaaaactgtaaattaatctgaatagcctattccctaccagatagcacatcatgttaggaaatgcaatgtgctcgttccctcagcagccatctcctggattatttaggggatctgtgcctctgtccaagacctagggaaaagaaactgggagtaaaaacagaggccagctttcagagcaaggtgcttgtctgggattatattttctctttctttttcttccatagcacctaacacattgtggggcacacatttgtatccataactgctgattggttcatcacagaaatccccagtctgtgatgctctgctggagatagaagagagggtcattggcttagtgagataagtcattgtagcttaacagaaagataatagctcttgtacttatatggacctgaattgagataacatatgtagaggcctagcatggtatctgacaaatagtgagtgttcctcaaaaggtgttcattattatgattatcatgatgcaaaatatgtgtgccagaaggactaaagcttcccaggggatctggatcactaatcaaatgctgagggggaagtcagcatgctaaaacttaggagtctttgctaaatgcatgatttggggaggaggaagaaaaaaagaattcccagttcctctactgaaggaccacttttcagcactttcttctgaggtgtgcaaggtctgttgtcactgtggagtagttccagatggtttttagtacctcattggacttttggtgccatcacgaagtggaggaggccaatgctcccatgttgaacattagttacttgaggaaagcttattgcaatactccctaatcttctaaatagtaccccatgttctgcaattttcctaattcacccttaaagtcctaatggaaactaacccatcttgtgtcatatgcccccaggaccttggccttagttaatacaaaaactaatttattcagaagtgttaacgatcactaataccttgtttatctcaggtgatccacatatattttcactttcatgaaccctccatgtcaacctaaaatggtttggtagagatttctgacacctgagtaggctggtgggggagatatttatgggcatataggagcattttggtagtcctcaaaccatatcatgtgggcagctctgcttcagatcattctagaaaatcaactgggtataaattataaaaataacaaaaagagaaaattgcctactcaacctatgtgtagggcttcccagctgtcactttattcaattctgtagatattttgaacacctactctgaacctggcactgtgctgactgctgtggatacaaagatggctatgacacatcattggaactcctagttctatcatccagctggggccctaacaaaacttagagctacttatttggttgacaaaggaaataaaacagcagacaaagccaacagctgtttgcttataaccacttataatcagagacgtctctccctggtttaaatacttctctttatctcaaacacaaagaggatgaagatatccatgtgaaaaagcctactcttaaaggtaaaagctaaacaaagaacaagtgataagagaagtgaattctgcagtgagcaaattgctagtcttttcagaaacaaacctacacggtctggtaccaggaaatagcctttgatgaggaatccactaattaaacctgtttttactgtgactattcaaaacattagcaccctggagatctctggaaataaataaaaggcagaaaatcccaggcagtttaacagaaatattttctcccactggtgagaacgataaacccgacttcaaaggaatcataaaacattcaagccagaaagaaccttagagatcattggattctcatttttcaggtgaggaaattaaagctcaaagaggcccagggacacacctatggccgcacatctagaaaatgagctctgggactagaatccagagctcttgaatgctatttattcatgaatctggtcagtcggtcaactaaatttcttgagcaaccactatgtgccagtcattgtgctacgattggtccctatccctgtccttataaagctggaggaagcagatattaaacaaatggcaaattaattatttataaatgtaatccatgctgtaaagattaagtagaggatggaatgaaagtaatctagcctttttgagggagtaagggatggcatggcttaggctaagaaatgaaagataagggcaagttccctagccaggtaaaaattgaccatgtagttggaagtggaggtctgagggaagagaacattctagatggcatatggaaaggtgcttgcagtccaaaactatcccagctcccccatctgcccctctcaaaatccagacgtctcaccctttttataaaacagcgatctacagtatatagagatatattttcagaagtatgggtgtgtagtaggaaggaggcatcatagccatctggacctattaaaatacttattaaatcacttcactgattaaacagttatttttactaaccaatgccatacaccaaggcagataatcagtgttttatgcttctggaaaggtcacatcctcatccttttgcatggcacctggaaataaaataagcctatattcaaagcagtagatgttaaatgatgcttactgaaaataagtcctcactttcaagtagaaataagaagtaatggaattttcacatatgtatgcagaagatgacatagcagtaggtcagcaggcaacaaccagaccttaaccccttccagctctcactagaagtaccctgtccacaagggcaagcaactaaaactatgtagcagttgctaactccacaaggggtttggagtcctgcatcccaaatgaaaaggggtaattctgaggctctcagaggtcatttctgttatggcacctggaatgtgcctaccatctagtcccccactttcaactcaggttaaaattaactgttaaaaagaaagcagaatggtggttgccaggggataagggaagagggaaatggggagttattatttagtgggtacagagtttcagttttacaagatgaaaagagttacggagatggtggtgatggctgcacaactttatgaatgtatttaataccactgaactgtatacgtaaaattgttaagatggtaaattttatgttaaatatattttaccatgataagaaataaatttaaaaagttaactgctatgcctgcaccaaaacatctcacgtactttataaatatatatacctactatgtacccacaaaaattagaaattaaaaaaattaactgttaatattaaactatgatgagtcacaagcagcataataatgaaagctatcctgttatgggcactatttgttttatatgcattatattattttactttcatgacagtcctttggcatgggttctattcttggcattttgcaggtgagaaagctgagcctttgaaaaattaaacaatttgaccaaaaccacacagataataaatctacccccaaagtgagtgagcttattttcttgaaataatcaatgaaggcaaagatttgtgtcttcttactcactgtcatattcccaccaccgagaacaataattggcatagagcaagtgcttggtaaatatttggtggagttggagtccaatcaaagcagtcttcttctagagtctacttagccactggatgaaatgcctccaaggtctctatccctcagcctccatctatttaggttcttatctcttatctgggaaccacagtgtgctcctaactacttgtcttcactaccattcccaggcttcccaaggtttgcaactcttcctgacataacacttaagcctagggataccccttactgaacagccttccgaatgccacaggccctgcttagtcctcattagtgcatttcagatattccatgttcacatcctagctctgacatatgctagctatgttgaacaagttgggttacttctctgaacctcagtttccttatctgtaaaatggaaaaaaatcacttaccctctctgagcctcagtttcttgtttatctcccaggtctcttctagctctcaagccttcatgactaacacactggtaccacagatctattgctgccccacccctaatgacttacagccccttgtcaaagttctgcaaataggtctggtgccatgagaatttgctaggcttttagttactaagatctgcctgcagttaccaaatatgcagaattcaatgatttcttacctcttttgaagaggtatacatagtatttctgcctttattcctacctaagacattttatgcttaagatctagaaatgaaagaatgagcaagatgtcttctgcctgggaatttgatgatcagaggttgaagccatgaatagtaagtatttgaggagaagtattagctatataaagctgttagcttgttgataggacctagaaggactcctatgtataattcctaaaaacttacctttttttcatgttttccttttctgaaaggaaatgctacagtaaaattaagaaaataatggtccctgttttatggcctcaaaacattgttccttccatttgcatgggtaacaccatggagtcctggaaaaataatattaaccttgtagaagaaaatgaagcctgttgccttaggcttgcctggagctattcccttctgtggcctctccttcttatgaactatgaccttcccagatgctaccacctggttgacagggatctgccccagtagtggaaggctaactgacccccttacaaactggccctatgactctggcttaagcaggccacagaatttccagccacttccatcattatctatgaatccatcccttccacacacagcaacagagccatccccatgacaaacacccttttggtccttatgccactctctaaagcttctaccctgaaaagatttgtactttctctcttggaatccatttcacaaatgtttatgactctggaatactgatggtattattataagtagagtggcaaagtgatatgtagaggcaataactatcttcaggatgggccagttcagagtgagcttcttagaggaaattacattccaagcaggcagtaagcaatgccatcctggctccctgaaattgactgggtggcaatccaactacaacatgtatctgatcattttataccttgtggcaacatattgagatcagaccatttcaggggagtggaatattccacctcagcggttggcccactcttaatgggtccttaacacatatataaggagatataataaaataataactctgttctttaagagctaaggtatccatgggtaaatgtgttatgtcatagcaacaatatatcaggcaataaggcaagagggtgcaaatgacaaaatctcttctaaagacgaataactggatcgtaagctcaaatagcacatatgcattgagggccaggataattggtcctttatcttctctttataaaaacaaaggtttatttgccctttaaatggttcaataaaattaaattggtaccctgtagtgtgtgctgaatacataatcagaaattggaagcaataaaaaaaaagagggaaaaggcaaaagtaataaaatctaaaatttggaacagtgtacaaaaacaatgtaggaaaataatgcaattcccaataacacctcctcattgtgtagcagatcctgtaacaatcacttcttctcctgaaagccagagatcaccaactggatccacagtacctcaaaggcacaggctgcttgactttgtagtatcctcagaaaaggggaggggcagggcaggactgggtaagaaaggaagtgactctctatttactttgtccacttttggagggatacacaaaactttgaaagtaaatgtagtactcatgaaaaggaatgcttcgtggaactcaaaatgtcttttaaaatatattccctgtaatccttccaaagctgctcatgttaagatcttcagagaaaaagcacaataaaaacctcataatacataagcatacagcaatccaacctccagaaaaacgggagagttggtgcttggcaactgatgaacatgaaacacaatacattaaaaaaaacacattcttctttctgatttctaattttgatggccagacacagaaatatttgtttaatgagtgacagcacattgataatacttttctgtatgaactggatagatgaaagagaagggaaattgtgttattgttcaattattttttgcaccaaatatattcacatgctttactcagagaaaatattaatcatgcacacaagaattttgacttggaaatctcagaacactttatagaaatccattgtgtagagtgattccggtggccagatacattaaaaaaaaaaaatgaaaaagagggacacagaacgagtttcaaaaaataccttcattaaaatgtcttacagttgaagattcttagtgaaggtgaaactatctagaggtcatctctttgcctccaaccaggagtacattaagtcatcctgaataaattaagttcatctgctttccacacaggacgtttcttcagcctttccaggggcctctcttagttttctccgggctcaacagaccaaaagaccctttcataactaaagaaatacacgttttatttcctttatgtctctcccaggcacctgccaaaggactctgcacttcgtttaccctcaaatatcattgctgcctggctggcacttatgtttagtgccacccataccacaccaatctggagctgggactctttcttaaacacagatgaaaaccaacaagagaaagaaaagtagccaaagtaggagctttaagggtgaaagagagcaagacagtcatagagtcactgggtctgcagcattgctttgtggagcctaggccccatactgaagattaatcttaaccaacttcatcagtgattccatttaaaaggcaaagaggcaactaggtcccagttgtgcacagaaacaaaaatcacaagcaataaaataaaattaaatactcataattaactaattggtggtacagttggctgcttttccccccagagaaggcatcttctatatgaattttggagcacttaaccaagtacaacaactgtaattattattattcctataataatagggttcccacagatcttcgtatttttacatgttttatactcattatggctaatccacaaaacatctctttagggtatgcaaatacttttattgccagtatgctagagaggagatagagctaaaaaaaaaggtgaaatgaaggtcacagattatcagcagtgacttacgaaatagaactagagaattcctcatctcagaacaaatttatgtcatcagctcgctaaatgcttacagtatgagccaaattatactgagtctgacacaaaagtaacagaacacctgtttcctgggccttcaaaagcttctcagtcattgatgaagttcacatttacacacatgaggcaagcaggccacaactcagtccaggcaagctatgatcaaatgccaaaatgggggcttcaggccaagtgctgctggcagtcacagtaataatagatttcttgggggatgaggcaggcaccaaatgctccacagagcagggagtatcagccaggttttgaaaggcaggcaagaattggaatggcagagatttagagaatggcattccaggatggggacacagcatgagaaaatgctcagtagcaggaatgaataagaagtatctgaggcatagaaagaccactagtctagggcagaaaattcctacaggagacctgtggaagacaattttagttagatcctaagtcctaaatatagagagccatggggtagaaaacaaatacctactgtttgttgaacacctattatgtacagattctgtgcttcatgttttcttaatgtaaattccagactgaagagtttggactatatctgaaaggcaatggagagcttagggcccagtcactgcgttccaatatctaaaataagacagagtgtgctcagttacctcactcacatgtccttggccaacctctgaggacttacttgagtgttttataactgagtatacagcttctctcaggcaataccattgttacctgaaaatacaaagcctttaattttgcgtgacatcacacaaagagaattacagagcccgaatcctctttctcttggagcaaatggaccactctgatgtggtcagatgtattcatcagtagcacataaaagttacaagttaatacatgactgagcagcaaagtgctagaggggctacttattccgtctgcagatgaaactacattctaagagttgcatgtgtttacttaattgtagctatttctagctatttttagtcagattccaccccatggagcaagttaggtactttgggagacacagttttactttcaagccactgaaggagcatctgcaaggtccatgcaaaaggactcagctgttccgtgttgctgcaaaaggctaaagtaggaattaatttgaatgatgttctgcaccagtggtttctcttcccaccttgcaaatggattgagttctaaaagatgtgtaatctggctggcctacaggtggccttaaataccagagctgcttgttaaagcacataagacccagggtacaactgaacggttttacagcactgaacctaactctattgcatgctcatgtttctgtgggaagatgcgttcaccttcccaactcaaaagtttagtaacacatgttccctaagcactcccatctgagacagtgggagcagaaatcccatcggcttccatccccaggtgttggcaattcaatgtgactccagctgggtggtggggatgagttcagatggaggctcagagggcctagggaggagggatggattgtgagaacaggaaaaagaatgagatgggtcctctgcaggaagtgataaacagtgaggacacaaatgttgtagatcaaaccagtactaggcttgggacagggcatggaactacagtggcataaggtagtaaagaaatacattttattttatgacccataacacatatgcatgtatttaaaacccaaaacatatgtttcatgaaacaatgaaacaatacgtacctttactacaaagatgcaccttggcatttttctaggctgtttcatttatttttaatgctaggtcatgactcactacattgatttcataagccactaatgggttgtaccctgcataatttgcaaacattgtaggaaaagggaagaaagattagttttcctttattctttttttttctcttatcgatcatagactctggcctggaacaaatcagaatggaggttgaaaaaacaggcactgggataaaagtgatgaaggtgggttctaggcaacattcagggagaaaagataaatggataggaaaggtgtggtcatgctgtcactggaccagttatgagttccctagcaggaggtcatatgaaagggaacttgagagtagaactctgtatatctccagcatctggcacagtacttgatgctgttcaataaatgtttaatttaaaatatctaccaaattgatacacatacattagaggctgattgaacatacacatctgatcaaaacacagagtgaatatcagaatgtatgcttggccaatggcggtgttgacagggtttgttgttagcaactttatccctcccctttgtctctgcgttcaaatgccaaaaggtccccatgcagaggtatccccaactggagagtcattctcctagaggacaactaaaagactcagatctcccctgactgtcactaacggccctcaaaattttatctgacctgtgtcctgtttcctcagtgcctggttctcgtcagaactaatctgacaaaccaatccatactgaagtagtcatgagaaatactgaccgcatgtttcccttccagaccacatttgtaatttaatagggaattttgccatgctagccaaaaaaaggtggatgtttcaaaccttgtggtagtcaatggagaagagaaactgaagatgggacatctttctagggaccctcaaaccacactacaatgccactatctactctgcctacaaataggaagtttccattagtcattaaacaatgccctcctcccctccaaaaaaagtatgaaagttgctagtacaatgcctaaaacagttagtaactaataaatactggttggattagaatctaaaacatttaggtgggtaggcacaggaggcagctttaacaggtcctactcacctagcattgtctgtgataatggacaattaaatgttgcactgtccactagctgcacgtggctatggagcacttgaaatatgactagtgtaactgagaaaagtgtagtcacatgtggctagtggctatcaagctagacaagacaggtctagacagttaacagacatgagacacacattttgagcaagtacctttctctcactggtgcccttgttaaaaagctggatctttttctagattagccccaagacctaaaatgcctgtcttcaaagggttgtccttcttcttttaggacaaaggggtgtaggggatttgtgggagctggttacagagggctttgttcttagattcgagctagaccatctgttcccaatcaaagcagctttcaaatagagagcagtgcaaccctgaaacatcctgcaagggccactgaggtttacctgaatgtacaccctatgcttgtcagatggacatctcagcgtggacctccttggcacaaagttttacacagagccagaacaacctcccaaaccacaattgggcaattacttttaaaaatccaactggttgaattcaagttagaagaaatgccttttactttaacttgcctttttttttccttgatggaaaataggtttttttgctcttcaggctattgagacatatttgaaggaactgaggttgtatggatttttaatgcagcaaaaaggtgaactgttttgagtacaccaatcctgggtattgtgaagatggcttttcaagagttgctgtccatcaggattgcatttgggaaatttcataatgctgcttacaattgctttaaagtcttctagcagatatggatgctgaagaccatgaaccctagggtcggatattaattcaatttttccacctgtaaaatgggtaggccatttgcttcctaacaacaaacagcaatgaatcagcattttgatcttaggtaataacacactgcttgagttattctgtagaaaacaggagtttcccaattcttctggtggctcattcttcaccaaagaggtacttctctgtttgatcatcctctctcctctcagcatccttttctttttttttacttccttttcataaaacttgatgataaatggtaaagatacattgtcagagatgataaaacccaggagagaagaaaattgttccagttattttttacccaagatttaggcctgtgaatgtgtgtgaagaaccaaagtcagtgttaagaatcattcatattgcctaaactgtgaatgtgttaaagatataatatatttggagcatactgaagaactttagccagactatttattatctagttattgtcatcctgaaaggtataggggtgaagaataaagtagcatgcccaataattttgtccttggccctgtcctcttcagcatttttgtcaataacttggattatactacccgaagcagactgaccaaattgcagatgatgcataactgggagcgacatctaataaacttgttaaacaaatcaagattaaaaatgatccctagaggccgagtcaaaaccattaggacgtttttaaaaagcaaaagtctatatttaggtacaaaaaatcaacagcacatatccaaggttgggggaagcctggtttggcagaagtttcttaatatacctgggatataatttcaagaccacaaagtaggagtggtttccatggaaatctatggtgagctgtttgtttgttgttgtggttttgttttgttttattttgttttgttttattttttaaaaagccatgccatactcagcagcactgacagatatgtgttttctagtccagaattggggggtggggaggggtatcagttccctgtcttctggaggggttcaaccttactcacagtgtggtgctcaatcctggacgccaaactttaagggtgacatttgacaaactggaacacatccagagaaggatggccagagtggtgaagagcctgggatctctgaagaacagttggcgataggctgaaaaaaagaagtcatagacaggtgggatgcatattgtcagatgtttgaaagcctgtcatttgaagatgaagtagattgtttctgcatacttcagacaaaaaaaaaataatcctcaggtggtgaaagttacaaggaggtagatttgcagtcaatatattaagaaatttctaataattagagccatcccaaagtagaatgcactgttttgaagagtagtgagttcactatcatcagaagtattcaagaggggatggacccacctgccaattaagctatagaggggattgttgcattttttaggaagatggaggaggtgactgaggccattacaacattaagaatgtgatgctaaggaatccaaacaaagtgggaaataaaggcatgtcttcttcactgatgatggatctaaagattttattacttatatatggttttggctttaattatgaaatattttaagcctacagaaaataaaacagacaattattagttcatttttgagaataatttttgtttggggacccatctcaccctctccctgctcagcatgggctgcaaaatcaaagaaaatggctttcaaatactatatgatgtgatatcaaacttgtagctcttatctgtccatgacaaaccttagggctgatccaaagacatcataagagttcatcactttcctgcacagctttaaaaattgtttcattgactgtgactggattactggatcaattattttttcaattaagagtcctgctaaaccccatgtaaaatgagttgcaagtcaagacaagcccctgactactttagatgattgatggagatatgtggatgacagagacaggctgtaaagaatgacaattctgtggattgatttgttatgtggatgatgattactggaagccaagtaccaatactacttactcgttgatactcagggacttttgtaatttttaaaaggagaaatttagctattacttccatttattctctgcacgaacctgtgaggtgggcagagcaggtgttagcattgctgggttacaaatgacagacctgaagcccagggaagtgaccggcccaaggccatatagccaattaggggctgaactgtataaaaacccatctcagtgcaaacacactgagaaataatttttaaaataatataaataacatatatcacttatcaattgagcacagactatatgaaagtcataagcactttacacatattcatttaatccatacaataatactatggagtaggtactattataccaattgttatagatatggaaatgaagcttggagcatctaagtaactagcccaagtctatttaaccaataacttgaccttaaaaaaaaactccaaaactctttaccttcagtgccacaacacaattcaaaccactattgtctctcacctagactatagtaataacatttcaaaggtgttccctactttcgttgatgttcccttaaatctactcttcatacagcagcaagaaaagtcttttaaaaatataaatcagtttatgctatacccatgatcaaaattattctaatatttcctcccatagtccttggcataaaaatacaaattccttaccaacatctaacaaggtcctccacggttggttcctgcctcctctaccagattcatcttgcattatcctcttcctcactggccatgttccagccaggctagtcttctttcagtgcctcaaatgcatcaaatgcatttcagggccttgtcacatgctagtctctttgcatagggtgctcttctaccatcaggtgtcagttcaaatgctttgtccacagataacctttccctcgcctaatctaaattaaaaccaccttatcatgaagtcacagcatcctacacattctcctcttcatagttagaacgtgataatcacacattggtatgattatttgattcatatttatcatatttactgccagtactagactgtaagcaccatgaaggcagagatcttgtctgttttgctcaccaccatatttcagcacccagacactgccacacactaggaacctgaaatttatttaatgaatgaataagcaaaaaattaaagcccactcctgactcctgagtcccaatgcttaaccatattatctcgatataaaagggcctaaaaagcaccctcttagcccaacccatttcaacacctttcccgtcatctctgacattgctatggaaggatgatttacatttacatgtgcaaaatgaattttccaaaatacatgtgttcatatattaatgcctgcatttgctagcagttacattcaagtaggatcaaatgttgacaataagtgttttctttgccagcatttagatacatgccatgtaattgcaaaaataattagttagactttcagaaggcagtatgctcttgagagctgaacaaaatgttcaaaggaattaaccccaagatggtaattaaaccatgcaatcatcagctggagaatggggctgacacactgttctgactctgaaacctaaaaggacccactgtggttaccaggacacaagaccaaagggcactggggagggatcatgatttatatgaacccagggaaggtatgagctgactgctaccctatactcaccccaccatatccatcctctatctaatttcccctctcctacatccccaggctaaacacaaataactcattaaagggcaggatcaggaagatagctgcctgtatggtaggcttggaagagtccagaatatccaccctttttaagtttctactgctaaagtaactcctttggggttttctagatatgtatgcattttcattggattaaggttttgctctttgtaaggaggaattcataaggtaaacctttggttctcaatgtgggagatgagctatgttgccctcctgagggatatttgatgatgttctgaggcattttgggttgtcacaacaggtagtaggagtggtgcccatggcatttagagggtagaagtcagtgatgttgcaaaacatcttacaatgcacaggacagcccctggacaaagaattatccagaccaaaatgtcaatattgccaaggttgaaaaaccctgaactgacccacttacaaagattcatttattaatccattaacaattcatacacagagtaggttcttgcagaaataggagatgggatgagtatattttgattgatcagttgaaacagaaagaaggaacagtaattttatagcagtattcaatagtctgggaaaagactggaagcaactgaccagttaagagactactctcagtcaagagaaaaggaatgataacttgaactgacaatgaacaggaggtagatacacgtaccttagaggcagaattggtgaagcattacaaaagaatggtatagggaaatgagggagagaacaaaggcaatcatgatccttaagactttagctttggttcctggaacaagagcaatgcattagaagaaacagggacaacgggagcagacacataggtggaggatggacgtagagaaataatatgctgagttcgtgatgccttgagggcctctgggtgaggctgttttatgggcagttagaaatgtggctctggagctcaggagtgtggctgaagctacaggtatctagttagaagtcatccacatggaggtagtgagattagatccccttgcctggcacatagcaggtcctccataaatatttgttgaattttaaaaaaccatatttaaagtgaggagaaaagagggccagggacaaaatctttgaaacacatcctcattgaggaggtggacacagaggaaactgaaaaggaggagtaagagaggtagggccagcagagtttaatgcactggaaatccgagaggagagtttcaagggctaagatttagccaacaatatcaaatgcggctcagcaatcaattcgaacaacgtctatgaatagagggggatttgacagtgaagaagtcatcatcgaacttgagagagcagttcagtagaggagttggaacagaaactaggttccagaagctgaagactgcaagatctttattatcccatcattagtaatagtgataaaggagttagaatgatagttgatggaggtggcagggatttaggaggaaatggaatcttagcagatgtttagcctgacaggaagaaggcagcatagagagactacagtgtggcactcaagaagcccaaagagtaaaattaggttcaatttaaggacgagctccctagctgtcagagctgccctccaagggaagtagtgagttcccttgttactggatggattcaaggagaggcaatatgacctcacagaaggtggctcatgtattgaatgggaatttggactagataattcatttccaaccttttggacttatcagattaataatattttagggggaaaaaggtagggcaggtgcacattgatccagagagttaccaaccttttaattttgctatgttaaatgtattagctttctatttactgctgtaaaaaattaccacaaacttaatagcttaaattgacacaagactattatcatacagttctgtaggtcagaagtctggtacaggtctcaccaggctaaaaccagtgtgtcggcagggttgtgttcctatctggaagccctaagggagaccctgttttcttgtctttttcaacttctagagactacccatatttcttggcttgtggcctctttccacttttcaagctagcaatggccaggcaagtctttcccatgtcacattactctgataccgactctcattttgcctctgtcttccacatttaaagaagcttgtgattacactgggccacccagataatccaggatattcttgatattttagggtccattgattagcagccttaatcccatctacagcctaatttccctttaccgtataacctaattcagggactttgggactcagacatggacatcttttggggagtcattattttatctacccacataagagatatagatatataaatatatcttccatgtgatagacatcatcatcatttatcatcaacatcatcatttcagaaaataaagactacatatagcactaaagagtagaaattatatagagaaaagtactgtctttcaaaaaaaaaaaaaaaccacgagttgtctaccttactccaacacacacaataaaacacagcatacatttatttatttccttacactggtaactccaccaattactaataccacagctttagaaagcaccagactatatgatctctcaaggtccctcctagctctaagtttctttgatccactggacttcactgtactatgaaggaattacctggagaaccttgttgtgatgtagctctatgagtttcttcatagctatatttttcgtcttcctgcttgctttaaatgcaatcattaaatcagcaagagacttcagtttccctctttcctccttgattcaaaaggtatgaaaagtgttctgtaaatgatatgcaatattgttattctgaactttgaagtaatcaagttgtttgacatttttgtaatgatgccttttggaatatgggtggtataatttggtgccacactgtacattaacaatacccgtctcgaccctacagactcggggactataaataaaagcgtgacagctggctccagccttgcttgccactcaccattgaagggaacgcagctggggagctacactagagtccccaggaatccagaatgtagtcagaaacgacatcttcaatgagaaaaaaaattggtattttgttactgggaatatacagagacaggcactcttaggaggcagacaaccaagctatttcacactgagaaggcacagaggccccaggtagggacagcatttcaccagcacaaaggcattatatagggagggaagagacagaggacaatggcatcttcttgagccaaattggcagagtttctttaacccattaccacccagaagtgagactaggaaagaagaaatggataggaaaagtgaaagagatggaaagtgatatcctggggcttggtatgagatagagggcaatggttactgtggggaggataacacaatagagctaacagagggcaaagtacacagagagagagagagaggtgaagctgatatacttcatattttatttatttgtctcatttattgtattttcccctcactagtctgtaagtcccaagaggacaggatctttttcactcctgtatctcccaacatctataacagtgcctgacacatagtagacgctcaaaaaatatttgatgaatgaataaatagctagtattcattgaatgtctattatatgctaagcactgttataggtgctgcccatgaatgaacgtattttaactttcacagcaatgctgaaacagttattgtcattatcccaattttacagatgaagaaactctatcagaggcacagagatactaagtaacttgcctaataagtaaaggatacaggatttcaacctatgtggtctaactttagaacctgcctatgtaataaccatcctatactgaggctcagaaaggtcaaataacttgcgcaaagttacgcagcttatgactggcagagccatgattggaaccaagatctgcctgtctatgaagttgctgcctttccctctgcacttcatgactttataagattgccaagacaaatatttcttccatcaccattttaccagagagtcttctgagataaagaaatgggtgtgaggctgggcatggtggctcactcctgtaatcccagcactttgggaggctgaggcgggtggatcacctgaggtcgggagttcgagaccagcctgaccaacatggagaaacctcgtctctactaaatatacaaaaattagccgggcatggtggcgcatgcctgtattcccagctacttgggaggctgaggtaagagaattgcttgaacctgggaggcggaggttgcagtgagccgagatcgggccattgcactccagcctgggcgacaagagcaaaactccatctcaaaaaaagaaagaaagaaagaaaaaaagagaaatgggtgtgcttcattaaggattcagataaaggaaacagacatcccccaaaagaatcatgactcccaaaagatcaccaatctgcaaccagctctcactgctgttattggggctggagggagctgagggaagcagctggcagatgaatcatgggaaacccctggtagagccatctatgctaccttgtctgagggctaggcattgaaggtaagtcactttcatgcaggtgaatcctgacccacgctgcaaaagatagctctggagtagggatggtgaggaaatgccaataaagcttttctaagagactagttcataattcttgtgtgaccttgtgtaagacactccctccctttgtgtcatagtttctttatgatagggagacatcagaccagtgaaactctgttcaatcagaagagctccactgtctcatttgtaaaataaacttttccatataaaatttcatttggagaaaggatttcaccactaaaaactatgcttgagaaacaagtgaataaaaaataagttccttctagctcaaacattctaagaatctaaaatcatagacattgtgggtgggtcaactcagtgttccattcaaccctacttttgacagccaggaacaggcctaggatctgctgtgaaaggcccttcacaggtcccccatgccccagcttctttcagaggccattaacactgtcctcatatggcagttgtcttccccattgggctaatccttcgcaggccttctactgatgtctgtctatgttggagtgggtggagcacaggggtcaatatttgaaggacagttgtacttctgttttatatgaaaggagtcaaatgtttcctgattttcacctaaaactcttcttattgatgtccaccaccaaaagacagtggatctgccttttggaccacggtggcatattattccctgaggattgccactgatctataaatattcctgagtcccttgtctgagtcacaaccagagctgtatgcttagtttggaaattttaaatttcagtgggttttctcacacaggctccctacacatttttataagttcttcttttgtctcattcttcttgtcataatatacaggcttaaagatttcactgggttcaccttcctggagacaactcataaagttttaccaaagtctgggtttcacatatacaatatgactcccttgatataaagctttaaaacaagcaaaaataataatatatcgtttaggtgtatgtgtttgtatatttttttaaaaccaaggtaataataaatacaaatttcacgatagtagttacctggggcaggggtagcagggaggagtgttatcaatacagggagatggactagaggaggaccacatagataaaagtaagttaccagtaatgttatagttctcaggttgggtaatggctttataggtgttcattatagtctaaataaataaatgaatgcaataaataaaatattaaaagtccgtgtatgaactaacaatgattaattaattctgcaccccgagttcaaggtcaatgattagaagagcaatacaagattttttttaatcaaccagaacctcgccacttatcttctgtttccttccactatttcaagagtttttgaaactgaaagtggatcatggctatagttttccttctttttaagtttatattccccctcaattattgcccataatctagtcaggttggagttctccttactgaaaatatgttgcattttcccatgagactatttttgtataggattcatggatcctaatttttcttttgccagttggtatggatctgagaattaccagctaccctttgaatcattttggttgaagggccatgattgcttgttctagtcttccagcccatgaccattattagtaaggagaggttctttctagggttgacagataaaatacaggatgcccagttaaatttgaatttcagataaacaacaaattatgtttttagtgtatgtatgaatttgaggcatacttatactaaaaaattatttacctgaaattcaaatttaattgaaaatcttgtttttatttgctaaagctcgaaaccctatctcttgtggagcaatgattactttttaataacattattggatttgagtacatgtgagtgtgagttttggatcaagcacactcagattcaaattctggctcctctgcttaatagctagaacagtttttttggtctcagaatttttatctattaaataggaataacagcaatacctcataaagctgatgagaatattaaatgaaaaaatatttgtacagtagttagtatagtgcctggctaaatactattctcattattaatggctgttattatcaatggctattatcattattattggatgttatcattattattgtcaattttgtacagaacattatgtgcactggccaagatttgatttggtattgcaaaactccacttacaggattaatttgagaatgggacttttcttagcatcacccttggtgatgatcaagacatcccttttgtttctgagtattgtactccctttggctcttgtcatgaagtaccccagattcactctagttggatttttccttttatttatttatttgtttatttttgagacggtgtctcactctgtcggtcgcccaggctggagtgcagcggcacgatctcggctcactgcaacctctgcctcccgggttcaagcgattctcctgcctcagcctcccgagtagctgtgactacaggtgcccgccaccatgcccagctaattttcgtatttttagtagagacggggtttcaccgtgttagccagggtggtctcgatctcctgacctcgtgatctgcctgccttggcctcccaaagtgctgggattacaggcgtgagccaccgcgacgggatttttccttttaatataaagacgtttcctgtgcatgtgtctgagggtcacttagaattcttcaagttgaagactattgtctcctatgatggagatggttaagtgactgataatcacttttgaaatgctaccctcaagccaatggctaatgactttggttgataaaaagagaacagctctaatcaacatagattcgaatcaaatgcagggaaagcaaaatactacatccactgagaactctatctctcacaacagggtcaagaaatgaattaaattggttttccacttgccttcatgctttcaataccttctttatttttggtgctcaacgtcttcactgtttctcctctcagggaggactccagaccccatacacattctcttctctgacccactcatccccatcaaaatttacccatctgatttcccactcatccttgcatctaatcagacattaatttatcttaccacagtaactgctaaataagattctatttaatcactctcccaggccacagacttcttttaaacacttgaagaagtaaacttaacagtggtatttagggttttctagtaggtaagggagaccatgcaggaccccttaaatcacaccacattatgcctgttatgtctgcttcgcatgaatggaagtgagcagtggtgcagataatctaaagatcatttccactttgtttgtgaatgctccacagtgttgttgtagctgatttgttttgctaattatgttctactgaagctaatattaaaattggttcacattttttaagctcttatgggccagaagagagaagaggcagcaatgtggcccactttgaaatgaaggaaaggtgacaactgtgaggggggtgtgaaaattctacatgtgggctagtggagtctataagatacatgcaaaaggatcaagatagaactttcccaattacacatgggcaggataggcagccacctaacccctgtgactcgatgagcactgaaaggacagtcttcccatggcctgcccagagccttaaatcatctaaattaatagcccacattaagggctttaataataacataactgtggctaagacattatgtaacctgaagggtaacacatttcctagcagacttattagcagctagtcttactaaattctcagtcacctatgagaaaaaggaatgaagggtggtacaaaaaacagttgtagttgtagtttgatggacgcattagtacactaagaggcccctgggcagctaaagtggaagtacaagagcactgaatgccttggagatgagccgggagggttttgaaagggagtaagacgactttcacctctatttttcccacattttcttagtttccagctcattgtgcacatagagaatgtgtacctgtatcaaattaattctcttccctttcttactcttctcctgttgggtaactgggttttcaggggcttctttcttctgaggtatgcaatttggggcctaattgtacattgtatttctaaccctacaagttgcagcaaaggaccatggagctattgaatctttttctctttttctcattgcagtctgctcccagttctcgagaggggtgtatgccatctttggattctatgaccagatgtcaatgaacaccctgacctccttctgtggggccctgcacacatcctttgttacgcctagcttccccactgacgcagatgtgcagtttgtcatccagatgcgcccagccttgaagggcgctattctgagtcttctgggtcattacaagtgggagaagtttgtgtacctctatgacacagaacgaggtaagaagaggcacctgctctgctctttagatattcatgtaattgtgttcaaacttcctcagcttatgtgccctttgcttccaataaataaaatctaattctgttttaaaattgtatttaatattccaaataaatcaaaggttaagattaaaaaataaaagtaatagtaattttagaacctaatttttcaagctatgtaggccctccctgaaaaagcagtttggaatacctcttgattgagtcaccatagttgaaaaagaacgcctcccccatcaaaaattttatctggtctaaaatgtatgaagtaaaagcagcttagtctaagtagagagaggcttaaattggaaagttttggaaaattaatcctgtcagaaactgtaattatccccatttcatagatgagatagctaaagtccaagtgctttttcatacagcagtttcaccactaaaatgggactggtagcaatgtctcttgcttccaggactcattccatcagatcacattaggttttcagcttagcaggcctcaacaattatctgatagaaataatgagtgagacagctaaactgggctttggggattgactttttgttttgtttttggttttgtttttgtttttgttttgttttgttttaaatagtgagacagtctacggccataccactctaaatatgcccagtctcctctaatagtgagacaatatattgaggatacactctattaaaacaggctcagaaattaagagtctgatcttaaataatatacagtaaggtctattgattaatttgctagagcacacacatcataattcatctaatcaggctcctccaacacccagttgtctttgacgggttccttggtaaaaccaagggattctatcaccaagacgttccagaagacaatgttactttatcactcatttgcctgtggttccatttataggctgggggtggttctctctaactcagaatttttaaactcagaaggattaaatgaaaggcttatctgcctgaggggtacctgtagaagaggtccttctaagtaacttaacttgaacggccattttgctcttgggaatccagaacactcttcactttactctcattttgctgcatcatcaaatcttaatagcaaatacttaggcctgtatttccctattgtacttacctccaaactatcatcaaatttcatgaacctgaagcagaagaccagaggtctagtccaagctctgccacttactagctcacttaacaagttgaccttgaccaactcattgacatgctcttggacttggcctcctcacctaaggtgtgttccttcttaatgttatattccatgattctgtgattttttttgagatatttgaccagctactgacactttgtatcttgctactaatcgtaacttatatattatcagttaattagtcaatccattctacaagccattatcaacccccaatggtggtctccaatcctgtgatacatacatatataatatggtttcaagggggtgtgtacagaaaaagatacttataaagcaattcatgaacaacacagaacaacatcaaattgagtgctacactgtatactctgaatactttaagaattgtggaaaggttgcactccagaaaagtagagttttcagagaaagcttgctagagaagctagccttgaaagatagataagttgtgggttgcaagagagaagggagatggggctttggagaggagaaaagagaacaaacaaacagcagggccaggaaggaacactgtgtgttcaggtagagccctgtctgactgagatacaaaatagcttgaatattctaattcataatttgccaaattttaataaatttcattttgtccaaacagtatacatgtactgtatacagcgtaatctagtgcatatcaatttcgttttcagaactgaactttgtaagtcaggcaacttctctcctgaaacattttaaaaacgaaatattggttccaccaacagtgtacctctcatttattcaaaagcagaagacacaattaatgaattttatcctcatctagtgtgacccttctctgctcattagctctctactagaagaacgggaggaaaagaccatctatctatttcttacccttgcatcttttctctaatcatctaactaaatagtttggacaagtctatggtcttggagtcaaagaaagctttctgactcatgtaactttatatttttcacctgcagccatttagctggtgggactaatccgctctgcttaagaagtacttcccataaacttttacactaatttaccccttgaaaagccttcttacattactgtactaggatcctgttccaaaattttcaatggctttctattgcccatattgaaaaaagcagtctattcttcaagacttggcatgagtatgcctcaaccaactaacaaacccattctccctatgctacccaatgagaacctcccattgtaggaagctcccattttccactgctgcctaaatgcaccagaaccatgcctgcctcagcaatcgtacttttactactacctggaattctctcctttatcttgatatggtaatcatgtccattcttccaattttcaaaacccgcctcaaactctacctccccaaggtagccttccttgaccactctagctcacaattattcattaatgcaatagatgctaaggctacaataaaaaccacatagatatagttagatatggttcctgctttataaacctacattctaatgatggagatagacaaaaaccaagtaaattaacaaaaaaacaattgcacatttaaataaggtgctatgaaggaaaaaaatagacagataataatggatagggcttaatttccaaaggatgttcagtgatggcctcattgagaaggggcatttaagctgagaactaaaggactggaaggaggcagcatgtgaagagtagagggaaatagtttcaagcagtagaaatagcaagtgcaaaggtcatgtcgtatggttgaggaactgaaagaagtccagtgtggctaaaggataacaagtaggtagaaagtggcctgagagcagactgtagaggtagacaagagccagatcatagccatagagtataaacagaagccatgctgaggagtatgaattttattctaattgcagtgggaagtcattggaggattctgagcagggaagtcacatgatctacatttctgtagagaatggagtgtggtgcaagtaaaaaagaagggaaaccaattgaaagtccattgtggtcatccagatgagaagtgatggcagctttggactaagctggagatggagaaaaagaggtggagttgaagtatactttggagacagaattgacagaacttggggacagattgactgtgggatgtgaaggagaggaaggcttcatggatgattactatgtgtttggcttgagagattgggtaagatggtaagatggtgatgccatttactgaggtgactggacaggaggagacttagttttgaggagcagagatcttgcctacctctaaacacccacagaacccttctgtccatgtcattcatctggcattgaatataactgccttctgctgttatttcactggctatgatctatactataccttcccaagcatttctctccagtgtgataataaacaactggctagcccctagatttatactttgtgcctcccctagtacatagcacatgcctgtgtgcctacttagtgttttccaacctcctttagtgattcatcaacaataagcctatgtctgtttttcaacactggactgaaagaaagagagaaagaaagaaagaaaaataaagaaggaaggaagggtgggtatgggtaggagggagaatgggaagggaagaaagaagataggaagggaagagaaagaagagaaggaaggaaggaaggaagggaggaagggagggagggagggaaagcaggcccaattcataaatcataccaatcacttggtacagttgtttaaaatattcagtattctgtattttcttgttttgtgcaatgatcatctcttgctttagtaataaaaattacagggagaaattacaatagaaaatataattttacaatattttaaattatataagagagatagaagagaaagagaaacagaagagaacacctataattacattcataagctaaatatacaaatgatgtgactctactgtataagggcagggatgagtggggagctgagaaatgggttaaatgtttgagatcatttaaaagaattgtagcacaaccagggtaaagttttctctgaaattatgaaacattgagtggaattcagggctttgttgactctgcttctatttctgtctgcagacgaaagtctgatttggggtttgcagtttgtcagtttctaaaatcctaccttgattcattaatacaaagttgaaaattactttcttggtgctatatacataaaagaacagtttttgaaaaaattatgaggttaagtgtgttgtctgccctatcggtaccctctcctattaacaccctctttccttactatggcattatgtttacacctgccctccctggcaggagcaaaaccttaacatctctgtctcaacctgcttctacaccttcataaaaacttccctgtcctgcattttcttcccactgattaatagtctttctctgctagtgacaacagctcagctgaccaatttattcatgctaatttatctatgactattaacaacttgatgggttagtgcatccagggaagaagaaatttctattcaggcaaaggccttctgtgaatacagaaccataatccaaggtgtagctttttaattctgggattccaggcaccatgagtccagtttgtgaggtcctttgcccacatgccttcctatatagaaagtcctaaaaccatgccagggaggtggccatctcttccagttattagacttatcttttgggtgcaagtgacctagttctctgtggtgctaacatttcccccagaacagcaacatacttgagaactgcagccagactctcgtgcacctgacaactctccttggcttcaatgggcacagcccacagagatgaaagaatccggcccagctgtggctctcagcttagataatgagataatagctctgggtgccctttgaggcaactagtccctaccttcttgccagtgttcaataaactcctgctgtctcccattctcaacctgaaactccctactcagttcccaagtaactctctggaagtcaacagccttctaacagatctttctatttcctctcgaaggttgtgacaggaacataggcagttgtaacaattatcctatcagtcaacaagcaattattaagctttctccagtgttagcttgtgctaggccactggtggggtttaaaagaagcagaattagatctcagctctgagaagttgacaatactgttgctgaaagagtgacttatctaagaggcctgaaaaaaataatttttaatacaactgtttccagatccaccaatgaaatatgcattcattagagcaagaaccctgtgaaaagattaaagagttgtcagatagctaggaaggtgggaaaatgttggaaggtcctaaagggcttaagaggtaaagggattccccaagaaaaggagaaaagggcctgtcctcagaggattatgaatgtttcaaccggctagatttgaactctactgagagacaagcaaagtttcagcctcacacttttctgcatgttgtcattctccacctacttacatagcctagcctcatcccattcacccagttctactttcccaaataaagcacaaaatacctctctctctctccctctttctctatcttccttctctttcttcgcctcctttcctcctttctcctctccactccttacgcccttttctttctctctacacacacactcatgcgcgcgcacacacacacacacacctcaataccaatcaatgacacatgtcaacaaatctgttattgttatcattttattcttattgtgataagagcaactgccatttcttaagcacttattatgcactaggccctgagcttatggattatctcatttaatctttgtaacatccctgcatctttacaactgaggaaaccaaagcatggaaaggttaaatgatagttcctagggtcacacagctacaaagtaataaaaccagatttcaacctgggtctgccacgttccacagtctatgtactgttctctgactgacatactgcctcctacattcttaacagttgaacacaactattacctcttcctttagtcttcccttcagccattcttcaaagaccaggtacttagaccctccctatcctggttgtcttcccgtggatgcaatccaattgccaatttccttcttaaggcatggtatccacaaatgaatgtaatatcttgttgtctcagggtaccaggaatccagacaggcaagaggtcaaaaatccaggttaagaggtaaatgagttgcaaaggtgaaggcagagagacagcagagttctaaatgcaggcagaaggtaactgctgtgatgcatactaacggagggttgtgctgaggccctgattctgagggaagggaactcatctattcttctctgggtcagagactttcctgaacacagaaagaaaaatctgcaggttgtcattggtaaggggctatatttctggttggaggagcctattctggttcaggataggccactatcatgaacttctttaaagttccagctaagtaccatgactgcttggccaaaactgttaagacagtagcagggtatctcaattatgaaagaaagaaagacagacagacagacagacagacagaaagaaagaaagaaagaaagaaagaaagaaaggaaggaagaagaaaggaaagaaagaaagaaagaaagaaagaaagaaagaaagaaagaaagaaagaaaggaaagaaagaaagaaagaaagaaaaaaaggacagactatcatggattctttttcttcttcactttaagaactgattaaaagacgtacgaaggaaacagatggctccaattctgattgtgtccatttgccttctgggaaaagtgaagtcaagagagtttttattgaaattcaagctactttttacatctgaataaattaggaaggcccagcgagtacattatcgtgtgagagacggatactaaattcccctgtttgagcagcaataatcagggttgacagtacctgagacatttggtagtttccacagcctgcctaatctattgtgatgagtcttcaactatgagagcatcttgagagcccgcacaataataatagtgaatgactatttggactggattgtgaataaaagactgtacatttgtctgtaatgagaatttcatcgaaaatgaaaataccagagctgtcatattttttaatacttcgatttgcacatccttgactgctttggggcataagaagagaaagtgccgagcaatttgttgtcagctcttgaaataaattatcatttaaacacttactctccacaaaggttattagcttagtagctcgttcctggggttggaccatcagtaggggaaaaaattcaaaagacattaaactaccctttcagaagctgaatattagttactgtggaaattgttctctcggtagcttaacatatttttctgtagctctccaatgctgcagattaggctgcagcaactattaataaatactgtcatattttacagctgtcatgcaaagctgaaaaaaggcttcactgtgattagatcctgtttactgtaatatttccagctcagactcagaaaagcagttttcctataaaggtattttccataagtagaatatttctccagaaaatgacgattaattttaatgtatttttaactccttggtggcagtgaatttgaggttgaattgacttcacagccagagacattcctctctagagacaaattaagctaaaatgtcaaaatttctctcttgggttgtccttcatatgcggaaatggtgctactgtcaggagatgtgcattgagtagccccccacccctatagaaggacaaatctgcactggtttatccaacttcttttaccctgtccctcttgtgaccaattgcattgtttgcaagacagctggtaaggatgttgggtaggaatatcacttcagtaggctagctaaaaattctgcttcctgagctaaaatgtcatcatacgagctaaagaaacagatctctagcccccctacaatgcattagctgtttgaaatggtattcacatctctgaaaaaaaaggaggtgacagctggcagggttgcttttgctctgaccttctattgctttttatcaagctccttgagggaattaaccctcactaagctgaatatctagtttttaatgaacaggtagttaattaacccattaagggttatctggagtagtctataaattcagggtttgggcctgaaacatccttgaaaaggttcttccaaatgttccttggggcagggatggacagcggtatagacctgcaactgtgactttgaggtttgtcccttgaagccctttagacaacaattaaagccaaggcagggttgttgtgagagtttaacaagataatgcctctaaagcctttatcatcaagctgaacacagtaacaccccatgctcaatgacttttagctcttattattttattaccattatggaacagtggtcctcaatagagagtgagggtaattttcccccctcagaggacatttggcaatgtctagggacattttagtagtgggtagaggccaggaatgctggtacacatcctacaatgcacaggacagtatccttctccacgctctcaacaaaaaaattatccagcccaagatgtcaacagtgccaaggaagcagcaggccaaataaatggttgcagaaactccttaaggggttggcagtgaaccaatctagcatttattgagtgtctcttactatgcctagatcagtaataacagctctgttcaataagtagagcctttgattctgaagagcttacatcttggccagagagacatattaagattaatgcacagaagcaaatattagtgcaaaacagcataaagcaagagctagattgtgtggtatggatgtgaagtaccgtgggagtccaaagaagagaaatttcatgataggcaggctggactagccagggaaggcttaatggaagaagttataaacgtttctgaggccaccacagaactgcctcccctagcaatgaccttgccttgattactaaggccaagttggtatctagaaccaaaacaacatggcattcccatcaatgctcccaaacgtcacagctcaaggcaagaaatacaattaaaagaaaaaccaaaaaaggaacaatgttccttttactaaatggaaagcaattacagggctgttgaaaataggcagtaaacaaagggagggagggaaatactggcaaaatcccattttctcaactaatcctgtagcaaaagtgcaatttgcaacaaaatcaacagtgctctttccctctctcttgcagtcaaacacactgtctggcatcagtatggctacacatgatgccttagccaaaaagtgcatgcaagcaaggaggacagaatatgaattggagaggagagcagaggttaaggtggagcacagctcacttcacctccaactgaagtctctgtagagcattcccattcagaggaaagagggggcacacatagagactacttcactccctgtcttcctggatcctttccaatcaataggttgccagtgtcggctgctgtcctgctttgtcgactccacaaacgatctgattaattctctggtgctaactgcctcagcaggctttctcagcagtagaacagaggctaattaagatcatgtcaggcgaggaggctgacaggttatgttcctgggctacactgaacttttagagggtgcttcaacttcactgcaggcaggcagtgcttggctaggcgctgattccatagcaggcttcccatttatttccacgggttcctgtgtcaatgggtctccgttttgttaacgatttacatcctcctcctggggataaatagttgctactgtgttgctttcaattgcattacttgggctctctttcatttaaatttttaatatgcttgtaaacaaagataacaattaatagtgaggtcgttttccatcctaaatcacatgtgtgtctgagactgtgtatatgcttttgcatcttatcaacataaagcccacagaggtgaatttaggacaaataaaggaaactctacttctcacagcaggtagaaaatggaggagacatatggaactcattacaccaagtggtggattagactgaagatataaatagctttcccctccccctaaataaaggcttagatgaattcatggatgacagacccatagtgagctattaagggaaacagagatgtttggaaactgaggttggcacaaatcaccaagtagatttttgaatccatatttaccttctcataggcaaatggccacacagagtactggcactctatcctctgtgttttaaaataaaatcttaagaatccaccaagcatctaggagacaggaggaatgctcagaaatagaggaaacttctccaggagcattctgtctggtttcatatagagtctctaaccactgtcaaagataaacaaagctggacatttgttaaagagctaaagactgattttaatcagtaatatactattgcagtagggaaaagcgttcagcataaactgaactcaccttcaatctgtacagaggtggctgggcattttgaagggaaaatgagggaaaggggagggagatgaaagggggcccaatagagtcaggaaagtgaaaagttacaaaaagcaggaaaggggaggtttggcctatgtgaaactcatctgagtttgtcaactggcacttactgaagttaggctcccacccttccatggagactggcagacaggagaactatattgaggtgttgggtgaaacaaacaataaattattttggcagccttgagtcttctcaggcagccactttaaggaagactagaatcttcctagagatgttgtcttgggctattagaaactatgttagtgttttgttctagtctttataggccaaggttgggacggggtggagaagagggctcagaggagcatggtgagaatttggtcaaagaatctttgtcaccacatgtcaagaacactctgttatgagaggtgaatagtcccgttaagggtgttgaagaaaagcatcatcaactcagaacctcagttccaggcccccaactctgccactaagtagctgtgtaatcctgggcaagtcacaatagcttttctggtcctcagattccacatctgtaaaatgacagagtggactccatcattctgcaactaacaattcctgagtgcaggaattttgtgtcagggaagttacaggagttatggaagtgaatgaaacagagtgcctccccttaataagctcacagtttagaagggcagcatggacatataaaaaaaaaaatacgtaaatacaatctagagtgattccttttgattctaaaattctgtgggctattacaacacttccatttacaattgacccttaaataacatgggagtagggggtttacccacctgtacagttgaaaatccacatataactttggactctctcaaaacttaactactaatagcctactattatctggaagccttaccagataacataaatgattcattaacacgtattttatatgctatatctattatatactgtattcttacaataaagtgagctagagaaaagaaaatgtcattaagaaaatcataaagaagagaaaatatatttactattctttaagtggaagttgatcatcataaaggtcttcatcctcattgttttcatattaagtaggctgaagaggaagaggaagaggagaagttggtcttgctttctcaggtgtggcagaggcagagaaaaatccgtgtataagtggattcatgcagtcaaacctttatggttcaagggtcacctgtataatgaaactagaacttattttcaaatgaagtttgaaattaactcttaaggagagttatggagacacaaataaccagccacattggctttggaaattggccagaggccttaagtgcactcacatgtttcccttcgtgttcatttctgagccctgaaccctttcaggaccctgatagataggcggcaaaaggaaacaatgcctagatagtagattaggatatcccagtagatcttaaaacccttcctggtagatctccaagccaggggctgacacaacacacttctagcaagttttcttctaacaaggtttgtcagtattctcaacagtggcctctcctccacttaaggcctttactgccatcactcttcgaggtcttaaaacacagacctacataaccatttgcaatttccaggattccttaaaataaaaggagtatttcttctcaaaaatgatatgaatttctaggataaaagataaagcagttttgcttcttgaatatttttgtaatgattcaaaacccttctctatgcaaaacagttgcaatttcacatgggctttccagaggccccaacctctctttccagttctggatccatagtttggtttccctctaaaacctttatcttgatgccctacctggacctcaaactcaatgttctgaattccgaatttattcttttttcccagaaaacttttgcctccacctatgttcccacactcagtgaatggcactgcccagttgcccaaagtagaaacctcatccttgaatcttgcctcttcatcatattgcacatctcatcaccaaagaccttcgtctacgtttccactgccactgactcaagctcaagctcccaccatctcctgcaccattctcctaactgatctccctgatgttaccccctccaccactgataaacagcaatcttcccatcatgtcactcccctgcctaaaagatttcaacaacattcctgttacccctagattctaagcatggcacacaaggcccttcatgatccaacaaaactccaacccactttcctactctcttctccacccatcccttaactactagtgctctatactataaccatatggaactatgctactttcagtatgtcacatggactatgaccttttttccctccattcctttgcaaatacttttcctttttttagcactcagccccctcactccattccccccatacacacacactttatctggtaaatgatatatcttcgaaattctgctgaaatatttgcttccccagaccctagatctccagccccttagccctgctgtgtgtcctcatagctatttatgcagcactggtcttacaatagtattattatttgtttatatgtttaactccctcacaatactatgaacttcttgaagacaagattgttgtcttatttatctctgccaatagtgcctggattattattatttgtaaattgaataactgaatgagtaaatgagataactttagctaaaaacaaaatgtaggattacaggaacattgaggagctagcaaaggacatggccttgagtaggctgtgtcctcagataatacattagatagtcatctacctcctgtgcactggacttgccttgattttgacccaatctccctaccaaaaacattaccttcctggtccgaccaacttagaagcaaaacagatatcttggttctgggaaccttagtcatgggtttctggctagaggacaaagctgcagtgcgccttatggttcctgagtctcagccagtagaatcattaacatatgagtaatctcaagagctagaatgtagatataacgctatttcatataaatcaatggtatttagacagccacatgaattctctaaagacaagagtagcatagtattattttccacagctcctaatgaaaaactaaagaaggaaaactgcttcaaaatgtctgtgtaggcaatgtaacaaggatgaaaaatgatgtgagaactgttataggtagttctcagttatctgaaccagaggaggtaagcttggcacagataatccaaaaggcatttctgtgagcataaaatagtgcctattcataatgcatcttccttcttggttctatctttcttaggcttggctgagcatgggaagtaagggaggttatctcagggataggaatgttttggatgtcccttcaattacatattcccaaaagtcagggagcatccttttgagggactagcagaagtaagatacaaaataattgtatgcagaaatatgagtggatgggggaacacagaagaaaagagagggacactaaatccagggagaaaaagaatagtttcagggccataaagacaaacgttactgatctcacaatgacctgagatccttgttcctgagactataatgtctgacggacacaaataaagaataaacaaaatcaacaataaacatcataagcttagtattttttgctaaagaaatttgatgtgatgttttatacttgcttaagaagctcaaaagaattgcatcagctgtaaaatttccaggttccaacacgcatactacagaactatttcacagaagcattttatacctctgagaggctgagaaaaaggcttccaaagattggtccagtctctttttctcttggaaagctcttggcacaaatgtattccttctgaaaatcctagagaaagaattactggttttcatttggcacagtatgaaaggaagcagtacaatattatttaccaaagctacccattctcttccattttttattccttttgataatataaataataatataaatataaataataataatataaatatgtcatggttcatcagtaaggtagaaaccttaaaaacctttaataatcactttaacaaatgattttttttatcccaccacttctatccacctagcataatgctgaatagtagcatttaaaaaatgaccttagacatgtcaagctagaaaggtctttaaagttcttaaggctgaggtttcaggttctgaaaaatgaattggcccatattttgtcaagttggtgagtctcctaatctgtaattctacttaaaatgtgggattcgaaaaatctaaaggctagccccagatttatcgcgttaagccttttctaccctgtctcaattcttttatctgcataatggcagtaatatactttgtaccctatcttgcaggaataaagaagaatggcatagtgatgtaagctaaaatcaaaatgccgagtatgactgggcaattgcctaaagctaaaagaactgctctgtatataagtgattaagatgcgggaggaaagcctcttccttttgtgcccacgcagtcacagtgctttgtgtaaggctttacccaacagaattgaaagagtcaatgtaccttcccatgttcctcatgtactcacccacccaggagaatgcagtcagttctatctacttctcacatcgattagcaagtcaacaagtcacggcattaaatgctaatcagaacagcggcttttgtggtatactctctgggccatattgtgacgagaaagaatgaccacaggcattaggctctgtgttgtgtggctgtttcctcaccaataaagtgaacataataattgcccctaacttatagaattgttgtatgggttacatccatgaaaggcacctagaacagtttctgccacatagttagcattctgtaagtgcttgccactaccattatgctcttactagggttacaggaaagcagacttctgagacatagaacgaagatctttagctgccctagctgatgtctcccatgccttggtgccaccttgctcatctctccaatgtgctaattttggttttcttctatgagaatcagaacctgttcccaggagaggagctgggaaactcatttacactctatgaaggtagaaacggctgatggacaacgtctctcagacatctctgtggtttaggcaagtgtagaaggcctcgggccaaaggaaggaagtcttgtttttggaatcgcaatactggtgatcagaaagcggaggttcatttccttccaacaatcctaactacatagccagccatccgcctatcccacattttgctaaggttaggcccattgctgcagagaagaatgcaatcagaaaagctggaccaatgcatttttatggctttactgggcatatattttggagaatcataaaaaggaaaatgacattctctttattcacaagcaaacggaagtgcctaaaggcagcttaagctaaacagacttctttggaaattcttgaagtcagtggctccaccaaaaatatatctacattttcatttcttaataagctgagagaaagcaaaaagcatacgtattttctgacatatttttaggctcccctggattcatagtacatattgaatcttagaattgggaaactaagcttagtttacggtcttgcatttgtttggcttaagctggtgactactaggaattgggaggaatggccatgtatctagttccaatttcctttccaagctctcccttcacctgcaggcccatttcctgaggccattgccatatggctggatggacccagtcatttgtgtgtatcatccactaggagggctatgaagagaaagcaaaggacagccattggagagcatgcagaatatttggttattttgtgggagatcatgggaaagattttttgtggccttaaagacaaacaaataaaaagataggatagccactaccctcactgacagcccacataaatctaaagtcagtgttccccaaattcaagcttccctcatcacttgatcgtaggggctgtccccgccaagtggatgctcagaattctgtggtacaatggacctattttctgaatgcaaaaacaggacacatggtctgaaaatacgttttcttttctttctggcttttctaaggcaatcctgaggattcaatcccagctctgacagagattagctgtgtgaccttgggcaacaacctgtctgagcgtctgtaaaatggcaatgattatagtatctacttcattgggctgttatgaaaataaaatgagatactgtgaaagtgcttagcacagtgtctgataaacagaaatactcaacaaagtgtaactattaattatgataaatgattaaaattgtataaaagcatcaacatgaaatcacatttagttagtaatttcacatttagttactaattttatagaaaagaagaaagatacacgaaatttggattgtcctagaaaatcctgggtgttttatcactgtatctgtattcactgtctccccttcagattaataaggcatcttagaagaagagacagaaagaagacaaaaataggaggcaaaggcaaccttctcactgaccccataatttcttatagctgctgataagctatttggagctctgtagatctgattttgtttctagaacccatctgttttcctctctgaatgtgctaacttgaaattagagaagatttccataaactatttgtttcatgatgtcatctaatatgaatctgaaagttcaaaattattgtttaactggaacctactgaaatggaagaccattcagttattctaattaatattattcaaaaggtaacctaccactttacacttccaagcactttccccatgtcttttatcatcattcatacttaatgaggagggcagtgcaggtatattgttgttactttacagattttaaaaatctatatttttagagagggtaagtgatttgtccaagttcacacagctaatgagcagtgaacgcgggactaaagcccgtttcctaacacccagtccaaaaatcttccattacaccagaccactgcacacctttaggacaaaagattattatatccttactgacaatgaaaggctcagcttcagagaaagttttggggccaatgaataatcagttcctcagactaacatccacccttgacgagcattcatgtgccatgctctgggctaagcctattaaatgcatcatttcctttagtcgtcacaaaaattttaccaaggaagtactgtcatgatcctcattttacagatgaggaagtagaggcatgaattaagtaatgtgttcaacatcgcattcctagtaagtggtggagccagtgctagacgccctgattcctaactcccagtgaaagtgttcttcctgtcactccatactgacagccactttcaactctcctattagcaaagaaaggatgttacttttaaagatgctttagggaaaaagggtaactcagtcctctctcaattccacatacaggcagagggggagaagtttagaatacaagcacatcatgcctaatcccaaagccatgaatgtgcaaatgtgggaggacagttaggaacacagagtccagcagagagaactcagggatagggatacatcctctcttacttattcatgccttgggcgtcagtcacatctggttctcagccaaatagaagggcaaagtaggtatagtcagtctgtagtttccttcctcctatggggagcctggggccctaaccacgtttcaacctaccccacagacctcatcaaaactgctctgttcccttttccctagaattccactagatgcatggagccaagtccaagtgttcatggctagggagaatagtggctacccgcctcagtgacatttgctttttaaagaagttccttctaggccttcacctttgagcctctgaatagtgggtgcagaagcaaacctgctttccacccttcccatcccaatctgaggtggggacagccagttaggcgggatgctgaagggttgccttggctaactcactagtaattggaagttgacctttctcattttcttgcctccagaaatcctcccctggggatacaaatgtgtgcaaatcaccctaaagacaggacaggtgaagctccaagtgcacatttagactgggaaagggaaaaatcagttcattatttcaagacctcttgagatgctgtaaatacacagtcaacacagaacaaagatccctttttcccccttacattatttatgtgccatctaaaaattacacacccgttctctttccagcactgagagagagaaacatgcatattcatgatctgataaatatttaagtgggatttatttaaatgagagagtccatttacaaacattccctggctctgagatcttatcctgggcacacagagggaggataatttcctctggtagattcaaaacctccgctggccacctgtccccctaaacttggagctcttccttgagagctggtgaatgccacccgcagtatttcaagggagtcttccgtacctcctccctacagtccggccttcctgctctgagctcatgtcataggatcagtcgttggcaaaatgctagagctggcagtttatttggtagtcgggggaggaagtcacagctttctttgcctgggcccttcgtccccaccacataagcccgatggcagcacccaccactgatattcctagctttcttgtgggaccatcttcccctctcaaggagaacagttatgtgatacaccaggtaaccaggactggttgactgtgctgcccctctctcaggaagacatgcattttaatgcttcaaaagcgttttgtcagtacctgttttcaaaggacttatacatagagtgtttccattcactcctcacaacaatcagatgagaattgacaagaattccaaggcaaaaatcattttcccagccttaaaaatgaagaaataaaaaagagaacccctgcttgcccaacctaagtcacacagtttgtaagttgcagagttaagacttgaacttaggtctgactctaagatctgggatcttttcattatacaaggctgcctctcatcaggaaggaggactggagagaaagcaatggtaacccaaaaggaagactaatggtgacctatcaggcattgtggccacgggggcccaagacctcttcattcctatcatatagatgactttctgtatatgaacttaactctggactttccattctggtgcccattcttggacatcactctgtctctagtcctatcccacttcttctcgctcaaattaaactcacctgttttgtgtctcattttatctagactttatgagatgatcagtgaactcacccatagagctaatctgggctaaggcattaaattaaatgctgattaatggctcaatatgcaacctctcttaggtcatacacattttttgacagaagcttctaaaactttactcaaggatactgtatatgacaaatacttcaagcaatgagccaggccagtgagagcaatatcattgggcaaatgggcttctcaggcctttaacttatgctacctaagtgaccatctattctgcctaatttagggttaccagatgaaatataggacatcccattaaattcagtttcagatgaataacaaatactttttaagtataagcatgtcctaaatatcgcatgggacatacactaaaaattatttgttgtttatttgaaattcaaatttactgtgtttcctgtctttttatttgctagatctggtaacccaaacttaattgtaagatctgttccgctgcgcataaccatcaaaaagtacctattaggcatctgcttcctcatgacacttgcttgtgaccaatcctatagcatggaacactggtggaggggtgagggcaatgagaaagaaaaagcgaaagcagacatgggaaagagtatcccatcatgagactggtcttacctagtcacttgtccatgacataaaagtaatgtcactaggtcttttcagaaaatagaactagtcccatttgcctctcatcaccaacccctcctcccatctgctatgctatactgttctgttctattttgctttttgataaatgaaaaaggaacatgttttggcaaatgccagcccctgtgttctctaagtgatctgggcctcagaaggcatatcccaagcaaacatcaaggtgggatggagggcgctaccaggccactgcacagacagtgaggctgcccaaatgtaattaagcaccaggcgcagaccccaagagtgacagtgggaagaattccatgaccaaaaaaatattagggaagtgaagtggagaatgtttacaaccctaattagcaatttgcacaacaccagaattaaaatttttcccagtgtcaagcaagtttgtagactgacactatggaagctaaactgggcccatgggaaaaggcagcactaggctcctgctagtcagtccagtccagtggctaacgcacctaccaaggcattcaaattgagaaaatgactaaattagaacacaaacagtagactgactcatatgtaagataacaacagaagcgaaggaatgcaaactccagaaatgaggcctttgagtagcaataacaaggataataacaataataataacaataataatataacaatattataaataataataacaaagataattataacaatagcaaacctatgtgagcacttatgtgtcaggcactgttctatatactttgcatgaattcgctcatttaatcctgatgacaatcctatgaggactgtcatccacattttatgggacacagagagattgtgtagcttgcccagattcacacaactattgaatgatgaagcagaaaatcaaacttaggcagtcaggggccaaggcccacatatttgaccactaggctttaccacttctctaatctgttcttgaagacattttcccagaagtgggatggatttactgagcccttcccaccacattttccagtatttcactggtgcaagagacacccatttgtcaaacaggtagaaaggttaaaggtacactgcatggatctagggcagaaggagcctagtgactttctcagcatcatcatgttctaattaaatgaactaaccaccactgggctcttgaaagtatcctagaactacgaatttaaagtgtgaattacacggacacttaaagagatcatacatatctgatagtactttggaacttggaactgaccttgatctgttaagttggctgatatcttagttatcctttaagacacatattaacacctcctccatgaaggctttcccattttcccagttggaagcatttgttcctttaagctccaaatgtgccttttcgtgtatcattgtatctagcttctatctgtctctccaaaaagaatgtaagcattttgaggccaaggattattttatttatatttatatctgcatacatttcccccaaacatacacattgagtatttttaaaacaaataaatttagtctaacccattatttctccatatgaaaagacaaaggcccagagagggaaaatgacttacctagggtcacacagcaggtcagtggctgtctcttgactctcaatccattgctccatccactatccaaggatgcatttctggagattctgaatgggtgcaatttttctcctccatattcttgctattctagtgcattttcttttagttccagaacctgctggtttcaagctttcttttttgaagctcatttggaaaacagtcactctgattcctctccttacaacctactccctcccttgggattactttttccatcctttccataaactctcatatctaggtgatgattttgagactattacattttttaattgacagagatgcagctgggtcctgtataacagctgagcaacacagaatctctccccctttcctccctcactgagccatgagctgatgaaaatttgtaaactatacagaggtatgcctattctatgccagccaatgcactaaaacaattcatggattttatcttatgtcatcctcacaataattctatgatctaggcggtgttactgtttttattttgcaggtgaggacatagaggctcagagagcttaaatgatgctcccaaagttacacagataatacaactggaatttgtatccaggcagtctaactttagtgctcatagccttagtctttacataatcccctctggaacatctcacatgacataattctgccagagaacttttcctaaagtatgtcattattgtgtccttccctactgcctctagagctgtacctctagagcagtgtattagagacagtatggtaactactagacacatgtcgctatttaaacataactttaagttaattatgattaaataaaatttaaaatgaagttcctcagtttaattacccacattgcaaatttcaaaagctagatgcagatagtggctactgtattggacagtgcaaatagagaacatttctatcattgcattttatttctgcaatgaaagctctattggacagcaccactctagaaactaaagtttgaactcctctgcctgttttttttttaactttttttttaattattaaaaaaaaattgtgagtacattgtaggtgtatttattcatggggtacatgagatgttttgatacagacatgcaatgtgaaatacgcacatcatggagaatggggcatccatccccttaagcatttatcctttgagttacaaacaatttaattacattctttaagatattttaaaatatacaattaagtattattgactatagttgccctattgtgctatcaaatagtagatatttcaagtgccctgcagtctggttcctacaaacttttcagcagaaaagcagaaaacaagaagcgaggaatgaagctagaaaaaggggtaggagtctgaggatgaaaggtctcctatgccacactaaggaagtaaggcctcgtgatgtaggaaggacacaatggatttcctctctgagaatagatagagccagtgcatgttgagacctggctcaaactcgcctctctcaggaagcctgagtaaataactacagaggtctgaatatcatgtcactctgttgactggttgctccccaaaagtgacaggaagggttccaacacttacagagaatacaaaggtctcacattcaaaatggattcaaaggacctgttctcaaatcacagttctatgtcgtgttgggacctgccactttgcatcactgagcttgtttacctatctgtgaaatgcagccaataatatctactttcctgattttcatgaccatcaagtaagacaatgaggaaaatgagataatgatgtggggtggggcctagacttttaacttcctcatgtgattctagggaatgccagggttgaaaatccttgaactggatgatctctgaagtcccttccagctttgaaattcgaatcaagctttgactcatagtaagaaaagtcagcagtcattttgaacaaaatagttacctaggtccccacaacaggctgcaggcttcataagcagtcaacgtttcaacgatcacagatagcccagatttccaggtaaagcagcttctttgatgagagtgcagaagcagttccatgtacaatggtgagcattctactcttgagagtgcaggatcagttttggcttcttggaagagtcccctccccaccaggtggcagatgtactccaaaaccctagacaaggactataccaccatttgtttttattgtcctcaaaataagtcatttaaaagagtcaatggatattaaccccttgtcacatgtatagtgtgcaaatattttctcccatgctgtaggttgtgtccccactctgttgattatttcctttgctgttcagaagctttttactttaatatagtcccatttgtctattttggtttttgttgcctgtacttttgaggtcttagccataaaatctttgcctacaccaatgtcctgaagtgtttcccctgtgttttcttccagtacttttatagtttctggtcttacagttaagtttttcatctattttgagtttatttttgcatatgatgagaggtatgggcctaatttctttcttatgcctgtggatatccagatttgccaacaccatgtattaaagaggctgtccttttcccaaatgtgtgctcttggcatcttggccaaaaatcaattggttgtaaatgcatggatttatttctgggttttctattctcttccattggtctatgtgtccatttttatgccagtttcatgctattttggttgttatggctttgtagtatactttgaaatcaagtaatgtgatgcctccagctttgttctttttgctcagaattgcttgggctattctgggccttttgtggttccatataaattttagcatttttttctatttttatgaagaatattattagtatttcaatagggattgcattgagtctgtagatcactttgggtagtatggatattttaacaatattaattctcccaatccatgaacatgggatatattcctatttatttgtgtcttcttcattaagtgaaataagccatgcacagaaagacacacactgcatgatctcagtcatacatggaatctaaaaacattgatcttatagatgtagagaataaaatggtggttaccagaggatagggtggttaggagtgggagtaggtgatgggaagaagttggtcaaaggatacataattacagttatataggaggaagaaatttcaagaaatctattgtgcagcaaggttactataggtaacaatattgtatttttgaaaaatgtaaagacagtggatgttatgtgctcttaccacaaaaataataataataaatttgttaattagctagatctaaccatgacacaatgtatatgtacttcaaaacatcatgttgtacacaataaaaacatacaatgttatctgtcaattaaaaattttttttatatagagccaacagatttcaagtttggacgttggttcaaagctttctcctttcatatggaattgctttgtttcaaggaaatagaagtttcaaaacagcaggcagatggatgtacagaagtatgcaaggtgaagaggactgagaggagctggcagagggaggaagaagtaggcggggaatattctaactaattcagatagcatccctacaagccccagcagaatagcacaacaaagctgatttcccagcatgttaatttcccaaagacttctctattagccagccctctgcacatcaacaacatatggggacctggagttctacctatggctcaggaactctttaaggtcttgaagtacctccctaaattaccaaagaaagacaaaattatgttcaaattgatacaacattataattatattttgctttatatttactctttgaaaatcacaaatccctataaagtgaatagggaagcactctgttaaactagactatttgatgaatcaaggtactccattcccaactgtgcataaaactgaaagtttgaaggattgtagacatttgtaactccatcttgcaaccagagaaaaagaatcaaatgaagatcagcagctcacacttcacaaatgaatatcatagctccaaatagggctcccagggcaaatcattcatcactttcttgattctcaatcacagccacactcctgagttcatcttgaaaagacaccctaaggttttagacatggaaaccaaaacacgcagacatttcttcttttcactatagtctcactttatttcacattcatcttttgcctctaaactgtacaaaaaaaccacttcatctttttttgtggtgcttttgggtctggctatcaaactggttctgtggcggaatgccaaattaaatacactcttttttattattaaaaataaggtagctgaggattagttcatcaaaattctcgggtaatggactgttctaattaaaagaatattctgataaactgggtttagctgcaactacaagaatgttgaaacaacgtatctagtttggtctacttttggcatattttctgaaatgtctggtttcatgtcccaccttaaaaatatgattgaatcttcggtacttgaggctctttcagggttttagagttattattttgaacatctatttttaatgtccagagttagaaatgaatatagataaaactatacatgagctgagttctggacatagctttggtgaaatttccaatgtgagaggtttattgtgtattgcctcttttaagtcaaggacaacggaagaggacaattatgctaactgaagtttctggctaaacaaaatttaatgtaacaatacattcaacttttccatacattttcacacctggattcacttgatcttcattatactctcgggagactgactcttcattttataagctgaaacctagagatgctaagtgacttactcaaggccgagattatcaagtttttgaagtcccagtctagtgttcttttcagcacatgcaatatccatgtcaattctagttttactatatttgtattgacttcctcccaagcaggccacactgagctcagctaatctcaacacagtaggagtaatatatgaatatatactcaaactttagtagcactcagaatagcttaggtgaaagtcatggctaagataatgacagctgccagaagagtgtccttaagcactccagttgagagctatttattttgcataatatgatcttggcatactaaatgttcatttgcatcctcacattgaggacactttacttgtctatggcatcattgtctgtggaaataaattttcttcagaaggttttagtgtctctaacaataactgctggacttctgagtggccaaagaattctagtatttgaaaagaagggagaatgtgtgttcttagattgcttgtatgtcttttaagaaataaaaagaaattatctctgttgatctttatagtaattttatgaagttggtactgcaggtgtcatgattccgttttacagaagtgattcctgagattaaacaagcttgtcatggtaccttaaacctagccacacattccttttcctatggtgcttactaaagctcacttatcatcagaatgccctaggagcatgttacaaatacatatagccttcccagctccttccctgacatcctgaaaattgcctgctccaccaacttcataagatgactatcaagatcaactgataaaattttaattttcttactgaaaatgaaggaattaagacactaaagaatggcagctgcttagagcaataatttaatgattacctgctctgtgatgaacaccacatcccatggtggaggttggataggaataaggacacacaagatacataggactcagagtgtggccttggagagtttataaggtagttggttgccaactaccttatagcagtagttgcaagaaccaactctagcatgcctcagaaatcatctggaggacttgttaaaacaccaattactgggcctcagcctcacagtttctgcttcattaagtctacaggtggaactctgagaatctgcatttttaacaagttcccaggtgatgccaatgctgctagtacaaagaacacaatttgagagtcactagcttaggcatcatttaaaattgtatgactgtcttggagttaaaagtgatatttcagaatatatgcatgaaagaaaattaaaacaaaaggaaacaatgatctgtagtattatacggactaccctgtgtccccctcctctttcccttcactgccctcacagggctacatgtccatgcactgcagtcacagaaataaatctttctgatatctgaaaaacaatcccattttcttaccacaaatgcactggctggcaccacttcaaatggaaacatttgcttccttcactgcctggtttctctagaaataggaaaaccctctgctttagagtccagaaggaggcagaagagaggaccacctctccccatcgccaaaggcagcgtttctcatactccagtcctcagatgaacagtggcagaatcattcggtgtctttattaataacgaaaattacaggctgggagcagtggctcatgcttataatcccaccactttgggaggccaaggtgggcagatcacttaaggccagaagttttagatcagtctggccaacatggcgaaaccctgtctctactaaaaatataagaactagttgtgtgtggttgcacgtgcctgtaatcccagctactggggagactgaggcaagagaatcgcttgtaccagggaggtggaggttgcagtgagccgagattgcaccactgcacttcatcctgggtgacagagtgagacaatgtctcaaaaaatataataatgacagattaaaaatgaaaacatgggtggctggcaagacggccaaataggaacagctccggtctgcagctcccagtgagatcaacacagaaggcaggtgatttctgcatttccaactgatgtacccagcttacttcatggggactggttagacagtgggtgcagcccacgaaaggcgagccaaagcagggtggggcattgcctcatccgggaagcacaaggggtcggggaactccctcccttagccaagggaagccgtgacagactgtgccataaggaatggtgcactctgacccagatactatgcttttcccacagtcttcacaatccatacaccaggagattccctcgggtgcctatgccaccagggccctgggtttcaagcacaaaactgggcagccatttgggcagacaccgagctagctgcaggatttttttttcataccccagtggcatctggaatgccagcgagacagaaccattcactgccctggaaagggggctgaagccagaaatccaagaggtctagctcagcagaccccaccctcatggagcccagcaagctaagatccactggcttgaaattctcgctgccagcacagcactctgaagtcgacctgagatgctggagcttggtggggggaggggcgtccaccattaccgagacttgagtaggcggttttcccctcacagtgtaaacaaagccacctgggaagttcaaactcggcagagcccactgcagcttggcaaagcagctgtaaccagactccctctctagattccccttctctgggcagggcatctctgaaagaaaggcagcagccccagtcaggagcttatagataaaactcctatctctctgggacagagcacctggaggaaggggtggctgtgggcacagcttcagtagacttcagtgttcctgcctgctggctctgaagagagcagcagatctcccagcacagtgctgaagctctgctaagggacagatggcctcctcaagtgggtccctgacccccatgcctcctgactaggagacacctcccaacagggggcaaaagacacctcatacaggagagctccagctggcatctggcaggtggccctatgggacgaatcttccacaggaaggaacaggcagcaatctttgctgttctgcagcctctgctggtaataaccaggcaaacagggtctggagtggacttccagcaaactccagcagactggcagcagaggggcctgactgttagaaggaaaactaacaaacagaaaggaatagcatcaacatcaacaaaaaggatgtccacacagaaaccccatctgaaggtcaccaacatcaaagaccaaaggtagataaatccaagaagataagaaaaaccggcacaaaaaggctgaaaattccaaaaaccagaatgcctcttcaactccaaaggatcacaactcctcgctagcaagggaataaacctggactgagaatgagtttgaggaattgacagaagtaggcttcagagggttggtaatagcaacctcctccgagctaaaggagcatgttttaacccaatgcaaggaagctaagaaccttcaaaaaaggttagaggaattgctaaccagaataaccagtttagagaagaacataaatgacctgatggagctgaaaaacacagcacgagaacttcatggagcatacataagaatcatagctgaatcgatcaagcagaaaaaaaggatatcagagattgaagatccacttaatgaaataaagcgtgaagacaagattagagaaaaaagaatgtaaaggaacaaacaaagcctccaagaaatatgggactgtgtgaaaagactaaaccggcatttgattggtgtacctcaaagtgacagggagaatggaaccaagttggaaaacactattcaggatactatccaggagaacttccccaacctagcaagacaggccaacattcaaattcaggaaatacagagaacaccacaaagatactcctcgagaagagcaaccccaagacacataatcatcagattcaccaaggttgaaatgaaggaaaaaatgttaagggcagccagagagaaaggtcgggttacccacaaagggaagcccatcagactaacagtggatttctcggcagaaaccctacaagccagaagagagtgggggccaatattcaacattcttaaagaaaagaattttcagcccagaatttcatatccagccaaactaagcttcataagcaaagaagaaataaaatcctttacagacaagcaaatgctgagagattttgtcactgccagtcctgccttacaagagctcctgaaggaagcactatatactgaatggaaaaaccggtaccagccaccgcaaaaacatataaattgtaaagaccattgacactatgcagaaactgcaccaaccaatgggcaaaataaccagctggcatcataatgacaggatcaaattcacacataacaatattacccttaaatgtaaacaggataaatgccgcaattaaaagacacagactggcaaattggatcaagagtcaaggcccatcggtgtgctgtattcaggagacccatctcacatgcaaagacacacataggctcaaaataaagggatggaaaaatactttccaagcaaatgaaaagcaaaaaaaaaaaaaaaaaaaaaaaaagcaggggttgcagtcctagtctctgataaaacaaactttaaaccaacaaagaccaaaaaagacaaagaagggaattacataatggtaaagggatcaatgcaacaagaagagctaactatcctaaatatatttgcacccaagacaggagtacccagattcataaagcaagttcttagagacctacaaagagacttagtctcccacacaataacagtgggagattttaacaccccactgtcaatattagacagatcaacaagacagaaaattaacaaggatattcaggacttgaactcagctctggaccaagtggacctaatagaaatctacagaactctccaccccaaatcaacagaatatacattcttctcagcaccacatcacacttattctaaaactgaccacatgattggaagtaaaacactcctcagcaaatgcaaaagaacagaaatcataacaaacagtctctcagaccacagtgcaatcaaattagaactcaggattaagaaactcactcaaaactgcgcgactacctggaaactgaacaacctgctcctgaatgactactgggtaaataacaaaattaaggcagaaataaataagttctttgaaaccaatgagaacaaagacagaatgtaccagcatctctgggatacagctaaagcagtgtttagagggaaatttacagcactaaatgcccacatcagaaagatggaaagatctaaattcgacaccctaacatcacaattaaaagaactagagaagcaagagcaaacaaattcaaaacctagcagaagacaagaaataactaagatcagagcagaacgaaaggagatagagacacgaaaaacccttcaaaaaatcagtgaatccaggagctgctgttttgaaaagattaacgaaatagaccactaaccagactaataaagaataaaagagagaagaatcaaatagacacaataaaaaccgataaagggacatcatcactgatcccacagaaatacaaactaccatcagagagtactataaacacctctacgcaaataaaccagaaaatctagatgaaatggataaattcctggacacacacacccttccaagactaaaccaggaaaaagtcgaatccctgaatacaccaataacaagttccgaaattggggcaataattaatagcctaccaaccaaaaagaaccaaggaccagacggattcgcagccaaattttaccagagatacaaagaggagctggtaccattccttctgaaactattccaaactacagaaaaagagggacatctccctaacttattttatgaggccagcatcatcctgataccaaaacctgggacagacacaacaaaaaaagaaaatttcaggccaatatccctgatgaacatcgatgcaaaaatcctcaataaaatactggcaaaccaaatccagcagcacatcaaaaagcttatccaccacgatcaagttggcttcatccctgggatgcaaagctgattcaacatacgcaaatcaatacacataatccatcacataaacagaaccaatgacaaaaaccacatgattatctcaatagatgcagaaaaggccttcgataagattcagcacccctccatgctaaaaactctcaataaactaggtattgaaggagcatacatcgaaataataagatctatttatgacaaacccacagccagtatcatacagaatgggcaaaagctggaagcattccctttgaaaagagacacaagacaaggatgccatctctcaccattcctattcaacatagtattggaagttccggccagggcaatcaggcaagagaaagaaataaagggtattcatataggaagacaggaagtcaaattgtctctgtttgcagatgacatgattgtatatttagaaaaccccatcgtctcagcccaaaatctccttaagctgataagcaacttcagcaaagtctcaggatacaaaatcaatgtgcaaaaattacaagcattcctatacaccaataatagacaaacagagagccaattcatgagtaaactcccattcacaattgctacaaacaggatataatacctaagaatacaacttacaagggatgtgaaagacctcctcagggacaactacaaaccactgatcaaggaaataagagaggacacaaacaaatagaaaaacattccatgctcatggatagaaagaatcaatatcgtgaaaatggccatattgcccaaagtaatttatagatttaatgctatccccatcaagctaccattgactttcttcacagaattagaaaaaactactttaaatttcataagggaccaaaaaagagcccatatagccaagacaatactaagcaaaaagaacaaagctggaggcatcacgctacctgacttcaaactttactacaaggctgcagtaaccaaaacagcatggtactggtactaaaacagatatatagaccaatggaacagaacagaggcctcagaaataatgccacacatctacaaccatctgatctttgacaaacctgagaaaaacaagcaatggggaaaggattccctatttaataaatggtgttgggaaaactggctagcattatgcagaaaactgaaactggaccccttccttacaccttataaaaaaattaactcaagatggatcatagacttaaatgtaagacctaaaaccatcaaaaccctagaagaaaacctaggcaataccattcaggacataggcatgggcaaagacttcatgactaaaacaccaaaagcaatggcaacaaaagccagaattgacaaatgggatctaattaaactaaagagcttctgcacagcaaaagaaactatcatcgagtgaacaagcaacctacagaatgggagaaaatctttgcaatctatccatctgacaaagggctaatatccagaatctacaaggaacttaaacaaacttacaggaaaaaaaacaaattaccccatctaaaagtgggcaaaggatatgaacagacacttatcaaaagaagacatttacgtggccaacaaacatatgaaaaaaaaagctcatcactactggttattagagaaatgcaaatcaaaaccacaatgagataccatctcaagccagttaaaatggcgatcattaaaaagtcaggaaacaacagatgctggagaggatgtggagaaataggaatgcttttacactgttggtgggagtgcaaattagttcaaccattgtggatgacagtatgatgactcctcaaggatctagaaccagaaataccatttgacccagcaatcgcattactgggtatacacccaaaggattataaattattctactataaagacacatgcacacgtatgtttattgcagcactattcacaatagcaaagacttggaacccacccaaatgcccatcaatgatagactggataaagaaaatgtggcacatatacaccatggaatactatgcagccataaaaaagaatgacttcatgtccttttcagggacaaggatgaagctggaaaccatcattctcagcaaactgatgcaggaacagaaaaccaaacactgcattttctcactcacaagtgggagttgaacaatgagaacacatggacacagaaaggggaacatcacacgctggggcctttcagggtctggggcactaggggagggatagcattaggagaaatacataatgtagatgatgagttgatgagtgcagcaaatcaccatggcacgtgtatacctatgtaacaaacctgcacgttctgctcatgtatcccagaacttaaagtataatttaaaaaaaatatatatatatatataaagataaagataataataaataacggaaattgcagtgacccactacagaccaagtgaatcagaatttctagaagtgagacctgggaatctggaatcttaagtgccttgagtcattgggcttttctgaggcacagtgaaattggagaatccctattaaaagaattttcccaatattcggtttggataaggacactaaaaagtctgatttctcctaactgaccaccacttcccctttcctgcgtcttcatgtcccttgagaaaccttgtgagactggaagagacacaaggctcctccctccttcacccttacacatgaccaccctccacccccccaaccaagacatgtaaatccatttggactgagacatttctgaggttgctaaagtacccaccctagtccctgccaaattccacccagtgaggaaaacattcctttattttttaatgcactttttataatttttttatcttctctgttctaaaatgtttctctctcctgcttctttatgatatattctggagatatttcaaagccatttatacttcatactgatattggtgttttcactgttctgtgaaatgccatagtttatattgaaatgatgcattaagatataggagaaaaagagacattgagagaggaaaaaaatggtgaggaaaataaccgagagcaacattatgagaaagatgaacagacccaagggttggaactctccctcctatagcactaaaatattatcaattcattacttggcatgcacctcttctttctagggtggggaagactttggaagttaggggatgaaatgcaattctttcacctgctttaccagctatgggtctgcccgagtttttgctttttggtttattgtcaagttacagcaaatatatattttgtgtcttctgggctagtcactatataacttacagtttttcattgtgagcttctcaatacaattccacacagagtagattaactaatgaaggtcagaaaacactatggagatataggttgctaggacacagaaccaaacagatgagtcctctatatgggagggggcacccaacatgtgcaattcactaatgctcagttttaattggcttctaaattctgtttctcttgctccctctcctcaaaggactgtgtgtgtgtgtgtgtgtgtgtgtgtgtgtgtgtgtgtgtgtaagggtatatgtataaaaaaattatttgcattagacatcataatcatgttctcaatttatatagcacaataacttttacatttctgcagaggatcttatccaatgctctttttcgcattacttttcaggatcatgcaaatattactgagaatttgaataaaatctgtgaaagtaataaaaagtcatccctacaataattccaaatggagccagaccttttgaaggtggccacttataaggtggggttaatgagcatccaaagtctttctctgacccaaaatgtgtcccttgatttccctgccacagctatcaaaatccatttgttacaatggaggggggtcaccctttgaggctaacacagtggagaactctgctataagttaaagctttaacacacaggcatttattcaattagcttctatcacttcacaaggccctgagggaaacaggacacagaacagattaagctttattggttttaatagtggtagtgaatggagatcaggaaagacctgaaactgggcacactggcatagcaggctgacctggacaaagcaccctactgaggagaactgaatagccaggaactgaaaagccttgaaggtgctggaagcctggtagtaggtagatatgtatctattaagataacaaggctgcaagtagcaaatcttgactatctgtgctttaaataagtagtaaaagccttcaagcaggtagttgtaggcattgtttctgctgcttaagaataccatcaaatggcaacaacagacaccgggaactactactgagagagggagagaagaaggcaagagttgaaaaactgttgggtgctatgctcagtacctgggtggccaaagcaatcataccccaagcttcagcatcacacaatatacaaacctgcacatgtacccctgaatctcaaataaaagttgaaattatttttaaaaaaagaaaagaaaaaaagtacaatttttaagagaaagtataaaagaataacatcaaagacctaagctcttcctttttgcttctccatccttatcacctggctttcacctatatgcttgtttcccattcacatctcgtttgccagaactatattgcatggcccgcctcctcaatatcagttgcaagggagcctgggaaacaaagtatctagctgggcacattgccaccttaaacaaaaccaggattgtgttagcaaagaaggaggaaatagatattgggtaggcaacaaacgatgcctgccaaagaccaaaggagagctctggctgcccttagatcaaccatattcactgggcacctactaggtgccaaacactgtaccatgtgcttggagatctgacttttgcctcaggctaaccagaattcagagaatgaagctactccagagggataaattaccaaaactagcatctagctgtgtgtcaagttttatttttttttcctagccaccaagctgcactgagctttgagaacataatttcatctaatctttcaaattatttggggcagagattcaaacatcagctaacccgctcaatatagggaccatcacaaagaaaggtctttgaattttagctatcaggatcatttttaaaaactgtgcatcagagttattttatgcatgcaaatctctttctgctttttaattggatttgtgcctggatgtactacaaattgcttttaaagatgggctgcagaataggttccagctatggacaccaatacaatggcataggcaggtacttttggtgtcacctcacctccacacctttatttccacacagtctccaatctcatcctacttgctgactagtcggtacaaaggacttcttctaacctaaaaacaacctttgaagacctccccccaccccacaccccaaaaaagcaaatgcaaaatcattaagagctccagaatgatttttactaaggaatttttcctggggattctctctccaaggaaagataaataaacggctctcacaaaagaacgagtctttgctgctttgatgtgaatgaggccaaccagaaaatccctgcagcttaaaacctaagctcagtaacactttgtttttagtaaagtcagaatggaaaaagactttggggaagtcaagaagtggccagtaggattacatggcatagactcttcaaaatccaactttctgcaggctggtagcagtggaatacaaaactgtctaccaaatgtgatttgagaagaaaattcatgcccacagatttctttttaccttggacgatcatggcgaaagtccaagtcccttagggctttctggtaacaggtgcactccatttctagggaaggataatatgttatctgggattagtttatctggttggcctattgtcacccagaagagatcagagccctaagggtatggtaccttctggtgtttttaaattttgagaaataggaaagggatggtttataatttagaatccaagcagaactcagtgaggtgcaccagaaggaacttcaagatagacacggaagagtaggtggccactagacccctgggaagagagtgaaccaaagagaagtaggagagcggcagggctctggaatgagtcaatcatgacacctatctatgccaagcttatgttggaatcaaaagagtatactgaagtgggatatttagacccatttcttaaatgatgcagagtgttacaaagcacccagtatagtgtcttacagacactcatagaaaatatataataaatcctaaccacgaaacatttcataaagtagaaggtttgaggaaggataaggttgatagaaaggcagcaccttagtgaaataaatgaaagtgttcattgatactcctgtaccatccactgcatcccctgtgcttttgcttgcccatacctgatataaaatcccacccaacataacatctctatatatgagtcattagaattcatgggtggggagggtagtaataatttatggagtagaagaaagggactaggtggggaagggacagtaggaaggagaataaaagaagcagttgagggtagaagcaaaacggagaatggctgtgaaagtgcaaagcgaaaatacaggaagaagacactggatattaacataataacaacaataatagtaaaagttatataaggcttactatgtgccaagtcctgttggaagcacctcacgtacattaactcactcttcacaataatcccatgaagtagatttattattatcttccaattttatagattaagacattgaggcatagagtttaagtcaaaataatgatacttataaagcagagacaagggataaagaaagagactgaattctgacatcatttgctctccagatttttcaattaagccaataatgtctttctttcaagtcaatttaagtcaggtttctgtcccttgcaacaaagagtccttgctaataaaaaaaaaaaatctattggctgtttatcatggacaaagtactgggctaagtgtttttatatactttttaaatttaatcctgatgactcaatgagtttggtactgttattattatccctattttgaagatgaagaaactgaggcacagagatattaaataacttacccagagtcatgcagctaataggtagcagaactgagaggtaaactcctgcagtttgacttcacactctgtgcttatcacaaccatactaatctttgatgtgcacacaaataggcagataaaggaagagcatgtcactagccagtagtgaataatggaaactgaaggccacttcattccaactgttccttttaaagagtaacctgataaagttatagccacccattcaaatttccaagaaatcaggtcctatgcaggtgaacatttgtttggagtctcctgactcttgggaaaccattatttttgatggtatgtagccttgactctccagtgaggagtcacttagcactaatagaaactagctctaggattttatgtccccaaaagagactccctttcaaacaggaaaaggaagaagttatggtgaagctatctctgtgggtacggctgggaatacttcttagaacaggaaaccagtagcatcacaccctggaaaccaccataccaagattcacaaagctagcatcaactgagcaaagccttcttccatttcttacgtgcctacagcctctccatataatcaaagcttgcatccttaatggctttcagtcaatccctatgagcattccttcttccacaagtgtactacaattagttgctgtagctttactgcagaaggaactatgtatatgtttttaattttttgttgttttatttttaatgtatacaaatgcctatctgctagcgataactattggccaaagaataatagtctattcaactgggattcaaacagttaaagattacaaatggctttcattgttttataactattagaaggctcccctgataattccttgctgatttatatcttggtctctatttctgcatagtcaccataaaaatgctgtgttaaataatttcatattaaaaaacaaaaccaggatttaatcgtcacttaagaggcaaacgataatttttatcagcctttgcgaatgggccttgtttctccttcattacatgtctataaatgtttgctagttcttagaagttaaatgactagaaggatagaagagacgtgaatttttaaaaatcagtcactgtttttagctccattctaaaatacatcctgcatgacacagtagatcttctccatgagactagttaataacaagcattctgcatattttataattatgtgcactaccagcagagtgccattggatttattgcacatttgagcccccagaatcagagtcgtgcttcacactacctatcataacaaatggcatggaggggttctttatgttacaggttactgagttggatatttaaatagcacattcggaagtgttctgagttatggtcaccctgcaagaaaggcaccatccaaagtacactatgatttaagtgtcatggcccatgctggagctagcagctagctgactcagaattgggatctataaaaaaggaaatgaataaaaccctagttgattaggagcagattgatcagaaacatctattgtttctgattgggtttttggcacactccaatttttagatgtaagaggcaagaaacacagacatacataggtcatattacttctttttttcagtagatagtccaattgcctatacctcttttctatctccatcctttaaaatgttggaatgtatcactaagtgatatgtgtgtagaaaccccttctttctctggcataaaaggtattccacacatggagcagtatttctctcactcccaccttagaatgaagggagaatgacctttgtttttccatcatatacatagaaagtttgaagaattttttatttcaatgtgtgcaaaataattactgatgcaaccttgactgtttataccacttttactcatcaacctattatcctcagataatgtctttggatatgaacactaacactggtacaattaactctacattggtatgcttggagtggtgacataacttatcctaggtcccacaacaaggtcgatataaaggacagactagattacaggtctcttgacttctggccgaatgttcttactactgaatggtgttatctgcaacctgtactgcccttggttaatttactttgagaaacatatgcaaaaaaaagtctaggatgttgttttcttaccctatgctcatgaatcaaacttgttcttcttccccctcctgttaccagcaccctccccaattcccaccccaacctccacatatcatttaaaagcctgtgtttccttctactattcaagagactggaacatccagatcatctaactatgacttgagataaatcacgctatgttccctcagaaattactttgacacaaacaattactccaataatatacggtggaaaatagtgttaagtacaatcagcaaatctaaatggcagtaattggcattactaattcttgcacacaaataaataattatactactttccttccaaatttcaatttggacatgcaaagtccacttagttcactggagcagaaaatggaagcctttaccaaagttgacagtccacatgataatgtgtagcctataccttaaactcatctttatattgttcacagtaactgttagcatgaggctttgcatgtagcagggttttaaataaagccttgttaaatgaatggttgttcatgaccagtctctaatttccatattattttttatcccatgagaataaaatgctcgatttcactttgtattgtggtatataatagaagttcttatataacttagtttattaaatatattcaagcatgcctctcccaaagcataccaattatggagaagaccctaaagacactaccctatagccttgctacttaaagtgtggtccatagaccagaagcatcagcatcaactgggagcttgtcagaatttcaggccccatcccagacctatggaatcagaatccacatttacaagattctcatgtgattcccgtgcatgttaaagcttgacaagttctgtgccatgggaacagttgttaatcctgtcacctgactccaatcgtcacactgcacattccagtctataaaacctcttgaacccctatgggtttattaggcactagatagaatacagacaaaggaaaagacatagcttttagcaaggacaatatataatctagctctaattcatgtggtttacattgcagtaatgcaatcatagggaagatcaggtagattgggttgttcagggaaggcttattggaaatggaataatttactaatcagtacttttggaagtggggaaaagtggtaacaatagctaatgtttgtctagtgcttactatctgcaaaggcctcaggttacactttttcatttatcatcccatttaatcctcacattaattcgatgagttaggtttagtgtagtggcaaagtgcgtaggctctaaagtaaaatggtctgagtttgaatcctacctttgctacttactagctgtgagatcttggaaaatattttttttaacttttattttatgttcgggggtacatgtgcaggtttgttacatagataaacttatgtcataggggtttgttgtacagattatttcctcacccagatattaagcctagtacccattagttatttttcctggtcctctcccttctcccaccctccaccctctgagaggcccccgtatgtgtttttcccctctatgtgcctgtgtgttctcatcatttagctcccacttataaataagaacatgcggtatttgtttttctgttcctgtgttagtttgctaaggataatggcctccagctccatcaatgtctcctcaaaggacacgattttttttatgctgttcttttttatgctgcatagtattgcatggtgtatattatgacattttctttatccaatctctctttgatgggcatttaggctgattccatgtctctgctattgtgaatatgctgcaatgaacagtcacatgcatgtgtctttatggtagaaggatttacattcctctgggtatatgcccagtaatgggattgttgggtcaaattacagttctgcttttaggtctctgaggaatcaaaacactgtcttccacaatggttgagctaatttacactcccagcaagggtatataagggtaccattttctccacaacctcaccagcatctgttattttttgactttctaataatagccattctgactgttgtggcatggtatctcattgtgattttcatttacatttctctaatgatcagtgatgttgagcttttttcatatgattattgactgcatgtatgtcttcttttgaaaagtgtctattcatgtccttttgcccactttttaatggggtcgtttgctttttcttgtaaattggtttaagttccttatagatgctatatattatacctttatcagactcatagtttgcaaaaattttttcccattgtgtaggttgtctatttatactgttgatagtttattttgttatgcagaagctctttagtttaattagataccatttgtcaatttttgcttttgttgcagttgcttttggtgtcttcctcatgaaatctttgcccatgcctatgttctgaatgctatttccctggttgtcttccagggtttttatagttttgggttttatatttaagtctttttttcatcttgagttaattttttttatggtgtaaggagtccagtttcaatcttctgcatatggctagtcagctttcccagtactgttcattgaatagggaatttttctccattgcttgtttttgtcaggtttgtcgaagatcagatagttgtaggtgtatggtctcatttctgggttgtctattctgttccattggtcaatgtgtctatttttttgcaccagtaccatgctgttttggttactttagccttgtactatagtatgaagttagacagcatgatgcctccagctttgttcttcttgtttaggattgcttggctattcaggctctttttgtggttccatatgaattttaaaatacttttttatagttttgtgaagaaactccatggtagtttaataggaatagcattgagtctataaattgctttgggcagtatggccattttcacgatattgattcttcctatccatgagtatggaatgtttttccatttgtttgtgtcatctctgatttctttgagcagtggtttgtagttctccttgtagagatcttttggctccctagttagctgtattcctaggtattttattctttctgtggcaattgtgaatgggagtttgttcctaatttagctctaggcttgactgttgtttgtgtataggaatgctagtaatttttgcacatggattttgtatcctgagactttgctgaagttgcttatcagcttaagaagctttggggctgagactatggaattttctagatataggatcatgtcatctgccaacagggatagtttgacttcctctcttcctatttggatgccctttatttatttctcttgcctgattgccctggccagaacttccaatactatgctgaataggagtggtgagagaaggcatccttgtcttgtgctgattttcaagggggaatgcttctcactttttcccattcagtatgacattggctgtgggtttgtcatatatgacttactattttgaggtatgctccttcaatacctagtttatttagagttttttaacataaacagatgttgaattttatcaaaagcattttctgcatatattaaggtaatcatggtttttgtctttaattctgtttatctgatgaatcacatttattgatttgtgtatgttgaaccaatcttgcatcccagggataaagccaacttgatcatgatggattagtttttggatgtgctgctggattcggtttgctagtattttgttgaggattttgcacgtatgttcatctgggatattggcctgaagttttcttttattgttgtgtcgttaccaggatttggtaccaggatgatgctggcctcatagaatgagttagggaggagaccctcctcctcaattttttagaatagtttcagttggaatggttccagctcttctttgtacatgtggtagaattcagctgtgaatctgtctggtcctgggctttttttttttttttttttttttttttggttggtaggctacttactactgcctcaatttcagagctcattattgatcttttcagggatttaatttctccatggttcagtcttgggagggtgtatgtatctaggaatttatgcatttctgactgtttatttgaattttctctcttttcttattagtctagctaatggtctatctattttattaatttcttttcaaaaatccagctccgggattcattgattttttaatggttttttgtttgtttgtttgtttgtttgtttgttttttgtatctcgacctccttcagttcagctctgcttttggttcttgtgttctgctagctttggtatttgtttgcttctggctcattggtttttttagctgtgatgttaggttgttaatttgagatctttctaacttttcgagatgggcatttagtgctataaatttcgctctaacactgccttagctgtgtctcagagattctgatatgttgtatctttgttctcattagttttcaaaaaacttcttgatttttgccttaagttcattatttatccaaaagtcattcaggagcaggttattcaatttccatgtaattgtatggttttgaatgaatttcttagtcttcatttgtaatttgatcgtgctgtggtcccagagactgtttgttacaatttcagttcttttgcatttgctgagaagtgctttacttctgatcacgtggtcaattttagagtatgtgccatgtgccaatgggaggaatatatattctgttgtttttgggtagagagttctgtagatatctatcaggtccgtttggtccagtgttgagttcaagtcctgaatatctttgttaattttctgtctcaacaatctgtctaatcctgtcagtggggtgttgaagtatcccactattattgtctgggagtctaaatctctttgaaggtctctaagaacttgctttttgaatcttggtgctcctgtattaggcgcacatatgtttaggatacttagatcttgttgaattgaaccctttactgttatggaaagaccttcttggacaagatatttaaactctctatgccttagtttcctaatctatagaatggagataatagcagcacctacctctagtacccattagaattaaaggagttaatatgtatgaaacacttagagcaatgcccatcacatagtaaccatccaataaatgtcagatgctactattttcattttatatgtggagaaactgatgcacagagaagttgaataactttttcaaagtcacacagctagtaagtggtggagctagaacttaaatgttgctttgtgtgactacagagctcacactttcaactctttattacataatttaaaatgttcctgaagagggagaaggagaaaactgttctaaatccaaacttttccaatgattatgagcccaatcctcctgtggaagctgggcccacacaagtattaggcaataagctgacaatatttgagatagtgtcttcatataagattccaagcagatttcactatttgcaacaaaattcatcaaaactttaaattgttttcccagcagtggctatggctttgcccagtaatttataatcttctgcctggataacttcgtgaccagacaaaagtaagggatacaggctgcacaaggcctagaataaacgtatctggccctcatgagcctggtatttaagaaatggtgtttctgtgcaaagcacacctttaaaagacagactgaacaccttctgaatagcctggaatcggatcttagacatagaatcagatgtcactggattagagggtagtttttggttctttctaaattctgggtcttattcagatgagattaattctgtgtcaaaatcttggctaagatctcttctgtatgaccttgagtcagtcagtatccttctctggacctcagtttccaatatatgtaaaataagactaatgggatggtctctacatgtctttccaattccaatatagtctttacagttttgaaagtgtgttttatccacaccacttctctcctccctggtctttagtgatgtggaaagagcataggctttggaatcagatagacatagggttacctccttgcccccaggacttagaagctgggtgaccttggtcaaaatatgcctctctctggatctcgattctctcctagagatagtaatactcccacctcacagggttaccaggaattgtatgtagtagaaggcatgcaatttactaataaatatctctccctgaatttctgaggatcattatatgggtctattactctatcgtctacacagaaccacttttgtatgcttagagaagtcaagggtaacattggcctgtgtgatcttctaatactgaaacctttccctataagccagaaagatccattgaggagttttaatatcttgataaggtcagagaagggccaaggaagagctattgtaatggtcatggcgtaccccttagcaattctatcctctgtctaagtctaataggacaagtgtttaatattacacactcacaatagaatttcctttctatgacgtgggctcccagagactatttcaaatctgagtttcatagcaaaaactttccactgccaaccccttcacaattttttcaccccagaatggtctcctattacttttaaggactactgcaacatttatttaaagtaaaattaatgttaatgcatttagattttattcagatattgggttgcaggatctagtaagagtgtgtccaagctcctgatcaatcacattggaaagcagaattctcagtagtgggaaaaatctagatttgtcattgactaaccaaacaagtcataaaatcattcacttgtttttagagcagtgctttggttcagctaggaaggcttagttccttctagtcaggaaccatatagaaaaatgaaagaacacttccgaagaacatttgtcaccttggtttgggtgacggtgtgatgtatacaggaaaagatgttaaggtgaaataaaatatataatttacccagcaggatatctactgctgggaataggttgtcatccattgatgagagtcataagcttcactatgtaaacattttaaggaaacatatatctgtgaaggcactatggttaaaaagttcatctctttctctgatgtttcatctatgtttcatgttttgcatcgttacttatttcaggcggggtcagtactggtctagttccattctttgcaataaggccatgttatttgacaccacacttcttgaccactccaccccaacttttgctcccatacccaaggagaatcttgactcacttcagacacttcttctgtgaggaggatctcccattagcccccaaagccccacttttagtgctacaaccaaggagaatccagtgaagatatagcatgtgtcagccctaatttcagattccaaaataacatttaaatttctttttacagtaaaatctctatcaaacagagtctgatgggtcagaatcttcaaatagccaaaatttctgcctagagattttaggaaaaaaaaaatgatttcaaaaggagcgggtgatatcagggatttagtaaaagtgacagtctccttgggctgctccagggtcagtacacatttagccagttgcctccattttaacttctacagtcctgggtaatgaatacctatgttcagaaagatgaccctgagacattgtaatatccttgggcaccaaaaaagattctgcaatattcagttggttatatttatcaaggaagaaaagtgggcttacatattttatagaaactttcaatggcatttcaataacaacaacaataacaacaacaacaacaaaaagacttcttggtaagcattcaattctacatatgttactgaaaggaacttttccccttcctcctccctttacaatttccaagcatgccacatttccctctggcttttagtgtgtacatctgtaaaatcaaaagattaaattagatgatatctaaggtccctttcacttctgatgtcctgcgattataccatctctgtgatttcttacatggcctctataacttcagtattatgcataattctagcagagtctacctcagtggaaaatatttcctccaggctccttctcttattcagtgccttcgaagtgccaaagaccagggaacagtctcaggaatactagcccaagttgactaagcacagaggttttgcggatcccatctgtaaaggctaccagagtccctttgatgaccaccttcaagagggctaataaggacaactcccatgtaagaagaaaagtccatctgacaagtataaggcagtagtttgaagaattaaataaaggacagtttggcaactgcttccaaaaggctatactggcctggaggtagtttgaaataaagtctgtattactaattgaaaggcaagaagagagtcttggaataaatcagataaaataaataaagagattattttacttattgtcagcaatgccacaggcagtcttggaatttggtggcagtcctatcttcttaagcttttcgttgccaactctcaaaatgttcaaaatccatttctaggtcttctttccaccccatggttataaatcttcaatgacaaaaaagcaaaccttgaaagttctataatgttaaatatttctgaggatacaacccactccccaagtagagctagcacctggatacttcctcccacaagaaagaattgctggagaagcttgcctgagccacatctattaaacttaggcttctaggagtctaagaaaaatgtactgttttcacgtcgagtttataccagctgacctgattttgaacccacacccacccaaacacaatgtaaaactctgctcatgattctaactactggagagtgacttgtttcacttaccaaagagtgtcatgccaagacttaggaactaccaaaatatagcaaaaacccacaaccaaataaataagataaagaaattagagaaatgatgcataagcactatattatctgtatatgttctatatcttaaaatatagattttctacacatacccaaaagatacttcttataccaaaaataaacattgagactttggaagacttgtctcttgcattatccttgtccaattataagggattcgttacctataatgccaatactgctttcgagtttggccattagcatttatttttctgcactgagggaaattctacataggcattttgtatatgtctgagagatgagcatggagagagtggaaagtagaaaatgcacaagaaactgaggcagattctcctttcctctagcatcaggcctttatagttaaattcattcccacagcatgcagacacattcaaacaaagtataaaataggttacacaattaaatacaagtgagtttaagcatattcactatttggtactattcgaaccttggattccctgtccccgttgcaaataattgagaaaagtaagttttaaagcataggtagacagaatagctgaagatgggaggtggtgggggaagatgggttgggtagactaaatggtctattgagacttccacttgctctatcattctgttaggagtcattgacgttaatgttcttagactattctgtatgcataaggcaaattataatagaccctcagattgatcattcaagaatctgagggctgttttgaaagatggagcttaagttcttttcttattcatcccttgggtatgtggataattcaaaagcaagtaatagacatgtctgttgggtctacctggcttattggccagtttgatctttaatattatacagtcactactctagctttatctaaggctttatgattcccttatgccaccaaatcgcaagttgaccagatattacacgtgcaaacacaaggctcagagagcagaacaggtgactactgtggctgtgccccagacacactcttccctagaaagaagggagggagtaaattaacatttagtgagtacctactatgtgccaagtactgtgctaataacttccacatacattctaaagcatgttctacattggaagcagggttgatctattcaaataatatatgatacattggaaagtagaagaagagaggggtgttgcacctgggaatcaataaatccaacagcaaaatattgattcaagaaatactagcaacctctggccagagaagcttaccttccaaaaagatataatcacagcctcagccagctgaagataggaatgtcaaaaggctcaggggaggatgcatatctttcgaaatgatcacaacagcagtatttctccaagctacattgagctttcttggcaccacagacagagtaggggagcctagggttgaaccaacatacttgtacccatccagctgtgcccacatatctgccacctccagataaccctctctctagccctggggcacaagctgatcacacaccattttctgaaaataattcttctttgtcttgctccagggactttggcagagaattggggaagatgctttgtgcatcctgtggcactcaactatctaatgccgaaagcttgcagccaggggaggtttgtccaaatgtctgacctaaaagggccatggcttcacttcttttctaattaggataattaacctcccctgctcattcatcctgttccaatccaaaaagctcaaattaaaatggcacaggagactgtcaggctctagggacaagagacagtttacaagtctttcatttccatgccaccaccatcaaggcaaagccaggacaaagttgtcacagcaactttacccttgaaacaaccttggggcccctggaaggccactttcagaattttcatcaatgtaaatactccatcagctataaaattttgcacagctccataacacttgctgactaaattggggcagaagggagggacagggaagatgataataggagataacatttctctttctattgtcatgtggattctgtggttggtccaaggagaacaaaaactagatgctttgagttggtaggatttgatatgggattcagggaatgtattctttgggaacaatcactggaggcaaaactttgggagcatttaaaaaactggaagcaaatagcagcacttcaagcagggcagagacacaactaaggggaagcaattctacagttcttcctctgatgactttaactgtcctttccccacctctgagcaggttttagagtttcatatcagatgcccaggcagataggactgatgactgtcctctggatctcttgcccctccctactctaggattcagtccagcatcttcactacatgcagcccttcctacctacctgtgtgggaagccactgtgcgctgtagtctcggtgccaagaattcgttggctacagacctttgtgagcctccatggctgataggaaaggcaacggacaacaggttaatagatgagattgtgctgctcatttggactgagtactgaaaagttctttccagcccagtagtgttgattttccctgggtctgccttgtttggaatatctccagtagtgaagaccctgacttgcaactcagtatgtcctagatccatctacataaatttttcagcatgttaacagctttgacttgggcctaggttgagcaagttggtcactctctaaactttgccaaatcatgtcctggtcccctgctagccctacactgttcatgtcccatccataatctccactgcagcctgggcctttcctgctcttgaattaccaatctgtgttaaccagccaaagcgtagttctcagtcgttatacaagaatgactaggccagtgcttctcaaattttgatgggctaatgaatcacctgagaagcttgttaaaatgtacattctggttcattaagtctagagtggggcccaagagtatgcagttctaacaatcagccttggtgatgccaatgctgctgatccatagaccatactttaagtagcaagtagagcatctttagggtcttctctgtaattgatatgctgatgtagaggccacactttaagtagcaaaaacatatgctcatttcccaaatgagttagacccgacttggctgcttgaaataagacattgtggcacatcaacctctcttcttggcagtcaacaatagcatcctttcatattaaggctaaaagaatttttagggtaaccagggctgtgcagagggtgtgacaaatgtgaaccttagtgtagagtattcttcttaggacttgggttactggaaaaaagccttcctgggcacctgaagccaatcatgcaggccaaactcatttcgtatccagccactccattcatcgcacccactttcatagtggttctggatggctgctgccgccacatcactcatgctgtgatctgcatcagtggttgagacaacggaagcagctacatcatccaagccacaatccatttatttcatgctaagaaaaacaatcttctatccaagtggggcaagctaagctgggcagttgccacaactttaaggttataggaaatatgccttttgcgctatttacctcctcagtggagagcaatgacccccttgaagaggacccagatttcatcagtgcatcagtgccatgccaggcagagcaagcccatttctcctctgaggcataaggcgtataactcctggagttgtttaaacatagattttcaggccaggcgcagtggctcatacctgtaatcccaacattttgggaggctgaggcaggtggatcacttgaggtcaggagctcaagaccagcctggtcaacgtggtgaaaccctgtctctactaaaaatacaaaaaaattaacagggcctggtggcacatgcctgtagtcccgagaggtggaggttgaacctgggaggtggaggttgcagtgagccaagatcgtgccactgcactccagcctgggtgacagagagatactctggaaaaaaaaaaaaaagccataagttttccagagaaactaactgccttgtttctcgtttctctctaaaggtaattcttgaatcctttcctctttagcattgctgctgattgtgttctttgctcaaataatagctaataaacttcaaagaacatttgtatttgttttgagggatgctctgttatgttgatatttacagagttaaacactgcagatggggagttttccctaagaagattccaaagcattatgattttgtggttttgatccaaaatatatacatgttttatggcctaagggggttgtcaaacagtgttttaaaaaacactggcaaatttaagatgcctttaaaagtaggacagcttggggatccagaagggccccacacctacatttcccagtggctgtgtagaaacaagtcttgctgggctggcctattgctggctctggtggggtctccaagctaaaggagtagtcctcattaactttttccctcttatccactatccctgcccacctaggcaggttactaaactctcctggagagcttaataaatactttcatcttcacaggacctgacaactccattttcctcaaaatgatacataagacttaagacactggccaaggggatcagatgcccagccaagaggaactgaaccattttgttaagttctgtcaatgagtactttgcctgaatgagcatagaagctctttgggcatggccaactagtccctgcactgacccagtcattatgatggctagctatgtgatttataattagattcattttattcaaataaattcctagccagtatggtttcccagaagtccatctcaagagttgtcatcttaactctaagtgactcagggctttccccctgtaaactctccagccccagattctagtttgctgaagcactcctaaattcagtcactgccatgtggttgtttgttctttgcaaatattatagttagctcagctgggtatatcccctggttaaatgaagccaaagtcatgactttgatgactgctagtgccagtcagcttacttctcatccagagatctagacttttccctccatcttggccagccaaccttcttagtaatctatgccatcaatggcaaagaagactagatcaaatggtgagctggctttgcttacatctctttgctttatgctccacagctctagacaaagtgttaatttccaagtgaaatattatttgggaacaatcagggtaagggagcagaaatctttagaaatatattttctctatctctcctcctttcatattatctttcctttttttctaaattctagcctccttttgtctcttatcaaaatagaattctcaaccaggcatggtggctcacacctgtaatcccaacactttgggaggccaaggcgggcggatcacttgaggacaggggttcaagaccagtctggccaatatggcgaaagcctgtctttactaaaaatacaaaaactagccaggtgtggtggcacacacttgcaatcccagctactcaggaggctgaggcacgagaacctcttgaacccaggacatagaggttgcagtgagccgagatcatgccactgcactctatcctgggcaacacagtgagaatctgtcaaaaaaaaaaaaaaaaagaaattctcttgatctgtcctgcaaattctgacagtacctatttatacaatccttatgggactcccaggaatagaatatcattttacagatgaggaaactgagtcccagaatggaaaaaaacaaccacatgctcatgtattttaatgaggtccccaagacttttttagaaggtaaatcttagattgcacgcaagttcaaacatttataatgccttctctgaactttctcctatgggcaaagaaaaaggttggaaagtttttgagaatgagcatggctgtaacataatcaaaagagtgaagaagttaaagctgaccttagtgagaagcttgcatgaaagaggactgctggagtagcccaagcatgtaccaataataacttcagaatagctggtactaattagagcgtaaagaatgtggcagaacacaaagaattaatatatttgactttgtgtactcttagggcagtggaaggctccaagatagtattcaaattttgtaactaggaaatttgacagaaataagaaagtcagaagaaaccgctgctttggaggcagggatatctgagagagtgtgaagaataagtaaggacacaaacaataataaaacctgcccagtctaggaactccagctcaattacaaagttggtgattaactgacaggaaacataccattagccagagaaccatgactgtgtttcttttaagcactgacttacaattgattgcatggcctgtatccctgtgagcctgaaaaatcctgggcatcttcaggtatttacacaacaatgtgttctagagccctccctgccatggagtaacacatagaaaaatgtatgattccaactttcctggacaactgcacatgttggaataatttcagtcactgatggggggaagaaataagagtgcgaacttagaatccagactagttaagtgtttttcttcatgaacatgtgcgtctctgagcctcaatttcctcacctggttatttgggataactatgtactctttaagattggaagaattaaacgtgataatgtgtatacattgttagctctgtactcagcccaaagtagacaataaatgttcatttctatccttgaccccgccttgacagcccaagggaaaatagttcaatttaaaacctgagggatgagagtaaaaacattatacatcacaatacaagaaaaccacaaatctcttagtcaaaaaatgatttaaatttggcattcagctataatccctcagagatgggagtaaccatctatagcctaagattctcaggctaatagaagatggatgtgagagctcggaatcttcgtttcccactatctcaatcagatgatctgttcagtgatacgtattttaaggtgagtcttaatgaatgaaaggtttgtgggatggaagtgaggctttgtggtggagggcaaccagagtaaatcatgagagatggaaaatgctggagaaggctgtgccttgcatgagaatttgtgtgagtaagcagggtgaaccaagccaaaggctttggagcctgcgtagattagagtgggcctcagtgccaaatgggagtcccagctagatttgaggaggaagatatgctttaacacacaaacttgtttgtgggctctctcactcctccatgcaaaggtactgaaggaaaggagaagagcccttaaggaagtcacagatgtgttgtaggcaaagtgcaagggatatatccatcatgacattcctattggattttaacttttagtctatatcaaaatgaatctttattcagaaaatgccacagaaactttgttttacattaatattgaaagttaaaagaagacaagtattgtggtcatggtcaagtttgggatctatcattggggcaaaccattttgtctttctgggcttcagtttcttattggcacaatgaagagattgggaccatcactaattctggctctcatatttgagaattctgagaaacttggaagaactctggccaccacaaacagcctgacttctctgcagctcacacaagattcagccactctttctggaacccaaggccttgacattagcctataacccgcctccataatgccaaattcactctcatatccccattggaaaaaactcaattgaaagtaaacaactaatcaaagtgagttgatcttgggggtgttttacgtgggtttctttagtatggtggatggcacatgaaaatacttatttatcttgtgagttttgaaccccattttgggtgtttcccaagcagattttaaaccacagtattaagtcaaaaagaacttgtcttccgcaagagaacagcatgttctctgttgtcctcaggactgtatctttggctcctctgtaccctctaggcaagagtttgcccttaatattacctttgacagccctccaatggtattaggatcaaggagtctcagcactcctggaggcacagcaggcagaataagctacagtcctttgcactcagatccagacacttttcatctttggcatacattcacccccacttccttcccccttttccttctcactggtaaccatcattcatacctcacacccagaactcagaaatgttaagaggtttatcttggccttgctttttaaaaattgagaatgctgaagaatgttcccagataagtgacttgcctgatgagaagccttttgcttagtggaacctaaacacatactttctgagctcaagtctcacttcagtcagttcactttacaagtccataggcacaggccacaatgtgaactactctgcacagaagttcagggtatggatgctcaatataaaatatactcacttctgggaatctcttcaaagttcatcttctgctggagaaggggcagcagggtgggtggtcatcttcttctttgtagtcactaggttccatgtggaataaatgggacctgggaagaagatgtactgtggctgactggtagcactccttcctccaacccataagtgaagcccccttttaatcatgcataaggccttccccccactgccacccaactagggctggcaagtgcattctctggttgtgatctatggtcagctctctgccccgggtatctataaagtgcttactaacatccatgtcactcactacttgctctctaggagacgcagtcacaagatcagagctggaaattacggatttcaaagggattaagatgccgaatgaggaaatgtcatgtaagaaaccctattcatgggcatgattaatcctctcatggcatctgttaagagctcaacagtccatggagaaactttgagatgactcctgccctctgtgagtttgcatcgcaggcagtctatcccagaacaattatttagataccaaacagaaacatgaaggaactacacacaatcattgtagcatccccttcaatccaaaccccagttgctttctgttatttttattttttttattttttatatcagatattgtgtgggtgaggatcagaggcttgcctattctgctcttcccagatgttaagtaaatctactccagatggtcttctaaatttcctttcagctgacaatgcaaagcaagtttactttcactcaatgaaactgacatatctatttgggcatgttttcttagctcacagagaggagaatggagctacataattcaccaacagggagacaaagttcaaataaggaacaagatgaaagagaaaaatggaaaaggcaggattacatgcattgccagcttcagagccaaggttacacttgactagtagtcagtagctgcctcctggagtgagctattggagtacttggaatgcctcaagtaagatattggggtacctgttagctcaagttgccaaacaatacttgatcaatcacttacggctgtctacaatttgcccctgtattgtaagtctttggttctaatattaaaacatacatccttcatgaaggaggtcacagttgaagctgttatcagtcatggacagtctagtataagagtttcgtttggattgagagacaatttgtattgggagagaagaaaaagcacaaacaactgggaaactggggtcaccttctgttcaatgattccacaaattagccaagtactcatcctaataatgcagctgcaaggagaagaagatttgcagagggtcagctcttaattaaaggaaaatttaaacaaatacaattataaggaatggaagtctcagggaaatattaatttgctaacggtaaattaaggattgaatgtcggtgaatatttgtctttaccttgttccataaaattcacagactgacatccatatgcaaatataaaggggttcttgatcttcccatatcaaactcttcacacacagaacagtttctgtattagcgtctcaaatttagacaatcactatattgattttgatggaaaataaaagggtttaaatcaagttaaaacaaaaacaaacaacaaaacaacaaaatgtggattcaaatgtgctatagaagtctttccatgaattatttttaaatgaaagtatactttgtaatatgaatagtaatagcctgaagtactggctctgagttcagatttttgtatatcaggtttctgagatatgggaaaacataccatgaaataactaaattgagctcatcatctttctctttcctctgcctctattttttctttacttctgtctcagaaaccaccttcacactccatatctagcttctccattgctttacttggccacaatatgcaagggaaatttattggaaattccatggagaccaaagacattgcaagaaatggaaagagtggttggcataagtttggatttaaagcccatgtgagcactagaataagagtagaagagcaaattttggtcaggcacagtggctcacacctgtaatcccagcattttgggaagccaaggcaggtggattgcttgagcccaagagtttcagaccagcctgggcaacatagcaagaccccatctctaaaaaaaaaaaaaaaaagcaaattttattcgtcattcacgtgattttttgatgaaaaagaatattaatttcattaaaatgtcaaacttttattcatgacaatgtatcataaatattaaaagtaaaatacactggattaaatatatggcatatgtcaagatacttaatgtcaatatataaaggctcttataaatcaataataaagacattaacatcactaaaaagttggacaaaggaaataaacaggcagtactcgaaatgatgaataaacatggacaaaaaaataaaaaagtcactagctttactaataaagaaatgctaacaaaaaaagagaatcctctttattcacctaccaaatgggcaaatatattgttcagtgctggcaaggggacagagagacaagtactctcataacctgctaatgggaacacaaagtgggacaacctttctggagggcaatctggcagtatgtatcaagagccttaaacatgtccgtaaatgtttggcccagtattcctactttgagatattaattctatgaaaataattagagatgctgtatgagtgttgtcagcacggcattattcataataaggagagattggaaaacactgaaatgttcatgttgcagaatagttaaataagttatagtatgtctaaaggttggaatactatgtcatcattaaaactcatgtttgaaaatgtctaataacaagaaaatgttcatgatataatgctagattttttaaaggcaagacacaaatacagtcatgcgccacataatggcattttagtcaatgacagactccatatatgacagtggtcccataaaattataatactatacttttactgtgtcttttctatgattagatatgcttagatacacaaatatttaacactgtgctacagttgcctactgtattagttcgttttcatgctgctgataaagacatacccaaaactgggaacaaaaaaaggtttaattggacttacagtcccacatggctggggaggcctcagaattatggcgggaggcaaaaggcacttcttacatggtggcggcaagaaaaaatgaggaggaagcaaaagcagaaacctctgataaacccatcagatctcttgagacttattcactatcatgagaataggatgagaaaaaccagcccccatgatctaattaactcccctgggcccctcccacaacacagggaaattctaggagatacaatttaagttgagatttgggtggggacacagccaaaccatatcattctgccctggcctctccaaatctcatgtcctcacatttcaaaaccaatcatgccttcccaacagtcccccaaagtcttaactcatttcagcattaatccaaaagtccacagtccaaagtctcatctgagacaaggcaaatcccttccacctatgagcctgtaaaatcaaaagcaagctagttgcttcttagatacaatggaggtacaggtattttgtaaatacagccattccaaatgagagtgatttgccaaaacaaaggggttacagggcccatgtaagtccaaaatccaacagggtagtcaaattttaaagctccaaaatgatctcctttgactccaggtcacactgatgcaagaggtgggttcccatggtcgtgggcagctccacccctgtggctttgcagggtacagccttcctcccagctgctttcatgggctagtgttgagtgtctgcggcttttccaggtgcacggtgcaagctgtcagtggatctaccattctgggatctggaggatggtgcttctcttctcacagctccattaggcagtgccccagtagggactctgtgtaggggctctgaccccacatttcccttccgcattgccctggcagaggttctccatgagggtcccacccctgcagcaaacttttgcctgggcatccaggcatttccatacatcttctgaaatccaggcagaggtttccaaaccccaattcttgacttctgtgctgccacaggctcaacaccacatggaagccgccaaggcttggggcttccaccctctgaagctgcagcctgagctctacgttggcccctttcagccatggctggagcagctgggacacaaggcaccaagtccctgggctgcacacagcacggggaccctgggcctggcccacaaaaccactttttcttcctaggtctctgggcctgtgatgggaggggctgctgtgaaggtctctgacatggcctggagacattttccccccatggtcttggggattaacgttaggctccttgctatttatgcaaatttctgcagcccggttgaatttctcctcaacaaatgtttttttcttgtctactgcatcgtcaggctgcaaattttctgaactttaatgctctgtttccctttaaagatggagtgcttttaacagcacccaagttttaaatgctttgctgcttagaaatttcttctgccagataccctaaatcatctctctcaagttcaaagttccacagatctctagggcaagggcaaaatgccaccagtctctttgctaaaacataacaagagtcacctttgctccagttcccaacaagttcctcatctccatgtgagaccacctcagcctggaccttattgttcatatcactatcagcatttttgtcaaagcaattcgacaagtctctaggaggttccaaactttcccacattttcctgtcttcttctgagccctccaaactgttccaacctctgtctgttacccagtttgaaagtcgcttccacatttttgggtatcttttcagcaacgccccactctactggtaccaatttactgtattagttcattttcacactgctgataaagacatacccgaaagtgggaacaaaaagacgtttaatatggacgtacagttccacatggctggggaagcctcggaatcatggcaggaagcaaaaggcacttcttacatggcagcggcaaggaaaaatgaggaggaagcaaaagcagaaacccctgataaacccatcagatcttgtgaaacttattcactatcacaggaatagcacatgaaagcccaacccccgtgattcaattacctccccctgggccactccaacaacacaggggaattctgggagatacaattcaaattgaggtttgggtggggatacagccaaaccatatcacctacagtattcagtacagtaacatgctgtacagttttgtatcctaggagcaatacgctatgccatatagcctaagtgtgtaggaggctattccatgtaggtttgtggaatacactctatgatgtttgcacaatgacaaagtcacctaacaacgcatttctcagaacgtatccccatcattaagtgatcaatgactgcattacaatccattttgctaaaataaaaagtgtgaagtctatttatataaaacagaatgtaaagagggataaagtcacctatactttttcttttaatttttgtactttctgtgtttttccaaatgtccaaactgagcatattaattttatacttagagagaaacacccagatgctacctcagaaaaggaaagatatttgtaaagtgctttgagtacatctgggtttgcttcccacatactgtactcaaggtttccagattcttcatctaccacaggaagaagcaatttgtaaacctggcctgagccctcccttcttgcctctgtgtctttatttgctgatgtctaggtagtatatggcccttcttgaaacatgcctttctcacccagaacctttctgctggtcatgaagaacacctcaggaaaaaaaaaaaaaaaaaggcctgctttaatatgccacatttgtattgggtagcccttagaataggtcagtgattctccactctggctgtacatgagaatcccccagggagattaaaataaaacaaaacaaagcccaggaatcactttgagaaatcattattttattgctccagagtaagccttggccatccatttttcatacttcctagggtaactgtaatgtgcaaccagcattgaaagccacagaggtaggtgaagacacagaaaaggaaagaaagaaatggttttttcagctgatttcagttgagtaacatagacaggaatggacactaaccttctgtggacctgtctcaccattgtcttcccactccactggcccctgagataccccatatctacaagctgttcatttgttaaactccgtaagatcatcaagcacatcaccaactttcaaattcatcatctgaatgaccccataagatgggcagactcaaaaacaatgttaacattctcttttgttttccttccaaactcattcatgttaaggtcactgctaaaatgtacgtgtgttcgctgaaaggataacatgttatgccattagctatttttacgctggcacctggaaaagggaagggtgctgagggaattgagcacaggataggaaagttttaatatggggaaagaggaagaaaaagactgggattggtagtgataggcctactcaaggtactggggagacagggaagcgaacatcaggatgttgtgtgacatcaaaaagagaagagaaaaggacatgaggaattaagttctgtccacaccaaaatgttgctaagcgtcatcttaaaatgagagctataaagtaagttggacatgatgcacttgaaagaccactaaattggaagccaagagacttgcttacagggtcaatactagggcaaggtaagtgcggctgcacttgtgcaaccctcagaaagtgccttcttgaatatttaccctaggtgcttcacctgcctcaccttagctccagctctgcttgcttagattccagtctcgcttcagattctaaactgtgtgatatttggcaagtcacttcccctgtctaagcaccacctctcaaacccgagaagctccacttttacctgtctaagctattgggcttccataaaaatttcatttgaaaagagttacacagctttaaaaattgtatcctacttctctgagtcatctgtaagagtactagcctgtaatactgtggttctgtgtctaataattgtaagctacaggagttttcatgggccacttaaagcctctctttatcaacctgaaaatattgacaaggtaatttctagcacaggccactggaaaagtattgaattaccctctgggaaagaccaacttgcctctctatagaacatttcgagagggccagtaaacctttttggggctttatggcaaaccctctgagaatcacagccaggcacaaattgctataaatgtcaacactcatgagaagcctgttcatcaatatcagcaacttccatcatttgggggactgttaaaagaccccgtcagaagtacaaatgctgtggctctgagagatctggtgcagattcacagctgacagcaggtggtgatagtccctgctggaagatgcacaacaggaacaaaattatcctcaactatattttcttgggtatctttattatgaacttccatatgtcaatatcctacttattgttcttctgtgttttcagatgaaatactaaatgtgttcagcatggagcgggttttcacttgtttatacatttaacaaaatcctggccttctttcccctgtgaaaatgattttgacaattgtatatttgagaactttttgtatctgatgctatccctgtcatgagatcaacctcatagtcacagatgaatcccccagaaataaactgaaatagagattcacatgcaagaagtttattggctggtactctcattgtcagcaattgtgggaagaagagaaggatgcaggtgagggcacaaagagaaaatgagctatggtgcagtcataacaaaccctcagctcccttccgggagctctgaagctaggatgacttgcccttagagttacctcgctgggggtatgagggttgtgcctttctatcctggggcaatcggtcattggatgcaggataccccaggaaagggtcataaccttaagctgcaacttttccaacaactgaaggaataagttctatggtgctgaaggaggatctgggtggtacagcacagcatccaccacactaccctttgccaagattatcacaccttatttgccaagagtagcccaaccaccactccagtaggattaaattggtcatagctgcagcccagttcttcatccataatttccttcccactccttgccacaaactgcattatattggtaaaatgcagatgacaatctagcattcacccacttacctatatggtaactaccattctttaaaatgaggaagaagaggaaagtggatagcgacagcagtctggaatcagaatgagagaatttgctgctcaagtaaaagtagtttttagtgttgcaaaattgggcacgttaaagctcacagagagtggatgacaattctgaagctgctaaaacagcaggcttatttttacaaagccaagggtttgttacgtacctctgctcctacaagcaccaatgcctgtttttttctctgcctcctgtgtcaaatttttctctttttttttctccctcaagcgcatatttactctctttggtcagcttcatcaggaaacagtcaaactacaataaattaggtatgaaaacaaataaaagcttttcttgggctgctcagtgacaggtacggagctgaggtgaccattccccccagggttctatagtacacagccacatgcttaagcaaacacagagaaattctgcatggtaaaagacactgcagtattcagccacggttctgacttgctcaaaaaatgtgagcaaggcttatagcccaggaagcttcagacatgccctcattaaaaagcagtgtgctttttctacttaatttttgaataggtaatacattcacatggttcaaagaacaaaagtataaaaagatttgtaagtcagtgtttagtaaaatgcctctcatttgtggcagtatgcagcctacaaaggagctctcatctatcatctatgtcttccagaagcctatgttctgagaggacagcatgagttgtacttctttttaatctttattgtttttgtacttacagaaaataatacctgcttcttgtaaaagggccaaattttacataactaaatgacagtgaaaataaaagttcttggtaatcctacatctcagagataacagccaattccttcagattttttccacacatatagaaacatatagtttctttacaaaatagaattataacataaatgccattttacagcttgttttttctattattacctattatccaatatattatatatactgtacaaatcttttcttgttagtatatatagattgagctgtcttttaaacaatagcatagtattctatgcgtatttactataatttctttatgcagttttattttaaaattttaaatgtctgtgacataattctttaaacccatttctccattgcttataattaatttaccatgaacttaaatctactcatttctggagaagttaatgagaagtcagtaaaggaagtttcatggacaaagaagataattcagaaaggtctgcaggtgtagacagatgtgcctgttaagtggacagacaagtgtggctgcctggagtactgaataagtgagtgaggccattttccagatttgaatgaatttgaaaataagggagaagtggggactggaatggggtgagggattaaacaaagggagataaaagcaaattggaatggaagaaatcttgatacacggatggtgagtctttccagacgaaagatttttatggagagaactgacacgttttagttgaatccaagcttgatactaattaacaatataatttgggtatttaaaaatattggcaaaggctgctaaaataacaacccacgtcaaagcaagcaataatctcattgtcgtccacactgatcagatcacactggaattatcaggatcaataaaatattgacagatatccataggagagagcaacagtgagggaacttgtcatcatgccataaaagtaacggtggaaggactgggacgtctttagcctgaggaaaagaatgttaaagggaaacatgctaactgccttcaaaaatgtgaaggactaacacatgcaaaaggagttaaatttgctctgtgtcatcccaaatggtggaataagaccaatgagtagagattacgagaaggcttattttgattcaacacatgaacagctgtattctgctaaagggcctttaaaaaagtttactttaaatatattaaagactctgtccactttcattaacattattatttagccaatgttttcttcataaatagtacaaaagtaaaattcaactcagtccttgatgaagtttcataaattcttaattagtgagattcaaaataatgaggctttatcgtacactgcttgagaaagattttcaattgccttaatctctttcttcctatgtttatttctcaatcccatgccttggcctaccatgtcccctcaactcccactgaagcagagagcacatcaacaacccacacgaaaatgtaaatctgagaaataaatatgcgtggttggtttaaaaagagaaagaattaacatttaaagcaatggtaatttactctgatctgtaattttgagctcctgtgctgaaattgctcatttggaaattaccaagtgcttgggtctcatttgtgatcttcttcctgcatacacccagcacacaaaggagtcataatgaccggctgagtcactgctgccatctccctgaagcgtgctcttcaaatgtcaataccattttctatggtacaatgaagaaaattccgaattgtagcctgcttacactaaagggtgagcccgaaacagcacagaacctggaatatgctcaaagggcatcgcaatcctctcccattctcttctcctccagtcatcaaattgctatggcatggatcattttggctttgcaaatcatccctatcacccactcccattagtcattacttgaatataaatgaaaaactatttaggtttatgggaagaaatgagctgcttttggcaatatcccaataaaattatatctatagttgaagttatattcagatatggattcaaaccagaagcgaaactatagacacaatgtaatattagagacatgaagactctaaaagaccagcatgtagaaaactcttgtgctattcttatggatcatacttcagatattttgttcttcccaacttcttaaaccctaactccaaaaaggttacccaaaactcaagcatcagatcttttctctttttctcattcaatatagatccagggtaatggtagctaacagttatctaatgtaaattagataaaaaggaaccaggaattcctggtaaatttaattgagaaagggaaagaactcaggaaagcttaatatgactgaactttttaataatgtggtgatcaagagctcacgagtatgatatctttgttatagattgtctttttcaggttttcataaaattattttacttgggagacataatttaccttgttggatagtctttctatgtaaggagaagccatattataatgaggcgctatctctactgaagttatttctaatttgccacaatgcttatatagaagatgaaataaatgagcttcaactgcagtaaggaaattgcaggcagttgtaagaagttcttgattttattccatagatattttgagagtgcatgtcaataaaaacaattagataatataattcagctgtgagctctcatgtagccacttgatgcggggtgcccaaaagttgtagaatcttctttcctttgcaacaaaatgaaagtgcaaactgtctggagggttaaggctgaggttatgagtaagcctgctttccataatggataaggttcaaaggcacctgatggactgtgactagaaattcagtagaatctttaatacctacagaaagatttttaaatcattgaagctgtttttccttccttcaggattttccatcctccaagcgattatggaagcagcagtgcaaaacaactggcaagtaacagcaaggtctgtgggaaacataaaggacgtccaagaattcaggcgcatcattgaagaaatggacaggaggcaggaaaagcgatacttgattgactgcgaagtcgaaaggattaacacaattttggaacaggtacgtttgagatttatttcaccgccagccaacatgttaaattatcaacctaagtcagctcccatatctgctaataaattaagtagccaacagactaaacgtgccaacagtttttgatagtctctctaatccttttttcctccccagtggctgcagaaaaaaaaaaaaaaaaagaaagaaagaaaagagaagaaaatctaagctgttgaaaattgcatgccatgattaatctggaagtatttgcaatttaatgctacctatcagataaacatatccctccacacctctgtttcatagacaactgactttcaaagtaatccccttcctttcccataccttcttcccaacagggaacagacaagggactaagcagtgcagatggaaagggtttttgtttcaggagcctcattgctggaatatgtactatttccagacccttctaaagatcaccacccattcttgatgactatggatagacagactgtcaggacagtactcaccaagttttgaatttgtctacatttttgcagattatccctctggatcagagagagagagagagaacaatttaagaccattttttcccattttataactttttaattcattcactccacaaatattcatttaagacccattacatgctgacaatgtgggcaacaagttatcactgtcccataatttctcaaaggagaaataagatcttgtattactttaaaataacaattttttttgagacagagcaagactctgtctcaaaaaaaaaattatgtgaaaccccatctctgttagaaatacaaaaattaactgggcgtggtggcgggtgcctgtgatcccagctactcaggagactgaggcacgagaatcgcttgaacccgggaggcagaggttgcagtgagctatgaccgcaccactgcactccagcctgggcaacagagcaagaccatttttaaataagaagtggcatatgagaaaaatgtttatgcttttaaaaatagaattcaatgggccaaaatatattcattattaagcttggatatttaaatttaagactaaaaaatattagaagaaatgtttcaccctaaaccagatctgttcagggtagagtcaagctgaaatgtgaagaaagtttatcactttccttagaagtttcaatttgccagttaataacaatgtgcccacgctgccataaacaaaaatgtaagggaaacatttccattctaatttaatcccagtgtacctaggggccaaaacagcttcagagattgaaattatagtgagcagctattgcctgggagagctgttttatagcaaattaaatattaataatttgtcagatatgcccccataagaagagaaatgcaaacaaaaataggtgacaaaaggaaagagaagggaagagacggaaggaagggaggaaaggacaaagggagaaaaggaaggagggaaactgctgactctatatcgtagaaatacaaagtgtccccttgttaagatcggcattaccctctagtgaatcatacttcacagaaaatctacagcactagcctggttaaatcaagtttctcaactaacattctcttgagctacacaaatgatctacctgccccttcccccccacaaaaaaaaaaataccttcctttgattttcttagatcttgaaagtgaagaatcaggtcagtgatgttggtgtatgtactacatgccctctaaaattttataccaaaatagccttttagtgggtgacctacttaatagcccaaagcagaagaacatcctccttgtcatactttgtttttcttcttttgtattagtgactttggcttcttagatatcttatattctgttaaagtcttttggattttatagaactttatactgcagtctgggatttttcagcattatgtaatagaaaagtagtgggtagagctctgaattctatataattgtgggaccttgggcacttaaatatctatgcctcagttttctcatctacataatggagaaaataaaattttctctacatcacatggttggtataattgctttaaaaagcgtaaaatgctacagaaaaaacaatcattattactagacactttcagaaaaactaaactagtatcattcaaaaactctattctcttttcatgtcatacttctccatcttcctttcttctatacgcacattcacagtatcctttaaaacactttctatacaatttttcaggaaacattgttcaaagaaaagttttagcaacatctaggtaaggatagagagttactttcatttattctttttccctctttcaaaaaattgtcataaaaccatcaactcatgattgttttctctgccatttaaggtgttcttactaggccataaattctatgagggaaggactagatttatcttgttcactattatatctccagtgtccaacagagtaactggcacatagtgttggatgaatgaatggatagatggataatgaacaagaacatttcagaagttccactgcaattttgctgtatttccatccagaggcaaaaaagtacctacagttacatgatgtgattattattaaagtacacattttctcaaaggtgtggctttctgcttaagcttattccaatgatccagtgaatttgccgtaatttattttacgaaaataaattttcattaaacaaatgatctaaattaagcaacaacttcaacatgatatttatttatagaaaacattttttaaagacatcaaatgctaaaatacagagatatctatcacctttctcattggttcctaaccagtcttttgataaatttatcatacttcactatacagatcctgattggaatgatagcatttataatccaatcagtattaagttctccctagagatgctcccatcctccaagagtgtattcagctctgtttgagatcatttttatggaaggaaacttctacagtctcccacaaaatgatatttcataccactatctgaggtagaagagcctgttacaccactataacactgtttcctatagatcagattttggcataaattaagtttatattgtactctatatccaatgagtgttaataaaaatgcctcaatgtggtgcaattttaaaatataagcaggtcttcaacatagtgttatatagcataacctcctcatgtcatgatataagttctggttttccctgtgaatattcaaatacataaggtaaatcaaaattctttcaatattttttccccaaacctctttttctttttaactgtttcaacccttgagattacattaggggaaaaattcaattaggtatcaatctgtctttcacatctccatttaatagttaatctaccagagaagcattctaaacttatagatataagaattaacatagaaaaggacagcactagagagagatgaaaccatgaagggttggtagggcacatagagaatatttagagatggtatatcctgaattcaagaattaagagcactttccataagaaggtttaggtgaacaagggtgaatgaaccattggcctgacccaatatagcattcctattactgtgttgtgcttatgaagctctcctcactggtggacagctgccttactcaattcaatgaccaatctaaacattaatttttgaaaaggttgcctctctgggagttatctattctgaagagatcctccaccacagtaatatataccttatggctttgttgcacctttaatgtctattcagagacgcagcataacagcgtttcagagcatggactctggagccagtctgcatggattctgtcacttactatctttgtgacccaaggcaagttattcaattctctgtgcctccattttttcgtagtaaagtgagagtgataactgtactatgatgagttaatatatgcaaaccatttagaaaggtgcctgacacgtagtgtttatatagtgctttgatgccaaagcaaagtgttttcacatagataatctgatttgacacccactataggaggcaggcagagcagataggttttatcccaaatttacagatgataaattgaaacttggagacatttatatgacttgtttaaatgtaaccctctgctcaatcctagtaagtggcagagcaaggataaaactcaagtcttctgattcctcatacagttctcttgcccctacactgcactacctcttttaatttgtaagttactcattaaataaatatttagccaatgccaaaacttggatttggcctgcttatcaggttaaatcttaaaacagttgcaaaacaattagagaagatccaaagaagagcagcaaaaatatgattaaagtgttagaaaatggggcctgtgaggaaaggctaaatgagttgggattgtttagcctggtgaaagagagccaagaggtagtttaatcaccttctcaagtataaagagttatcattaaaagggcactgaccaactgttctgcatgcctaaggacagtaccagagcaaatgagcttaactagactagagagagagtcagtattagaaatgactcattataaaacagagaggaaatgaagacagtaaaatctcaccagttcaggctatatgaaggtgaagccatactgaattagtgaaaagtcagacctagatatgtcttaacattgttttcaagaatatacaaatattccaaattaatcctgtgtgttgacaagtaaatatccttatagaagacttatttaataaatagacttatttaataaatagtattttctaatttgtctattcattatatatctaaaaggctgtccccttaaaaagatttacacattcctccttcagtcttaaccatgtttctctttattccatagaaaatttacagacaagtctcagcatatcctctgcctaaattatagcatgtgctaatctagtggggcccaaaccaatatgtttcaatgttctacctaaaatattatataatgtataatttccccttgagatattccaggctaaaatcacttcatcatggatgatgtgaaggtagcatttcttaaggacagattcctgaagcaggtcaatccttcaggtagatttcatttcagaaaccccggctgtcactttgaatttggtagttttaagaaatgaaagtaagtcagtttcctaaataaaacagtgtaagcaagatgaacaacattaggggcccttctaaattatgagactgtaactcaaaggggagagtgctcacacttcaaaatatgtctagaaattgtggtcactagagcactgttgcctacagctggacctaggacaagtgaagcaaaaatgttatagctacatgcttgctccctgcctcaccctcactcagcagatagtggtactgcccagttcctctccactttgttggtccctttttattccagcccttactctcaatgttccatgtagaacattaagctcacttaccaatccaaaagacagtttgggttagcattctttctttttggaatattttgtttgccatatagttgagtaaacacaagcttgggactcaaatagacatgatttctaattttagctccctgatttccttgttgtgtgacaacaggggaggtgacaatttctttggggctcatttttctcagcttaaaagactgttccactaccttcctttcgtggttgttgtgaggatcaaataagattctatgtggaaagcacttggtacagtgcttggcactcagtaggtactcagtaactgataaccatagctatttgctcatgagtggtgagtttctgtgttcatgaaaatcagttatttgagaactattgctgaagaacaatgtccttgtggcttccccaaggtatcagttcaatctaaggtcatatcatgagagcaaagtctgagagttgggctatgctcaggtctcactaatataagtttagcatgttagaaaacctctctggttttttttttcctgtgatataacactgggtaacacatattgattgataagctcaagaacaatttgaggattaactagatttttcagcatcacctaaaataattaaaggcactaaaaccttgaaccaatatgctaactgggcatttttaataacaaatatatatgtattgaatgcttactatgtttcagatattattttaagcaatgtatgtgtatatatgtgtatgcttatatatctcatatgagttaatcctcatattatccctgtaggtagatggaaatattatttccattttacaaatgaggaaattgagacttagaagtcatgcaaccaataattggtagagatggaacttgaaccagggaagttgacaccaggtactgttaatcactgctctgactggcctcgcatctgacagaattttccaatcagaatagattcaaccggaagtcatcagacttcttgataccctcatatcttttgccttattccatagtattccctttcatcctatccgaagtctgaaaaagaagatggtcaggagccatggttaatataaattataaatttggagggacagggatacagaagtaaattactcaaatttttcttcctcttctccacaactactgccacaacttaccctgaagcactaagtctgatcagactcttcaatgctagagtttatctaaaacattttctatacttaggattctaaagttcttctagagacttgctttcagagacatggttgtaagcagagagttaaacagtcttccgccactaaatagtagtggctctatacttcacttaggtctctgtgtcctccatgacattcaaattttatggtgggttgggtactagatgacagacagtacagctatactggagccaccctaaagcaaatcaggatgtcatttctttaccagcctatgtctagtgtgggctggctgagaagtctttcagcatcttcaaaagacaaacacaagtaaaggatatgacagatgttattacctggatttcagaggtcaatctgaggtcatgcccccatgagagaaacaaggagtatacagaaagggatctcttggagtagatgagtaattgcttagctacctaagaaatcactgaatattcaggaggtaattcatatagaagaaggaaggcaaatgggatcagacctccagaatgggcattgaaatttacatggaaactgtcccagacaagagccagccaactgttgtgaggttaagcgtcacacaagggcttatattcagaatactatactaggcactattgggagaaacaaaagttctttctttcttttttaagtatttgtaatagcccttagcaatgcgattcaagtcagagagcagcatcttgacaaatgcaaaataatataacaaaaactaggtatgtaaatgctgatagaatgaaagatattagaaaagcctagaacttatttttgcatacgattgaatcaatcatgaaatgtaaggtgaaagtgttcttagtacctataatatctctccatcttcttctcccaagtgcatattaagtactatatgtaaaagaggagatcccattcctctttgctttccttgcttcccaatttcctaatggcgagcttccagagtagatcaatacatggccaaacaacccactggccttccttcatctcttactgtattttagtaggtggttcccttttttcccctgcctccagccattccaggtgtctctctgtaagttggttgccttattcttccttttcaaggacactttttgttacctaaccaatcatggtgtccaaatcgtggtcactatttcttaatctaatgacatggcaatttgatgctattacttaacacttattgggctacctgaattaatatcttgaagcaataatgcaacccaaactacagaatggtgtcccaaaagcaaaacctatggttggatttcttaaagatgttcattggaaacatggtttcttaagtctaacctagtatctttaggccctaagcaagcgagactctacttgtggtaaaagccttcaacaacatatgttaggtgactttgacactcactgacagccttaaataaacttgttctataaatgcaaagatatttatcctaggagttagtagcagacatcaatattctatatttaggaattttatcttcagcttattaaaaaagatggcacaattctctggtcatacctcacactagactggctagactggctttgtgactgtttagaagcaaatcccctctgggaaaataaagagaaaaaaaaaactttttcaataacattactttgaaacagcaagactcttgtttatttcagatgatagaagctttagggtcaaaaaggaaatgttctacttaatcaacagttccctcctcccattaaacaaaaatctgataaatgtttgattatttcttgtcaggtttggggggttttatttttaaaataaacacaaattcaaattaattttcattagggaactttttgagagtcgttgggatgactgaagacaccttggggttttgtaaagcagagtacagaagccttgaggcaggagagctggattctagccccaagctgtatgagttcaaaaaatcaatctctctacatctccatttcctgaactgtaaaatgaatctatggaatatgatggtcttttccagttccatcaggctatggttcccacagctgtgaaaaacaaggtaggaaatccagttcaagaaatattgattgattcccaacccattttgccacactcaatgctagggtgaggagaaaaggacatgtcttccctgctgaagaagcttgcaatctagtagggcgatatgtcaatgcaataattctagaagtcagaatataataaatatctaaaaatgtgtgaatcaactttcctgctttctcaggtttccaggctggtgaccatcattgatttcttagctgactgacactcttacacacctcaacatcagtgagctttgctgagacttggagacagagatgataggaagattgagataatgtatcttaaggccagggcacagcctggaagtttatcatttacctctatccttagaacacagaacaacaaacgtctgcattaaaaagagtttctggttgatcaaagctgtgccacatatgtatatataaataaatatggcctcagcccttctaggaaatacctagggaaaatccctattaattaagggcttctggtaattggattctgattaactgagatttgtttgtttatcataagcctatcataagttcctcattatatctatattcactgttatcctactactcagatccaacatatagtagattgcaatacagatgtattaaatcaaggccttttctcccaccctttaatgccgcattttagcattaaggctggtatcttattccaaaattataaaaatatggaccaattcaaatagaacaataaaactgatgcaaatatcctctttattttgagttaatcccatcacttaagtcaagtgagatctccaattcatactttaaaaaaaaggaaaggaaacactagccatatatagccatttcatccctccataggcagtgaatatgtttttagtgggcagaggaagaaagagccctaatacctcttacttcatatgacttacactgtgaacactcagttaagcctttgcagacactgagagattaagtcctatgagttagaattactagcttgtaaacattaatgaaatttttaaaatcatcatccagctttattaggaaattttcccagattaagagcaacaaaaatgtagcaattagagtgttcatcacacagctgcatgattacaggagtcttgttctagattctaacagatgctgtaacaaacagttttgtgagggctgcaagaaccatagtttacaaaagcaacacaaaagctagttattgttcaagctcacattgccacaggacccttatgtttaaaataatttacactcttgagctcctctactgagaggcatcaagcatgtaaatgagcaataacaaaaaataaaataaaatgtgcagactcaagttcttcactgcactaacatggaagggcaagggacattaattgatccgtacaaagttctggactttgatgagaccaaatgtgggaatcagccatggactagtttgatgtcattgttaccaagccaccacctggctcgtccagtcaaattaagctcatcctttcagggacagctttacttcagtccagatttggcaaggtcaaactatctctgctcaaaggttatgacaaattgacaagtgaggggcatcactcaatgggcccaggtgggggcttgaggagattggtgacaattagtgttacatcactaggggtggagccaaagtggaagagattcatagccagataccactattacatatatatatttagaaatatatattatatgtagcctcccaaatacaaaccaccaccaccctactctgaaaaagaatagcaactgatcaaatatttcctaaaggactccagtattaagccaacgactagcaatctggctgagttctatctatttcaagatcattgtgtgaccttgcacagccacctcacctttcatcatctcaggaacttcagccataaactataaaaatcctttcttgccttactgggatgacattaggatgaatcaggcaatttctctaaggtattctaagatcctcagagagggcaagtctacaaatacaaggtattataattagaatcactgcacctcatttcttaagggggagaaaatgaataaggaaaggaatgtgtggtcactgagcttgagactcaaaaggcatttaaaagctctttctatcatctgaggtaagtctcaagagagggaaactgatctggtggagtcagagaagagttcagtgaagaacctttgtgccacctgtgaaagtggctaggacatgctcccaggacattagaagccttcctgtttgtctttgacagtataacgttacttcactatgatcaccataaaggtttagatttgtgaataccaccaagagagtggcaagtgctttgattatgatgttgtaggccaaaaaggtcttgccttccgtagtgggattaattgttcataaaagaagaatagtatattcaagctcaagtggtttagctgaaattgttttcatgcctttaattatctcaatagcagaaatcatagctctaggtataactggataattagtggggacagagaaaggaagaatgggatccctttcagagttcagcattgggccagaatgcgcctgctgagcttaagaatggggacacagaaaaaggataactaggtgaacggatttgcaaatcagaacctggggattatgctatctaaaagacatacacatttgcgaggtaaataagagaaaaaccaaaatagagtgtgacctcagtaatactctgtcttggattaagagataaggatctagagacactgaaacaatggactaggtagccaacgagggtactgtagaaagcttcttagtgggcacttttaagtaccttgccatcactatcttttgaacagctctgagggtccttttcagtcctcttgacctatttcaaactactacttgtgcttaacttgaaaacttcctactcaacaaattgttcctcctgcttcctttgaccaacataaaatcaattgttgtttgacagaatactttgttgctgttttctcaaaggtgcaaaggggaaaaaaacaccttatttttgcacacattaacttaatttcagtcttacctactcaagcacaacataatccttcaaactctgaccgaagccccttcaccatttggtgtccatggcaaccgccaccaagccactcagagagttgcaagcagtggcagaaaagtgcatctcccaacagagccattagctcttctgcattaaccccatcaataaaaggtggcagcaggcccagccctgcattttctttcatcagggaggaggaatgttgtccgtgtttccttcccagattgtgagaattgggtgtggctacatctcacacccaacctgttgaaaataaagcattgagggtaaattactgcaactaagtcagagaacgattttcacttgagaaaacttcccactggtatgcttccccaacgactctgtcaactgcagcctccaccacaacactgcttgctaaactacagccagtaatcttaaaccccacaaagacaataaacatgaaatcctagccacttcctgctatggttcttagcactcagtgacctacaggtcatactctttgttacccatgtcaagaatgcatgcgtgacaatttcatgccatcaaactatattttatttatttatttatttattgagacagagtcttgctctgtagctcaggctggagtgcagtggtgtgatcttggctcactggaaccttcgcctcccgggttcaagcaattctcctgcctcagcctcccgagtagctgggattacaggcatgtgccaccacgccgggctaattttttgtatttttagtagagacggggttttaccatactggtcaggctagtgtcgaactcctgacctcgtgatccgcctgcctcggcctcccaaagtgctgggattacaggcgtgagccaccatgcctggccccatcaaactatattttttaatgaaaaagagcaatgttaataatggtctaggtactggaggatttatgagccaatagtaaatggtatggtttctccaaatatagacaaagctgttcagtctacaaactgtttttatgtgttccatattatttgctttgttcagagcttagcttaaaagttgtcagataggaatttccctttactgtactccagaggaagactaggatgtttcatggggatggttctgtcattacaacagaatccaacatatctaacagagatatttttgcataaagagaaccatctcagactaggttctttgtagaaactaaaaaggacctactactcaagtatcttcttcatagaatctacataaataggaataatatttagagtagaaggaacaagtgagtggttttatcttctcaaccgcatgaaaaagaaaacagaaggctattatgcacaatcctttccagtaggtcctctgaaatctaaggaaacaatttcaagctctccataaaaagcaagacatcatgactaatcacactgcctatctctgtagtcctggataaggactagtaaagaaaaagtgaaaaaccaataagacatagttccaggcctcaagaaactcatagttcatagggaagcagccaagtaaacagatgatcatagtctagtgtgataagagcagtggcagaggggaacacagatcttaatggaaatgtagaagaaacatcctaactcagcttgactcagatcaggaaggcctttctcctcaggattggttgaactaagtttccaaggacccattgaagatcatctggtttggaaagggatggaaatgtataattgcataagtatgacaatccccacttatgtgtcagcatgaacgctagtaagaagtgctgattcaaaaattgaaactgactcagatgtcataagacagaacagtaaaacctgatactaataagaatacgggttatactggccagaacacaacttgacctttcatcatgacctttggatcctcaagaaacagacattttccgtctgccagtacactaacatggtatctgaaatgagacgattctgcttaggcattaaaccacctcccttcattttacagtgaagaaactggggtgctgagagagactgacatacataatggccacacaactagtgagtgaaagagcaaggatttaaacacagattttactccagtgctcacactcttggtgccacaccacccaagactatgccattacatggaccaaataagcatctatatatgggttcacctgaataggtcacctgccttcttacccccatttcacatcccacccaactgtctgtaattagcatttagattaagatagcctattcacatgaaagcatactaaaccagagagataaaatttaaagttaatattacttcccacccttcttcccagtttttggagtcctttcctttctcattatccacaaacattaattgtatatctgcatacaggcaactgtactggatgatgtgcactctaagaagtatgaaactggagccctgtcctcaaagacatatcatttaattgggatggtaagacatgtgccctaagttgggtaaataattagtagactgagggaaagatgagaagtagagattatataggaattcacagggggaagtgcactagacaaatgaaccagaatataaggcttcatgagggcagggtgttttgtgttttgttaactgtcataccccttgcatctaaaacagcttggagcttagtaagtactaaataaatatttgttgaattaaataaatatgcttcttgacttgttttaggaaaaaagtcctgatgtttatcatttggagactaactctcagtcctatatgcattccactttgtggattttactcacggtacacacacagcaggagctctctagggagacttgtagaaatgactattcaccctatgatgacttaaacctttgcaaaaccctagcaaagctgtgttctctgctgctccctgccacggatgggtgtttcccagcgatgaaaaacaacagggagccagagctttttgtttgtttatttgttcattatgacctcaagctcttttcagcaaagggcacagaccttagatagcaatgcaattctgggaaatacaactccattatttgcttggctcatctaacaagatagaatgcagactctgatttaaaagcaagctcctttaatgagttttagttagggttgatggataaacagttgttattactgtcagtaggcacaggttgtaaatgtctgttttcaatgcttatattccattacagggaactcagatgggcatcagaatacaatttcctttaaaaggtggaattaaggggaaacaaaaaagcaatttcaaatgtggtcattttgtgtatccccagatggtcaaattcttggtcttccaaggctccacattgcgttatgattttttgtaacttatttcatttttaccattgtacaaattcttattacttttggcttcagggcttggaaagatacggacaattagaatgtatcagaacactgaaaggaaacccaagcattcattaaaaaaaaatgagtgaggctaaacccatccttctctcaccatggcttacactaacctcgcagcaccacagtctgtgccagcaggtaatttcaagtaaaagatctatattaacacaaatggagaaggatctgatttcataacaaacaatgctaaatttgtgtgctctctgatttcctccaaaagcttagaaagccaaaatcgtgttcagttctgtgggtgcatctaagaaattagaatatcacgtaccaccatacaggtattgtgctaaacatattgcccactataatcctttcactttctgagaggtgtagctcagaaggtacctggtttatcacggagtctaaagaaaaaatgagaggccacacctaaagcaggcttatactttaaaaacaaaaatgttttattaggaaactttcctgaactaaagcaagagtaaacactgccttgtagagctttccatatttttcaaagatttttcctgaagtagcttcttcatcctctgaagtagataggactaagagtgggtttttttttttcattacatagatgagaaacagacataagaaggttaaataacttgcctaagaccacatggttaaaagcactaaattttaatccttatttcctaaagacctagacctattttatgtaccacatctaaagggatgcatttggaaagacagcaatgaaattcttgttatacaacattaactatgcctgccccaatcagcgccccctgcttttgaaaggtatagctatagctaataacctttactttgggcttggacatttctctttaccccatccccactctatttcctgaaagaacaattaagatccatctgggactaattatagcgattcttgaatttgaactcgcagccattacccaattgaggtcacttattttaaattaacttgcctggtcagaacacaggtttggttatcttcagaacccagtgcagagaggtaccagctcactcagacttttaattaactagctaaataacctgcactgtgacaagctgcctatgatttgatggactcattcatttgcattcagacaaggatcaaaatacattgtcagagcttcagggactgagtcctagaaaccttcacagtctcttgttaaaggctgtgagccacttccctttggttcgctctagttatttttcctgtgcttttgttctgattatccaacattcatcacaagtgcagcttgtgattaaacaatgacaactcatgtcatatgctgatagggaatcgaaaattggagccatgatcatatgaaccaagcacaaagctttgcaaaataattaggggaaaccaaagggaattccctggatgcccagcaacaaaggagaatttccaaagtttcgggccacaactgttccccacttaggtaataatacataataatggtaggtactcagtctttttttaattgaattcatggtgggagctgaccatcccacaatagtagtgacagttgttatcatcaataattattattacagcttccaacatttagttcctgggttcttgagtcagataaatcagattttgacttcaagctctatcattttcagcctgtgaggcatgagacaaattatccaacctctctgtgcctcaatttccttacctggaatataaaatcaataacaatgcctaccttaaaggattgtggtgaagcttcaatgagatgaagtgtgtgaaaaaatcgtttaacaccatgcgttgtacataacaaaagctcagtacattttagctaacgtttgtcttgttacatcccaccaccaggtttttatccagggcatctttccacctgggatcctctcttctccctgccagcaacagttcccctcatcattcaaaacctagtctaaagatccttcttttttctccagtggaaagccttccctggttctatcccctgcatgtaaacttgttcagtgcccatcctttcagtacactttctgcaatacacttttcagattttctattattttaaataggccatcttctactgtttcataggcaatctggacttttcttcaggatgtactattgtttaagacttccagaatatttatatagataacatatacagagagagagaaagcaagagagagagagagaaagacagagagagagagagagagagagagattgagcatctcattcagagacagagagagagagagattgagattgaacatctcattccattgtccaggctggagtggcgcaatcatggctcactgtagccttgacctcctagtctcaagcgatcctccttcctatgcccggcaattttttttttttttttagagatagggtctcactatgttgcccaggctgtgaaacatttactgagaactactccagtgccacacactggggctgtatgctgtggagtacaagagatgagtagagatagggatgggagaatgggaagcagcattggttgaatccccttatattgcagttgttctgttaggaattttaaaagcattttctcatttaggtctcacaataaccctaaaagtaagtgtcctagttactcttaatgtacagatgtggaaactgaggttcagagaggtaaaacgacttgtgaaatatcacctcatcttggaagaggaagaactggtcgatctgactccagagtgcactcttatcattaactatgctttactgcccaactcacagttttgttttgttttatcacttgcagtgttgtatgtcaaagcaatacataaactttaaagtgttacatatgtgacataaggtgattgcagtgtagcagatgctgttggtgccctacccatatcccctcagcactaacctttcctatacctgccaaaagcatcctattgtaggcacatgctgttctcctcttgaagactttctctcagcctgggagtgagacaagtcagaagagtgagggaggaattaatatttcccaaagcagttataagctaatggtgaatgggagttgaaagtcaaagaccccaacttcctggcccttttggtaggtgtattgtccatcacctccagaggtcccagaggtaatttgctgattaatacactgttttgtcacctttcttctccctgtctcatttcctcgctcccctactagttcttcatagaatcacttccaattaaactactggccctcaaatctttgtctcagggtctgccttcaggagagtcctggttaaaacaacaatgtttcagaaattcttttttggctcctttcccaggagtctgggtgaatttcctcatgctgctccctgcctacccaggactcaccatgggtgatccctaagggaccacctcatagactcagtgtgtcccttcctatccactttgatgaggatcccatcattgagggtcctgcttttagattttcaaagtgcatttattatcagatggaaaggtggttcttaaatttcagtgtgcatcagaatcaccaaaggtgagatgttaaaatgcaggctccctggccctaacctagacttgagaattagagtccctggagaggagctcaggtgcttgcattttctagattccccaggtgatccacatagtgtacactttgagaaatactgtcctaagacatccatgtagacttggcctcaagggaatgtagattatgttccttagtgctatctctacctccaaggcctctgtggagtcaagtaagaaagcctggaatagttatgcttccctgctcctataatgaagcacgaataaggccaagagctagatgctactgtcagagtagggcagcccaagacgcctaggcaatgttctacaatgcggaggagatatgcatcttactgactgccaaattattgctctcacctctctcactgcccacccccaacccctattctcccctgtattggaaacactgtgatgactgcacatgcccagttaggttatgacctgtgctcctttgtctctgagtgggagccccccttcacaacacacacacacacacacacacacacacacacacacacacacacacacacacacacctccttcccaaacaaggctactgtagagtttgagttcatggttttgatcaatgctaggggcgggagaggatggcgcaggggaaggtggcagtgcgggttactttgttgtcagtttacccccagcttctcttctcttgtcctttttgcactctcagcataaacgcccaaactccaagtacaaacctcaactccttccctccatctccagcccagtgccatcctaaccagtggccccaatactcctctgcacctgagtaatgatgcctttccacggcccccatcccacagcagcaggaaacctcttctctaccttttgagcttggggaacaaaaatcagggaaggcttcttggaggaggttgcatatgacctgcgccttgagggattgatgtgatttctacagagagggatgaagggaagaggcattgaaataaggagtaaggaagggagagcataactaatataggataagcattgggcaatctgttaagaactatagatacattattttatttattcctcactgcaattctatgaaataggtactaatggtagacccattttacaaataatgatactgaaacccagaatatttaagttgattgcccaaagtcatacagcaaagtaggaattctaagccaggcagtctagcctgtactcttgactaccctactctactgcctctcgactattgtaatccttattttacagatagaaaactgaggttgagaggttaggtaacttgcctaaagttacacagcttataactggcaaagctgggatacattgtctttagcagataccattctatttactatctaatcattcataccctctgtaacttagcttttttcaccaatcatttcagtcaccactccaattcttatggagtcagccctggataccatcacaccaaatgcttatagttgctcccaataaaaatctttcccctagtgtgtaagcactgtaaaagagcaaggctcttctgaaatcaagagaaatagccctctaaaacacatctctcttcattttcaaaatagcattctgtttaagttacctgtttgtcaggttcccacttataaaagctacaggaaaaatttctctagatctttagttggagacaaagtactttctatctatagcaaattatgagttaatcattctctcctcagttgtaccttgtacatatttctgttcttgcacttctcccactgggttataattgtctgttaacttggctttctttcccactcgaatgtgagatcctccaggctaaggaccaggttactgtgacctctgtatctccatggtccagccccagaattggcacagagcaggcattcaaaaatgttcattaaaagaagagaataatgaaatgtggttaataaatgcagcccttccatccacttgagattttaatcaatattctttctgaatccagtggtatgctggaaaactggctcccagagagcaaaataaaaagccctgatttgtagtattgttcgatttttgtggtgttagtactctcatcatggctgatttcaagcaaccaatggtttaataactggctcacaaaatttctgaatatttaacaatgggctttcaagagccccctgtatttcgctgaaagtctataattctgcctagggtgcttgaactgttagcgtgtcagtgtgatcagaaaggtggatgagctggcagagtggggaaaataatgccagatgcaaatagcaggagcgaaagaccaaaccaaacatttgtgaattaagagaattctgtgtttgcctcccatgaactaagcctctatcatttgtcatccatttgcaaattgagatccacttaaatgacatggctcccagtagaaagagaaatctgccaagtaagcaactatcctgaaaaatcaaaggcccaaagaacacattaggtttctcagagatatttacttttattcgaaaatataaacatgttcactcacttctttcagcaatcagaaaatctccatagatgaggatatcaagtgctggaagcactgcacagatggaaaatgcatagacgaggcatacctagggagttcaaaaggagaacatcccaccctctacatccccatatgtttctcttccctccccactcggaggctccattgttctaggctggacttggtctctaatacaatatcctaccagccatgcttaaattttgcacacaataatggaactaataagtaaatggcaggatttaaatccagaaccatccgacttcgaggtttatgtctctttctagtacatcacctttaataaataccaatttgtttgcagctttaagggcaactcagataacatttataaagaattttagactcttacaagtttaaacactgtaaggtatcattttaggtgtgacgagttattgatcctaataaaaacctaaagatggagaggtgtgactcttgagccaatgaaggaagtcttgttttatcccacccaccctcaagtagctgtggctggaaataacacacatttgagtaactactcagccatatacccgatggtgccattccttaaaaaataaaaaatcaaagtaatgagttcactggcactctcaagcttgctactcagtacccatacagtgctttcagtatatctgtcagatattcatgattatattgctttgggcccaaatgattttgcaaagtctatagagaacacaaagatacaatttgatatttagaataagggtgtcaatattaaaaccaaacattgttgtgaatgtgaatatagaaatatataaatagttcacagtaaatttcacaaaagaagatatcaggaatgctgtaatttaaaatttactctctaaaataaatttcttgctaatttggggagatagctaatatcagagaagctacagaagtcataaacatggtcgtgttaaagaaaaactaatttccctttgctgtgatactctagattgaatactagttaaaaatcactccaattctgccttccaaaaaaaatctagaatatttccaaatataaacagggtgccatgaaaagtcctctagataaggtactccaagaacagcatttgaaaatgcaacatagcttgataaagcatcattttacaggatgctggctggtggaaagatccaggaatttaaagtatttactgttggacccatgaccaaggactctagctgatcaaagctgcaggcatcctgtgtgggaaaatacatgtaaattgcctcaggaaatggttttgtaagtttccagattttttacacagtcccaggcatcatttgctaccttccgaactctgtccatcattttgctcctttacaatactcaagaagatttgaaagtagatgaagatattcttaaaatttcaaccataaatgggaaactaacctttcatcaggacagggaaacctgatctacattctctcccctaaagatatgatggctttaaggcaatatttcccaccatccctggtggtacacaagaggattttcagtgacacctagatgaatacattctattttcatacagttgtatttattttcttgtattagtgtcattgatattatccctctggacatgactagatttaagtagtgactagctataaaggaaaaaattaagtaaataatagtcatgtgatatgcagataagacaaaaatcattaaggacgtttgtgaaggagtgaaatttgagaaatgctgttttaggattaagacaatgaagtgttcccacaaaggtcaacatgtatttaaatggctgtttatccccaataccaataataatctgttgctcctttaatttattcatggccatttattgcctcttatttgcgttggttctttgcctctcctgctgtttagcattaaatcttccatgtattccattgagtcatgatgaatgcaatgttaaagtctggaaagtgaaacttcccaaagacatgttctttggtgaaatccttgttctctaatcctcacatcctagcattttatttgatgccttattcaattgccttctctctgcataagcttccctgtagatagcataagcattgatgagattcctcggttatacttccgttttccttctttacaaaaagcttcagcctgtctttctccatctgtaccacccccacccccattaccattgggctgactttggtatgggtgattggctcttctctgcctcactaatccagcacatttattcaagtcagatgactgcaatatgaagcattgtcattcggtgataggagagcatgtgtgtgcagattaagattattagaaaataattctaacagaattgacttctggtatgtatttacgaagactcaggcaatttagtaccttgggggttttattcatgaagatgaatgccttttatcatatggaagatttcttctgtaaagtatggcatgttttaaggctgatttctgtagcacacctcttattcaacttccaacatagccaaatgtaaataggatgccataggacaacagtatctttttaaaaaaaaattaactaggagagcaggaaaaaatgaagggggctgaaaaatatcccctctttgaacataaagaatgtggtctaatagctttttcttaaagagaaagtattcatacaataaatgaagaaaacttggtgaattaaaccagcaatcccccacacccacacttctctcctagcccctcagacatttgcaggatgcctaaatcaaagagaaatagagtaaggtgagcatcaaggcatgttgttctgtactcaaagcaagatcaatctttatacatagatccttttttggcgctgatgtagaaaatccaaacaaggagatacttaggtctacaaataacctaatctgcataccagatggatctaagggggaaaaaaacatacacacttctccacacacatatttttttctaaaatgtgagcatagaaaaacagatgcttttgcctcccaacggatctgtgggcctctctcaagtagtcttgtggagcaatttcatttcaaatttctaaaattatgaaaatgtctagattaaacattaaattgaaaaggaaagggcctcttacatagaaaaccaaatgaatattttatgaattatttttaactgctcagtgatacccaacccccagtttcacagatgagtggatatggggagggggccagtaagaggaagtctccccagaatgggttgactatgattcactaacttctttgacaaataatttgatgctatatgcatcactctgtgtgttagtatgtaagagctctttcttctacgaatgaaactctactgataaagcttcagtgaataaggattgtggcatttttttctttcagatcctatatgtgaggattaaaataaatttccttaaaacaataaattttatctatatttcacacatttccccttattacatttaatatatctgctatcatatcaagccatccatcatctccaacaaatcttacaaaagcaaagtgaatacagaacatggatttggaaacttgctatttcttccttaaatttcatggtcgactgtaaaaacagcttttatacttgaagttctgcaactaattcagaaagagctattataattactgtaaaagcaaagttgaatattcttttggttaccagagtcattaagtaactgagggtacaatttatgccttgttcatctataacagatggaaagaacaaagatttagggtgagctgaacaagaaccactcccattaactagttccattatgcatcgcactaagtacaatcctcccatcccaccctattcccataagccctgtaccaaaaattcaaaaaagggaaagatcaagagcaaaacatgacactttttgtggtgagggctcctgtagctcacatcagtaggatcatagctgctccacgtaagtaagatttcaagataactgaaatttactgtcttaagtattgggactttgagcatttcttctggaaaccttccctaaaatatgcatatccctgggtttttcagcagagattactgaacacaataaaccatagcctgatgacttagggaacatccatgattatactgtgcactagtatgatgttgtctcgttttctcatcccttctttctcctttaagtcagtctgtcacttccactgctactaatgtacctctttctaatatcagtccctcccttcacacacaccctttctagtttgcagcttttaatttactgtgaactggaaaaccaagattggtaagaactatatgttaagtaagagttaaggcactgaaagcaaggatgaggaattaattatgggcttcaatacatcagctttgtgacactttaatgttcctatctttagataagcttcctatcccagtttaaagctaaattttgaaagggtgttgttataagacagctaccttcaaataagtaaatttgttctgagcagaccaaagtgggcctgaattaaagcagatatcttgatagctccaagtttttctgaacctgaaaaacaatgtctcaatgaatgaccccttcccacatttatatagcatcacacacttaaataatgcacatttcaaacattttttttttttgagatggagtttcactctcgttgcccaggctggagtgcaatggcacgatctcagctcactgcaacctccgcctcccgggttcaagtgattctcctgcctcagcctcccgagtagctgggattacaggcatctgccaccacgtctggctaattttgtatttttagtagagatggggtttctccatgttgttcaggctggtctcaaactcccaacctcaggtgatccgcctgcctcggcctcccaaagtgctgggattacaggcgtaagccaccgcacccagcctcaaacacttttggagacattatccagtttgatcccagcaacacttctgatataggcagggccagattatagataaggaaatgaaggctcagtaatttgcccacaaacaaacaattagtaaatgacaagactggggtcctgggttctcattcactgttcttttcacaacactgatgtcttctattgctccctctcatcttctctacacacaaaaaaacactaaactctgcctctgatgaaaaagacgtattccttttccttgggattccttccttattcccctctaagcattgccagatgtctttaagaatattgctcatttttctagcagaactcaaaaccctctggttttattatgttgagagttgtcagttaattaaaaattcaacaaatgtatggtcccaacttgccaccaaaagttaacaaatgtcaccggcaaggatgtttctcgcaagcggacactgaagaatacatcccagaagatacctaacagctcattttgtgtcatggaagcatgagaaatcacatcctcaagacatttattaacctttcatttcctctataaataatcagtcagaaatgtggctcataatttaaattaatcaaaaactgctctcttgtcctctctctctctctctcatacacacacacacacacacacacacacacacacacaaacacacacacacacacatacttaaaatgacttgttgaaatgacttgagggcttgtaatgccagcatcatagtcaaatgtatggttccacttctctgggtcaacttaaacattgcctcgtccatgaagccttccctgttcatatcaggccttaaatatctcttcttcctcttgtccaagactttatagcaattactagcatttgctatttagcatatatttagaaaccatgtgaagtactgccaagagtatgggttctagaggcaaatggacccagattccaatcccagctttaccgcttcctagctgtgtggccttggaaaaattacataaactctctctgactgaaattcctcatctgtaaaatgagactaatgatacttaatctgttaaactgttctggggattaaatacatataaagcacttagcaccgtgcctgcatatactaggcactcaaataaggacagttagacttattattattacaatctttcatgtatagttctggtttgatatatgtgcaattttgaggccttctcactttgttctaaaccctttaatagctgcatccagagagaaatttatcataaagcttaagcttaatggcccctcacttgcatagcttctttccaaggccttgttccaaattatgacattcataattttatatttttttaaagaaagatcctaaaattgcattagcttcaggccagtacaaaacctggttccacctctggttgtgtctttaacctctatgttatcctgttccgtccatgggtactcattgtagtactttgtacacagtcagtactcaataaaaatcctcagttagccagagtttttggtgaatttggcttcaaggaaataaacatcaattatttagtcaaaaacttctaacttctaaccaatacatttgattggaaaatattcagcccactcacatattttgagataataaaaatgtacttcgtgaactgtacaaagtacatttttattaatacaaagcctattattagacttggtactaatatagcattattcataaaaattatggtaagaatgatgatactgaggaagggtttctcaaccttagcactactgacattttgggcctgagaattctttatgtgtgggctattccaagcattgtaggatgtctagcgacatccttggccattactcactaaatgctagtagcacccttcccagttgtgacaatcaaaaatgtcaccaggcattgccaagtgtcctcgagaggaatccctcctcagtgccctaaggcatcatgatcagcaccaaaagatgtacaagcgattacaagtctttcaaactaaagcaggaaaaggaagataattattttagaaaagttttcaataagcaaaagcaacctcggttaacctgaaaatcccattaaccccattccttgaatgttctattcccttagcattccagataaaaacaacaaaaaaaaaatactgtacattctattttctactttgtatgcaaagttcagctgattttccatctcaaaagctaagtacagaaatcgagttcatgagtgggggatcttcagcttcatcacttttgccatctattttaagtgacagtgatgctattgacctgaaagtttagggagtttttttccccttgttttgacattttaagtttggtattagcaagtcttcctgttttatctagttgaaagcgaaatgcaacaacaagaaatctgatccaattaactgtgattttcctgtatataaaagctctaacattttgttctagccaccccactgattgtgcaattgaaaatgtccttcttgaataagcaatatgtcttatttcttctttctgcaggttgtgatcctagggaaacactcaagaggttatcactacatgctcgctaacctggtaagaacaagcaagtgtccctgggcaatatatcctatttagtttgaatttttctgtaatcatccaaaaaggaaatacatcaagtacctaatgctttctccagaaacttggagaaatgacttcggtaaataccaaaacctgaatgcaatagccttgctttcaattatgctgtcgttttagctgtgaagcagctatattctttcctaatttaaaaaataatttgatatgattcattacttatttttagattcaatttcggtttgaaatgtaaactattttaattgggtttgaaagataaaccatggaattggggacacaggaaactgactctttcccaattgattcaagtatatgtgcagatcagtactgcatttgtcctttcagaagcagaccactaccaaatctttttgagcagatgtcagagtaggtttcaacacagtacattatatgaccctgccaaagtgtatagccacctttctacttacataaaacacaacttgaatctttactttcaaacttcccatgcctttaaaatttgtgacactgtagaagctagtatttcattaaggttattttatacattttctttctctggaaggacaatttgtttaggaattaacaaaattgcttctaaattagtaatatctgtttggcagaggttctgaataataccatctccatgaaatgaaagagaaatgttaaattatcgctataatactaaaaatctattaagttattacatgagttctaaccccaattttgtttcattagcacaagaaaatcatgatcattgtaaagctcttaagccaaaagaatagaaacaaaggtgaaagattattgtaattatattcttatattttttaatcaaagaaatatctaatatcttattttgttttcataatgaatattttttaaatgaaaaaggaaatgttacttaaacctctttcttaggggtatgtgcattcaaacactttataagatgcagattagagctactgctttcaaatgtagtgtgcatttttctccaataatttgctctaagtggagcacttagtccattttgggaataaatgaatctagtcttttagaagaagaaatcttgattcttaaattacatccatatattttcaatatggtttttaggcaaccaacaaataaaggacttttttaatgcaatggaggttaaactgtggcttgtcaggatatatggatgtcacaacaaggcacctgatacagttattgatgactttttgtcattactttctcaccagaaaatattttgctctccttctttccttcctttctgttttccttccttcctttcttctttccttcttttcttccttcatctctttcccctttccttctcctcttccttcatctctttcccctttccttctcctcttatttgtatgtcctagaaagcagcaaggtttatagcacagtgtttaaaaatgcagggttcaccaatcactgaccatacatgaggtgactttaggtagtatacgcacgcaaacttttttattttaatgaaaatatatttccttactatgtattagaaaaatataaaactagcatatcaaaattgaaattgtatagatactattacttcaaacagggctaaaatagagatataacaaaagtaaaatatgtttttaatgttcaagtaaacaatagcaagggggataaagagatatagcaaaatctgggttttgcctacctggttgttttatacatgaatgactaagtttgagatataacattgaactggggatcagaaagtttgggttgtcaaactgactttgctactagcaaggtaagggaccttgggcaagtcacttcaactctacagacagtgttacaattccattactttaactcaggtgggagtggtggggggcagtcattgatgtgtcggatgggtcatttgaaagcagataataattagaagtgcaagatatttattgggagtaatacctgtgaaagataaaagggaaagggacataagtaggcagggagagcttcagaccacaatacaggtctataccagtaacagaagggaaaaggaagcaagtttaataggaaaagcttcagactgtgctgtagcattgataaaatcttggccaacacaactaggagatcagttcaaaagatagctcatagaggagtcctatgcttcttccaaatggcaaatcatttcatcccgactttgctcagtcattagctggcagcagcccagaaagcacacaccttccacttgaaaaactgaggcagatctgaaggtacctgaagctggaggttgtcagctaacttaattctttgagacagattttgtcttaaagagcgatctgagccgtgcataagaatggctatctcatttggcctaccatgaccgatgatctgtaaaggcctttcccattctataattccaactgggtctccttatttctactgacaaacttttttattttttttatttttgtgggtacatactagatgtatacatctgtgggttatatgagatattttcatacaggcatgcaatgcacaataaccacaccaggataaatagggtacccatcatctcaagaatttatcctttgcctactgacaatcttttaaatcagcttttattgcaattttgagatccagacctgacaaaaattaaagtctatggagtgatagaactgaaagagaaaaatcactaggacaacgttgggaaaaagaatggtaaactgaatcctatacacacaactcagaattatgagactttgggggaatgtctactacaagaacaagcaaagtctgttcctttaaaaataaagtaatgtatagtatgatgtcagtctaagtaatgaaaatgtgacttcctttaccatgctttgagctgccaccctttttcttcctttagtgaccctcttttcatttgaattcagccgtgtaagtccctgtactctatatcaaattgcatttgggtaatagagataggagctgctgttcatctctgatgataataataatgagccaaattatccctactatggtccatggttcccagttttttcaaagcagataaaaattaccccaaatgcctccatcaaagacagacagagagagagagagagagacagagacagagaaccaaaactatttagaagtaagttggatggtcaagaaaaggggaagtggagataagaagatgtttcctttcaagatgagccagctggatgaaagctgagggtggatatctatatacaaaagagcaaagtccaatgtgagtcttggtgttacagacagcacaaaaccactgctttcttctacaaatgtagagtcaagaatatttaagctacttaactaagcttcctggaatcacttcctgcagttccctttgatactgagctctatctggcaaagacatctttgtacatttacatggaacttcccctggtaacaatcctaaagtgagaagacttggatattccatgaatgctttaacgaagacctctcagaggtcaagatgtacatttcagagtggacaatgagctgcagaaaattctagcttgttgaaatcccggaaagaaacagaagatttcaccaggagtacaacccagagatgtgatctactcaggctagaagtggacatcccaatagagcaagtaagtctcttagaaattcttgtatcagttgatgatgtcattttttaggagttgttctgtaattaattgttgttttatcttccaggactctctctaacatggcgctgtttgtcaacgttagtcccagaattagccatcatgtgtacaatctgtcagtcaagcagcctctcaatctctcatggtaaggtcctggatctggatgctttacactgcattgtcaggcatgttatgtaaagtgatttagtttttttcacctatgtcagtaatgatagctcagttactgtgtgtagagccctagagtaatattaggaatagatgcaagggcaggaggcagtgtggtataataataataagaagaaaaaaaagcacgaggctaggaggtaggagtcaggtttgaatcccaagaattcatctaactagctatatagcaaaccaaacccctctgaacctgattatcaatctgtaaaatgcagacgtagacaagatcagtatttcccaaaatgtacatgagatgattttagatactacatagcaaaacttctcttttaacttattagttttgaatgtatattaaatacatattggaaaaacaactatcccagcaattctgtgattttatagataccattccttagaatgaggctaaagtagatatatagataaaagaaactcagtcaatgtaaataaaaatattaagtaaattatagttcggatggtccacctctatggcaaaaaattgaaaaggtggtatactaatgactagaatttggaaaatacaccactgtcgcttctagatctacatttcttccctcttggagttcagtttgggccagggtaggccaggtgaatgctgaggacacaaacagggaagcaaaaccagagccccgttatccttggggatataaagttataaggcagactaaagctttaaaatcagtccaagggggcaaaaaccaagatagatatgagtattcttagccaagttctaagcagagctgaggatctgaaggatcaatcaaaaacagtctagcagattacacagggcaaattggatctggattgaatgatccaacaacagatgttcatcactccccaaataagaccaaaaacaaaaacaaaacaaaacaaaaacccacaaacaattgaagtgcccaggggagaacatgagccatagcagggctcattcagtgttgcaccagttaaccactgccttagaagacctgacattttccctgcctaggttgatactggtaccagagttggagacaattgctgaccctttaagtggaggaatttaggtaatgtctgctgttagcagtagagagctacaggcaatcaaacaggtcattgtgcaagaagagaaaatagaagaaagttcatctatcttatattcctctctgatgtgttagctgttttctttagactttcatttaattttctcagaacttctatgaggagagacttcttgcccacccaccttcctaagccttttacatatcagaaaatggactcagaaaatatatataacttgcccaaagtctcatagctaatccattgccaaactaagttttctatctagattggtaacactcttagtagagcacctcgctcttcccactttacccacccaagcttctcagtgagatagaaagccagcaccacaaaggtcacataaaagcatttgcaaagacacaaatgtaaataaatgaagcacaagctctaaatttatgaggatgaagtgatcagagataaaaagggcttttaaaaacaaggacacgttgggccgggagcgatggctcatgcatgtaatcctagcactttgggaggccgaggtgggtggatcacgaggtcagcagttcaagaccagcctggccaatatgatgaaaccctgtctctacttaaaaaaaaaaaaaaaaaaaaaaaaaacttagccaggcatggtggcatgtgcctgtagtcccagctacttgaggggctgaggcagaagaatcgcttgaacctgggaggtggaggttgcagtgagctgagatcgtgccactgcactccagcctgggtgacggagcaagactctgtctcaaaaaaaaaaaaaaaaaaggacacctttgtgaatctggttttgaaaaaaaccatccaaaagcccaacatgaactgtatcttaacaggcatcaattacatccccatcactccctgctgtctaaccattttccttccctcctctctctctctctctctctctcacacacacacacacacacacacacacacacacacacacacacacacattttcattccccttttttcttatgcttcgtcttctctctccctcctcatccaacctcacttatgccagaaaataatgatggaaggggggtactagatgacatctaatttttccaaaattttactaaaacaagagcattactcataagattgaacccaaacaggcagccaggagcttcaacaagcttgaggaagtgaactctgcagctcaccagatctcagaatgtacttgaaaaacagaagggcctattttgcttagagagaaaacaagtttaaataagatttagttatgctgttttgcttgccaataacaactattcccttctctcttccccttccaggtcttcttcttctgttctctactttccctttctttgttccgacattttttatgttctaaataaaaaattcaaatgctcaaagccacgtgttgtgatcactgacacctcagcagatggcatgtaaacacagagctcactgggctggagcctggctttgcaggcaagggaggtgggcttgcaggtaaaaattccccctggtcccaaatgccagggagcccagtcacctctcctggtgcacaacttctctggtagctcaggattcactttcttctccaaatggaaatggtacatagaacaccaagggaatgaggagtggggactgggctggtttccaacttcctgccatgcatttcaaaagccacaggcatttgtcagcttaaagttgcgaactctgagactcctattctctctctcccaaaatgcctttattatagtcaaccactgcactgtgtctctcttctctctctcccctgcctgaaattaacaaggaaagatcatttcctacccaatgttatagcaagatgaattaaaagcattttatcttctccccaaactctcagattatgtcctctaaaacagtgcttcctaaactacctgtgaagaagaaccagtttttccccccaagatcttcatggaccagtaaacatgcaacaaaaataaattacttaaaaaatgaaataagcaaaataagatatataaaatataagttcagtatttttagtattacattcaatagccattatattaccctgtcaagttcctatgaaggttggtaaagacttaccctccatttctttccttatatcatctcagactggtaacaaacaatgaaccagcaccagtctgcacacattttgagtagcactgctctgaaggtctttacagtaagtgtttttttctatatataccactgtatgtccaacaacttgttcacttcacagcaaggaaaacagagtgtattgtccttaagaaccttataattgtattgttcagaccagacttgcatagcttatgataattgccactgagatagaacaggtgctgggacaatgaataaagagaaggcagattgtggaagtcaataccgtggaagtctgcatagtgtagccagagaaggcctttcagaaaaggtgactttgaaaccataatctgaaagaggagaaagattcagctacatgacgaaacagggagagttcatgcatagggaacagtacatgtcaaagtcctgaggcagaaaacagcttgatgtcttccctgaacagtcagaaggcaattttgggtagagcagaatgagtgacaggacagattagatgccaggtggaagagttttacccttttttcaacagcaacagaaggcccattgaagaatttcaagcagggaaggggtatgatctgatttatgcttttttaaaaatccgtgtcaaatggatgagttttatgtgatataaattatacctcaatgaagctgttagtaaaaaaaaaaaagagagagagagagagagagatcagtggctatttccccattaatagaacttatgccacgttgtaattatttatttattcatacaaataacccccactgaactgaagtgccatgagggcaaggaccaagtttgagatggctcgccattgtaacagctagcacttaataggtttctaagtatgtttgttggtcagactagagaataaaatcatgagtgaacaatataagcaacttgtaatcaagtactaatttatatggtgtaattgtcaactctacacattgtatcctcccaggaggatggatctgctttctagaaaaagacttgtgtctctcattagcaatctgacaacttgaatcaccacaattactatgcatttctttactgaagcatcacccagatgaacagtacaaatggcaccaaaggcagagccagtcttcatccaaaatgtgagatagatagttgtctttggcagccttccaaccctcattctactgcttttatctttcctataggcaagccaccttttctcacccataatctatcatcaactcctaaaagtcacccaacttatcttgtctctgttttccccctgtacaaaatgtgccctaataatagtactgtatgaaggaaaactccacatcataccttgaaaataaatgcacttaatgtaagccttggatatatttatttccaactctcaaatatccacacttccaaaagtaaagtgaaattcagtatgtgaaaatcaacaaagatgggataataccaaagtcatttggatctttggaagactgaattgtcgggctattctcaaatcatggatggtctgtgtttggatgacagttgtgtaaccagtgtctatgtgaaagatggctttggagagttaatcaacagaagcttacaagaccctgcatgaactgcttaggcataaaggtcatgttggttttatatagctgcattcagatgtgagcaaacatgcactgatcaaacaaacagacatgatatgattgagaagtggtgcaatttatgaaatatagcagaacctacaaatcaaaatgggtagtttccgtttcagaagaatcacttctggatattatacccatatttctaacaaatatcaccattgttacacagaagcagtcaagtgtacagaaaacttagaacgcagagagtgagaaagcagaatttcaattcaccctatctatgagcagtaggattgcttccaatctgtccctgccttctctcatatcttttaatctcttcccactgcacacaaagattaccgttcaaaccaaagaaaaggatactaacatggctagccaacaaaaccattgattgcaaccaaatagaattggtgaaatgcaaacagcactagaattcgataagtttagtccaagcacacaaaaatcattgaatttgtaatcaacccttaattattaaaatccttatgaaataataagataggcttaacagaaattccatagcacaacaggaaatttgggaccttagagtcacttagcacctatgttgtagagtatacacatatacttattgcacagaaggcatgggaagtcatgcaataataagacaaaaatccataaacagtcatccatatgtacaatagcctatgtaatcattgggaagggggaggataaaggagcacaattagcccccttactacctagtagaagatacagggacaaatttgatatagatgttcttaaccattatttcactaattgaaaatgttagcaaggatgcagaaaaaagggaatgcttgcacattgttagtgggaatgtaaattagtgcagccattatggaaaacagtatggaggttcctcaaaaaactgaaaatagaactaccatatgatccagtaatcccattgctgggcatatatccaaaagaaacaaatcagcatattgaagagttatctgcactttatgtttactgcagcactattcacaataatcaagaagtggaatcaatctaagtgtccatgaacaaatggataaaggaaatgtggtatatgtacacaacggaatactatttagccataaaagggtggaaatcctgtcactgtgacattcatttggatgaatctaaaggacattatgtcaagtgaaataagccaggcacaaaaagacaaataccacgtgatctcacgtatatgtggaatcttaaaacgttgaactcatagaagtagagagcagaatggtggttaccagaggctagggggtgaggagagagggaatgaggagttgttaataaacaggtccaaagtttcagacaggcagtaggaataggttttgagagctattgcacagcagggtgcaataacaatgcatcatatatttcaaactaagagggtaaatttcaaatgtctcaccttaaaaaattgtaggtaagcaaggtgatggatatgtgaattagcttgatctaatcatttcacattgtatatgtatatcaaaacatcacattgtaccccataaatgtacacaattatgatttgtcaatcacaataatattaataattaaaaaagaaagaaaggaaagaaaagaaaatggttcttgaagaatgaaatttcaatagaggcacctaaagttgtaagtaataaagtaggggccctttgtaggcaaagagaacaaagataccaatgttaaaagagtgcatgatgtggctagagcatgaggtctgttgaaggaaatggtgtagatgaggccaggggagcagaagataacagataatggaaatccttgaaaatgaagttaagatatttggctgttaatagaaagtagggactcattgcagtcctttgagaaaggagtcttatacactaactggtattttaggaaggtaaatttattatgtgaagaataaactggagagggaaaaaaaaagaaatcagagcaccaactaggaagctaggacaataatctaggccagtggttctcaaaccctcttgtacttcaaaatcacctgttgaattagatgcttgggcctcatactccgtaagtctaaattagagaaagggatacaaaaagaagagattttaaaggaatgtaatcaccttgctttggggcacattctttttttattttttttaagtgaaagcaagtttattaggaaagtaaaggaacaaagaataggcagagcagcccctagggctgctggttgcccatttttatggttatttcttgattacatgttaaacaaggggtggattattcatgagttttctgggaaagtggtggacaattcccagaactgagggttcctccccattttagaccatagggtaacttcctgacattgccacggcatttgtaaactgtcatggcgctggtgggagtgtagcaatgaggacaaccagaggtcgctctcattgctatcttggttttggtgagatttagcaggcttatcagcaagttctttatgacccatatcttgtgctgacctcctatatcatcctgtgacttagaatgcctaaccacctcggaatgcagcccagtaggtctcagccttattttacccagcccctactcatgatggagttgctcttgttcaaatgcctctgacatttctcctctcccttttataagagaacctttaatcctaagggttctccttcgtagaaggatgaagattcatcttctgtaacttctttaggctgaatagggcaatgatattcccgcttaactattggttcccttgcatttggggtagagaggagctcagtcaaaatgctgacttggtatgtcaagggccatttataactcttgagttccaacaaaaggtgatatctggaaaattattaagtgttcaatttaagagaacattgagtaagcttatcctgcattcctacacgtagagtgtaacagcaatatattccacaacagtaaagcaaaataagccaaattattccaagtaaactaaataagaaggctttccatgaactgggaaactgttggaaccaagctgatatggggttgctagctgactccagtatgtaaggcacattctttttacaacgcacatggaatatgtaagttaatttagtcagcaggtggttagagaagggagttttagagatatgagaaggtttaattggagagtcattggtatcttattcaaagtgaattcaggttgaaaatgccaaaataaaataagaaattaatttgttttacagactctaaagcctcaaaatgtaacaagttcattttctgaggtatttgtgtggtaaatgtcatccttttgaaaaagcagattctcagagcccgactttatgaaaaatcatgagtatccccatagtcaaacactcaaaattaaaaatataaaaaggcaaataaaaaagaacaaaaaattctaatgtctttgggtagacgagaaatgccagaagaaggtacttgttttcaagcagaaaatgaactgctgaagcagtctatgattcagtgaagggagaaagcagttgctgcaaaacagcttaaacaaaaggaaccattgtttctcgcaaaaatatcaagtctactgaaacacattttgttttcggtaaaaatgctattttaaaatatattattttaataccagatgaaattcagtgaggaaatagaattcatgacacagaaatttcctttgaagtcaaacttgttaaaaatgtatcatgtattaaataaaaagatgtgggttctctcttttttttgttttttgttttttgttttttgtttttttgagacagagttttgccctgtcacccaggctggagtgcagtggcgtgatctccactcactgcaacctccgcctcctgggttcaagcaattctgctgcctcaacctcctgagtagctgggattacaggcacccaccaccacatcaggctaatttttgtatttttagtagaaacggagtttcaccatgttggccaggctggtctagaactgctaacctcaggtgatccgactacctcagcctcccaaagtgcacggattacaggcatgagccaccgtgtccagccttctggatgttgtttgtttgtttgtttgttttttctgaatagtcgtcattggatgaggagttcaggtcaagcatttaaaccctgaaacaaaagtcagaacaaactaaaaagacttaagaacatgaaaccaaatgtcaactttgtttgagccaaggacatgaattaaaaagtaaaaacttgtaaaatcgtttatcatgtatttaaactagtaatcatatacttttttctaaagacttggattttctgataataaaaatatctgtctgtgttcacatatattgctgtctggtcactgctctacttctactcacaacagcattcattatacaagggaaaaaatggaatatagggaggaggctgggctgtgggacagagagaagtctgagtgacagtaattggagtgtgtctgataggcagatgcttcatgggactagtcggaactgattggctgagggagctatgtcccactcgtgggtgttattatcagagaggaggagtgagaatggaactttctggaaaaggtcacatgataaagaggaccagtaagaggtagcttcacgaatggagtctgagccagctagctatggagaataatttgacagctggcaggcagacaggtaggatatgtaccttcctctactgctccctaccccttaaaaccccatctctttctgcttttacctctcgggtctgggtattgaaggcctaatgctgtttcattcaatttttacagaagttttaggaaaccagggactctaaattctccgacatggtgaactgtgggtggccatctccaactgctggtgatgccagaaacgaaggcaatggggaaccaggaggcaatacacaccttcctttagctagaagctgtctcctaaaatatctgtctctacatattacccccaccctttccctttccacttttacctaatggctttcaagtgacaaaaactgtgtgggcaattttacaaaagtttcagaaaggccagacatttcaatttctcaaaagagtgaagtggcaagtcccactgtagatcataatacaaaaaaaaaaaaaaaaattggccaagagctaggaaactctaataatttagctaatcatttagccagattatatgagcatttagccagatattcatataatagccatctctacattccttaaccttctcctgatagagattggtgccggatagcaaattctgttacaataattttttggtagggtttaaagaaaacaggggatcaaaattcccaaaagtgcagactttgggtggcaaacatcaagtaaaaattaccaaaagggaaaaaagcaaaaaggagccactaacttttaatatctcccacccttccactctctcctctcctcctttccccttttacttactgtatgtgtgatactcagatctgttgatttaatgtcttaacagaggttttatgtggattcttcctcaattttccaaactcaaggactgcgaattggaagctcacaaaaggaaatgtagcaacatgctatgagcaagaataatcatttaaaataaaaggataggcagaagagagccaagagccaggcaacctctgtcccataggcaaaacatctctcttttttgtaggctagtcaagtgcagcagtgggagtacagaaggcactagaacttttctcttaatacaactatgcctaccattcatcccttttttcccagttgctcagatcctcaattcctgtcgaagattcgctggccagctctgctgaattagtgtctttgctgagatgatagggagcgtctggcctcaattttcaaaatgttgtatgcactgtgcttgtccatgactccaataatgtctagcgatatgtgaaagaaaacagaatatattttaaaacaatagagtagagatggaaggtggactaagagccaggcatgtctgcctctcagccagcaactgtctccgaacttccttctttctactgttattctttacctttttctttgatctgtttacctatttgatctgtatggtggccatttctgctatgttagttgttttacagaggttttagagctacttggcatttatatccaaacttgaggtcagtgtgttatcaactcaaaaaaagaaatctagcaagagttatggataagaaaaatgtcttaaaaataatgagattctaggtgaataaggaccaggaaccagccaacttctgctcttagacaggatccctacattctaccagtgaccttaatccctttattttccttttatcctctaggtgttcagtggacatttccactgcattaatgtctttatagtgttgagtgggacttgggttcagtattcgcacctacaattcgcaagtggtcagctaaagaagtgaaacctaaaaataatttatgaacaaatgaaatgtcttaaagatattgtgataggagccaaaacaggattaggagccagcaaactgctgtccttcatacaaaagtggtcttctaataagcccctttttaacacacacccatcctacttttccttctccctcttacttccaggatatggggtggtcatgctgctgcatcaattacctacatgaaattgttgggagactctaatctcagttttctatacactgctgactgtatttactcatgtcagctacaccatttagcaatatgagatggaaaagacaacatgctttgaatcacattagaaggtacacagggaaaccaagagtaagccaacttctgcccaatagtcagtaccactctcctgccttccttcactctgccaacgaccttcacacatttgtttttcccatttccctttcaggttttcagtggtcacttctgttgcattattttgtttatagagatttcagtggggcttgggaaaatattcccacctgaatctctgcaggtaatcagaagtaaggcctaggaataatgtattttattttattttattttattttaaagggttttttatttttaatttttgtgaatacatcataggtatatatatatgtgtgtgtgcatatgtgtatatatatatgtgtcatatatatatatggtacatgatatattttgatacaggcatgcaatgtataataatcacatcatgaaacattgggtatccatcccctcaagcatttatcttttgtgttacaagccaattatcctcttttagttattttaaaatgtataagtaggtttttattgactacagtcaccttgtcgtgtaatcaaatactaggtcttattcattctaactttttttttattaatcatccttgtcttcctcccacccacccccactacccttcccaacctctgattaccatccttctctatggccatgagttcattgctttgatttttagagcccacaaataagttaaagcatgtgatatttgtctttctgtgcctggcttatttctcttagcataatgacctccagttccatccatgttgttgcaaatgacaggatcttattcttttttatgactgaatagtactccattgtatatatttatcacattttctttatccattcatctgcttgtggacccttaggttgcttccaaatcttggctattgtgaacactgctgcaacaaacatgggagtgcaggtatctctttgagatcctgatttccttacttttgggtatatacccagcagtgggatcgctggatcttatagacgacctattttcagttttttaaggaacctccaaactgttcttcatagcggttgtattaatttacattcccaccaacagtatatgaggattcccttttctccacatcctcaccagtattttttattgtctgcctttgtataaaagccattttaactggggtgagatgatatttcattatagttttgactttgcatttctctgatgatcagtaatgttgatcaccttttcatatgcctgtttgccatttgtatctcttcttttgagaaatatatattcaaatctattgcccatttaaggaattggattagattttttttcctatagagttccttatatgttctgattattaatcccttatcagatgagtagtttgcaaattttttctcccattctgtgggttgtttcttcactttgttggttgtttcctttgctgtgcagaagctttttaacttaatgtgatcccatttgtccatttttgctttagtttcctatgtgtgtagagtgttactcaagaaatttttgcccagaccaacgtccgggagattttccccaatgtttcattgtagtggtttcattataggaggtctcagattcaagtctttaatccattttgatttgatgtttgtataaagtgagagataaagatcacgtttcattattctacatatggatatccagttttcccagcacaatttattgaaaagactgtcttttccccaatatatgttcttggcatctttgttgaaaatgagttaactgtaggtgtgtggatttgtttctgggttctctattctgttacattggtctgtatgtttttatgccagtatcatgctgttttggttactgtagctctgtagtataatttgaagtcaggcaatgtgattcctccagttctgttcttctttctcaggatagctttggctattctgggtcttttgggatttcatataagttttaggattgttttttctatttctatgaaaaatgcctttggtattttgataaggattgtattgaatctgtagatttctttgagtagtatggacattgcaacaatattgattcttccaatccatgaacatggaatatctttccattttttgtgtgtccttgtgaatttctttcatcagagttttatagcgttcattgcagatatcttttacttttttggttaagtcatttcctaggtatgtaactttatttgtggctattataaatggtaatttttaaatttccttttcagattgttcattgttggcatatagaaatgctactgattttcatatgttaattttctatcctgcaactttcttgaattcgtttatcagttctaaagttttttgatgaagtcattagatttttccaaatataagatcatatcatctacaaagataatttggataatttgacttcttcttttccagtttggatggtctttatttcttttttttttcttttttatatttatatatataccttaagttctagggtacatgtgcacaacatgcaggtttgtgccatgttggtgtgctgcacccattaactcatcatttacattaggtatttctcctaatgctatccctcccctagccccccaccccacaacaggccccggtgtgtgatgttccctgccctgtgtccaagtgctctcattgttcaattcccacctatgagtgagaatatgcggtgtttggttttctgtccttgtgatagtttgctcagaatgatggtttccagcttcatccatgtccctacaaaggacatgaactcatcattttttatggctgcatagtattccatggtgtatatgtgccacattttcttaatccagtctatcattgatggacatttgggttggttccaagtctttgctactgtgaatagtgccacaataaacatatgtgtgcatgtgtctttatagtagcataatttataatcctttgagtatatacccagtaatgagatggctgggtcaaatggtatttctagttctagatccctgaggaatcgccactgtcttccacagcggttgaactagtttacactcccaccaacagtgtaaaagcattcctatttctccacatcctctccagcacctgttgttttaatgatcgctattctgactggtgtgagatggtatctcattgtggtttggatttgcatttctctgatgaccagtgatgatgagcattttctcatgtgtctgttagctgcataaatgtcttcttttgagaagggtctgttcatatcttttgcccactttttgatggggttgtttggtttttttcttgtaaatttgtttaggttttttgtagattctggatattagccctttgtcagatgagtagattgcaaaaattttctcccattctgtaggttgcctgttcactctgatggtagtttcttttgctgtgcagaaactctttagtttaattagatcccatttgtcaattttggctttcgttgcgattgcttttggtgttttagacatgaagtccttgccgatgcctatgtccttaatggtattgtctaggttttcttctagggtttttatggttttaggtctacaatttaagtctttaatccatctcgaattaatttttgtatagggtgtaaggaagggatccagtttcagctttctacatatggctagccagttttctcagcaccatttattaaacagggaatccttttcccatttcttgattttgtcaggtttgtcaaagatcagatggttgtagatgtgtggtgttacttctgaggcctctgttctgttccattggtctctatctctgttttggtgcaagtaccatgctgttttggttactgtagccttgtagtatagtttgaagtcaggtagcgtgatgcctccagctttgttatttttgcctaggattgtcttggcaatgcaggctcttttttggttccatatgaactttaaagtagttttatccaattctgtgaagaaagttattggtagcttgatggggatggcattgaatctataaattaccttgggcaatatggccattttcacgatattgattcttcctatccatgagcatggaatgttcttccatttgtttgtgtcctcctttatttcgttgagcagtgttttgtagttctccttgaagaggtccttcacatctcttgtaagttggattcctaggtattttattctctttgtagcaattgtgaatgggagttcactcatgatttggctctctgtctgttattggtgtataggaatgcttgtgatttttgcacattgattttgtatcctgagactttgctgaagttgcttatcagcttaaggagattttgggctgagatgatggggttttctaaatatacaatcatgccatctgcaaacagggacaatctgacttcctcgtttcctaactgaataccctttatttatttctcttgcctgattgccctggtcagaacttccaacactatgttgaataggagtggtgagaaaggtggatgctctttatttctttcttttgtctgattgatctaggtaggactttcagtactatgctgaataacaatgaaagtgggcatccttgtcatgttctaagtcttagaggaaatgctttccattttttttccctccattctgtacaatactagctgtgggactgtcatatggcttttattatgttgaggtatgttccttctatacccagtttttttagggtctttatcatgaagggatgttgaactttatcaaatgctttttcaccatctattgaaatgatcatatggtttttgtccttcatcgtgttgatatgatgtaacatattgattaatttgtatatgttgaaccatccttgcatccctgggataaatcccacttggtcttgatgaatgacattgttaacatattgttgaattcagtttgctggtattatgttaaggatttttgcatcaatatttatcagagatattggcctctagctttctttttttgatgtgtctttattgggttttggtatctggttaataccgcccttggagaataagtttgtaagtctagggataatttatgagcaattaaaatgcttttaaatgatacgataggaaaatgagcaggataagaggcagccaacttcactttggcctttttttaaaccctcttaaattctggatatcttttagtgttctctgttatattagttctttgctgtaattgcccaaataatccagtctcagttttctggacctgcagactgtatttgcggatatcacccttagaatctagcaatatgtgatggaaaagtggcatgctttgggccacattagatgggaaatagatgaaccagtaatcagccaactctcaactttagtgagcacttatctcctaactcttctttataccaataacctttgcacatctattttcacctttcatcttctagatgttctgtggtcatgtctgttgtcctattttatttatagagatttcagtcagctcagccagctattcccacctctgagtcttcaagtggtcatctcaagaaatgaaaaactagcaacagtttgtgaataagctaaatgtcttaaagtgttgtcataggcaataaagcaggatcaagagccagccaacctgtaaagtttatggaaaaatggtctcctaatattaacattcctagcataccactgtccccttctttcattctctatcttatgtcctggatattggttactaagctctgccacattagtgtctttacttatgttgtctgaagaatctagtctcactttcctgcaccttgcacactttatttgtgcatgtcaaccatacaatctagaaatatgtgacagaaaaaaaaacaaaatattttaaaatagaatagaagcaagtgaactaggaggcagacaactcctgctattcagaaaaaaaattgggctttcagtgtttgcctcttgccacaacctgcccttttcttatttacacccttacatcctgggtatttggtaggaaaccatcttatattcgtgtctttgctaaagttggcataagaatctagtctcggttttctgtatctgtagactgtgtttgcacatatcatgatagaatctgggaatatatgatagaaaacataatacactttgaaccatgttagaaaggaaactggtgaatgaggagtcagccaactcttgcccatcagccatcccttttctcctaacttctttatttcttccaatgttctgagtttacttttccccttttatctttcaggtatttagtggtcatttctgttgtgttatttatatagagagatcagtagggttgggccaaatattctcacattttggtctgcaagtggtcagctcaagaagtgaaacctgggaagaggttatgaacaagtgaaatgccttcaaatgttgtcataagaggaaagacagcatcaggtgccagccaactcctgcccttttacaaactttgtctcctaatattcctcttcttatcactcccctcttcttttcattcactctttttttttttttttttttgaggcagagtcttgctctgtcgcccaggctggagtgcaatggcgctatctcggctcactggaagctccgcctcccgggttcacgccattctcctgcctcagcctcccgagcagctgggactataggcgcccgccaccatgcccggctaattttttttatatttttagtagagacggggtttcaccgtgttagccaggatggtctcgatctcctgaccttgtgatccgcccgcctcggcctcccaaagtgctggtagtacaggcgtgagccaccgcgcctgtcctcttttcgttcactcttttcccttgtggatatttgttggtcacttctgttatattactttctttgctgaagctttccagaggccgaagtctcttttgtaacttggagtttgtatttgcatatatcaacagttgaatctaacaatttgtggtataaagacatgcttgaacccaaattaaatggaaataggtaaaccatgaaatagccaattccctcccattagttgtaagttccttatttctgtctatgatatttctcattttattttctcctattcccacatggatttttaaaattatctctgtaacattagtatcttttgagagatttgagagagtttccaccttgaagtctgaggtcacaacatcaaacagagaagcttagcaagcattatagaaaagtgaaattccttaaaataattaaataacaagaaagtatgaaccatgagccagccaatttttgtctttgtgccaaactatttatcctaacttccatcatcctttatagcccctccatcatcaccattctattgccttccttatacactctggttgttgtctgggctcttgtctgtgttattgtctttatattggtttcaaggattcacagctcagctttaccaccttgactactgtgggtgtcttgcatgatgaaaaagatttaacaagatagtataaaaatgtgtattcccttaatatttttggattttataaaaagaagttccagaaatcatacacctcctgtcctctatcgagatcctcaatcctaaaataactgtgatcctcagtctccctatttcacttcacttttacatatattctcatgcttgctaaatgtttcatggtcacctctcccccatcagtgtctttgctaagcctgtgggaaaaatcaggcctctgtgttcaatcttgtggactacagtttcttacaatacaaagtagcagtttatgaagaaaaacagcacgtgcattacaaaacttaattcagatggaaggtggtccagatgccagctgacttctaccatttatttaacacctctctcctagcttccatcttctactgctgaccttctttcctctattttcccctttatcgtccaaatgtttaatattcatttttgtagtgctagtgtatttgcaaaggttttagagagactcagtattatcaacttgaggcacttttttttttttttttgagacacagtctcactctgtcacccaggctggagtgcagtggcatgatctcagctcactacaacctccgcctcctgggttcaagctattcttgtgcctcagcctctcaagtagctgggactacaggtgtgcaccaccacacctggttaatttttgtattttagtagagatgagggtttcagcatgttggccaggctgatctcaaactcctgacctcaagtgatctgcccacctccgcctcccaaagtggctgggattacaggcatgagccaccattcctggccaacttgaggaccttttgtggccaactcttaaagagaaatctagcaagagttgtgggcaagtgaaataccttaaaataatgagataataggtgaaaatggaccaagagtcagccaactcctgccctcagccagaacttgtatcccaacttttaatttctataactgcctgtcacctttcttttccccttcactattcagattagtttttttttaatttgtataaatgtatggggtataagtgtaattttgttacatagttaattttaaaactctactgtcaggagtgggattgttgaaggttatttttgttgcattaatcccacctcaaggtctctgtgtagccacttcttgcaagaaatgaattctggcaagagttatgaacaaattaaatgtcttaaaataatcatacaagtggagaaagtaaaccaggagccagccaacttctcccctgaatcagaacatttctcctaacttctatcaccctaccacaaccctccctgccatcaccattttatttccctttttatatactctatgttttatagtgtcctatactgttttagtgcctttacattgatttcagggatacatggcctcaatataaacaccatgagggttttgtgtgtccaatgactaaaatctaacatgctatggaaaagtatggtgccttaaaattcgaaagcaaagaggaccaggagcctgacacctcctgctctttagcccaaaaccatctcttgctctcttctctcttaccactttctccccttctttatttcctgtctacttggtgtatgtttgctggtcagttttgttgcattagttattgtattaaatctgtcgctaaactcaggcctcaattcacaattttgccaactatggttgtacatgacaacagcctctagcaacttgtttttttttttttttttttgtaaaatttatttttttattatactttaagttttagggtacatgtgcacaatgtgcaggtttgttacatatgtatacatgtgccatgttggtgtgctgcacccattaactcgtcatttagcattaggtatatctcctactgctatccctccccctccccccaccccacaacaggccccggtgtgtgatgttccccttcctgtgtccatgtgttctcattgttcaattcccacctatgagtgagaatatgcggtgtttggttttctgtctttgtgatagtttgctcagaatgatggtttccagcttcatccatgtccctacaaaggacatgaactcatccttttttatggctgcatagtattccatggtgtatatgtgtcacattttcttaatccagtctatcactgatggacatttgggttggtttcaagtctttgctattgtgaatagtgccacaataaacatatgtgtgcatgtgtcttcatagcagcacgatttataatcgtttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcccgactttttaatgatcaccattctaactggtgtgagatggtatctcattgtggttttgatttgcatttctctgatggccagtgatgatgagcatttttttcatgtgtcttttggctgcataaatgtcttcttttgagaagggactgttcatatccttcgcccactttttgatggggttgttggtttttttcttgtaaatttgtttaagttctttgtagattctggatattagccctttgtcagacgagtagattgcaaaaattttctcccattctgtaggttgcctgttcactctgatggtagtttcttttgctgtgcagaagctctttagtttaattagatcccatttgtcaattttggctttcattgccattgcttttggtgttttagacatgaagtccttgcccatgcctatgtcctgaattgtattgcctaggttttcttctagggtttttatggttttaggtctaacatttaagtctttaatccatcttgaattaattttcgtatagggtgtaaggaagggatgcagtttcagctttctacatacggctggccagttttcccagcaccatttattaaatagggaatctttccccatttcttgtttttgtcaggtttgtcaaagatcagatagttgtggatatgtggcattatttctgaggggtagcaacttgttttagaagaaaaaaagttccatgtttttaaaaaatgaaatagatgtaagaggttgagagaagccagcaaagtcttcctccttggccatctcttctctctgaacttccatccatctatctatatattttattctcatctcttttatgttagtgtctttagggaggttttaagaaactcagcttcagttttatctccttgaaaactgtgatccaacagcctaaggagaaaatctaacaagaggttatggggtcagtaaaatgccttaaaacaatgacattctgtactaggagaaggaagacaagaagccagccagctcctctaccttagcccacacatctctcctaacctccatcttcctaccactgacccttacctttttatttactccatttttatttctggatattatatcatcacctgtgctgtgtgagtatctttacattggtttggggggaccattggcctgccttagggttataagtgtcataaccataaaaattcatcaaagattattatggaaaggagtaatgtcttaaaatgttaggataagaagtgaaagagacctagaagccaaacaaatcctgcccttgtacagtacctctctcctaatttccatcatccctctttaccttttctcctttcccctcttactgttgaatatcagctctgctgtgttagtgtctctgaagaggctgtggagagaatcagtctttaatttttgcaatatcatggactgtcagtggtcacttaaagagtggaatttagcaatagttgatacaaaaggaaaagtctttataataaaaaaggtatcagaaaaagaaagatgacgaagagtcaacaaactcctgtctttagcttgacaattttccttatatccacctgtctattactcatttcccttctcttttcctcttctacttctttgatacttattaatcagttctgctgcattagtgtttcttcagaaggtttagggaaaaatccagccttgatcatctcaaccttgaggactattggttgctctatctaaatgctgggaaccagagtgacaaacaagtcatagaatctgaagaaagataacaagcaaaatgtacacaaatgggacagagggagaagtaggaccaggatccagttaactcttgccctttagtaacaagatctttcctttcatctccctaaacacctgttaccttctttcttttttcacctcacttctgctctcttcaccttgccaaaggggctgttagtgctttctgtccatatggcctggtaagctgtaatggccctcagtaggagctagtggtgtggaggtcttgccagctaaaaaaaaagcaggttgtgatgacctccccctggtttaatctgtgctgctgtggacacattttatcccatgagcacagccaggctaatgccaatttgcagtgtgccagaactcattcccgggatgtctgtcaaaaaacattagtcgactgagagacttctagttcctcagtgatatggttgaggttgggtatagagataagtgcactgtattcctataaaggtgtttccaaatcacaatgtgtttattggagatcaagacacccaggtgggaatttgtggggtgtatgcggcaggatgaagcttcctgggagcaaggggtggtaatttttgaggtgtatttgaggtggacatctccttttagtttctctgccagaaaaagggtaattaggcaaatcttcaagaaaagagtggtacagtagacaataaccagactgaattgctggctcttaggccttaaggcagaaagtgagatttgggggaccctttctccctcgcttttgctaattctacattgccattttaacatgctatgaatattaggtaaacaggagtatgaagcttatcaaagtgagagatactgctttctagtgcatgctgtgcctattgaccctgaggactgtaatggtggcagaagcattcacaacccctttctctcaagaaagatggctctacttttccagcccaggcttttaagatacaggccaagcacaagagatcccatccttcacccacaacagcaggtcaatgggcagttggtcaattttcttatgtaatatttgttaactgccaaatgtggttaggcatggtaaatgaattaaagctattcattaaagattttaaatgatacatatttgtacatatctgtagggtatatgtgatatattgtcacatgcatagaattgtaatgatcaaatcagtgaatttaggatatccaacaccttgagtatttatcatttctgtgtgttcggaacatttcaagacccctcttctggctaccatgaaatacacaatacattgttgttaactataattaccctactctgctattgaacaagagaacttttcccttctatctaactgtatgtttatactcattaaccagcctctcttcatcctgccccctctctcacccttcccagcccctactaactatcattctactctctacttccgtgagatcaaaatttttagctcccagatatgagtgaaaatatacaatatttgtctttctgagcatggcttatttcacttaacataatgacctccagttccatccacgttgctgcaaatgacatgatttcattcttgtttatggccaaatagttgtccattgtgtgtatataccacattttttgaaggccattaaactttttaagttttttttaatcttttttttcaacttttatttttggttcaagggtacatgtgcaggtttgttatataggtaaacttgtatcacaggagtttgttttgtaaattattttgtcacccaggtactaagcctaggacccaatagttattttttctgatcctctccctcctctcagcctccaccctccaataggccccagtgtctgtagttctactctatgtgtccttgtgttctcatcatttctctcccacttataagtgaaaacatgcagtatttggttttctgttcctgtgttagttggctaaggataacggcctccagctccatccatattcctgcaaaagacataatcttcatgttatcactgcatagtattccatggtgtatatgtagcacattttttttatccagtctatcattgatgggcctttaggttgattccatgtctttgctattgtgtagtgctgcaatgaacattcacgtgcatatgtgtttataatgcaacgatttatattcctctggatatatacccagtaattggattgctgggtctaatggtagttctgtttttaagtctgagaaatttccatactgctttccacaatggttgaactaatttacacttccaccaacaatgtataaagtgttcccttttcggccaggcgtggtggctaacgcctgtattcccagcactttgggagaccaaggcgggtggatcacctgaggtcgggagttcgagaccagcctggccaacatggtgaaaccccgtctctactaaaaatacaaaaattagccgggcgtggtgacacacgcctgtaatcccagctacttgggtggctaaggcaggggaatcacttgaacccgggcagcggaggttgcagtaagccgagatcatgccattgcactccagcctgggcaacagagtgagactctgaaaaaaaaaagtgttctcttttctctgcaatcttgtcagcatctgttatttttgactttttaatagccattctgactggtgtgagatggtatctcactgtggttttgatgcatttctctaatgatcagcaatgctgagctttttttcatgtgcttgttggccacacacttgttttcttttgaaaggtgtctgttcgtgtcctttgtcaatttttcaatggggttgtttgagttttttgtgtaaatttgttttaattgcatatagatgctggatattagacctttgtcagatgtatagtttgcaaatagtttctcccattctgtaggttgtctgtttactctgttgatagtttcctttgctgtgcagaagctctttagtttaattaggtcccatttgtcaatttttgctttcgttgggattgcttttggcatcttcctcatgaaatctttgccttttcctatgtcctaaatggtattacctaggttgtcttccagggtttttatagttttgggttttacatttaagtccttaatccatcttgagttgatttttgtatatggtgaaaggaaggggtcccatttcaatcttctgcacatggctagccacttctcctagcaccacttattgaatagggtatcctttcaccattgcttgtttttgtcagttttgctgaagatcagatggttgtaggtgtgcaaccttatttctgggtaacctattctgctccattagtctatgtactaatatcatgccgttttggttacggtatccctgtagtatagtttgaagttgagtagtgtgatacctccagctttgttctttttgcttaggattgccttggctatttgggctccttttttggttccataggaattttaaaataatttttatctagttctgtgaagaatgtcatttgcagtttgatgggaatagcattgaatctataaattgctttgggcattatggccattttaatgatatagattcttcctaaccatgagcatgggatgtttttccatttgtttgtgtcatctctgatttctttgagcagtgttttgtaattctcattgtacagatctttcaccttcctggttggctgtattcctaggtattttattctttctctgcctattgtcaatgggattgcattcctgatttggttcttggcttggctgttgttggttatatattttctttatccacttgttcattgatgaacacacttaggttgattccatatctttgttattgttaatagtgctgcaatatacataggagtgcaggtattccttagatatactgatttcttttcctgtggataaatactcagtagtgggattgctggatcatatggtagttctatttttagttttttcataaatcttcacactgttttccatagtggctatactaatttacattcacaacagtgtacatgagttcccttttctcctcatccttgccagcatctggttgttgttgtttttgtttgtttttgtctttttaatagtagccattctaaccaaggtaagattttttgtgtggttttaatttgtatttcccatttgattagtgatgttgagcattttttcatacacctattggcaatctgtatgtcttattttaagaaatttctattcatgttctttgcccactttttaacgggattatttgtttttgtttttgtttttgttttttattgagttgtttgagttccttgtatattctggatattagtcccttgttggatgaatagtttacaaatattttctgccattcaacaggttgtctcttcactctgttgattgtttcctttactgtgcagaagctttttggtttaatatagtctcacttgtctgtttttgtttttgttgcctgtgcttttgaagtcttagccataaaatctttgcctacactaatgtcctgaagtgcttcccctatgttttcttctagtaggtttatagtttcgagtcttatgtttaggtcttcaatccatctggagttcatttttgtatatgatgaaaaataggagtccagtttcatccttccgaatatggatatctaattttcccagcaccatttattgaagagggtgccctttccccagtgtatgtccttagaaatttttttgaaaataagttggctgtaaatatgtggatttatttctgggttcactattctgtcccattcatctatgtgtctgcctttatatgaatactgtgtcattttgattactatagcctggtgacacatcttgaagtcaggtagtatgatgcctccagctttgttctttttgctcagggttgctttggctacttggactctttattcattccaagtgaattttaggatttttttttctattttctgtgaaatatgacattggtattttgacaggaattgcatgaaatctgtagattgttttgagtagtatggtcattttaacaatattaattctttcaatccatgagcgtggggtgtctttccatttgtgtcctcttcaatacctttcatcagagatttccttgtaaaggtctttcacctccttggttaagtttattcctagatatttcagtagctactgtaaatgggattgccttcttgatttctctctcagctagatcaatattggtgcataaaaacactactgatttctgtacgttgattttatatcctgcaattttactgtatttaatgatcagatctaagaatttcttggtggagtctttaggtttgtcttgatataagctcatgacatatgcaaagaaggacaatttgacttccccctttccagtatggacctttctttttcctacttggttgctctgggtacgacttccagtaatacattgaataggagtgatgaaagtgtgcatccttgtcttgttccatttctcagaggaaaggttttcagcattttcccattcagtctgatttcagctgtgggtttgtcatacatagccttcattatgtcgaggtacaatccttctatgcctagtttgttgagagtttttattatgaagggatgctgacttttacccagtgatttttctgcgtctattgagatgatcatacagatttggtgttcattctgttgatgcaatgtattacatttattgatttgcatatgttgaaccattcttgcatccctgggataaatcccacttgatcatggtgtatcttttggatagattgtaggatacagattgctagtattttgttgaggacttttgcatctatgttcatcatggatatttgcctgtagttttttgttgttgttgcatccttgtctggttttgctgtcagagcaatgctggcatcatagaatgagttagggagaattccctccccttgatatttttggaatagtttgaggagaattggtattagttcttctttgtgagtttggtagaattcagcagtgaagcattcagtcctagacttttatttgttgaaatactttttattactgattcaatctcattactcattattggtctgtttaggttttcaatttcttcctgattaaattttggtaggttgcatgcctccaggaatttatccattttctcaaggttttccagtttgttatcatccagttgttcataacagtctctgatgatctttcatttttttcttttttgagacagggcctcactctgtcacccaggctggagtacagtggttcactcttggctcactgcaacctctgtttcctgggttcaagcaattatcctgcctcagcctcccgagtagatgggattataggtgtgtgccaccacacccagctaatttttgtattttcaatagagacaagagtttcaccatgttgccctggctggtcttgaactcctgacctcaaatggtccacccgccttggcctcccaaagtgtgggattacaggaatgagccaccgtgccaggccgatttttcatatttctgtggtatcaattgtaatgtctcctttcttatttctgattttatttatttagattttctctcttttttggttcatctagctagtggtttattgattttatcttttgaaaaaatttattttgttgttcttttgtgtttttctttagtctgtttcatttagttctgctctgatcttcattattgctttccttctactaatttgggctttggtttgctcttgcttttctagttctttgaggtgcatcattagattgtttatttgacatccttctacttttttgatattggcagttatttctataaacttccctcttaacattgctttttctgtttcccacagattttggtatgttttgtttcaatttcatttgtgtcaagaattttttaaatttcctccttaatttcttctttgacccaatggtcattcgggagcatgttgtttaatttccaggtatttgtatagtttccaaagttcctcttgttattgatttctaattaaactcctttgtggcctgagaagatatttgatatgattttgatattctaaatttttttgagacttgttttgtatcctaatgtataatctatcctggagaatgttccatgtgctgatgagaagaatgtgtattctatagctgttggatgaaatgttctataaatctctgttatgtacatttggtctcaagtgaagtttaaattcagtgtttctttgttaatcttccctctagatcatctgtctaatactgacagtagggtgttcaagttctcacctattttcgtactggagtctatctctctgtttagttgtaatagtatttgtcttggtgctttggtgtcagaagcatatatgtttagaattgctatatagtactattagattaatccctttatcattatgtaatgaccttctttgtctcctttcactgtttttgacttaagtctgtttttttctgacataagtatagctactcctgcttgctttaaatttttgtttgcacagaatgtctttttccatccctttactttgaccctatatgtacatttacatctgaggtgagtttcttgtaggcagcatatagctggatcattttttaaatccattcagccagtctatatttttcttttgtttttgttgttgttgttgttgttgttgttgttgttttattgaaacaaagtctcgctctgttgcccaggctggagtgcagtagtgcgaactcagctcactgcaagctccacctcctgggttcgccattctcctggctcagcctcccaagtagctgggactacagacacccgccaccacgcccggctaatttttttgtatttttagtagagacgaagtttcaccatgttagccaggatggtctcgatctcctgacctcgtgatcctcctgccttggcctcccaaagtgctgggattacaggcatgagccaccgcgcctggcccagtctatatcttttaagtagaaagtttaatctatttatattcaaagttattattaatatttgaaggctcatttctgtcattttattaattgatttctgcttattttgcatatactttgcttctttcttcctctcttactgcttatcattgtggtttgatggttttctgtagtggaaacatttgagtcccttctcttcctcatttgtgtgtttgctctatcagtgggttttatactttcatgtattttcattatggtatatactctcctttttcttccaggtgtaagactcccttaagcattttttatatggctagtctagcagctattaattatttcagcttttgttatttctccttcatttatgaaaggcaactttcttcagtatagtatccttggttgccaggtgtttttttgttttgttttgttttgttttgttttttcagaactttgagtttagcagcccattctctcctggcctataacatttctgctgagaaattcactgtcagtctaatgggaactcccatcagactaagtgactagatgcttttctcttgctatttttagaattatctttgacttttgacagtttgactacaatgtgccatggagaagacctttataaagatttagggatctctgagcttcctgtatttgtatgtctaaatcttttgctacatctggaaagttttcagctattattttgttaaataggttttttatcactttcattttctcttcaccttctgggacactaaaaattcacattattggatcactttacagtgtcctatatgtcatagactttgtttattcttttttagtattttttcatttttgtctgactgggttatttcaatgacttgtcttcaacttctaaaattatttcttctgcttgatctagtctagtgttgaatctttcaaatgtattttatatttcattcaatgaattattcagctttagaatttctatgtgtttttctttttattttagctatctctttggtaaatttctcactcatatcctgcattgtttttctgatttatttgtattgttgttctgatttctgtgttctcttgtatctcactaaacttctttagtatcattattgtgaatttttctgggatttcataaatttctttttgattgggatctattgctggagaagtattgtgttcctttggaggcaatgtattttttttactttttcgtactttttgtgtccttgcattgatatctgcacatttgatgtaacagttacttcttctaatattttaaatttgcttttgtaggggaggactttttcctgaagatttacctatggtgttggttgggtaggacactttggctttgattctcggtatgtgcaataatatagtctccatgatgatttatctggctgtaaacagcatcagtagtatttgtgatttccttggtggtataaggtgcagttgttggtggaggctgtggtgaagtttttctggggatggggacatcagatgggccagttcttgggcaccagtggtagtagcaacaggtcaaacatacctgtccatgggcctcagggaagtgtacatgggcaccagtgttagtgggtctagtcaggctgattcttgggccctccaggcagcttgctcagatgccagcagcggcagtggtgggccggatgggtgggtgggtccttggagccctagcaattgggcatagcataggcaatggttgtagcagaggcaacacaatcctctgactcccaagtgctttgtcctggtgatgatggtggctgcaataggctaggccagccattcttgaggcctgtaggtagcacatgcaggtgagtcccagccatggtggtagtgacaagctaagtcagcctgtcctcaggttcccaggaggagtgctaagttccaacggtggtgaatggggcagagcaatctccaggcccctggacagtttactcaggcactgggaattgaggggagtagagccaggccatctggtggtgcacgtgggtgctggctgtggtaggcaggggcgaggtgatccctagatccccagtagaatgctcaggttggggctgaagtggctgtgctgcagccctactgctggagaaggcatggttgctttcagtggcagcagccataaacaggtagcttgggagcatgtgctttggccctgatataagcaggggagcctttcctcagggctcttttaaatatgtagcagcactgctactaggagtgacagggtcactgccaatgactcgtgtttcgccctggcagcagcagccaacaataaagcccagccctgcattcaaggtattcaaccccattgatggggttccaaggatgtggaaatgcaggggctgttgggcccctggtcaggatgtagtctgatgggggctgggctctcaaaatggcaccctgctgtggctgcttaggactctggggtatgcaggaaccactcaagctccctctctagagaaatgccattatacaatctctaggcaactccttcaaagcccatgtgggttgagggctctcccagggctaggattgcaggagtccacattgagaatatggactgctaggggtctctcacttgtcctttacccatgctggggcacctcttcaggcttccagatgatcccagccaagcaggctaccttacttctttctcattccttgagtcagatgtttcctgtcacttctctattgaattccagcattctctcttaggaaatatattcaaagtgtgattatctactcactattttatttcttctttgtatgggaggtgagttctggatgcctctattcagccatcttgaggcccctttcattggagttttatcctcagcattttatttgaatataagtttaaggagtgagaatggagagttgggtaacagttaggcttaaaccccaatggtagcctctgctagactttctacacaagtgaggctctctgctgaatttattacagggggaataaaatgggagaaaacactgagtcttattttccctcatgaagaaagcctttgggagaaaactcatcatgatgaattaatgttaatttttaaaatactttgtggttatcagaatgaaggagtgattcccagtgatgtaaactatttgactctttgtccagtctcattgactcataccccacttatgaaaagaagaggaaggggctgtaagtaataactgaaaaagctgtttcactaaaatgttttctaagactgtcttgttatccatggtaaagaaatgtaaaattaagagaagcacggatggaggtgctgactctacagatattgtttatgtttagtttgtgaataaattcaccaagctatacacgtaaagatatgtgcacttctctatacaattattacacttcaataaaaccttttttagactgttaaaaaagagaggaaacattaaagaatggatatggatttgggtaataaaggtgtatgcatttatcaaaactcatcaagtacatttcattgatgtaaattttacctcaaaaaatgaagaaagaaaaagaactgtaaacaaacactgaattttagttaatgacctgcatgctgaaatctttaagggtgaagtatactaatgtctccaacttactttgaaatgaaccccaaagtgaaatggtttgatagatgagtagaaaaataattgtagaatctgagtgtgactatgtgggtattcactgtataattctttctatttttctgtatgtttgatcatttttatattaaaatgttggagggttctaaagaagggaggaagaattctacccatctgtttatgaatagaaatgatggcttcagctcattgaagaccctaacacattaatagtaattagcaggatatagttatccagcaaaagtagcagcaattcctaggctgctacttgtcccagaagataataatgcccaatggagctggcagagctcacatggagatactcctttcacaaggcttaggtggcagaagcaccagatggtagccacagcaaattagaagaaagtggtggatactatgtagtagttgttaagattcatttattgtctgggtgcagtggctcatgcctgtaatcccagcactttgggaggccgaggcaggcagatcacttgaggtcaggagttcgagaccagccaggccaacatggtgaaaccccatctctaccaaaaatacaaaacttgggagggcatggtggcatgcgcctgtaatcccagctacttgggaggctgaggcacgagaatcgcttgaacccggggggtggtgtggaggttgcagtgagccgagatcacaccactgcactccagcctgggcgacacagcgagactctgcactccagcctgggtaacagagcgagattctatctcaaaaaaaaaagaaagattcatttatggatacatgtcagataccctgggatttgtaccatcatatacaaccaagctgtcagtttcactcattggcatttctgtaaatcacaaatttctaaagtactcatcactagaatctgaagcaatccactgtgtttatcatgttaggctgaagaaaagtttgctataacacccatcgggtcaaactttttcaacattttccaattacataaagcattgtatttgtacgcaatgaagaaagactaaaaatacaggtaaatgaaacaaatcaaaatatttgcttaaagttggcacctatgtttgtccatgtggcagccacattacataaagacacatgaactaaaatggaagaatgcatattttctccattatgcctgcagtttcagggacatagtgccctaacaattaatttcatattcaaggctgtcttgattgctaataaatgatcctagggaaggagctttcacattatccttagcactctaacagatatggtgagtaagaacatacaacttcccacaatcatgatcctttcaatgtctttccagggttttactgatattttactggaaagagtcatgcatgggggagccaacattacaggtttccagattgtcaacaatgaaaaccctatggttcagcagttcatacagcgctgggtgaggctggatgaaagggaattccctgaagccaagaatgcaccactaaaggtaatgttccatggcatgtaaaaaacctaaggccagcttttcaaagtatctcagtatgatctttatacactaacagtcatcttatgatcaagtgattttcctcagaagtgattcaaagatgccacaaaacaactgcaggtgatgctattgcatttgaaaactaaacccctgaataaagaagctgttgagaatgagatcttttaaaatccagtgcttggaaataagttaacttaatttttaatgaattttatttgtaatatgcctataacaatttacagtattacaagaacctgagccaggcaaagggtgggggcagtgggaacaggtaaggaagactgatagtctgaaacagaaaattagattttacattatttatgtgattgctttgttttaataagttccatgaatctcagtacacccaagtgaattagggtctaataaagagtgtacattgcctatatgtatattgaatggaaatgttttcctgcctgctaaagtatcttagaaaataattaaattacctagattgctcattttcacaaaatcaagataagaatattaaaagcagaaagtcatggttaaaaatgcacatttttcatgtgttcccctatggctagaaatcctattatttaaaaaccaggaattaaacagataaattaggggaaagttattcatgctacacaaaggacccttcaaatatatttttaagtaaatcgttccctcagtgcattgattcaaatatgaaactgactttaaattcttcctgatatagtgaaagtatgtaccatagctgtggtacgaaataggggatcaaaatagagtcaagaccctttcctagaaaaggaaaaggggaaaagatcttcctcattgtttcaagatactcatcctcacatccttcctccctggcaagaatagaataggggataacaggccgggcatggtagcatgcgcctgtaatcccagacacttgggtggcggaggcaggagaatggcttgaacccgtgcagcagaggttgcagtgagccgagatcatgccactgcactccagcctgggctggactccatctcaaaataataataataataataataataataataataatgatgataagggagaacagtaggcaacacagaccagaaaaaagatatagagatacattctgtaccatctatgcagctccaccttaaatgggttacgtcagaacataatacaagtgaaatcttactttatgcaattggtgtgttctagaaaagttatgggttaaacatacttttttcgttcagttaagccacttactagttaaatggtaccctgtggttgtagcgattatgcctgccagatttttccaagatagtcttattttaaaacattctgttttagggtccgatcaagtgtcctaatttgctttagtaaatatggtcacaatccctatgatgaatcctttgtaatcaaaaaaatttttaatgtactaaactgatatttactggaaaataatcccaagtgaattaggctctaatacagagtgtatgttgcctacacatatattgaatggaaatgttttcctgcttgctaaagtatttttgaaaataattagattacctaagttgcccattttcatagaaatcaagataaaaatatcaaaagcataaagtcatggttcaaatgcatattgcattacatttaggtgagcttattcaaatttagatttttcataaaactgcctacccacactgctttatgatctttagatttaccaggtaataggtagaagagagaaattcatttattcaatattttagtgggttagtagtctggcacctacaatgtgccagacactgtgttaggcatgagaaaatgagtaatggtaagaagtatgaaaagggtactgaagagtagtttatgcctgtgctgaagttgcagagccatacaaaagagaaggaagccaatctcagctctggactattcattgataacacttggtgtgtataatgtaaagttctagaacccactgagaagaaatgttcatgcttataagtaaaaccctttaaataactttaaaaaattgaatatttgaatagatgttacaacttacagattacttttgcttagtattggtcattatagaaccttgcacaatatcaatcaaaccaaaagcccactttaaaaattgatgtataatatttttgattaggaaataaaattgtctacagattaaaaatcctgataatttactctataaacattttcttttagggcttgggagggtattctcacccattggtaagtagaaactgaataaagcaaaaattaaatagctcctttggcatggtttggaaaggactacattaagattgctgacaatttatgcagtcagctgaaaaaatcatcaccatgttggcttcatgtattgcaaagatgtgcagacacaaagatttttcttcatgaaagaacatatgtcccctgttacagtcacacttgatgatttgcttctgaaagacaagtaacgtgagaaaagtcagaaaagctaattgatagttgtagaggcaataatctattcactcccaattgtatttggacatactgtactagagagagagaactccccctgggacattttgctacatttttaaaaagtcaacaacattctacattctaccagtatttgtcacccctgcaaaacaggggccagcttattttaaccatagtttgttatgttaattcatttaatgaaaaagcatccaccatttcaaattgcagataatcaaatcccttgtatttagtgactgacctcatccctagtagagcatatcaatatatccaaggaatagaaagtgttcttgcctgcaagaggtggcatcatgaagtattgcctatgaattgtcaacatcatcagatttaaaactcaataataattgaaattttctacaattgaaaaacagctttggtttttgctacccccaggaaacaaaaactcatttattgctggccagaagtcccacctcgccagaaacatggtccagacagaaatgattaatgttctcctccaaattaatttcaagctgtctaacttagctatttccattttcccctaagtaaacaccagatctctacaaacagcagtaacccagtcttgctttaggatgtgctgtttcctctccagtctatacatgccatcctttaacttcacacatatttcttcctctataaaggacacagccttttggtagtcactaactcagtataaaaaagaaacagtattgagagcaagagagagattgccttgagccatttgattgtaataattgtaacacatgcacacatgaggtaagaactatcactgtagaatgaatcgaattcaggcttgcccagagagatctcttaaataaataggggggtgactgcatagaacaataggtagaaatgaatgaaaattataagaaacaaggcaaattttgagggtatcatttatcatgatatcttgtttttcatgcatccatttcagtatacatctgcattgacacacgacgcaatactggtcatagcagaagctttccgctacctgaggaggcagcgagtagatgtgtcccggagaggaagtgctggagactgcttagcaaatcctgctgtgccctggagtcaaggaattgatattgagagagctctgaaaatggtaaagaccacaatgggttattggggtggaagaaacttataaagacataaaaaagatgagaccttgatcttgagagaagacatactaaaaggaataggaccagattatgtagaatctcagagtatgcaaagaggataagtatagccatttctataaatcatccaaacctagaaatctaaaagttggaggtcatttcttgaagcttgaaaaaaaaagagataaatttagggcaaatgaatttttggttatgcactatactatggctagtaaatgaaacttagtactctcaaaagttacagattgaatatataaatagcttcaaaaaattcaaagctttcaaacatatgacattctttagggagattagaatattttataagatgttcctaacttcaagatagacattacaaaggacagcatcctctggctcatcagacaaatgattagcctagacaggctgtggaacttagccagtgtgatagtatttctgttgtcaaaaagaacactcatgctattctacaggatgaaatgcaggaacatgatacatttctaggtctacttaagaagcttttgcctaatgctgcaaagaaaaagcctaaagaaaagtaaaaggaatcaatggatagacagtcaaataggtcacttgtttttagtatttgctgggtaggagatcatttaaggcttcaagcaatgtcctttgaacagatttcattatttataccagaagtagcatcacccattcattgcagttttccaagcaagagctctgtcctgaatattttgctttatgctacatgtgcctgcatgtattaaaatgagctttcaagagtacaagaatctcttatttctacttatttagttatcctgatgtttgggacatccaaatcaacaaagagatgggcaaagataagataattctgtgtgcaacccagcaaggaagaacttgtaacggcctcataacatacatcattttgtgtagctggctctcttattgatgccttaaatttgccaagttggaagcattcaatcaaaaggggttagtagcccttgtgtctctcttcaagaaagagatatgactcattttcccatcatgcagatttttatgtcattatgtcagttccttaacaaatgccctaagtgtagttttatggaggtagcactgtacaattttgaagagcagttaattaaattcaaccttcatagcagttacaagatttgtattgtcaggtgaaacataatgatgagtgaaatataaaactccctcagagtgaatcaaaaggagtttccatcaacaaaacctcaaggggcaagagccagcatctccaattgactccctattcatgacacaaataactaccttcccaaatagaaaactggctatcagaatgaaggataagataccaattgggctaggaaaaaaaaatagattgatcatactactgcacagaaaagtttctgcatgtctacctcactgataaagctcaagttataagccaggtaaccttcctccccaggccctaatgaccagacactcaaccaaaacaatacattacctttctataggacaatctctattgctccagagaggctggaaggcatctattttttccaaaagtagacagtgcctcagtaaaactgctctactcagagggactgtaagggaggctagtctgaagtactaaatgttttactacattaaaagaaatcccattttatttgaattaattaaaattgagactgcataatgtaaagcatccctcattgtgactagcacatagttgtttctcaataaattattctcttccttcaaaagaaatctggcaaacaaaatcattgcctggcagaggctcctaaggggcctgttttaatgaataaataagcacaacattcattcagtaaatatttattgagcacccatgactatgtatcaggctccatattagtatgcaagcaagaaataagatgaggagtgcacacatttaaattgttaatatgtaaacaaatgctttaaaatatcttaaagccacttgcaaattgggtaatcattctcctcacaatctgcaaataatgcaaagatcagcccagcacagtctactgacatatctgtcacagattctaagtctttgagacttgttcaatcaacatttattaaggatctgctctatcccaggcacaacattagttgctgagaacagaggtaaaaaaatgtctctcatctcgagatgctcctaatccagtaggaaagttagaaacacatagattataaaaatgttatgtctaagtcttgcacaggatgctatgaattaaagaagggatcccagacgggatgcggggaaactgtcactaacattcaatactggaccacatccttaaaaatagatttctctgagtggtagtccaattctacttctggtcaccaaacgttcaaatcatgcgtctggaatctgttggactatgccttgactattctccagttcatatatcatattcagataggttgggtctttagaaatagacaactcttaatgagacttaaagccctagctattttcactaatgaaggctttccttaataagttcctattgcccttgtctctgccctgtctaactcttctatcagaattcagtgctcaaaatagagtataaagagcccttcatgctcacattatgtatcagtctcatcccactggataagtaatttctatctcaacaaaggtcttttctctaactagaagtgtgatgccaccttctctgcaagcctaagctaacaatagtgcttaggtttgttggatcagttggacaatcatcttgttttcagttcatcagattggagcattttcctttcaacaggaattccacagtctcctactggtggtgaacaagcccctttccctttaaaaaatgttccctaatatttgacaacatttttctttctgcaacacaaacccactgccacctctgacttgtttgacagcttgtcattttccataagtgatgaaaaacaattccattctttcatactaggaaaatgagatatattctttctctttgaagcaaagtctttgacctttacttgccagatgagtaatgcaagtggttagcaacaattatttatatttgtagagggtatttcatccagtgtccctgcactgtaaaataggtaaagaatctatctaccctgaagagatggcctcttgctaattcataatactgagcccaggcccaggaaaaattgttccatacatgaaatcggcatttggcatcccaaacaagtgttctggcttccagtacttctacatttcttgtctagtgctccatactcctgaccccttaggcttaataaatttcatcagtctttggattatccctctatggcttagctctcttgtctgttacctgtctgtagctgagtgtgggttaaataagagggaaagctcatccctgtcactgtagtagctggcaaatgtgtaaccctctcaagaaacagaactaaatccattttggttaataataattaatatagctagcatgtattctgatgcttaatagatgccacatactgttctaaacattacgtttatatgtgtgtgtgtatatatatatatatatatatcttctctaatcttcccaataactctgaaagatagatactactaggattttcaatcttacagattaagacactggggtaaaaaagcattaagaacatgccgaaggtcattcaattaataattgaagctacgatatgagtccaggtgtaacagtgcccatgctgctgaaaccagattatgttcagatatgggaaatattaagataagacacagccatggcccccaaggaactcagtttagaatacattaccctagttaagggggtagcctgcagagtatttttaggaaggggctagtggaaatttcaggtccttgaaaaagtggcggtagagccctcattatattatataagtaacagcatcttacacctactcaatgcttcaaaactaaaaggcatgccaagaaaatactgtggaggaaatgaagatcttgtatagactcgatctggtggatagagctcaatgacttgcaataataattcttcaagattccaagatctgtcagcagacctcatcccagagacttagaaggcaataatgccgtgctatttttaaattttaaattttccctttctaccaggtgcaagtacaaggaatgactggaaatattcaatttgacacttatggacgtaggacaaattataccatcgatgtgtatgaaatgaaagtcagtggctctcgaaaagtaagtaaccaaaacagacatttaaagaaaaggactcttgaaagaggacagcatttggatgtaagaaaataagtattattattttacaaaatatcagtaaggatgagtgggagatgggaacctccaggatgaaggaatagcacacctatgtgtcagtgttgggggtcctggtgggaattacaagacccggggagacaggatgtcaatccttatagagctcaagaaagttttgttccacaacagcacttcaatttcatgcagtacttttctgagggaaaaataggcatccaggtcaaatgtcttctctttctaggctggctactggaatgagtatgaaaggtttgtgcctttctcagatcagcaaatcagcaatgacagtgcatcctcagagaatcggaccatagtagtgactaccattctggtaagtgtgaacagaaggtaggtgggctttctgtccagcaagacttccgttttctgaaaagtatttttccaccagtagaaaagacctcaagttcaaacagtaaaaacttccaacagggaagctcaggaaactctcaaagtatcttgccatgatgatgaacagaatgtcatttaacaaaaagagagaaagaaaaagaataggaatttagaacagttttagattatcattttcctctttctccccgcctccatgcccgcccgcataggactgatgcttcatctggacttgaaacctaattcttcattgtgggggaagcagcattgtgtggaggagagagtacattaggattctaaaattaggtctaccactaacctgtaaaactgtgcaagtcacaacttctctgagcctcaggttgttgtttcttcatttatgaaaggggtataataataatcacctacccatgtcataagcccgtttcaaggcacagttcactacacgaagaagttttctgcaaaactcaaagcacttaaaatgtgagatggtattctcatttagttttaaaacacttttctagaagctggtttgtttttactgaatgaagtacaaacctgggttaaaaacaaatacatctctaggtgtgaaagtatgactaactgaatggagactaggctgaagtttgcctttcatctaagcatacatatcaaatactccctttgtcttaagtactatactaggccctggagatataaaaatgtaaatgccacggacgctgacctcacagggatcacaatgcttccccagggctttgcctcaactacctgcaattcctacataataaatcttgagaaatgaaaggcacttcaccatcatgtaactaagtctgccaaatttgatgaaatcaaagacttgataggtgaaaactgggccatctttcaaactctcaaaaagaactgaaatccttctctgcttccttaaattaccagttaaggactccccctaccaaaaaaaaaaaaaaaaaagtgacccaatgaatactcaattaaagctcttctgtttactaagtaacaatttaaaggcctttttcacataccaaacctcaatagtcacagaggggaaaaattattgcatttatcttctcttagaaaaatgtataggagtaatccttttatcttgcttctggtcccaaaggaatcaccatatgtaatgtacaagaagaaccatgagcaactggaaggaaatgaacgatatgaaggctattgtgtagacctagcctatgaaatagccaaacatgtaaggatcaaatacaaattgtccatcgttggtgacgggaaatatggtgcaagggatccagagactaaaatatggaacggcatggttggggaacttgtctatggggtgagttttttccaattctgttttcatttattctgtgctttccaattaacaaagaagagagaagatttaattttcaagtgcagtgtttatccaattgtatagtttacatatagtctacaagaaaaatatattcttctacagttgcgctctgtaaaggtaggttgtcagtagtatcctttggacaacaggattattttactaaaaggaaaatagaattgggggattttatttggcaacattaagcacagcctgccctctatttaaaatctgttccttctgtgttctctagctcaggcagcagaattaccacccacatagttgcctaagcaactttgcctaagcaacctcatcatctttcctcattgttcccctcttatctagtcagtcaccatgtcctatgaattctacttttaagtctctcaaatctagacacactcttcacccccaccatcgtcaccttaattagggttcttaacatctatcagtcatttaacttgttaccctgcgtctgttcttaccctggcaaattagatctccacattactgtaatttcccactttaacaatcaggatgaaattcaaattccttcacatggcaaataaggcactttataatctagcacccgcctacctctctagcttcatcctgtactctttccccctcacacccaatgttccagctatagaaaagtaagtgttgttccctgaaggtgctgagctctcacttagtataagcctggaagtacttttgtgtctcttcagcagctaataccacctactagtcctctgaaacacagcagtgatacttgtttcagaaaaccttctctattcgcatctacttgcctgcagtctgggttaggtacccctgctttttgcttccttcctttccatattcatatagtacttctaagtctgtattgtaatgatccatttacaagttccactgttctactagactatgaactcctcgaggacagaagatgtagctgattcatttcaatatcacacagtctgaaacatagacattcaataaatccttgctgaattaatgaatgaaaaatgaacagaatggctctgccaggggcttatctatagtccaactgcaaaagaattaatatgggcaattagggcttttaagaaaggtacagtgatatcttcagagctcctggttcacttagtattaaatggttttggcctctgattgtgaatgacagatcttgggcagcttaatgaggcacatgtaaataagcagaactggacagaaaaactgcccatgcagtaaaccggtcactagagaactaacccaagtgcagtgggtggtggcaaaggtttagttctaacaaacaaagattacctgtaataataactctctgtctagacaatatctacactaagtaaggggaagacagaggaatctaggaggtagagatactgagaagctccagctggcaagaagcaaacaaccaggttatttatttattggactgaggttcaggagaaggactctagtgcttgggatggaaaccagcaagaataaggtatagctctccaatcatatgagagtactggggtcactaaataagttcttggaacaggcctttgggaggaaccacaaagtcggaagctcatttctaaaaataagggcacagaaaggtaacaaaagcaaagctggaccccagatataaaaactggagcaccatcctctagtcagatgaacagcaaggcaacttgaacctcagcctccatctacgggcctggagccatcatctcctgtcttgggtcaagatcggtcctgggaactgaggcagggctaagtggcagatgagattcaagtgaatccagcagtaagaaagagaagaatttccaacaccagtgcagagagggctgaacaagggtcagagcacccagtcatgatttctgaggaccctgagaagctctgaaccatcttgacatggctctaatcttttactttccaagttgttgataaggttttcttctctttcctgttcctcatctccccaacacttaggcttcaagaggtcttgtcttgcttacagctcacccttgctcttggcacattacctgatacatagtaaatgctcactttttgctttaatgaatcaatgcctggcatacagtaatgcctaagccagtattcattaaattgagttcatggtgggatataatcttgtaatatcattactatttctattactactactactattaccactactattactactactactgccattattagctaccatttgttgcatatttactggctgccagatactgtactaagtgctcttatatgtaatttaatcctcacaacacgcctctggggaaggtgtcattattaaactctttctacatgtgagaaaattgaagcctagagaggtgaagtcacatgctaaagaccaaacagtttacagtgactatcttagtttgtttggactgctataataaaacaccataaactgggtcacttataaacaacaggaatttgtttttcacagttctggaggctgggaagtccaagatcaagggagattcattgtctcgtgagggccactttcaggctcatagatggtaccttcttcctgtgttctcacatgatggaaagggtaaggggtccctcttgggcctcttttataaggacactataagttccatttatgagggcttcactcccatgacctaatcacctcccaaagccccacttcctaataccatcaccttgggggttaggatttcaacatatgacttggttgcgggggggggggggacgtggggacacaaatattcaaactgtaacagtgatacaataactttaacccagatctttgactctgaagtccatgctttttaaccattacactatctgcccaacagctaaagtgtggtttcaggcccatcccattctgaaagatagttgaaatttattagaaaggcttatggtgccttagtcattctggagagaagagtgtttggcaacaacagcatggcaagaaatttaaggcgtaagtgtctttttattttatttattatttatttatttttgagacagagtcttgctctgtcaaccaggctagagtgcagtggcatgatcttggctcactgcaacctctgcctcccaggttcaagcgattctcctgcctcaagttcctgagtagctgggactacaggcacctgccaccttgcccagctaatattaaaaatattttttagtagagatggggtttcaccatgttggccaggttggtctcaaactcctgacctcaagtgatctacctgcctcggcctcctaaagtgccgggattacaggtgtgagtcaccacgcccaggctaaggtgtaagtttctactagcccaggttatccgatgtgagctataccatgaactctaccaccccatcacaactgaatgaccatatttctcctgtcactctctgtaaatagatcactgctctcctggcattgaggaagacattacacacagtgacatagagcaaggcagacttattgacattgttcagacaaagaccaattttctcactggatttgttttctcctccagcatgttccctgtactgcactcatttaatctccacatatctcttcctcattccaatttgtctacttgtgagtgagggagcttgagtattagagtccctcatttgtttagcaacttagatgccttctctccacttctgaatagtaaaagtgttcccataggaaccttcccatcttttccctttagttctttctactaaagacaaaagcaatagccggggaggctcttacagaaatgtcctcctccttcccctgcctaaaacaactttctgatgctttctgggcttataacaggaggtgattccagagaactacagcaaaccaacccatcggagaagactgccaaattccattttcctctaaaacctgtggctatgaaaaatatacattcttatcatgcttggagtaaaagctctctgttaaagaggatgatctcatgagctaaatgtgtcttcatcttcatttagaagttttagtcttttggcattgggaagttttcaacttctctatcaatgacagaaatggagaaaaatgaaaacacaggctttcatttctggcaggcctggcctcttgtggtttgcaagttgctttaaaaaaagaagagcagaaaacccctaatgatttctctaagttcttaatgagcaaaaagatggagaacagggaaatatttcttgcagtgaacatgaaacctatacagataggcactgctttatcttaagggtatttctcttatgcttttagtatgtaaaacagagcagagtggaaagaatgaaaaaaatcagagatgaagaaagctctgcaagggagatttcagtgtcagtcataaagtttcaagaaagaatcaaaatgaattaaatttgctaaagaataaggaagccaatcagcctcttttcagatgatttataaataggtttttttctaaggaaattcaaatcaggttgatgttggggcaccttgtatctctaagaaggctatttttgaaacaaacctcagtaggacacaatgtgccccattatgtaagcccttcagaacatcatggacttgaaactgtccacctgcttttagcagttttgattttgagctggatgtctgtaacaccactacatggtaacagtcccagatcaaatggcttacagaccacaagtttttatggcttccaaataccatatgttttgagggcacttaaaaacagcattttttgctagcagggctcttaaacatccttaatcctaccttaccattcattttttacaaatgcatatggggaccagccaagatcagacatcagaactgcccctcaggtaatcaggaatccaaagcctgataaaggacacaggtacagcagtggcagcaggattggacaaagtcacaaaatcccacaacttggcaacacaggttttgtgactcatggtctagtgctctgtccactgggtcacactggctcagttcactaaacttgtgagattatggaaatattggtgttgtatcaatcagatacagcatccccacctggctctaaggggcttacaatctagttggattataaacttttccatctaagatacttattttgctatttttcatccaagatactcatcctgcttatttatggcctccaggataatgtaatccacatttctagttatcactcgaaatatttgaaaacccaatatagacagctgggggttctgcccttagagaggagatatgatctaagggaaaaagagagtcaggagaaaggctaaaaggaaattgaggccccaattaacagaacacctcccagtgggcaactgccatgttccttatgttcctagcagttacaactaaggataaagaagaagggggttgctttgggaaaggcttgacaagctgctgcttaaattgcttcttctgacttagaagatagcagagagcctgggggtagtaatggggctgcagggatggttgattataggtcatattccctgggtgtccccagactccttcacgctcccaggacacatggcaactttacagatactatttgcactgacattgctctgcctagaagaaattatctcttaggtcgtcactatcctaagctggattcattttccattaagaaaggcagagagtcgatttgtccttccagctaaaaggcagagaagcaagggtccagtaacagatgccagatattcttcaggtgattatactgggctttggcagaagggctgatgatttgataaaagtcccccctccttcaaatgatgcatgtaacctccaggaaggagcattaaggacacatgaagtatgccattcgaagcagaaagagtggggaaaatatttccagctaaacgtagtctcacaaggccttcatccagctacagagacacttttttatcttgatattgtctttaactctctcagctccccaaggacaaggagccctaatcaatagatccagtcggggatacctgttctggataaagaaattaggatattctgttgtgacactgcttgttgttgcacagatttaaataagcctcattcttttctccagatcttaacaattgcagacagtaaacatcccatagagtactgccaataaatcagtttaagtcttgtcccccagcacacagcaattatattcctattgtctagcttgattctgccccactcctgttttcaacacatatcaactttccaaaggaaatgtctgccaaaggcaactagagccctgtggttgatacagggacaaagggtcaggtcatgtctgcttcttctcttggataacatatagtacattatgattacacatcaatacattgtctacttcctctctcctgtccccttccctgctttcagaaagtgttttaaaatggtgtctgacaagctcctgctcattcgtagtctcatggtgggttacaagttttgtatcagataatcagatgaaaattcttaaagatataacaagcttgcaatctcaaagagattaaaattacgtttaaagtcagtgtcatctctggctaaaacctgtcagattcttaagtgcatcagccctacacatatgagtttgttggtttttaagttttataacatttacaactttggcaacccacctatgaaaaggattataaatcccctcaagctaaatcctctccaataatgcagttgctccatgtttgcaactggtgagtggaaaattcaaacctaattcagtgtgtttactgagcccacacagccacatttaggctgcttgattaaaatcctttaagtagtcaagatgcaagcaaaagtactagtaaactcttactctgtgctctttccatttgcttgattttgtctgtcaattggagcaccctcataccactactacacacttacccacctaggtttctgaaaataacttgcctactgctattaccagtgcaagcagaggcttgaggacaactggccactggagtgattcaggacaccccaagagaggcacttcattgttgagtcagaatttcacctactccctaaccccatccataattcttaccactctctctcccagcctacagctggctttcataagagcagagactaggaaaggaattccatttgaggacttacctttttcagtttttcatcagtgtgggcctcctcaatctttaagttgccttgaaagtgacctctccctttaccttcttgctatggcaatcccaggagagctcaatggttatttttggatgctagttagttacagggtggagcatataactaactagtgttcaaaatacctactgagctctcttgggactgccataacatgattgccccacataaattatgccaagcaggtcctatgctctgaaataaccaattatcacaacaacttattttaacatttattttacgttcaggggtacatgtgcaggtttgtaatataagtaaattgcatatcacaggggtttggtggacaaaaaacaaccccataaaaaagtgggcaaaggacatgaacagacacttttcaaaagaaaacttacatgcggccaaaaactgcctgtgggaatagtggtgatagagggcaagggctttgccaaggctggctctgagctgacatgagttctgctgcttggtttcttaccaaacatacaagaaaggagaagagttgctaagtctcctaccaatagaagggaagggagctacagattctgcctcaagctgtccttgagccttcttccacctgccttcttccacctgctttttgctattcccttgcctttttccatctgtaataggtattttttaaggttcatcatggggaattctccttttggagtcaggtctacatcagtgaggtacaactgagcacagatttaatgccattcttgattgggagagcaccctccaaaacatagacaaattccacattttttgaaaaatctccttagaaagaaacaatccagaaaaaaaaaatacagaaatgccaggctgaggaaaaaaaaaggcagtgcctaagggaagcagatgattcttcctgttgtcttttgtgatttcagaagtacttcaaactaggaatggccttctttgggaatctgttcttttgatgaatgttcctgggaatcagacaacaaaaagtcctgctttatccatctggccacgtcttgttagtatttagtggtgcttaccatgtagtaggtgtttcaattaccaagtagggtttttttaaaggggtcaagattctcaaactcctttctgtaccttctagaaaagaccccaaattccttaaattcattccaaaataattttctcatgtgaatgccttcttatttcttttttctaaaacaaacaagtaacaatttctcctagaactatcttttagacttaaaagatgaaaaatactggttaaattaagtaattaaattcaaatgaaatcaagtgagaaatgatactagaggggtatttgcatgctctgagcaggagacagacatgttggcaaagagaggaagtggctttatctgtgaattctcttggcatgacaagactctttctaactgattcagactctctctgccaaaaaaaaaaaaaaaaaaaaaaaaaaaaaaaaaaaaaacactctgctagctttctggccaactcattctcctcagtacccttttttactatgaccaggtctagcttcaggcaaaagggtaaaatagatgaaaatttgtctttggctcccctctagttagtaacgtggaactggaaattcagaagttagccacgatgagatgagagttgaaaccacaggtaacaatactgagggatgaaagtgaaggacagaaccttaaagaacaaaccttcattgattatctcctaagacaagcactctgaatagtcccttggggtacaaaggtgcaccttaattgagagagcagaactaggaaggaaagtcaaagaaggaacattcagaaaggtaggaggagaacctgtagtctttcataacagagagctaaggaaagcacgtacatagtgcaaaaggccaatggcatcacacaagcagttaatgtctgaaggaagatatttgaatttagtagccaagtatataattcaagaaacaatttcagtaatttggaggggctggaaattaagtctcaggggtataaggagaaagtggtgttgatatcaagacagtaaagctgtcttttttcaataatactggtggtgttagggagggatgtaatgtggttaagaaggcagcaggatcaaaaggtgggaggagtgttttctgtttcatttttgtctgttagtaaataggattacctgaaaatgattttaagtgaataaaacagatcaatgattttcaaattatagcaagcattacaacaaactggaaggccacatgagtctcacgcctccacaatttctcatcccatacatctggggtggagcccgagaactggcatttctttttctttttcttttttattttttttattatactttaagttctagggtacacgtgcacaacgtgcaggtttgttacataggtatacatgtgccatgttggtttgctgcaccaatcaacacgtcatttacgttaggcatttttcctaatgctatccctcccccagccccccacccccgacaggccccagtgtgtggtgttcccccacctgtgaccatgtgttctcattgttcaactcccacctatgagtgagaacatgtggtgtttggttttctgtccttttgatagtttgctgagaatgatggcttccagcttcatccatgtccctgcaaaggacatgaactcatccttttttatggatgcatagtattccatggtgtatatgtgccacattttcttaatccagtctatcattgatggacatttgggttggttccaagtctttgctattgtgaatagtgccgcaataaacatacatgtgcatgtgtctttatagtagcatgacttataatcctttagatacatacccagtaatgggatcactgggtcaaatggtatttctagttctatattcttgaagaattgccacactgtcttccacgatggttgaactaatttacactcccaacaacagtgtaaaagcgttcctatttctccacatcctctccagcatctgttgtttcctgactttttaatgatcgccattctaactgtgtgagatggtatctcattgtggttttgatttgcatttctctgacgaccagtgatgatgagcattttttcatgtgtctgttgaactggcatttctaacaagttcccaggtgactcttttgctgctaatctaggacccatactttaagagccaccggaatagattagtggagaagggaaaaattaaagatgtaaaagagatagtagatagagctgggttttaagaagcgacagagaaatatagaatgcatggaataagttgatcaaatcttagaaagtgtcactttctgtgagatggaaacacacagaagaaatgtataaagatgctgcaatatgttgacaaagttgggggagggggaactgagatgatagagcttatatcaaatggcttccatcttctcagtaaagaaagaggcaagatcatctgcagagaggataggactgataaggattaggaactgggaaaagtttgaaataagcatcatccacagacacagaggagaatctacttttggggggatagatgggttaaattttagaaatgatgagtttgaaatggtggtgagcctccaaggtagatttgatcagtaggcagttggcttcaataaacccatgctttctgcaacttccactaggatgtaaaggatgtaggatgccctccatgcaggtaagtatttttgtctgttttgtctgtcttgttcactgcttcattcctagcacctagaatagtgcttggcacagaataaagactcaaatttgcattggaatgaacctaagaggggttggctaaggttgataattgcatataaaagtagtgtatagtagaaacctgcaagtatctatggagttagaacattatgttcattaagcaactgggttctggaatctgaagaccagggttctaatcccagcctctctgtgctttagtttctccatctccaacatgggaatggtgattgtaccaatatcaaggttactgtgagaattaaatgacatagtaagtgtaatgtgcttagcaaagtgcctcatatagaataagcactcaataaatgttagctagctgtttatcatctgcatttccctttcaactaattaaggagtattcctcaactggtttatcatatgtaattcaaaggagtaaaatttcatttctttgaaaatatactctatatcagacttccctacctctgccctttggtaggggtattgaggcattactgttctgaacatagaaaaaaaatgatcaaaacttgtgttttcacttcatatatgatataccatccaaaagcctttccttagtcagaaggatttttctttgtgtgcattttaaggcctggcttcagactatgacttactactgttggaaaggaacaattacagaaaacaaaagaaataaatgtagaaaatcctagtgcctattttcaagggattaatataaaaaacattgcctgcctttgcctaagttaattgtgcagtgcactactgacatttattttattgattcaatccatgtgagtgctacactgatattatcactagaaaatatagcttactacataaattgtgttctgacaactgttttacccttgttattgcccaggcaaaattctttcatgtttgcatatgtcatatacagtaatcaacaacttattttttaggcatctacagtttctttagtttagaatctgttgcagtgatacatacaaaaatagaagattgagtctctgccttcaaaaaacctgttttaaaagatatgctttcaaaaaaattcaagaataacataagacagcaaacacctaagaattaaactgctgtggccctgtgtggcacctcatggtgtagagtgaagcagatataagaagtataggatattatgcctgctccacaagaattttcagtcaagtgagggagataagacataagaacacgaaaattaaaataagaaaacgagagttaaatagtgacatgtcacaaggcagtacaagttgtattataaggtagcaaaaacacactattaggaaaagaaagcagagtcggttgctctaagccaatgtgtctcagaagacaaaaggccagcaccctttctttaatttaccatcaagttaaagcactttagaacccactgaatgctaccacttttctaacctaagcattgataattcaattggttgtaaagatttaggacttgatattttcaccaaagaagtatattaagcgacaaataactgattaaagactgtctctaaaagtcatatatgttttcttttttttcttttttttcagagagctgatatagctgttgctccactcactataacattggtccgtgaagaagtcatagatttttcaaagccattcatgagcctgggcatctccatcatgataaagaagcctcagaaatcaaaaccaggcgtattctcatttctggatcccctggcttatgaaatctggatgtgcattgtctttgcttacattggagtcagcgtagttcttttcctagtcagcaggttcagtccttatgaatggcacttggaagacaacaatgaagaacctcgtgacccacaaagtcctcctgatcctccaaatgaatttggaatatttaacagtctttggttttccttgggtgcctttatgcagcaaggatgtgatatttctccaaggtttgtttttgtggcatactcaatgcctcattgcattttatggtcatactccattcatgtacatatggtattcatccatctcaactccagatttttttcatttaacattccatcaaatgacagattatcatcaagccattgtgtttgcttatgtccatgaagtgagtgtgtcattggtgttgctttgaatgtctttcatgcatttctatggtattgtatatacattaaaacaaacatttgaactctggataaaggcaacattgccactaatattaatattattcagataaagtaaatactaaatcttcatcagatcaaacagacatggtttcctaattaattgtactgaagtgttttctcatttctaaagagattggatccagacaaaatttaaaagaacatagaactcttctttaaatccctcctaccttctcctttcaatgccctccctttttcattttgctctcagactgcctacaactatccattatagtatcccacccaagttttctagttaaaactataaaacttctcaaagaaaacataggagaatatctgttttaccttggtttggacaaagtgctcttagataagacacaaaaagcacaatccattaaaaatttgataaactggacttcatcaaaattcaaaaccttgcatttaaaaagacgtattaagaaaatgaaaaaaaaacccgactgggagaaaacattagtaaatcatgtgtctgataaaggacttgcatccagaatatataacacctcttacaactcaataaaaagaagacaatccaattttttaatggacaaaagatttgaatggacatttccccaaagaagatatataaatggctaataagcacaacaaaagatactcaacattgttggccattagggaaatgcaaattaaaaccacaatgagatgcttccatacatcctctagaatggctgcaatcaaaaagataggcaataccaagtgctgatgacaatgtagaacaactggaactttcatccactagtagtgggaatgcaaaatgctacagccacattggaaaatagcttggcagtttcttatcaagtaagataaatacttaaaatataacacagcaattctattcttagctatttacctaagagaaaggaaaacatattcacacaaaaagttatacacaaatgttcatagtaactttataatattaaaaaagtagaaacaacccaaatgtctatcaactcgtgaataaataaacaaaatattttatatctatatagtggaatactattcaccaattaaaaagaacagactactgacacatctataacatggatgaaccttaaaaatgttatgctgggccgggcgcggtgattcatgcctgttatcccagcactttgggaggccaaggcaggtggatcacctgaggtcaggatttcaagaccagcctggccaacatggtgaaaccccgtctctactaaaaatacaaaaaattagctgggcatggtggtgggcacttgtaatcccagctacatgagaggctgaggcagcagaatcacttgaacctgggaggcggagattgcagtgagccgaggttgcgccattgcactccagcctgggcaacaagagcaaaactcagtctcaaaaaaaaaaaaaaaaagttatgctaagtgaaataagccagatgcaaaaggccacatatcatgccatttgaatcccatttattgaatatctcatattgtatgattctatttgtccagaataggcagtctacagagacagaaagtacgttagttgttgccaagggcttgcagggagcagagaggggataatcagggccagtatcagggtgaggcaagtgagcctgagtaaagcaagtacagggatcacatccaagctttatttaaaattttgatattatgcattaattttttaaatattggactaaaattctatttatcttgattaatgagattttgatgcccctttaaactttgcatgtggggaagttgcctcacttgcctcatcctagtcctaggcctgccaggattaactgcaaatgagcatgaaggaactttttagggtgataaaaatgctctaaaattggatcgtgatgatagttgcacaactctacgtttactaaaatcactgatcgtacacttgtattggtgaattttatggtatgcaaattttatctaagaaaagcaaaatattgaacatgaatgtcctgagcctcacaaacttagtctaaacctaaacaaatatggcggtgaattcttaatcataatacattgtaggtgactgtaacatctttatattttgagacaaaaaagctgtaggttttggtaaacttgaacattaatccagatactgaccagagtcaattatacaaacacattagggattttcatgtgaaatataaagactcagaagagtcctaccatgtttttacagcatacttcattttgagattatccacttggaccataaaacatttaaaaagaagctttgcagcataactaattggtaaccatattcagcagctttttaaaatagtctgtatggggtatgcctcatttatcgaagtcacactttttttggcttttctcaatctgcttgattacattctccaaattatttcactccctgttccttttgtgcttagaatgtatgtcattttttgtattatctgggagtttattttgctagtttctttattttttgaaatgttcacttcaagagactatggtttctgaatgatcctataattaaatgatttttaacatggctggtaatctatgttgagacaatactaaagagtcattaaggctcaagattttattggtttctgtaagtgaattttcagaactaagtttgtggtatccccattggagtgctgcatactactctgcatactcaaaaagcactcttctcatttttagaagaatttatatatatattgattcattaagtaataacttaaagattatggcctgaaaatgacaagttgaacaggtttgttaatgtcttatagtagaatgtaagctgtggctcttctttggcactgagatatatcaaatgctttttttcaaagtatgtattttattatactaaactagacactgtcataaagagcaatggctttcaaaattttttttaccatgacccacagtaagaagtaaattttccatcacaactcagtatacacatatgtatataaccaaaggttcaccatactttacccttacaatgtgcaatgcactccgatattttctattgtgtcattttttttttaattctggttacaattcaacccagaaatagggcacacaacctacagaataacactagcctagagtaacaaatattattcttactatacttttaagtaataaattattgcctttatgagctctatgttttccaccatatgggtgatccctcctccaatattgtcttttgtgtgtctttcgaaataaattatacctttaagcattttaataaaatgttatgcttcttagcatatttctgatatatactagtgaagaggaaacatgtttctccttgtcttgagagctctattcattatatgtttgtgctcaattgtataacagcaatcactgtgatgtttctagaactattaacagatttagaaatttctgataataacacagttgttactcta

SEQ ID NO: 1288 - DNA, 236979 bp, mus musculus; identical to SEQ ID NO: 1287

SEQ ID NO: 1289 - DNA, 277 bp, mus musculus
atccgggcttctgctactagtgagaggaagatggcggccgcggctgtggtggttcccgcagagtggataaagaactgggagaaatcagggagaggcgaattgtgagtgttcgggccggaggcaggcgcactgccgggccgggccagggcgtcagctgcactctcacctgtagtgggaggttgagggggaaagatgtaccccctcccccacccgggcggcgggcgtggatggtcgtctaggagtttcgaactcggggagaggtgctgtttaccgccgc

SEQ ID NO: 1290 - DNA, 18497 bp, mus musculus; identical to SEQ ID NO: 211

SEQ ID NO: 1291 - DNA, 77793 bp, mus musculus
ctgagcccagcagcctgatcccagcaccccccgccacctccctcctcccgcttcgcccgcttccccggcggcgtggagaagagcaaagttgcgacagcggccgggggctctgcccaggtaaagggggcgccgtgaggcgggggtggtgggggaacggtgcggccctgcggcgggggcggggggaggataaagaaacttgcttcccgcggcccccaccccgcgtgggttccgatcttgcgtggaacgagcccgcgtggcgagtcgcggcaacactgccgggaccgaggccggcacctggacccggacccggaccgcgcgcttgggccggctcggcgggcgcaggcagcgggccaggccagcacccaggcaagggcggggtgggtggccgtacaccggaccgaatcggggactccggtggcgtgggcgcgggccgaaccccgaccgggccgagttgggtggcgaagtaggacgtggattcgggggcggggcgcggcgggagggggaaaccaggcctggccagactggcctgggcgtgggggcggggggcgagttcggggcacttgctgggctctggaccgagcggtagggcggggcggcgctaggggctgggccggacccgcagggagagggcgaggggagggagagccgggggtggagtaggggcgtggagttgtgagcggggtctggcctcggccgggggcgaaggtagatcggcggggccgcgagcggagggagggaggcccgcggcggcgcggcggcagcgaaggccagcttccgcggagtttgtgcccgggcttcccgggctctggccgcctcacgcgcacaaatggggctaggggactgagtggtaagcaactccgagtgttagacggtgatcgggcggcgattccgggaaaagcgaggaaagacacagtctgcgattgtgccgcaccccccacccacctcttagcatctggattctgctctcgtagtgggggccgcggaccctccccgccacagtccttttactctccagcactcccaccgccttcccccttcttcagccatctgactctcctaggggtatgtgtttttgggggtggacggcgacgggggtgggggatactttccttcccgtggcggcaacctagttcgtatcttattcctacaaggtagcgtcgcttcgagtcgcatggacattggggtttagataatttaccccccacccaagcgatttaatggcttttaagcaaaaggcgaatacctggatttccatgggagggatgaggtttgaagattgggattcacccctagctcacttccactaccaacccctctttcttgtgagccacttccacgggtattcaaatctgggggggaggggggacgggagtattaatatgcttctctatttctacacagggtcggcgtggcgaaggacggctagccttggagggaaagtagccaccagtccaactcgggtcgcccccaccattatttcggtgagggggcaacgctaagaaggggatactggtgggtaggggcccagtataagggagggggctgggtagtcgtccccagaaggactccgtgtcttggcggggagagagagaggcgagccccggcttcaggggaggggttccggggagggagatgggggggtggcgacgacggtgggggggggagcgggaagaagggggagtcacgccctgcctgcaaggggagcctccctcaggcccctgggagaaggggactgaatgcgtctgttctccgctgcccggcagaggagatctggggtctcgagatttgcacactggatcggcaccagtggcctgagaaagtcaggtcggggcataaggtggagaacgttggaagaaagagagagaaccctttggccgcggctcactgaccctctcccttcctcaacctcccccttcgaggggcgtcgaggtggggggggacgtggggctcctgcagccccgcagattgagcgcctccgcctctcccaggagtctagctttttgcccggcttgctgcagccactgctgcctccctctccggaatccgctcggtcctctcagcgatcccctcctcctctcctcccctcccagtgtcaccggggctgcttggctctgcccccttcgccgccgcttgctccctgctttcgtccctccctctcttgctcgctccctcccttcgcctcctcctccccattcccccccacccgcgtaggccgcattctgggagttgtagtccggtggagcgggggttggcgccgcccgcggacccagccggactccacttcccgtcgagccctgcgaccggcacccactccaccaggcttcgctcgcacacagacacacacacacaccgctctccccctcactctttcgctcgccgcggctgctgccagtgtgtggctctgtctctcctccgctttgctgagccctcccttcttcctctcagttcctagagtccgaccgccgccgccgccgagagagaggagaaggaggtcggtggcgataaggggcggaggggggcatcagatcggggcagtattaggcgggtggcggttaagagggagtaagagggagcccgggtggcggcctgagcctccccgcggagccgacccgggaacaggtgcgtcttttttctctctcccccaatccctccaccccttttgactccccggctttttcgtatccccccacccgcttctttctatcttaagcctttctccaaccctgttccttcttttccctgcggccgctcggcttgccccccgggggcgccgtcctcttcgtgtccccggacgtagcgctccctggagctgggtatgtcttcgcccctcccttcgggacagctcccttccacttcccaccttcgtaccccatcccctgacttgccctacccccttctcgacccccttctctcttagccaggtgagactcgttcgccacgatccaagagagtcttcttcccggctgggcgggggtctccatggaaacgggggtcggttgatcctgggggggaaaccataggaattaccccactcctcggaaagggaggtggaggctatggtcttgttaactacctgactccaacccccgatccaaggatccgacgatccgaagggaggctggctagcagggcagggcgagaaaaggcttttttttggggggggggggtgtccgtgatgaagtgttgaagagaccgggagaaaatgccctccaacctcagaggggaggtgcgacgggtgctcttcagggctgctttcttcccggcgctggggtgcgggaatcgtagggtaaggggtacccctaggtggcggcggggcctgggttcgggagtgggagtgctgtgatgggggcaggggcaattatccgagtccctggaaaaaaggcgggggatgacttcggagcgccctggctccgctgccctcgctctaggggcgggggccgccgggccgggcgcggcggggagggggcttaaattgaaggaagatgagatcgggggcaattcatactagcaccggcaagccagaggggagatccggcgtgcaagccctccacccgcttcgcgccaggcctggaggcaaggggtcggcgagcgaagccgagggctggaaggagggaggctccggttacggggccgggtttcgggatcaggggcaatcccccggcccttggagaaggagggagagggatggccgcgaaccccagggctcccccaccccgggtcctaaggggcgtgagggacggacagcaggcccagcggagctggattcgagcggatcgcggccggggagtgggagggcttagtggtgggcttcggggggagcagtccggcggcggggcgggcgggcggggcgtggggctccggcgggcggcggggcggggccgggggcggcgctgctgccgccgccgctgccgccgccgccgctgctgctcctgctggggccgccgcagccgttgccgccgccgccgccgccgcttctgggcggggaacggaggccaaagagagtcccgtgccggggcagagggcgcaggcggcgcgcggtggggagggggccgtcctgggggcgggggcaggcgggggggtggagcccccgacggggggcggtacgagccgggacgacgacgacgaggagccccgggggccgggtgcatggaggacgaggtgctgggagaaggaaggggggtgtgggtcccgcgactggcctcgtgggcttggctcctcgaggttcggtttcgggacagagccctgcaggggcgccaagaggccggggaagggatagggaggtgaactggtcggtggagggggccctcctcgccggggtcccgccgagaggaaggctgggccagagggacgtccggggcaaggctgggaggagccggccgcacctcggctggggatttcgcgttatggaggtgcgggagattgttgtagggaaagacgtggtcgaggggaaaggtgggagggaaacactgcaaacccgggaggccaacagcacaggcccgtgggggtgcccttctattccgctcgcacctcctccctccctgagtggaagcactatgtttttgttttattgttttgaaattttcaatgttggctgatcgaaactgtcgatggggtgatattcattcttggtgtctcctggagtagacagtaaagacaggcatcctttggcgagcaagcatctagcccagggtttagaggctctttacgttagtgtgggaagggggcccggtaactttgtgccacagcttgactactgttaaggcagtttggaggtcgtccctgtggtacagaggtggagtacaattgcaaaaatcttcagtaagacttctggagatgagttgtaggttagcgttacagtggttagccctgtggttctttcaacttagaaggctctttctcaaaagcacgccgttgagttacatgggaaaataaatgtggattgcatttggggttgggagtggattaggttgattataaaatttcaaggttggaagggagttttaaggttatttacttttctgttgatatgtcctgtccttgaatgttggaattgagggagctttattttggggaagatggtagatggcacagtggaggatgtctggtgcacagtttagggtactttaattgaatggtgatgtcaccatgtggtactaaagatgacagtatgtaggagagaaatttgggggattccactggggattaaatgggataacctaattttaagaatcatcccggggctccaaatagaagcaaaaggctggggaggagcctgtaaaatttcgatggaggcgaaaagttagtagcaaagattgaggtagctgggaagagcaaggggcttggtgagtcaagttaagagaatctgaaggttgatagtagagtttagggatgtggccatcttgactaagtcatgaggatgttgttaggcggacatcttttgacagggcaacttaggcaactgcccttggggcagatgtgagggatgaaaggtacaggccttggggcacagatcctgactaaaattgaccttaagagggctgatcctgataccagctttgcaacaagggtggttaggtttcttttcttttcttttttttttttagatggagtctcagtcgcccaggctggagtgcagtgctacaatctcagctcactgtaacctccgcctcctgggttccggtgattctcctgccttaccctccagagtagctgggactgcaggtgcccgccaccacgcctggctaattttttgtatttttagtagagacagggtttcgccatgttggccaggctggtcttgaactcctgacctcaggtgatccatccggcccagtttatttttgtcctggctgtaagtcattgatgaggaaggagaggggtttcacctctcccttgtctgagttcaggaggatttttaaaaaatttttttagaataggccaataaggaagggacagcaaatttttagaaaaggccaataaggaagggacagcaaaacaaatcgttggcatagggcagagaaaagctaaggccctggcaagctctgctgctggagtctgcatagggcagagtggagggagttccacaagacatgatggctgcaccaaaaacactcatgtgggtctggctattttgatttgccaggaaagcgtagataaagagggaggatccctttctcagtgacatagacattcttgggaagaaaagaggggtcctccacagggctctgcttcatttatgatgcagttcatgaaatagaaaaaaatgggccgggtgcagtggctcactcctgtaaccccagcagtttgggaggccaaggcaggcagatcacttgaggtcaggagttcaagaccagcctggccaacatggtgaaaccccgtttctactaaaatcacaaaaattagccaggtgtggtggggcgtgcctgtaatcctagctacttgggaggtggaggcacaagaattgcttgaacctgggaggtggaggttgcagtgtgccaagatcgtgccactgcactccagcctgggcaacagagcgagagtccatctcaaaaacaaaaacaaaaaaacaaaaaaacaaaaaaagaaaaaagaaaaaaatgttcagtacagggagtggaggatctcaggacactattggttggattatgggttgtagggaagggcttctttgagagaaacagaattatgggaaaaaaggacttggacactagagggaaggaaggcaagaaagagaagtcaggaagagggctggttgagcaatgaaaggaaaagaaaggtgatcatcactggtcccatgtaagggccagctaaggaaaaagtcaaaccttgaaatctctaggacaatgttttccaaagtaaactttgaagaactcttaaagctctttacaatttcatgctggaatcactaaggttggggcaagagagaaggaatatatggggtaaaagtagggtgggggagaaactggcatttagagagaaatacaagcatatttatccataaggaaatagggaacttagagattatatacaggttaaaatgcagaatgtgagagaaaaagagaggaattaagagccaaaggaggaagatatttactcagatatcttttggagccggtgttagggagcggaaaatcttgcctttgatagccactgccctgagagggcccaggaagcagaggttagctgggatccaggccttacacatctaaacattaattagaaaatctagactaaagtaaggatactgaatggggggagggattcactgtcctaaatagagtggccttgaaagaaggaaaaagtgggaatccaccagtgtttccagtctgcaggtgggaaggatcctaggtatcaggagatgagtgatggaaattccagggtgaaactggataaaaaactgagtgacatgagagcctgtgggccagaattggagggtggggttaggggcatggaagagaggctctaatcagggcttggactggaggccacatggagtaattcattgattctgggctgagctaagcttgggatgaaatagaacagccaaagagagtagagagctgttcttcagggccaatcagcatcagaatcagagtgaagaaattcgaggtcaagtttgggtgggaaagtgaacaccggagtggaacagagagggtgctggagaaagtgacacaattgttggggtagaataggaaaaggtagaagccactgatgattacataacccagagggaagaccctaggcctttgagttttcaaagagaagggaagtttcttaatgctggagtttgaattaggtgtgagtccatggttgccagagtgtttagtgtcaggatggccaaagagggaggtaatatctacttttcggccactaggatgctagtacagtatttgatataattttacatatgaactaggctttattaatgcccatttttgaatggttatccttaaaataatgtagaaatggttctttttctaaattaaatcattccctttcccactgttcataacttaaaagcaatcttttatgatgagaactttctttggcgaactgaagtttcattctggtcaagagtaaaatttaactctgtgtttctatccccgtaattcaaatatgctgttctagttttcttttttattctaagcagaagtgaccttttccccataaaacataaaaaaggatcttttttttaaaaaaaaaaagtaactgagtaactgcaggctgcatgtcaaggtcatattttccctggtcaatgaattatgatgaatttgaatacagctgatatattatttgtaaaatgtggtaattttcagatttactcatcacagtatgtgaggcaggatacctcttcatttgtattttaagaaaaccttaagctgaaggtccgtgaggaatccagagtaccaaggagcagggaaagctttgtgttttgggcttctttaccgtgggtctgctgagaaacaaaatttggttacctcattactaaggtatgcctagaaatcatagtgttagtgccatttaagggtactgttgagttttgttataatgctgatgtccagggacaaggagaacaagcagatttttgcttttccaagttttgtggagaagtgcaccgtatatgactatgatcgcagaggtgagttgatgcactgtatacctgaatccatgagatgattatcttctgataatgaggctttactcagtttaacttggttgtaccacaccccagttagtatagtacagtggttctcaaacttgagctcctcagaattgcctgggggggctttggagaccgacaacctcaggttagagtgcttgctgttctacttcttagctatgtggcaggaggcaagtcacttaacttactttcgttcttttttttgacagagtctcactctgtcacccaggctggagtgtagtggcatgatctcggctcactgcaagctccgctgcccgggttcaagccattctcctgcctcagcctcgcaagtagctgggactacaggcgcccgccaccatgcccggctaatttttttttttttttttttttttttagtagagacggggtttcaccgtgttagccaggatggtctcaatctcctgagcttgtgatctgcccatcttggcctcccaaagtgctgggattacaggcgtgagccaccgcacccgtctttttttttttttttttttttttttttttttttttttaaccggagacagtctagctctgttgcccaggctggagtacagtggtgtgatctcggctcactgcaacctccgtctcctgggttcaagctattctcccacctcagcctcctgagtagctgggattaaacgtgcccaccaccatgcctggctaacttctgtatttttagtagagacggggtttcaccatgttgaccaggctggtcttgaactcctgacctgaagtgatctgcccacctcaacctcccaacatgttgggattacaggcatgagccaccgtgccaggtcttcacttaactctctttgtttcttttttttttgtttttagacagagtcttgctctgtcacccaggctgaagtgcagtggtgctatcttggctcactgcaacctccacctcccggcttcaagcgattctcgtgcctcagcctctcgagtagctgggattacaagcgcccagcaccacgtccagctaatttttgtatttttagtagagatggggttttgccatgttggccaggctggtctcgaactcctgacctcaggtgatccttccacctcagcctcccaaagtgctgggattacaggcatgggccaccatgcccggcccacttaactttgttgagcctcagttttctcatctatacaatggagatgataataccaatttcacagggctgtgaggattacacaaaatcatcccaggcccatagtaggtgctcaataaatgggacctattattttatatatatatttttttctttttcttttttgagatggagtctcgctcttttgcccaggctggagtgcagtggcgctatctcggctcactgcaagctctgcctcctggattcacgccatcctcctgcctcagcctcctgagtagctgggactacaggcgcccaccaccgtgcccggctaattttttgtatttttagtagagacggggtttcactgtgttagccaggatggtctcaatctcctcacctcgtgatccgcccgccttggcctcccaaagtgctgggattacaggcatgagccactgtgcccggccctattattatattattatctaatttttcttgttcaattgtatcctattatgttatagtaaacatggtggcagcatgaaaactatcaacagcttctcagtggtccccttatatcttgattctctgtcctctttcttcatattcctgttgtattagtacacatttggcatttacaacatgctaggaagaaagcttgactcatcactgcatctacctttgaggtggaagtggcggcttctttaacagctatgctgtaacactgctcaatagttcaggacaggaactgaggagtgtatatccagttgaaactctagggaacatttcgggccatgggtgacatttttaaaaaccattgctttctgaaaagggctgttgtgtttatttaattaattaatttatttgtttatttattgattgatttatttgaaaccgagcctcactctgttgcccaggttagagtgcagtggcgtgatctcggcttactgcaacctccgcctcctgggttcaagcgattcttctgcctcagcctcccgtgtagctgggactataggtgtgagccaccatgcctggctaatttttgtatttatattatttatttattttttgagatagagtttcgttcttgttgcccaggctggagtgcagtgatgcaatcttggctcactgcaacctccttctccttgtttcaagtgattctcctgcctcagccttctgagtagctgggattataggcacccaccaccacgcctggctgatttttgtattttttctagtagagatggggttttgccatgttggcctggctggtctcgaactcctgacctcaagtgatccggctgccttggcctcccaaagtgttgggattacaggtgtgagccactgcgcctagtctatttatttatttttgagacagggtctggctctgttgcctcagcctcctgagtagctgggacaggccaccatgcccggacaattgtttttatttttatttttagtagaggcagggtctccctgtgttgcccaggctgttcttaaactcctgagctccagcattcctcctgtcttaacttcccaaagtgctgggattacaggtgtgagccactgtgcccggcagaaaatattcttttttttttttttttttttttttgagacagagtcttgctctgctgcccaggctggagtgcagtggtgcgatctcggctcactgcaacctccatctcccgggttcaagcaattctcctgcctcagcctcctgagtagctgggattgcaggcgcccgccaccatgcccagctaatttttttttttttgtatttttagtagagacggggtttcaccatgttggtcaggttggtctcgaacccctgacctcgtgatccatccacctcggcctcccaaagtgctgggattacaggcgtgagccaccgtgcctggcgctttttatttttatttttgtttctgagatggagtcttgctctattgcccacgctgaagtagagtggtgcaaactcagctcactgcagcttcgacctcccgagctcaagtgatcttcccacttcatcctcccaagtagctaggaccacaggcccataccaccaggcacagctgatttttaaaataatttttgggccaggcacagtcgtcacgcctataatcccaccactttgggaggccgaggctagcagatcacttgagcctaggagttcaagaccagcctgggcaatgtagcgagaccctgtctctacaaaataatacaaaaattacctgggcttggtggcgccaggtgtggtggcatgtgtctatagtcccagctacttgggaagctgaggtgggagggccacttgagcccgggagtgccgctacagtgagctgtgattgtgccagtgcacttcagcccaggtgacagagttgagacccagtcttaaaataacaacaacaaactctttgagctaatactgtttaatgaaagctgtatagatacacctttgaatgaataatatatataaaattagttgaacccatagctgagtctgttctgttgtgagaaaatagaaagaataacctgataatggtctctccaaatatttgtgttatgtagtccaggagacttttataaaagcaaaagttgggtgaggaagaattgtcttttttaaaaccatatatatatatttagagaccgggttatgagactggctaatttttgtattttttgtagagacggggtttcaccatgttgccaaggctggtctggaactcctgggcttaagtgatctgtctgcctcggcctctcagtgttgggattacaggtgtgagccagtgcgcccagctaggaattgtctttaggtgaaaaattgcgtatcatgaatatagtatactgaaatggagacaccagagggccactgtcacagtctatggcaggcaggacccagaagcatctcaaaagggattcagaatgtctcatattacaatgattcaagtttagagtgtgaaaaacacactaaatatttatatggtcctgctgaagaccaagattgagggaagccaatttgtgtttttgttctagcggaaattagaagtactcaaaaaatgaccctagatatttagggtgacattttgaggttgctttgccttttgaaaggactgattaatttcacaatgatcacttaagttttgcgtgacatctagaagttgtataaaatcttgtagctagagccgaggtttattataaagctatgatgaggtgtttttgttaaatggagtaaagtaattttcttacagcaggaaatggaagtgagtactgtttgaataataagaaaaaagtatcatagcaatgggtagaaagcaaaaagaatctggcggtatgaaaatgtaagtgaggccaggcacgctggctcacgcctataatctcagcactttgggaggcaaaggcaggaggactgcttgaggccaggagtttgagaccagcctaggcaacatagggagaccctgactgtactgaaaaaaattttaaattagccaggtatggtggtgcacacctgtggtcccagctgcttgagaggctgaggtaggaggattgcttgagcctgggaggtcaaggttgcagtgagctatgatcatgcgattgtactccagcctgggttacagagcaagacccgtctcaaagaaagaaataaaatgtaagcaaaagattaaagcttttgcatttgactacttcattcttggaatagattacgtatggtccttttttttattttttaatttttattttatttatttatttttttgagatagagtcttgcttttgtagctcaggttggtgtgcaatggcacaatctcagctctgaccccccaggtccaagcgattctgctgcctcagcctcccgagtagctgggattacagatgcccccccaccatgcccagctaattttttgtgtttttagtggagacagggtttcaccatgttggccaggctggtcttgaactcctgacctcaggtgatcgcctgccttggcttcccaaagtgctgggattacaggcgtgagccaccatgtccggccagtctatggtccttttctaagtgctttcatgttattccaaatttttagtagggactagtagtttattcccattttgcaggtgacatggtaaatggacatagagagatagtctgagatggctgagaagtggggactgggagtgttctccaagttttcccaccgcagtgtaggctatgggtgctagagtatatcacttttcaaggcattacttgattagatggttctgtttaatattgctgctgtttgagtagattgttctgaatggattttggatgttcctaaacatcagatcgaccctgaaaggatgggttccagcactaatgaggagagtgaaaaggacgtagtattggtctggatgctaacgctcacagaggaactccagggagattgcaagccctggccgctcggctgagatgactgtccagcctcctgaggcgactactttggggtaactacattcatttgaatgataaacgctcatgtgtttaacagcagttaacattcctttgtatccagtctcataaatgtttataggtaaggttttagacatggaagtacccaaagagtctatgaaggggtccatgctagacctatatgccggcaactacctagccttcccactaaataccagaattaatgtatctgggcaaaagatacaatatgccttataagactgatcccttggggtagatatcagtggaaatatttggataggaaaaaaaaaatccaggggaagtagaaagtgttagaatagatttttagtcaggcagaagtttgggatgaacagcagaaagggctgttctttctcctttaaattgcctggcagattatttctagttgattttgtgtgtgcagtagtagaggaaccaacttggcatgaagagaagcaaagtaaagtgtttgggggcatgtctatgggacttcttttttttttttccaagacagagtctcgctctgttgctcaggctagactgcagtggcatgatcttggctcactgcaacttctgcctcccaggttcaagcgattctcctgcctcggcctcctgagtagctgggattacaggtgcccaccactaggcctgactaatttttgtatttttagtagagatggggtttcaccatgtggaccaggatggtctcgaactcctgacctcaagttatccacctaccttggcctcccaaagtgctgggattacaggcatgagccaccacgtctggcctctctatgggactcttgagtttcagggaatatttggttaatggtagggaaagatgagggaatatagatattgggggtaaagattgaggagaattttcgaatacccttatatgtattagatcattaaataagtttatttttatttttattttttgacacggagtctagctctgtcacccaggctggagtgtagtggcctcatcttggctcactgcaacctttgcctcccaggttcaagtgattcccctgcctcagcctcccgagtagctgggattacaggcgcacaccaccatgcccagctaattttgtatttttagtagagatggggtttcggcatgttggccaggctggtcttgaactccagacctctagtgatccacctgcctctgcctctcaaaatgctgggattacaggcctgagccactacacccggccagaacggtttaaattggggtaacttcctcattgggggcaggggttgtggtatgtaatgaagtagggaaaacaggaatgttagtctcctaacacattctgttgaatacacatggaagaaggcagagtaatcaggagggcaagctctgtagtaggagttccacatctaaagccgggtaaagttgtccttgctgggtgtgtgtacattttcctatggaaaacaatgagcagatttgccttcactctaaaagacttctgggcagaagtcatggccttttccctttagccctgagatctcagtgtcagtggtctcttagatctcctcaggggtgtcttagatgctgttttttcccaagtggaatgatgaggtggcctctccttttgctgctgtaaagtttgcctctgtcttatgggagctttaccaagagctctgggtctctattggaggagtaggtcccaaagttggttttccttacttattagtcatcactgacccagccctcctccttaaactgtctgctggccacgcctatcctctagaggacagattcagggccaggcttcaagatgaatattttccggctctttcattttttaaagtcataattgcttccaggtcaccaggcagtatgaaccaaaaggagcctgggggagcaggactacatttcgtttaactgagagcttcttaagcttgggtttctagtttactgtcttgatggtagagtccaagcatgaataaatgggtaggtttcatgctatgtgtagaagaccgagttgtgttccataagttgagtgttctgcacttaaggggtcttcagccacaaagggaactacatgatcctgaagtacttgtcagctgcatgaacatcctgatcattttcttttatttatttattttttgagacaggatctctctttgtcacccaggctagagtacggtggcgtgatcttagctcactgtgggcttgacatcctgggctcgaaggatcccttctgccacagcctcctgagtagctgggaccacaggtgtgcaccatcacacccagctatttttttattttttatagagacgaggtctcactatgttgcccaggctggtctcaaactcctgggctcaagcagtcctcctgcctcagcctcctaaagtgctggggttatggacatgagcccatgcctggcctggtcctttttaaggttaaaaacctcgtaaacagtgcctacctcagtcaaaaacatttgtcagatagatgctttctctgttacctcctttaatgtccttctcttcctcatatgcatgatgacaaccatgcttttgcttgtaattgttgtgaaatctgcatgttttggcatcttcatttcaaaacgaaacaaaaaaatcctatcccacctgtaaaatctcctttgagattttggtgctgcctatcctctattactaactcccccagccccgacataggctataatttgatgttattcttccccttttgagaacacattctctctaaacttttctaaaatgtctgtcttcagtgcttccccacagtgtttcagtttggcccatgatggtgaaatatttcaggttcccctatttcattttttttccttttggttattgcatgcgatgggcttttcttttatgcctatcacacctgcccttgtcttctagtgtgttctatttggattgttttaaagatctctgcttcattatggtttctcttccactacccgctcgccctcagcttagctgctatttttcaccattttaaagttattgcggccaggcacggtggctcactcctgtaatcccagtacttttggaagccaaggtgggcggatcggaaggtcaggagttcgagacgagcctggccaacatggtgaaaccccgtctctactaaaaatacaaaaattagccgggcatggtggcccatgcctgtaatcccagctactcaggaggctgagacaggagaatcgcttgaacccaggaggcggaggttgcagtgagccaacatcgcgccattgcactccagccttggtgacagagcgagactccgactcaccaaaaaaaaaaaaaaaaaaaaaaagttattgctctctcattagttccttttctttttggtttcccctgttctgtagtgtggtgattgtctctggctacctactcttggctgcccacctgttggattcatttcctgggatcttgggtaggccttttacttctctgtgcatgtgcctcctaaattgaagttttacatatatatatatatatatatgtatttttttttcccagccacacttatggctttggattggcagagcacgtgctctcctttgtcctcaccatgagttggatatatcttttgagttttttcccccaaagtagggatagctcacagtggttcctctgccttccaggcagtgaccagggttgattcttgggccatgcagctgttcatttctttaacaattacatggttgtgacatctgggaaaatcctttgaggtatttcatatccttgtgcctgtgcttcctgggtcatttgggattaccaggtttcttccaagttcctttttggaactttgcttttgatgtgatgatttccatcagagagagggagagtaggcggggtggtggggggaggtgggaagggagaacacatgagtaccggtgcttcaagcaaaagcaagccagcatacaagtgtgtaaaccagcagcgcttacgaagtgtggcatgcctgcaaggcttttcctttttgctcacctctcctgggatactaatttgattggctataatataataaaacaaacccctaggcctactgaatcagaatctccaggactgagacctaggaatctgtattttgaacaagctcctcggtgattctggctggggaaacattggttgacattgaccgtcctgactcctcccttctgtgagcattcacgcagtcaggagtctgttctctagggccgctttagaggttccctttgctttccctctggctggggaagaccaatcttgccttcttgtatagaccatgtagctcagtgtcagtgttctcctgcctgtgttttatccctcccctcctctcctctcatctgcagaggctactgttaattagcaacagtgggcttcagataggaagtggcgctcctgggacaaaatcatgatagaaaattgagaggcaaagatttaagtggatgctccatcttgaggatcttgtgaaaatggagttatccagaatcagcgttgctctctacgtggtcataacatgtgtattatatagtaattattttgatattttaactcggttttattttttgtggttttttttttttttttgcctgaaagctctttatctaggtgatgttgtatgatgttctgtttccaaatgccagtgttccccctctgatttctgtcccagaccctacatactactaatcctaatcctctctaaatagagcaatacgaaacctgagagtgaaaaatctagtgtcactaatacctgctgcctatagatatttagtagcaactaaaacttgtactttgtgttgaaacacatctttttttttttttttttttttttttttttgagatagggtctccctctgttgcccaggctggagtgcagtggcgccatctcggctcactgcaacctctgcctcccgggctcaagcagttctcccacctcagcttcccaagtagcagggaccacaggtttgcacagccacacacggctatttttttgtattttgtagacatggggctttgccatgttgcccaggctgatcttgaactcctgagctcaagtgatccacctgccttggcctcccaaggtgctgggattacaggcgtgattacagtgggattacaggccactgctctgggcctgaaatgcattttatggcaagaacagccccttccattgcttgagtcctctaattctttttccccccccccagacagagtcttaactgtcgcctaggctggagtgcagtggtgcgatcttggctcactgcaacctctgcctcccgggttcaagcaattttcctgcatcagcctccgagtagctgagattacaggtgcctgccaccacgctcggctattttttgtatttttagtagagatggggtttcaccatgttggccaggctggtctcgaactcctgacctcaggtgatccacccgtctcggcctcccaaagtgctgggattacaggtgtgagccaccatgcctggccgagtcctctaatgcttagtagagagaaaagatgaaatgagtacctggggtatcagccaataggctgagctggttttgtttttgtttttgttttagacaggattttgctgtcgcccaggctggaatgcagtggcacaatctcagctcactgcagccttgacctcctaggctcaggtgatcctcccacctcagcctcccaagtagctgggaatacaggcacccgccaccatgcccggctaattttttgtagagatggggtttcgccatgttgcccaggctggtcttgaactcctggactcaagcaatcctcccagctcaacctcccaaagttctgggattacaggtgtgagccactgtgcccaaccagtgttgttggttaaaatggggatattccaagatattctgagaaacagtcaaaacttgattaaccaggatgttcagggaacggggtccttgttaaaaatatttctaaaattatgctaacccacataactgtcttcataatgttaaaagataattgtcagaaaaaaggtaaaaaatcatgactctcgtacagatacaaaaatgaacacgtgttaaagattttattttactcattaatcaacaagagaaccagacagatgttatagctggttcaaacaaaaagtcaaaaagcacaaatttatatggagtaaaggaaataaattgcaaatggaggcaaaagtagtttttctacagtggggaggaaagacaatccaaactcaatgggacaagacagacttcgcatatacatcagttacctgcaattacagagatgcaaaatagcttgaagacaataacctgagctaaaatcagatagcccagaaggttatgctatagacagtgcatagttttttcattggagtacaaaggtttttctgtagtaagcaaacatggtggatgctttgtgtgtgtgtgtgtgtgtgtgtgtgtgtgtgtcggggggtggctgttgattttgcttcttgtgatttctcagggccgtcacttcagttcttatccagaattcagttccatataacatgcatttactgagtagttactatacgtaaggtgtcgtggaggaaacaaagacaaaaaaggatgctttttttttctttttcttttttttgtttttgagatggagttccacccttgttgcccaggctggagtgcaatggtgcgatcttggctcacctcaacctccgcctcccaggttcaagcaattctcctgcctcagcctcccaagtagctgggattataggcatgtgccaccatgcccggctaatttggtattttaatagagatggggtttccccatgttggctatgctgatctcaaactcctgacctcaggtgatctgcccaccttggcctcccgaagtgctgggattacaggtgtgagccaccgtggctggccaaggacgctatttcttaccttaggtagctgattggtgggggagacaaacatgccttgtccccaactaaccaagctagagaggagaataagaaccagtgctgtggaagaggtagggagtaaatacttgaggacaaccagagagggaggggttaactgaactcgggctggggctagggggatgacatgatgacatttaagctgagtcttgagagaagacagggagaggaagagggggaagcaggagaggccatttcagggtgaggaggcagaagagtcctgaaactggatggtgtgtttaggaagggttgggagctgggggtggtgagagtggtggggaaatggcaggatgtggtggaagaggaggctggagaggaggtttgaggccaggtcatgagggccctgaaggcagtgctgagaatggctggctgggtgctagaggccggggaaagctattgaaagcttttgaggagggaaggagtgacatgatcgaactggcgctttagaagatgaattgattgtagaatcaagaaattgaaggcagagggagcagttaagaggtgattataatattctgggtgagagctgatgagggcctgcaccagggtagtggcaagaagggtagaaggcaaggctggagatggcattattaaggcctgacttctgatcgaatatgggcggcaggggagagaaggagttgaagatgacaaggcggaaatttccaggctaggggacggtagtgccgttaagtaagctaggaaacacgctgcttactgggcatagggggtggggagcaggtttatgagaacagataatgagtatggtttgagacacattgagtttgaggggcttggtggtcatccaattaacagcaagttgctggcagctggaaattctggtctgggcctaaggagagaggtcaaggctagagatacagatttgggagtcatcagtgcatcaaggggcgagctgaaactgtggaagctcatgagctgagagagaaggtggggcagggctgacaactggcacagagggagagagatgggtgggggaagccagagagagccagcaaaaggcagactaggaggaaaagagacagagggagaccggggagggaccggaagagggagactgaaggccaaagagtagaggggagggggaggcacaggggagggagaaggggaaggagggggagagggaggagagaatgaatgggagactgagggaaatggggaaggtgagataagcaagaaaaagacagggaaggagagaggtgggaacggggagaaagttggaggagaggggattgtgtgtgtgtgtgagagagaggagaaaggcaagaggtgaacagctgggaaaataataggggagagaaaggtgaggaggaggaagagtaaagagagagagatgggtagggggatgagaaagagggaagaagccttgaaagataggaaggggaggaaatgggagagggtggcagaggtgaagagagacagagatcaagggaaaggccaggccccagtgaatgcccaagtctttggggtgggcagtggaagagaagggccccggagaagccatcaggcagtggatcaggaaagacaagagaagggagagaataaagagggcaacgtatcccactctgcagagatgaggaggaggatgaagcccaggcagggtggatgcctctctcctctcttctcctaccacctccacactggtctcctggctctcccttgatctttgtgggcaacctcctgccttaggactttctcatgcactgttccctcagcctggaatgcttttctcccaaatatccacgtggctactcctttacctcattccgatggtttaaatgtctcctttacagcaaggcctatcctgttcaccgtatttcagatagtagccctccccacctagactgtgcccttgccccttagtctgtgttgtattatctcctcctcctcctccttcttcttcttcttcttcttctttttttttttttttgagacagagtttcactcttgttgcccaggttggagtgcaatggcatggtatcagctcgccgcaacctctgcctcctgggttcaagcaattctcctgccttagcctcctgagtatctgggattacaggcatgtgctaccacggtggctaattttgtgtttttagtagagacagggtttctccatgttggtcaggctggtcttggactcccgaactcaggtgatccacctgcctcggcctcccaaagtgctgggattacaggcatgagccactgcacctggcctgttgtactatcttctaacatgccgtgacatagaactatttaacatgctatgacatagaagtattcaacatgtttattgtccatgtcatccccctgggatgtaagctccacacgggcaggcattttgttctgtttcgttaattgctgaatcctcagtacctaggatggtgctggctcatagtaggaatgcaataaattgtgatactgtgttgaaagtggacaatctctgaaaattgaaaaatggatacatgaaacaaatccctcgtacaactatatcttattgtgatttactttggaaagtggagaacagcattcaattctgatcactgtagggttctgttcagttgaacttcaatgaataaggattttagctaataagctaactcaagagcttaagggtctcaaggcaagctcattggataaaggtttttcttggtgcctcattttttctagaaggtaaattaactgtgccctgcttgtcaaagcgagagagggacattggctggtgaagagagtggtggaacatggagacaacagactgacaggaagggacaaggacagaaatgtgtggtttttttttttttttttttttgagacagagtcttgctctgtggcccaggctggagtgcgctggcatgatctcagctcactgcaacctctgcctcttgggttcaagcgattcttgtgcctcaacctcccgagtagctgggattacaggtgcacaccaccaccccaggctaatttttttatttttagtagaaacggggtttcaccatgttgtccaggctggtctcgagctcctgacctcaggtgatccacccgcctcggcctcccaaaatgttgggattacaggcgtgagccaccgcgccctgccgaaacacgtagttctggatggaacgttgttttctgtttgtttgcttgttggtggtcagcgtgcaaggagtactgcacctgatttggagggagcttgaaaccaggttagatacgtgtgttatttccaactcaaagtcaatggagtatttttgaaggacttacgaaaaaaagcatgtgcttcctctgaagagtgtaaattggctacgtcactcaaatacttcagtacccatggattagagagtagacgagaaaaaggtcaccagtagtgttttagtgcaccattcatatatgggtatgactctctaattgtagttggttaggctaaatgtgtgtagaaatatatactgtcatctcatttgtctgaaatagattgaatttcctctactcaagcatatctgtcttttaagataatttaaaactcactctaggtgattaacaatgtcctcatctccatcctgaaacctatggattcctagaaagctggtgctccctcttcccggtttagaccttaattttccatagcaggctggctgctttaacattctgatgctgtaattacctttattgaaacattgctgtgtaaaaggtgattgaagcagctgtccctgttacgagttttgattttctggaattcttttccccagggggagtggccacagcaggtcctatctggtggtgagtggctgtcatgatctctacagcaccgctctacagcggcgtgcacaactggaccagttctgaccggattcgcatgtgtggcatcaacgaggagaggtgaggaggccaggaaggtggccgctgctggcctccagtgagcagtacctcgtcaccagagggatagctgcatacaatagggcctggggagggaccctggggaggagaagactcttagttgtttctaattttcctgtggtgggatggggatggggctgtgtgagtggcctgatctgccatgctatctcttttcagatgaaggtgaggaggccaaaaaaatgaccttttgccagctagcacttgtctactcattaacaactgtcagactgtggagtaaggggaagctcaggcaatggcaattttttttttgttttttgagacagagcctcgctttgtcatgcaggctggagggcagtggcacaatcttggcccactgcaacctccgcctcctgggctcaagtgattctcccacctcagccccaccagtagctgggaccacatgcaagcaacaccacgcccggctaatttttttttttttttgtagttttttagagacgggggtttcgccatgtggcccgggctggtcttgaacccctgagctcaagtgatctgcctgcctcagcctccccaaatgctgggattacaggtgtgagccactgcccatgcctggccagcgattgcagtttttatttgctgcatcaaagtttggtgctcaaggatatgtgtaaggtattttcagtctttgatctaggtctggaagaaagatggttttattgttcagatttctactgggaactggcagtgggcattctggtggtcagcgctttctcacctcatgaggctaattctgatttgaagtgagatccttatgaagtatcaaaggaagttgagaccgcctagcatagtcttgagagttggtgacacctgcctcacgtgtgtattttcagttatctgttccccagaatatttggttgaccaagatgtgccattgcctgatcatgccccatacccaaagcactcaaaatggccttcagaatttatatttggctttcataacccttggtcaaagagctgtgtgtgatggctgcagtgcctctctcattttctttttttttttttttgaggtggagtctcactctgtcgcccaggctggagtgcagtggcgcgatctcggctcactgcaagctctgcctcccgggttcacgccattctcctgcctcagcctcccgagtagctgggactacaggtgccgccaccaagcccggctaattttttgtatttttagtagagacggggtttcaccatgttagccaggatggtctcaatctcctgacctcgtgatccgcccgcctcggcctcccaaagtgctgggattacaggtgtgagccaccttgcccggccgtttttattttttatttattgatttatttattttgagacagagtctggggctacaggcgtatgccaccacacctggccaatttttgtatttttagtagagacggagttttactatgttggccaggctggtctcgaactcctgacctcatgatccactcacctcggcctcccaaagtgctgggattacaggtgtgagccactgcactcggccgcctctctcatttttagagaaggcactgctccttcatgcttgctggtgtttttttgttgtttcaatccattgactgtttaaattcaaatatacatcagataaatcaccaagacacagaacaatatggctttccctgggattcaagatctgacgtttcttgggtaaatcttagaaatgtgtgtgcgcatataggggagtattggtaatttgaagggaaaaggaatggaagtctttgtgtttatctactttgttcttctgttcctaactggagaagtatatacttgtctgaggtcaaggttagcagaatagacctttttattttcttaagccattagtgcctgatagcttaatgttctctgtactgaggaacaagttagagatgggcttaaaaggaatttaattttaggataaaaagagtcaagaccatggaaaatgagatgaaattcttaggtgctcaggaagaaaagtgttttcctttacatatgaagcatgtcctcagatgatcactaagagatgatctagggaaaggcagggtgatgataatgatttgcgtaagtattcattggcaggtcatgttgacctagttataagtagttgagactttgatgcagaaatctggactagagccttcaaaagaccagcggggccgggtgctgtggcttatgcctgtaatcccagcactttgggaggccgaggcgggtggatcacctgaggtcaggagttcaagaccagcctggccaacatggcgaaaccccgtctctactaaaaatacaaaaaaattagccaggcatggtggtgtatgcctgtaatcccagctactggggagactgaggcaagacaatcagttgaacccgagaggtggaggttgcagtgagccgagattgcaccactgcactccaaccggggtgacagagcaggactccgtctcaaaaacaataaaattaaataataataataaaagaggccaatagacaagttaccttagttcaccatctactgtaaatccctgccaagaaaggagcaggaagtaggctcaaaatctgattttccctccatcttgttttttgtttttgagatggagtcttgctctgttgctcaggctggagtgtagtggcacgatctcggctcactgcaacctccgctgcctgggttcaagtgattctcgtgcatcagcctcctgagtaactaggattacaggtgtgcaccaccatgcctggctaatttttgtatttttagtagagacagggtttcaccatgtcacccaggctggtctcaaactcctgatctcagtctgtctgccttggcctccaaaagtgctgggattacaggtgtgagccactgcacccagccagattttccttccttctaaacctgtgcctagtgcttaagaggacattttttttttttttttgagacagagtttagctcttgttgcccaggctggagtgcaatggtgagatctgagctcaccgcaacctccgcctcccgggttcaaacgattctcctgcctcagcctcccgagtagctgggattacaggcatgcgccaccacacccggctaattttgtatttttagtagagacgggttttctccatgttggtcatgctggtctcgaactcccgacctctggtgatccacctgcctcagcctcccaaagtgttgagattacagatgtgagccaccacgcccggcctaagatgaccttttaagtgttgtcacttttgatctcatccaccctttattgtcaccttcttgctacagtctaggccgctacagcctagaccatgctatcactggtttccaaaatgtaatctcaccttatttaaaaatcattttccttggccctttacaacttgtagaatttaggaatttggggtacaaagctgtgcctggggttcaactcttaaagtgatgttttagaggcctgccagctttggcagctgcaattgaggactgtagaacaggaggcatgggcttgcggctggccccaggtggccgtctctaggcaaacctacagctaaatgtgtctgcttgcctgcttgcatcccttctaggattaattcatgccttcattcaacaaacatttattcaacataatgagagcaaaccagtagttctagtacattggtggtgagtgccctagaattgcatgtccgggtccagtgggagtccaaatgcaagattgacaaacctcctggtgggagaataaggaaaggcttcccagaggcagtggcatttgagcccaggcttgaggaatgagtaggagtttgaggtgagagctggtatttccctgagacaataagagcacagtgtggctgggcacggtgactcacgcctataatcccagcactttgggaggccgaggcaggtggatcacctgaggtcgggagttcgagaccagcctgaccaacacggagaaaccccgtctctactaaaaacacaaaacttagctgggcgtggtggcgcatgcctgtaatcccagctactcgggaggctcaggcgtgagcccgggaggcagaggttgcagtgagctgagatcgcaccattgcactcctccagcctgggcaacaagagagaaactctgtctaaaagaaagaaaaaaaaaaaaaaaaagcacagtgtgtttggggaaggtccaagttggaatgaaggcaatcttggggtactgtgggactcgaaccagggaaagtctcccaggactggaaggtaaggagcctggtgtgtgctgggtggtatatttctcttacgggtagtctgggcccagcaggaactgaagagggtccggtttgacagtggtgctagcccttaataattagggaaatggcccagaggggtcatggccatttctggtttaagttccacaaagccttgaacataacagctctgcctcctctgtggtgggaagaaacagcaggattgattttcagtcctgactgaagcctgctatgacctctgttccctcctgccgcccgcctccgccagctgcaccctcataaccttgcctggttgacccagctcttcccgggccccctcccctgcaagttactcctgtcccaggctcttctctcaatggagcaagttaatgtttgcttagctctgcccacccctcttctcagaggatttgaaacacggctgcatgacattttgcagcgccttcggggctggactcaggtgtgggtatggctggagtggccaggactgctgttgcttggcctggttctgtggttctctggcagctgccttcgacggcagggattctgctttcgaggtgtcatttcaggcagggtgggagcttgcaaggggagaatgaggatgcagcccactcccttttgtatggccaggaggggaaagaatgtaaataaatagcaccttcccatgtggggttgcttgggggaagtgctgcttgtttccccttgagtactccccctaaaaccgtccctggcaagtctagtgggaacacgcttccccctggcccaaggctgggcataggtctcgcttttgtggtctcttaggagttgatgtgaaagtatgttttccctttccttcaggccctccctccctccccttccccgagaccaccctgactgcatctaaagcccttgcctctccttacagtcatttctgtttgtcaccaacagtcacttccagcagtggagccctcccacttctgccagtccaactgccttttaaagggaacaagcctttccccctcggttagccccttctggatccctgaaaagatggggagaggcccgtggtgatcccccttgccttttttgcttctcttgccccaggtacaattttggagtccctgtttcagtgggagggaggaagttagcagggccctcccccttcttgttggggttggctccagcaacctgactgccctttggctagggtgactggggaggcgagagctggcttcttcagggctgtcttcaggagcttggggtgagcctctaaagaagggaggcaaaaattagccaggcgtggtggagcatgcctataattctggctatgctggaggctgaggcaggagaattgcctgattccaggaggcggaggttgcagtgagccgagatcgagatcgtgccactgcactccagcctgggtgacagagcgagattcaatctaaaaaaaaaaaaaaaaaaaaaaaaaaaaaaaaagagggaaaaaaggaaagaaagaagggaggtcacctcaggcacagtgtatttccccaggggcacacagagcagtcctgtgccttgcccacccaggaaacgcactgcagcgtctatgttggggttttattctttaatctaaacctcctccttggccactcccacccacagctcccaagggcagggggcaatagttttttttggttgttgttgttgttgttttgagacagggtctcactctgtcgcccaggttgaagtgcagtggtgggatctcggctcactgcaacctccgcctcccagactcaagcgattctcctgcctcagcctcccaagtagctgggattacaggtgcctgccatcacgcctggctaatttttgtattttttagtagatatggagttttaccatgatggccaggctgatattgaactcctgacctcagtgatgcacccacctcagctggcctcccaaagtgctgggattacaggtgtgagccaccatgcctggcctaatagttcttgctgtacttaaaataccaggggagggaggcagtctgatgccaccctctccctttttttttttgtcaggatgtacaattttctatgatgcttacctgaaatttggagaagactttaaacagggggagatgcatttgagttttcctcctttgggacccagctctctggccttgagcccttttctctgggacatatgaacctgaatttggggtctgaggcttttcggacaggagagaacaaagtggtgctgggagactgatgggggggcagggaggggtgctggcaggagataggatgtaggcaaggatagaaggagggtagaagggagggtgttgcctagaactctagaaaaaagggggcagtgtctcctggagggaaaaaagtagtattcttaaaatgcctctcagcacccagtgacctggtggcctccaagtggtatcatcaccagtgctaataaacatgtctctgctctaggcaagacaggaggtgaataggtgacgattcagatttagacctgaaaacacaacaggggtttatttgttttagaagaggattacccatatgacactttcagccagctgcccttagagacttaaaataagattgtatttaaaagaaaaatgggttttgcatgccttttgaggcattcagtggttctcatgtctcccctttgagcaatgccctgtacatcctggatggtcattttggcaggtaagctccagggaaaaggtaaaagtgctagggtgtccacactcctggcaagagccctagaaaacagggtaaacagtccaaagaggggggtctagtcagactgggctctggtagggacttgcaaagctaggtgtggcgcctccgctttgtaaccaagaacccccagttccttgtaatccccctcacaagttactacaggaagtgaggtaggaaggttttatggggacccaggcaggcaggaggcattctggggaaggtggtgttggctcaaatcctgggcctcatgtcccttctctggttgtatcttccatgctagaagagcacctctttctgatgaggagtcaacgacaggcgactgccagcactttggatctcaggagttttgtgtcagcagcagtttttccaaggtaagaggctttatggagccacgtgctgtccaccaaaggatggagctgagctgcctgggaggtgtgcccagcctgccatcccaggaagtgggcaggaagggacagggtctctcccaggagttggtattggtgggacacaaattggctggctgccctctgcgtcttccgagacctggttggtcgagttgcagagaagaccagcagttgcctctcgggcctcaggacacttgcaccatctgcagggagctggctgagatgtgcatgctatcctgtcgttgcaggtggagctcacggcagttggaagtggcagcaatgcccggggggcagacccagatggcagtgctacagaaaaacttgggcacaagtcagaagacaagcctgacgatccccagccaaaaatggactacgctgggaacgtggcagaggctgagggcttcttggtgcccctgagcagcccaggagacgggctcaagcttcccgcatctgacagcgccgaggccagcaacagcagggccgactgctcctggactccactcaacacccaaatgagcaaacaggttgactgctcacccgccggagtaaaggctttggactctcggcaaggtgttggagagaagaatactttcattttggcaactctgggaactggagtccctgtggaggggaccctgcccctggttaccactaacttcagtcctctgccagcccctatctgtccccctgctcccggttcggcctctgtgccccactctgttccagatgcattccaggttcccctctccgtccctgccccagtcccccattcagggcttgttccagtccaagttgccacttcggttccagctccttcccctcccttagcacctgtcccggctctggctccagcgccaccgtcagtgcccacgctcatctctgactcgaaccccctttctgtttcggcctcagtcttggtgcctgtgccagcttctgctcccccttcaggcccggttcccttgtcggctccagctcctgccccgctttcagtcccagtttcagctcctcccttggctctcatccaggctcctgtgcccccttcagctccgaccttggttctcgctcccgtccccactccggttctggctcccatgccagcatccacgcctccagcggcccctgcccctccgtctgtgcccatgcccactccaaccccatcttccggcccaccttctacccccaccctcatccccgcctttgctcctacaccggtgcctgcacccaccccagcccccatctttactccagcccctacacccatgcctgctgccacgccagctgccattcccacctctgcacccatcccggcctccttcagtttgagtagagtgtgctttcctgcagctcaggcaccagctatgcaaaaagtccccctgtcctttcagccagggacagtgctgaccccgagccagccgctggtatatatcccgcctccaagctgtgggcagccactcagtgtggccacactgccaaccactctaggggtttcctccactcttacgctccctgtcctgccgtcctacctgcaggacaggtgtctcccaggcgtgctagcctcccccgagctccgttcttacccgtatgcattttctgtggcccggcctctgacttcggattccaagctggtatctctggaggtgaacaggctcccctgcacttccccatccggtagcaccaccacccagcctgcacccgatggggtccctgggcctttggcagatacctcccttgttactgcttctgccaaggtgcttccaactccacagcctctgctgccagcccccagtgggagctcagccccaccgcaccccgccaagatgcccagtggcaccgagcagcaaacagaagggacttccgttaccttctctcctcttaagtcaccgccacagctggaacgagagatggcctctccacctgagtgcagcgagatgccccttgatctgtcctccaagtccaaccgccagaagcttccattgccgaaccagcgcaagacaccccccatgcctgtgttgacccccgtgcacaccagcagcaaggccctcctctccacagtcctgtctaggtctcagcgcacaacccaggctgccggtggcaatgtcacctcctgcctgggctccacttcctcgccctttgtcatctttcccgagatcgtgaggaatggggacccgagcacctgggtgaagaactcaactgcactgatcagcaccattcctggcacctacgtgggagtggccaacccagtgcctgcatccctgctgctgaacaaagaccccaacctgggcctcaaccgtgacccccgccatctccccaagcaggagcccatctccatcattgatcaaggagagcctaagggcactggtgccacgtgtggcaaaaagggcagccaggctggtgctgagggacagccaagcacagtgaaacgatatactccagcccgcattgcccctgggctgccagggtgccaaaccaaggaactctctttgtggaaacccacggggccggcaaatatttatccccggtgttcagtcaatgggaaacctaccagcacccaggtcctgcctgttggctggtccccgtaccaccaggcgtctctgctttccattggcatttccagtgccgggcagctgacccccagtcagggggcgcccatcaggcccaccagcgttgtttcggagttttctggtgtgccatctctcagctccagcgaagccgtgcacggacttcctgaggggcaaccacggcctgggggctccttcgttccagagcaggaccctgttacaaagaacaaaacttgccggattgctgccaagccttatgaagaacaagtcaatcctgtcctcttgaccctcagccctcagactgggaccctggcactgtctgttcagcctagcggtggggacattcgaatgaatcaggggcctgaggaatcagagagccacctctgctctgacagcactcctaagatggaaggcccccagggggcttgtggcctgaagctggcaggagacacgaagcctaagaaccaagtgctggccacctacatgtcccatgagctggtcctggccaccccccagaacctgcctaagatgcctgagctgcctttgctacctcacgacagccaccccaaggaacttatattggacgtggttccgagcagcaggaggggctccagcacagagcgcccacagcttggaagccaggtggatctggggcgagtgaaaatggagaaggtggatggtgatgtggtcttcaatttagccacctgcttccgggctgatggcctcccagtggctccccagaggggccaagctgaagttcgggctaaggccgggcaggctcgagtgaaacaggaaagcgtaggggtctttgcttgcaagaacaagtggcagccagatgatgtgacggaatctctgccgcccaagaagatgaagtgcggcaaagagaaggacagtgaagagcagcagctccagccacaagccaaggccgtggtccggagttcccacagacccaaggtgagtgctgagctaaggtccagggtggggccgagatgccgctggtctacttcgtgccatggatagcaacctcctgtgacccctaccctgtgacacagtgctgttgggcagctgtgtgaactgaacggattggaaggcttttgtaaaagtaataatgacctgctgtcccctccctaggtcacattttccatatacggtgtctcagcatggggagaggctggcttgtagtttgtaggatgtgggaaatgattctgtccctggggtagggaagccattgtcccagatgagatcggaaagcggaagaaggtattggtgagggaaatcaatgaataacaggctcttccttgaataaccattcttccttttcctttactgagagaacactggccttgagaacttagggatggggagagcaggggcctctgacggggttgttcctttcaccactggttggggggcctgcttaggatttgctgggagccttgtggggtcagagccaatttggcttctgtgctaatcagtttcctacccgctcgaatgcttgaggcagcagctttgggttttggcccactggggattggatgggcaaggcaggttgggtgtctgggtgttggtcttgacaggctatggatggtggcagagttctaggcaaaaaggtgggccaggagcacttgatgagaatcccctggtcccccagaagggaccagaggctactggtgatccaaggagaatcttgaaacatttgaggatagggtttattaaaaatctagaacaacttgaagttctgttagcaagctttcaagttggatgttcatgtacactaagggacaaaatttctggctagagcactgtgaatttggctgtggcacaagtttatggtcttttttggaccatagaccattttgaaaagctggtgagagctatggaccctgttcccagaaatgtgacctcagaattttgccaataattttagggggttcatggacctgacctctgccccatcgcccaaagctcacccagggactgcaggttaagaacccctgggataggtgtttgggtggattttaactcacaaacctcacaaccaccctggtatgtcagagacacgtgaagtaggaacgtgggtcatgacgcagtagagcatataacgtttggcaggtaattgccatctgcgctcggtggtaataagaataataattcatgtcgttagagttgtgtttttacatttgttatctaatcgttacagtaaccatatgaggtgaatgctacaccaatctacaggtgagaaaataaatgaaacagaggctcagagaggatacattacccagttacacagctactaacttgcagagctagaactcagactctggtctctggttccaaagtccatgttcttcttcagctataccatattatcttccactctctttttgtttttttttttttgagtcagggtcttgctctgtcacccgggctggagtgcagtggctcgatcacagctcattgcagccttcaccttctgggctcaagcagtctcccactttagcctcccaagtagctgggaccacaggtgtgtaccactacacctggctaattattttttgtagagacgaggtctcactatgttggctaagctggtctcggactcctgggctgaagcgatcctcctgcttcagcctcccaaagtgctgggattacaggcgtgagccacctcacctggccatcttctactctccgcccatggaactgtttcactgaatgttttgcaagtttttgttgcatggctactgtatgccagtccttcccaggcaatgggaatacctcttcaggagggtggtatcatagattgatgaggagtatgctccctggagccagacacggagcctgggtttgaattttggccccacctcttcctagctgtgtgctattagtcaagctacttaatctctatggccttcagtttcttaatctatacacaagacaataatagtatctactcatagagttgtgaagattaaatgagatgatgatataaaatgtccacaataggcaaatccatggagacagaaagtagactagtggttgcctagggttggggaggatggaagagttggggagtgactgtttaatgggtattgggtttccattcagggtgatgaaaaagttctggagctagataagtagggatggttacatagctctatgactatactaaaaacaattgaattttacacttaagtgaattgcatggtatgtcttaataaattgtatctcagtaaagctgtcattttaaaaaagattaaagaacgtgatatacataagtgtgtacagtagtatctggcacatagtaggtgttcagttagtgttagtggttgctgttattgttagcattacaaacaaaatagatgtggccccgcctctcatgaagcttatgtctctcagatgactcagtgacaggtgggcactgccctatcctatattagatgaacagttcagtgggcccactatcaaatgcagagggcagaaattaaaatgacaagatcaggggcctggaagcagctctttgcaactgcctgtaaggatttagtaaatgtctattttttgggagtgcaaatcacttcgttccttctttttttttacatgccaccttcctgagaaggaaactgttgatcagcaaactaagatcaggggtttgtttgaaatagcccctttcagggcttggccaagagtgaaaatagtctcctgttgccaataccacctgcccaaggcctctcaggatcctaaagggccttctgcatcaccagcaaagagagagagttctgcttcatttggtgctggatgtattttattgtcctctcattccttggaaagctctttggaaaatatttcaaaactgttaaccagaatgttcatctctcacggtctccccatcctcccaacttcatgcataagttggagtgtgcgaaatatttttattcctgacctcaggtgatccgctggccttggcttcccgaggtgctgggattacaggcttgagccaccgcgccctgctagatgttctgttttacttgtttttgtcttcggaagtaaaagttaatgatctgcatttgaaagagccagctaagaatgatattcagaaataaataggacatgttcaaatgtatgtgcatttgactttattccccctgacttaaaatagtttttctccagccgtacctgaaggttagtttttaagcagtagttcctcatcttcctctttccaaccaatgctttcctcctcctaacactttggtttgtaggaactggcagcaagccaagggggaaactgaacttgaatttttagctcaggcctctgctgaaaataagaagcaggaagagttcatgggataggaggagtcctggaatttgatgggtagtggtgactccctgtccctggagaattaggaggccccagcccccgaaaatgttccatcagtaaggtatgtgccatccccttagctggaggtacaccacgataaccttctagcaggcgaggcatgggtcagcttaggggaaaaacagctcaagcaagtttaacccttcctttcctcctcggacctgcttttattgttccaacgttttgcttattctgcactccctgcatactagaatactggaaatccctacattgccctatttcttgtttagtggcacagagagacctcaaagctcgtgagaatacgtgactgttaggctgagagtgtccttgcagtgtgtgagcacagccattgtgcctcttagatgtgccaggcagtgggcgtgggagaagctgagctgaagcagccgaggaagtgattcagggaagataggtagcgagagctgatgcccagaggcccgggctgggggccagacccccgggtcctagtcccaattctgggtctttctcactgcaagcacaaatgtgctaacttgcgggttggcctggtaagtggcagtccctgagccagtggacacatgggattgtgtgttaccctggacaagtcattcaaccctttgtcttggagcctccgttttcttatctgttcagtggggataatattagcttctcctcccagggttgtggggaggataaaatccaataatagagatgagagcatttggaaaggctgaaagtgctacagagtataaagtggcattatgaataatgcttgggccttttcactgggttttataaatatgaggatatttgaattgctcctgtgtcatgtttttcttcttgccttagttgaatctattttctggtattaatttacacgtgaaaagagacaatttttcttgagttggcctgtactgagaattattttcagttgttggtgcaataccattcacagtgaagttatttgaacaatgtagtctcccaacttgcagaagaggcattttgtttaatgccggtctctccattggtgtttgggtacagagagtatggggcctgactttgcaccttttaaaatgactttgggtgtttattcactggcttttgaacgcagactctgtagacctctttaaagtgatgggatgtggacgcctatggggattagctggggccctggactcagtccaaaagagcccctgtcacccactctggaaggcagtgcacggccccttgcccctggtcccccactctgggcagctcatgcctctaggtcagaaacgggacacatggctcaacccctggagagctttcttaagaagcaaaactgacctcagacctgaccctctacctctccacagtgccggaagctgcccagtgacccccaggaatccaccaagaaaagccccaggggggcttcagattcaggaaaagagcacaatggagtcaggggaaagcacaagcaccggaagccgacaaagccggagtcccagtctccaggaaaacgagccgacagccacgaggaaggtaggccccgcggccctggccctctgggctgggctgcagagggatccccagggcacagtggtgagggcagaggggctcaggcgctgactccttcactctggaaaagtgagacttcttcactgtggaaagaagatatgattgacccctctgaagtctaaggtgagcgagcaaggatcgggggccccttctgctcctcctgggtgctagaataaggctgaaggaagtggttttccgacacaaacaccaggcccacaacacagtagccgacccatttccccgcgatgggtctaggctcaaagaaacaagtttaaggagaatttagacaaaaaccacggaatgggggttcattacgctgtcttctttgggtatactggaaaactgctattctgaaaggacaaaaataaatagctagttagctaggagagtttagagaaatcttaaacgtttattatcatttagggacacacaggatatctgggatgacggggctggtatgtgtccctaacctgtccgttttgccactaatagtttctgggcacccttatcagggagagaatccccagcattcctgagcataggagtccaggttcatggtcttgcccacctgacgtgactatgacctgcctcttctggtctgttctttttttttttgagacagagtctcactttgcttcccaggctagagggagttcagtggcacaatatcggttcactgcagcctcaacctcctgagctcaagtgatcctcctacctcagcctcccgagtagctgggaccacaggcatgtgccattacacctggctaatgtttgtagttttgaagagatggggtttcaccatgtttcccaggctggtcttgaactcctgggctcaagccatctccctgcctcagcctcccaaagtgttgggattacaggcgtcagccactgcgtccggcctcatctgttcttagccgttttttctctgttcactggctccttgttcctatcttcccacctcactcaatcctccaagattcactgaggttgccctcctctgggacctgctccagctcagttagaactttgtttattttctttctttctttctttttttttttttttttttttttttttttgagatggagtctcactctgtcacccaggctggagtgcagtggcacaatcttggctcactgcaaactctgcatcccaggttcaagtgattctccttcctcagcctcccaagtatctgggactacaggtgagtgccaccacgcccggcgaatttttgtatttttagtagagtcggggtttcaccatgttggccatgctgggctcgatctcctgacctcaggtgatccacccacctcggcctcccaaagtgctgggattacaggcgtgagccaccatgcccagcagaactttgttgaggtgcagcagcctcagagtcctatgggcagtggggcctcctactttcctactttctggcacaccatcacattgatactgtgcactgccttttctggtatcagcaaaagcgaccaaactctcagtttttaaaaaccacctggaaacactcattgtctacaagagacacatatgtgatggccacgtaaggggagtgaataaatgtaacccagattaaccacagggtaaacacaaactctttctcaatctttcccccgagcctcacaggtgggctttctggtctttaagctttgattgtaacatttctgccttctgtccccaaaccacacatcactccaggttccttggaaaagaaagcaaagagcagtttccgtgactttattcctgtggttctgagcacccgcacgcgcagtcagtctggtgagtgagactaaggtgatggcccctctcagcatcttctatgaaaagagagatcgaaatctggttgagcagttttaccatgggcccaggtgtcgagttgggaatttgattcactgtgccacaatgcccagctccttgcagagataagagagccctgggtgggggcaggggacaaatagtcctcaaatattgcccactgtttgaggattatttgttcaacttttcagagcagggatttgacatctcttgttgggagctgatggtggaaagaggtaaggcctgtgccactcgggaaagctggttcaactccaagctttggcacctcgtcattactggggctaatctcaggcacagacatttaactttctaccttggtcttattgccctatgtgacaggcagcctcaaagttggaaaagtcattgaatcgtcagggctggcagaatcacatttggctccctgaatttgtgttggtcaacctctagggactaaaaaaagctagccctttctagccaccactaccttctgctagcctccacactggtatccagggctggagatagttgtcccagttcacccaatttccatgcaaattggatagaatggggaagcaaggtatagtgtaaactcagttatctgacattctagtaaccggcaccttagcacatggcaagcgaggtggtaattggggctcataatgatggcctggaggccttacaaaatcctgaagtgtcctctgaattatcaaagagcaattacattacagccagtcccattttagtgttaaacacattgtactgtatttgattctttggaaattggtgatccctttgtgatctctatgatgattctgtattaaccagaatattagattaaccagaacactttgttttgcctagtctatataatggaaaatgtgctgttatttgctgtcttttagcagtgtgactaacttgaagctttggtcaagggctacttactctatttgcctcgaaccatttctttcttctgctgacttcgcttgggtctggggactgttgagttaatagctgggccttgggagaaagatggtggtgtctcacagctgcttccgaggaggaaggtgtcaaatctcctgtagtgtgaaaccaggccaatttaggatgtactttcgttgttagcagagttgaaggaaagagtggagagagaaaatggcctcttggcaaggtggctgaggaaggcaggaaaggtaccaatccatcctggggtggtgggggaggagggggaagcgcttgcccagcggtgaggaacagctacaaccgggtggagggaggtgcctgggaggaagctccacccctgaactcttggcaagtcgggaggaggtggggtcaatttaagggaagtgggcgtgcctgggtgcatttgggcgtgacccaaccaggctctgtcacagatcacaggaaagggactccttcttgcttcgcttttcttgagactcttctcttgtgatgattctgcttggccggggtggctctgtccccaagattggtggtgccacaaaaggagtatatcctcccttgccctgtctgagaccccaattgccctctcctagcccctgatttcccagggacccgtggccctctcctgcccttcacaaaatacttggcactttataagagctaagcaagagttttgggtgtggattcaggtgacactgtaacgtggatgagtaagggtgtgtgtttttaatacttgatgttgtctggtatattggactctgtaaagcacatatgcgtgaaaaatcttatttgagcctcaaaacagccctgtgaggtcagtaaggggagaacagtatccccattttatagatgaggagactgcactgaaggaactttcccgaacggtacagctaataactggcagagcctgaacttgaacccagaccttcaaactcctagtccagggcattcacttcgacaccatgctttgtcctttgaagaagtacctgaccatcctctgtacatcccatccacaggaagcatctgtagctcctttgctggcatggcagacagtgacatgggaagccaggaagtcttccccacagaagaagaagaggaggtaacccccaccccagctaagcgtcgaaaggtgagaaagacccaacgggacacccagtatcgcagccaccatgcccaggacaagtctctgctgagccagggccgaaggcacctgtggcgagcccgagaaatgccctggaggacagaggctgcccggcaaatgtgggacaccaatgaggaggaggaggaagaagaggaggagggcctgctgaagaggaagaaacgaagacggcagaagagccgaaaatatcagactggggagtacctgacagagcaagaagacgagcagcggcggaaagggagagcaggtaaggctggccaggggctctgctgtcgccgcggcccgtttggcttctgggaaccctcgggcatctctacgccagccaaaggcttcgggacccagagaaacccggtgctatgatctccagctgccagagggggtcactcaactccagctccgagcctttggctttgggttgacattgaatgagttcggattggcctgcaggtgagcggaggacatgaaggcccaagccctccggtttcttatagaagtctgaacctgtgggcaaggccacggtgacatccttggcatgggacaactggataccagggagttctctggttggcttgagggagtcgagtcttttgggaggacgggttctctctcctagaatcttgggttcaagaagacagagggcatcggctgcctttcctgggatacttgcagcctctaagctaaaaagaagtacagtgggttcttcaaaccaacagaagaacttcaagtagaaacgggcacagcattgctttatccgttaaagccacagtgattattcagaggcggagtgaagctttgaggtgacccaaagtagcatcatttttgttggacctgagttgagaaggcaggcagcccaaagagaaaaccaggctttctctgaccacatcaaatgctgtgatataccattccggaggcacagactgtcacaagatgctaatatcagtatgttccactgagtactgttcaggcccattcctatagtggatttctaaatgagcaaaaagcacatctttgggttttataagaacacctctgtctctcactctcattctctgacctctaccctggaagcagcaattgattgcctcctatgatgtattcatcctgagctgccggtaaacatccgctgtctccttattagctaaaactgaataacctcatattgagtgggtagtagagtccaggtttgctataatgcaaagacggcttaacctcatttccggctctgtttaagtggaggtgtatatgatacccatctctacgctcaagagagtaattgagctaattttcatcaactatgtgacagagtgggaacaattctctttcttctgctagagcaataatagattggtcaggaatgagttgtcaagctgttggcctcagccacttgtgttaggatgaagaggagcttttgtgtatcacctaatcttctctaatggcacctggtttcctagcatggaagcttcctgtggaacatattggcgcttggaaccagaaggaccttcgaggttgcctggtccagtttgccacccaatgcaaagatagagatctccacagcattcttgacaggtagccagccagccttttcatgaacacacctccagtaacgcagagaacaccaccaatcaaggcatcctacttgatttgggggcagctccagttgttggaaagtaggtcattcttcctctgtggatgtgtctaagggttttgcattgaggcagctggatttggcacatggtctggttactttcctccagatctgatgatggcatcttcgtgcaggaatttggcaaaggccaaatgaggcaggttaccctgcttctgtctgagcctcctgacttttcttttcatcctggttttggttatctcccttcttgacctgcggagcaggtaggcagagccacttccactcacacacctgccacctccgctctctagtcctttgtgggctactataaagccttcacttctctgcaattgaataaacacccgagcctgccctgccctgggtaaacaaggtggggggctgtttctttgcctgtagcattgaacactgtaatatgacttcttcatgtttcctggggtcctcacaaggcatggttctgttccttcctcttttgcctcagcccaaatgtgtcgcatcaaaagctggagtttagaacattctgactggaagtgctattagagaccatgtagtacagcaattcctggacaggctatggggccccactagcgggctgaggctagctgggagaaagggatggcatgacagctggccttccaggaactgtgcataagctgcagccaactccttgtgctgaaatgatggcttccacatctggatctgcctttgtcaatgtcacatgtgagagcccgtgtcagggttgagagaggcgagttgagaactcttcaatctcagtcccttcatttcactaattgctaggcatggtgttcattcctttggggaggaaaacacacgggcatggctccacctcaagagcttgtgcttaaataacacaataatgatgtcttacttgttataacactttttgaaaggggttttgcatgtattatcttatttaattctcataccactcttgtgatgtagattatattctccccattttacagatatggcaactgaggctcagagcaattaggacttgagcccagccaatcacacaattgatggccaagccaagcagcactaatcttgagagatgaggttaaacacacagtcgcccctacacacggggttaggacagaccctgtgggatgaagctcttgataatggagttcccggcaggcctttttgaaattagaatgtgctttgttcagcaagctgtggctaaattagagatgttgctggtgtgttctagtgacaccagtgacttgattttcacccagaaaaggcagcaggtttctgcccttgactgccagctaggtaggctcatgatgccttctagtttcagggagttcctgtagctttgatctttgtgtcctcggagagtgacaaatggggcagtcaggtgagtagagctgaggccatgaaggcagccttctaccttttcctccctgttccccatgtacttgatacttaatgtcagcaggaccaccagatttgctttcatacgggactggagaaacagacaaagggaatgggaaaaaagcaaaaagaaattctgatttgctctgggctctgggaaaaatcctgttaaaattacccttatcttagggctagccagatgggccgccccctgctggcagggctgggagctgtctcctgcttgtagatgagggacttcgatgttgaagtatggtgtgttcattcaagaagtatttagtggaatagtcagcacagcactagatatcgatagctgatagttatacaactttgcactgcagttctaatccccaaagtcctctgattcatcttagaggaaggcgttgcttttctgtgttccatttctctgacatccgttcttttcctgtttcttgccttcagatttaaaggcccgtaagcagaagacttcctcctcccaaagtttggagcaccgcctcaggaacaggaaccttctcttgcccaacaaagtccaggggatctcggattcaccaaacggtttcctcccaaataacctggaagagccagcctgccttgaaaattcagaaaagccatcaggaaaacgaaagtgcaagaccaagcacatggcaaccgtctcagaagaggcaaaggtgtgtagctatcaaggggtattgtagaaggtgtgtgtggcggggggtcagaggaggcaggaggggggtgggggatggggaggatcaaattaacccatatttagtaaggcattctcaaactagttctcgaagggttgggggtggatttgaagaatgggaactaaagttatagttaattttaaggtctggcccatgatggcttttcctctacaatctttagattttctttgagttaaggaagagttaaagaatatggcaggatgttagcttgagtagctcgttaacatccaatcaagaagcttttgtctgggtttaacttactggaaaccaatcttggaactttctgagtcaatcaaggtagaaaacaacttgtaggaggaaggattttaaggtccagacaaaggttgattgagggtgaggctgaaggaattccactggggcccaggttctagctactcctcccctaccctgcttcccagttctttagcttctcatggaagcgtagatgctagtgagtgggcagtcaccaatcaacagccaggcaagcattcctaaaaccctcatcccaaatcaacatctcttttgggtctgatgttcatgccattggtgttaggttgcatgttgtatccttagaaaaaatcagtcttcaacctgggttaactttacatttgagagaagtgagggtccgggttcaaatgtatacctataatatgtatttgtcattgacagccaaaaacaaaagcccatcttcagcttgttttggtggtcgtgattcttatttttttttttctctctctctctctctctttttgagagtcacacgctttcgcccaggctggagtgcagtggcacgatctcggctcactgtaacctccgcctcctgggttcaagcgattctcgtgcctcagccttgtgagtaactgggattacaggcgcccaccaccacgcccggctaatttttgtatttttagtacaaaaatacaaaaaatcaccatgttggccgggctgatctcgaactcctgagctcaagtgatccgcccgccttggcctcccaaagtgctggaattacaggcggaagccatcacgcctagcgctttggtggtcatgattcttactggaatccccgaatggcactggcaagaggtgggagccccaagtgctcgtctcccctcctttccccttccccctcccagaacctctttccagctcagacaagactcaagcttatttcttcatcttgaagaatggagctgctgcttcatgccctttctgtctcacaagggtgcttgggggaacaaaggaagcaatgtctgtgacaggctttgataaccataaagtgctctccgagggttgctgtgcatcattgtgcttcgggcggaagcaagaatgagggaacagaggcatagcgtggcagggtagcagcgttcgttcccttgaccccctagagtgggaggacaggggcccagggaaagagcagggaactctggtctgtgccaagcagttcattcacgttatcgctcttaattcccgcagtggcacttgggaggtaggcacctttattatcctcattttgtagtgaggaaactgaggctcaaggaggttaagggacttgtgcgaggttattgggtggtcctgagtgatgcagttgggacgtgaaaaaggcctgtctgcctctggagccatggctcgttccatatgtctctcaggctctgaatggggggcttctgtttgtatttgggaggcactgggggaagggggcagttgggcagaaaatgctgcctccacaagcagcgctgggaaaaggtgggcgtctcaggctcctgctccccctccccttccccctgttcctcccccagacactcagatggatggccccagcccacacaaaggtaaccagcgctcgagattcagcagcacactcacatgcttctgtctggctattctgcctggcagtgggtccgctgcagtgttctcctggagaggtttttgtccctccctctgaccttcctttccccctcccaccttcctttctctcccagtcaccaccacctgctctggttgcccccatggcatggggctttgtagcaggaagcaaggggtgggggagggcggggaacgctcctgcaacactgaaagcggggcactggccaagggcttcttcccacaggggctcagagccagggggaaggagagagggggaggggtccccccacttgttcttgctcctccccctcccaggcaacttgcctcgctgctgctctctggcagctttggcccccagaaaggagagtcaccctttggttcctggcttggcttagtgaaaccctggtactttacccagcatcctccagtcctgccattgtacattctatcctcctggcgataaagcagcattgtaccctcatagctagtgccttcctgctagggcttgtacctctctgccctttcaggatggggactgatcatggcttctcgctgtcttgggattgaccagaggaaacaaatgccccgagccctcatcttctgttctctactgctcctttcctgacttgatgtctttttaggcaacttttctggccatccagggctctgcacacagctggcttgaaacaggtcaacaaatatttgttgtaataatgtggccaggcgcggtggctcacgcctataatcccagcactttgggaggctgaaacaggtggatcacatgagatcaggagtttgagaccagcctgggcaacatggtgaaaccccgtctgtactaaaagtacaaaaattagctgggcgtggtggcacctgcctttagttccagctacttgggaggctgaggcaggagaattgcttgaacctgggaggcagaggttgcagtgagccaagatcgtgtcactgcactccagcctgggtgccagagcgagactctgtctcaaaaacaaacaaacaacaacaactaataataataatgtgcccagccctgagttaagtgctgtaaggaacagaaaaatgatgacaatatgaaccctgtccccaaggagcttaaaatctagcaggagaggtgagacttacgcgtgaaactctgggtggaaagaagaaagtgaggcatcagattacgtggttcagacttggtactctggctacacagaggaagagggcccagagtgttgtggaatatggtagaagacagaggattgaactgagaccttgatgttctgaggggtttggataagtcggaaatactagttatctattggggtataacaaattactatacaacttagcagctttacacaacaataagcatatgttatctcacacagtttcttggggtcaggaattcaggggcttagctaggcctggcttggggtctctcgtgaggttgcagtcaggtgtcagccagggcagcattcctctgagggtgtgactggaggatctgcttctggggtagcttgctcgcatggctggcacattgatgctggttgttggcaggaggcctcctctccctgccccatggatctctccagtgggctgctcaagggtcctcaggacacggcagctggctttccccacgagtgatccaaaagagagcaaggcagaaaccacagtgtcttttaggccctagcctcagaagacacctactgtcatttctgcagtctcctgttggttacataggtcagccctactcactgtaggaggaaggtgcataagagcatgaagatcaggggatcactggggccatcttagaggctgactcccacagtctgccctctggcctcccccagtgattcctgtccctcccacatgcaaagtatgccacctctcccagtgccccccaaagcttcatccaattatagcatcacctccaggtcgagaatctcttctatttatttatttatttatttatttatttatttatttatttatttgtaatggagtttcactcttgttgcccaagctggagtgcagtggctctatctgggctcactgcaacctctgcctcccaggttcaagtaattctcctgcctcagcctttcgaatagctgggattacaggtacctggcaccactcccggctaattttttgtacttttagtagagatggggtttcaccatattggccaggctaatctcgaactcctgacatctggtgatccacccgcttcagccttccaaagtgctgggattacaggtgtgagccaccatgcccggcaattttttttcttttcttctctctttttttttttttttgtaacagagtctcactccatcacccaggctggagcgcagtgccgcaatcttggcatactgcaacctccccctcccgggctcaagtgattctcatgcctcagcctcctgagtagctggaactataggcgtgtaccaccacgcccagctgattttttgtatttttagtagaggctgggtttcactgtgttggccaggctggtcttgaactcctgtcctcaactgatctgcctgccttagcctcccaaactgctgggattataggcgtgagccaccgctcccggcctctcctagtgttttgtgagcacctaccctgctcacagttctggagcctttgtagttcattatctcaaagaccctgcaaggaagaaagtggggctcagagagggagggccttgccccaggtcttctagctaggggatggcagaggcaaggttcaagcccaggtctgccttagatctttctaccaccccaggggagtctgagtatgatatggggacacagtgtgatggaagatgggaacattctgtgaggactggatgtggaaggaaggtttttgctacaagtgtgaagctttagcagctgtgactagtcaaagatagccggccgggcatggtggctcatgcctgtaatcccagcactttgggaggccgaggcaggcggatcacttgagatcaggagttcgagaccagactggccaatgtggcgaaacccctctctactaaaaatgcaaaaattagctgggcatggtggcgcatacctgtaatcccagctactcaggaggctgagggaggagaatcccttgaacctgggaggcagaggttgcagtgagcagagatcacaccactgcactccagcctcagtgacaaagtgagactcggtctcaaaaaaagaaaaaaaaaagatagctgtctcatttctctttactctcagagtttgcttctgcctatttacagataggacttataaaaacctcaataaatggtgattgaggcaggtaaagaaggcatgcagagtcttgagagaagctaggatatcccctcaatctctgatttacaatccctgtggcattccttggtttatggggttgagcatttgaacctcttcatatctccccaccggctacaaactcatgggaacctgtgttgatcctggagagacttcacatggttagcgcctggcccagcgtctggcctcaaacctgacagtagtctcggccatttagggtagtgtaagcaaagtacagcatggacacagataaggtgagatggccttggccactgagggcagtgatgaccctggtggatggataagctgcctggcctgacctgacctaggactgcatctctgctttccagggcaaaggtcgttggagccagcagaagacacgatctcccaaatctcccaccccagtgaaacccacagaaccatgtacaccctctaagtcccgaagtgccagctcagaggaggcctcagagtcacctacagcccggcagatccccccagaggcacgtcggctcatagtgaacaaaaatgctggtgagaccctcctgcagagggcggcgcgtcttggctataaggtaagggagttttcgactgaccacagggcgccgttggtctgagcatctatgaagaagcttttctccatgggctcttctggtgcttgaacccaggctggcctccctctacaccccagattgccctggggctgccttgcccctcatcacttggatgtcagcgtgtgagaatgcaaacttgcttgaatgtcaatttgggatgaatgcaattgaaatggtatcatgcagtatattcctagaccaggaacgcaatttttggatatccacgttgtcttaaatttctctgtatggtggtttcccaactcagaaaggaacaaggggtgatttattgctcactcttcatctcctcctccagcttcccctcattttcgcctctcgcagaggggccaggatcatgtttgaggggcgaggctgagctaaccccaccttatactactaccctatagattagaaagaaggcaagaaaggaagctggcatttattgagcacttcttttgtcatgtgaagagcctgattactttgtatcatttaatctcacagtaagccgatggagtagatttattatccccattttataggtgagaaaatcgaggctttgcagtgttactgatatgtctaagatcactcaactactacgcatatgagtctgaattcaaaccaaggtcttttgattcccaagtgccagggtaggtggaagactgactcattcaccataattcagttacaccttggacgtttccattgttccccactttttattgagtgtgtatctttgcctaccatatggattatttcctcagggtatgctcctagcagtggagttgctgggttagttacagagtgtgcctttggttttaaggctttccatccctatacctgagttgtttcacaccagccacactcccagccagactggtcagctctggggagctgacgtgacagtgtctcactggcaagcagcccatctttcatgagcacctagtgtgcgtgcctggatagctgccgagggagacctaaaacaaaaatcaagaccaatccctgccgtcaaggttaatttaattgtcttgtaccctgggcaaaaccagccaacaggaaaccattggaggggccaatgggacagggctggagcactaaggcagcctgtcagggagggtggaaggagcccttttgggcctgggggaagaggcagacatctgcactggtgaggagggtgggaagcctcgggctttctcccgggtaaaggagcttgacagtttctatatacagccagcagcacccctgacacaggctgcacacacagccgctctagccagctagcctgtgagctgtcagacagaaaggtggagtggcccatctccccagtgccccagagaggactggcaatggtgcagctatgggatccattgtttggaaagccaggcagccattaatgctgccagcctctcccctcctcacctcattcacccagcttcagcccatgctagctagggtgcttcaagtccctggtgtcccacctgtagtcctagcatcatctcaatccaaggaaggcagtcattaaagtgtggatgaatggcagtattggattatcctttttttttttttttggagatggagtcttgctctgtcacctaggctggagtgcaacggtgcaatctcggctcactgcagcctccacctcctgggttcaagggattctcctgcctcagcctcctgagtggctgggattacaggcacctgccatcacactgggctaatttttgtatttttagtagagagggggttttgccatgttggctaggctggtctcaaactcctgacctcaggtgatctgcccgcctcagcctcccaaagtgctgggattacaggcgtgagccactgcacccagcctattggattatcctgatttgaggggagggctagaactgactgtcctggcttgaacattggtcctgccgagacgtgcatccagggatagtccttaaaacaattgtcttccttattcttgaattgccaccagaggctgtgctctccaccacatctcatttctctggtctggggctggcttgccaagctcagggagtcgaggtctgagtgcttgagctctgggcgggcaggtcagcctctctgaggacctcacctcaaataccaccacccagatgagtgtccttggccataaaaaaagtctctccaggccaggtgcggtggctcacgcctgtaaccctaacactttgggaagccaaggtgggcagatcacctgagttcaggagctggagaccagcctggccaacatagtgaaatctcatctctattaaaaatacgaaaattagccaggcgtggtggcgtgcgcctgtagctccagctacttgggaggctaaggcaggagaatcgcttgaacctgggaggcagaggctgcagtgagctgagattgcgccactgcactccagcctgggcaacagagtgagactgtctcaaaaaaaaaagtctctccactgccaaggaaacggcccagagctggggtcctggcaattgtggctcaggactgatgttgttaatgaaagattttgaagtgtgtccctgctataaagggcaggctctgagactcctcagatatttggggagctttgagtctcagggttatataagttcaagaattagacctctctttgctcatggagttgtccctgtccccacaggatgttgttctctactgcctccagaaagacagtgaagatgtgaatcaccgtgacaatgctggctacacagccctgcatgaggcttgttcccggggctggaccgacatcctgaacatcctgctggagcacggggccaacgtgaactgcagtgcgcaggacggcacgaggcaagagggctgcatctccccccagtcccgccctcactcccagctcagcctctcactcaaaagaccttgcctgccgctggcaggcatggtggctcacgcctgtaatcccagcactttgggaggccaaggcgggcggatcatgaggtcaggagttcgagaccagcctggccaacatagtgaaaccccatctttactaaaaatacaaaaattagccgggtgtggtggcatgtgcctgtagtcccagctactaaggaggctgaggcaggagaattgcttgaacccaggaggtggaggttgcagtgagccgcgaccatgccattgcactccagcctgggtgatggagactccgtctcaaaaaaacataaaaaataaaaaaataaagaccttacctcaacctgaaccttcgtagcacaccagactgcgagttgcagagaggccttgacaggaggagttttggaaagacttctataggctcaagagggaaccagtttagggcaggagccaatgagttagttcccagatggccaggccgcatcagttactaaggggaggctgtggttgtctagggatcatcccatcatgtgtagctgtcaccaggaagaccactcggtcttccctcaactcatcctggtgggggacgtgtctcagacagaatagaaactgagaggttgacctgagggtaatatccagatttgatttttaaaatttgatctctagacactgtaagaaaaatacacctgctgtgtcttagagaaattgtacccattctcctctgttctaccagagagcctacttcctgggcaaattagagacaggagctgcagatccaggagggggctccgcttgggttctgcctggcgtgtggagcccttctgctcatctctgctctcagggagtcacccagggccttcagttccctgaactgaagtatccctctacagttgcccccaccttttttttttttttgagatggagtctcactctgtcgcccaggctggtatgcagtggcacaatcttggctcgctgcaacctctgcctcccggtttcaagcaattctcctgcctcagccttctgagtagctgggactatgggtgcccgccatgacgcccagctaatttttggatttttagtagagatggggcttcaccatgttggccaggctggtctcaaactcttggcctcaagtgatccacctgcttcggcctcccaaagtgctgggattacaggcgtgagccaccgcgcccggcttccctgcagctgccttaactttattgtaggtcagggacccatcctctagtgaactccacaactaccaatagagctacattgtgccatgggaactgtcccaagatgtcaggggaacgtaagagagagagagtaatgggagggaggaaaagggggtacagagagaggaggagttggggagatggtagtggagagttgcaaggctacaggtggttcccttgtcctaagtcttaaaccatattacaccaaggttacctgggggtcagctcagttttttcccctgatgcagtagccttaagtgtagacaccccagttcccacttgggccctgttatcctcaccctgtatcacctccacaggccagttcatgatgcggtggtcaatgacaacctggagaccatctggctcctgctgtcctatggggccgatcccacactggctacctactcgggtcagacagccatgaagctggccagcagcgacaccatgaagcgctttctcagtggtaagcatggtccagacttgacactgttgtccttggggccagcctctgattcctgaacttgtgaggacatcctcttcatctccttccaccttgaacagctcccatgagggccatctgccctcttcacctgctttcattcaaagagctcaagaatctcagtttgcttgaaaaagtccaaaggccacttcctcttatccccttactgcaagtgtgtgcgtcctcttcagggccctgggagcccacagggacctatttcgtagctagggatctagggtgggcctctgtgtgggggcggcagccccactagtagacctagctgggggcagaatgtgttgacctgtgctttgaatgggatgtcagttgcaacaaagtgatacttagcattttgcttatgtgtttgcaatttcttcttgtttgtgatcaagtggatcacagtggaacccctgggatgcttcccgaagcttcattctttacagcccttgcctgtgggaactgtgatgttccctctgcatcccagggtcccccttccttccgttccttttcctccctcacctgccccttctgtaaagtgtctggtgttgaggcccatggcaagggccacaagccaacatgcatttattttctcattagtggatagcagctgtttgtctgcagttagatagctctactgagttgggcagggggaggagggaaggaggggagtctagcttgggcatgctcagtaggaatctcctcagacttgacctctgaataaaggaaccctgcctcttagtgacatcacagtttggcccttgctctagcagtgacttcttcagactgcctgagcggcggagcagctgggagttgtatctctgaaccttcttggaggctgcagtgtttgtattgtggttagaacccctctctggccaggagccaacaggactaaggattggcccaaagctgctccctcttctcacccagactttggccctagttagccccgaacctctatacctccagatatatggttccaggctcccaaccaggggctcatttgtttatccaacaaaggttaactaagtagctgatgatggaggaagaaacaaaggggacctaactaaaggctcttatggaaggggaggactaggtaggcggtgagtggggggtaataggaggctgtcgcgggagatcttgactcctgctcagccagcctccacccaggtctcagctgagctgactaaaccttggagcacaggccttaggcctgtacagcctgactagcatctcccaggctgggggcaggatggctgccttttctgttttccctccctccagctctgggttcccaagcccctgtccttgaggcgcagagcagccttggaatgttcattcagtcatttgtcctgggccagtggtgactgttgttccccttagctgaaccatccctaggggtgcagggcttggggcaagccaccgttggtagctgcctcccacgtactgtgtacacatgcactctctcttagacacatacacgtgttatctgcactccactggattcccaggaaaatctgagaccaacaagcatccagagcatcttgatatgacaaaggcaccacacgcagctctgtctttgagaaaccggtctagtcccgaggcctccttaggctagaaactgccatcccgagggtctcaggggctcctagatctaaataacactgtgaccaccttagtaaacagatgaactctttgcttccccaatcccttctccaaaacccctaaggagtaggaatgtggaaaccattttaagtagttaaaaaatgggaaataggccaggcgcagtggcttatgcctgtgatcccagcactttgggaggctcaggtaggagaattgcttccggccaggagtttgagaccagcctgggcaacatacggagaccttgtctctacaaaaaaatttaaaaattagccaggtatggtgactgcactccagcctgggcaacagagtgagacagtgtctcaaaaaaaaaaaaaaaaaaaaaagagacagagaggagagaaataaacacgtttctcttatctttctgtctcctcatcccaactactagctatcttttggttttgttttgtttttggcgcgatcttggctcactgcaacctctgcctcccgggttcaagcgattctcattcctcagcctcctgagtagctgggattacaggcattcgccactatgcccggctaatttttgaatttttagtagagacagggttttgccatgttggccaggctggtctcgaacttctgctagccagctttttgacacctcctgaaactaaattgaatgccagtctatgttgcagaattcagagaagacttttattttttttaggcggagtcttgctctgtcgccaaggctcgagtgcagtggcgtgatctcagctcactgcaacctccacctctcgggttcacaccattctcctgcctcagcctcccaaggagctgggactacaggcacccgccaccaagctcggctaatttttgtgtatttttaatagagacggggtttcaccatgttagccaggatggtctcgatctcctgacctcgtgatccgcccgcctcggcctcccaaagtgctggaattacaggcgtgagccaccgcgcccggccccagagaagacttttcttaactctagtacttcacatatttgtggtgtgtgtgtgtatgtacgtatatgtgtttatatatatttgagacagagtcttgctgtgttgcccaggctagagactccagcacttcctaacttgtcctggctgagcacctttatttagatttgttaaaaattactagagacagtgtcttgctctgtcaccgaggctggagtgcagtggtacaatcatagctcagtgcagtttcaaactcctgggctcaagcaatcctcctgcctcagcctcccaagtagctaggaccacgggtgtgtgccaccggtcccagctaattttgtattttatctttttgttgagatacggggtttgctatgttgcccaggctggtctggaactcctgggctcaagctatcttcccgccttggcctcccaaagtgctggaattacaagtgtgagccaccatgcccagtcttcatttagaccttttgctcaatttatgggcatgaatcaggcttaataatgggagtcaggagccaatgggttgctataaagtgcaccagctcttttccatgcaaaggcagcctgggaccttggcctaccaccacaggaaggcaggcactggcaggagtcagcaggctctcaagaagcagggggcccttaggcccaaaggctgtttgtagggtgtgtgagaggacagcactcagggacttttttaaaaattgaggtaaaatttacctaacataatcattttaaagtgaacaattcgggccaggcgtggtggctcacccctgtaatcccagcactttgggaggccaaggtgggtggatcacttgaggtcaggaactggagaccagcctgaccaacatggtgaaaccccctctctactaaaaatacaaaagttagctggaccgtggtggtgcatgcctgtaatcccagctactcgggaggctgaggcaggagaattgcttgaacccaggaggtggagtttgcagtgagctgagatcacaccactgcactccagcctgggcgacagagcgagactccgtctcaaaaaattaattaattaaaaaaaataaagtgaacaattcagtgggatttagtacattctctttttttttttttttttcctgagacaaatctcactgttacccaggctggaatgcagttgcatgatctcagctcactgcaacctctgcctcccaggttcaagtgattctcctgcctcagcttcccgagtagctatgactataggtgtgcaccactgtgcctggctaattttatatttttaatagaggtaggtttcaccatgttggccaggctggtctccaactcctgacctcaagtgatccgcctcccttggcctcccaaagtgctgggattacaggcatgagctaccgctcctggcccatttagtacattcctaatgttgtgcagccaacctcaggggctgtttggatgccttgaactgagtgtttggctctcatttttcatgcctgtgtgcctccctgccaaatctccaggaaccactgggtaggttggtagggtggctgcaggaagcacccgagtgtggagactggaggctggggaagcttttccctccactgctctgcctcctcagcccctacacctagatacatttacatggacttctgatttatttatttatttttgagacggagtctcgctctgtcgccaggctggagtgcaatggcgcaatcttggctcaccgcaacctccgcctcccaggttcaagtgattcttttgtctcagcctccccactagctgggactacaggcgcccgccaccatgcccagctaatttgttatatatatatatatatatatatatatatatatatatatttttttttttttttttttttgagacggaggctggaatgcagtggcaggatctcggctcactgcaagctctgcctccctggttcacgccattctcctgcctcagcctccggagtagctgggactacagtcgcccgccaccatgcccggctaattttttttgtatttttagtagagacagggtttcaccgtgttagccaggatggtctcgatctcctggcctcgtgatccgctcgcctcggcctcccaaagtgctgggattacaggcgtgagccaccacgcctggacatttgttgtatttttagtagagacggggttcaccatgttggccaggatggtcttgatctcttgactctcgtgatctacccgcctcagcctcccaaagtgctgggattacaggtgtgagccaccgcgcccagcctgattttaatttttttactttgctgtctggctgaggtatttaaaatgcttttggctttttgtccccaagcatttgcttgactagaccctctgttgattaattgtcttcatcttcccctagtggagtccagctgggcagaaaatgaaggagaatccctttagggtgcacagggctccatttttggcgggaggaaaaggtgagcattagcgtcagggttatgcctcatgtagcgcttccctggctgtgtgcaaaggcccctgttgtggaaagttgtcgggggaatcaaatccttttctcttttttctttaattttttttttttttaagatggagtctcgatcttgtcgcccaggctggagtgcaatggcacgatcttggctcactgcaacttctgcctcctgggttcaagcgattctcctgcctcagcctcccaagtagctgggattacaaacgcccaccaccatgcatggctaattttgttttttcagtagagatggggtttcacagtgttggtcaggctggtctctaactcctgacctcaggtgatccgcctgcctcggcctcccaaagtgctgggattacaggcgtgagccaccgcgcccagcagtaaatccttttctaagtacaaagaaatgtcactgttttccggtatcctgaagtgagtccttttgtaaagcagaagatagataattcatctgggttgtaaatgtagattttcttatattgggttgacttaaggtgaggcccatttctcctgagatcatgaaggatggagtggcactcctttattcattcgttcatccgtccatttagtgagcacctattagatttcaggtgctgtcctgggtacaggaggccagacggtgaaccctttctacctcatgcttgggcttggagcgccaagccatccaaactccctgagaggcctctggaaggcctcccccttcagccaaattacaggcaggtatgtgactgatttacctttgtccctttgaagaagagagcaatatccaagctggctgaaggaaaacagacttgtttttcctcgtctgttggaaagaatgtagggcttacccagagttgatgcagtttggttcgggacatcagaggaagtatcaggacactctgccttccacctatgaaagggttagtagtttaccgcttgaagtcactgaatcacaggttattgtttttcctgctagatacctctgccatatgaccccatgttgaagaccactagttttttgtttttctcatctttcaagtccctcagctggtgagtgagttagaggagatggggaggggtatgatcggaccctgaggagtagacaaactgctggggtagcctcttgaattgaggtgagaggctctattcttaccatgaggcctgagggtgctttttatttttatttatttatttacttatttatttatagacaaggtctcactttgttacctaggctgaagtgcagtggcgcagtctgggctcactgaagcctcgacctcccgggttcaagcaatcctcctgcctcagcctcccgagtagctgggattacaggcacacattaccacaccaaaataattattgcattttttgtagagactgggttttaccatgttacccaggctggtcttgaactcctgagctcaggtgatctgcctgccctggcctcccaaagcactaggattacaagtgtgagccattgcactgagcttctgcgggtgcttttttaaaaaagaatttatcgagatgaaattcatgcaacatgaaattaacaatttaaaaggaaataattaggctggtcacattggctcacacctataatcccagcactttgggaggctgaggcaggtggatcacttgagcccaggagttcaagaccatcatgggcaacagagtgattcctcatctttacaacaataacagtaacaaaaattagctgggtatgttggcacatacctttggtccccattacttaggaggctgaggcaagaggatcacttgagcccaggaggttgaggttcagtgggtcgtgttcatgccactgcactccagcctgggtgacagagcaagaccctgtctcaaaaaaataaaaacaaagcaaacaattcagtgacatttagtatattcactatcttgtgcaaccacctctatctagttccaaaacattttctttttttttttctttttgagacagagtctcactctgtgacccaggctggagtggtgcagtggcgtgatcttggctcactgacgcctccgcctccgcctcccaggtttaagtgattatcgtgcctcagcctcctgagtagctgggattacagacatgcaccaccatgctcagctaatttttttttttttgagacggagtctcgctctgtcacccaggctggactgcagtggcgcgatctgggctcactgcagcctccacctcctgggttcacaccattctcctgcctcagcttcccaagtagctgggactacaggtgcccaccaccacacccggctaattttttgtatttttagtagagatgaggtttcaccgtgttagccaggatggtcttgatctcctgacctcgtgatccgcccgcctcggcctcccaaagtgctgggattacaggtgtgagccaccgcgcccagcctcccaaacattttcatcaccccaaaataaaaccccacacccattaaacagctactccccattcccccttcctccctgccccccgcccaaccactaatctttctgtctctatggatttccctattctagacacttcatatcaatggaatcatacagcatggggccttttgtgtctggcttctttcatgtagaatactgttttcaaggtctagccgtgtgttagcaggtttcaattcttcattcctttttatggctgactaatattctcttatgtggatatatacgccattgatggacatttgggctgtgttccccttttggctgttctgaatggggctgctgtgagcacgcatgtacaaatacttgtttgagtatccattttcgttctttggggcatatacctaggagtggaattgctggacttagggtactttttcaaggaaaggataagagaaaagggctggaagcgtggctggggtggagggaatcaagggaaaggaaggtccctcttcatctggactgtatgtgaacgtccgtgaggaaatggtaatggaagccacaccaccgaccaaatcttggagctcctcctgtgtgccactcatgggcctgtttgagctttagcttctttgctcacgccagttaacttttggctgtctcaaaaaggcaaattcacctgcaaatgacaaagattggtagtcagtgaagagaattagaggaatgtgccagaggctttgaaggaagttcccagagaggagccccaggaatgtggtgagttagggctgctccgatggaatccttgtgtgtcctcttgtggggaagggggacagcagtcatttgaatgcatgtgtttcggcatgttggttaagcaagcactttctagtctcgccttgtaggaattcctccctcctttcctctccatatatttattaagctcttactatgtgccaggcactgggtttaggtacggcagagacaatggtgaacaggacaggcatggtccctgtctttttagaacttatgctctcactccataatctcccatgacacctaacacagggctaggcacagaagacacacccacctaactgacaaatgtttctggaagaaactacttccaaccctcaagtgacatggggtacaaaggagcacctgagccgacagcgggactgcagttgtttttcagggagtgcacagaagatctaatgtgcatgactagaggtttcccactctggttgctcagccatgactctgaaagcttctctctggctgccttttcctactgggggaaacccgccatcacctggaaggttgctaaagaaatgagtcatttcagtagctcacaatgctaataggtgttcttgtcgataggatgatcccaaagggatattgggtcatggtggtgcttcgcactgggggaaactagctctgctcctttaagttggctgccaacttcctcctgggatttgctttctggggggcaccctcacctcacctgtgccctttggactgtctcctgtccggttgcctagctgtcacctgagggctggtggcaatcatacacaactaagtcagcttgccagttgtacagggtggcatattggttgagccatgtgtacccttagatggtacagttggatttgtcgtgaaagccaatggacctactttttgttcaggtaggaataagaggtgaaacaattccactaggtagtgcctagctaatgaggaggctaagcggtggccttagcctcctcatttgtcttgtcttgtctgtagagcaagtaaacaaaagattgttaaaacttttattgtggtcaaatacatagaacccaaagtttactattttaaccattttaaagtgtacaattaagtgacagtaagtacattcacaatgttgtgcaactaccaccactatctagttttgaaactttgtcataattttaaaggaaaatcctgtccccattaagcataccctcccgctctcccccaggccctggcaaccaccaatctgctttctgtctctatgggcttgcctcttctggacatttcatcttaatggaatcatacaatatgggacctttggtgtctggcttctgtcacgtagcatccatatgggtagcatgtgtcagaatctcctcttaaaggctgaataatattccactgtatggatataccacatttttgtctgtttatccattcatccattgatggatgtttgggctatgtccaccttttggctgccatgaatagaactgctatgaacgtgcacacagagaggtacttgtctgacaacctgtttttagttcttttgggtatatagcaggagtggaattgctaggtcatatggtaatgctgtgttttaccttttgaggaacgaccaaacttttccacagcagctgaaccattgagtatttccatcacaaatttcatcagttggtgggcatttggattgtttccaccttttggcttttgtgagtggagttgctgtgaacattcatgtataagtttgtttgtttgtttgtttgtttgttttgagacagagtcttgctctgtcacccaggctggagtacaatggcattatcttggctcactgcaacctctgcctcccaggttcaagggattctcctgtctcagcctcctgagtagctgggactacaggcgtgtgccaccatgcctggctaatttttatatttttagtagagactggatttcgccattttggccatggctggtttcaacctcctgacctcaggtgatccacctgcctcggcctcccaaggtgttgggattacaggcgtgcgccactgtgcccggcctcatgtgtaagtttttgtttgaacacctgttttcagttctttgggatatatacctaggaatggaagcaaaaggattttatgaagataaacctggccatttccccatgttcttcaaaaatgaaccagaaggacttatgcttatttatattactatacattggagagattatgattcgataaatgaacattgtgaccagcagggaattaaaatcctgggataggtctaagattctgcttgcagggttaaagctctacaccgtataaagtggaggtcccaaacctaaatgccttcaggcttaaaagggagaagcaggctgggtggggagtggcgaattggagcccagcccgcgtgtgtccctgttccctccagccagctgttgacatgcaggaatttggacacaatgttgccagatcagattttttttttcacagaaatattgggaaatctggatttttaagtgaaattgcccaatttaaaaatgtcggaagtggggccaggcagggtggcttatgcctgtaatcccagcactttgggaggccgaggtgggaggatcgcttgagctcaggggtttgtgatcagcctgggcaacatggtgaaaccccatcctttacaaaaatgaaaaaaaaagtattagccaggtgtggtggtatgcacctgcaatctcagttactcgggaggctgaggtgggaggatcacttgagcccaggagttcaaggtgccgtgagctatgatcatgccactgcactctgggtggcagagcaagaccctgactcttaaaaaaaaaaattaaaatgttggaagcaaattgggattttttttttcttttaaagcactgggtcaaacactaggcagtcagtgggttagattggtctcctgtccccttgttggcagtctctgactgagaacaggaagtgtgtgtctctctggtcactcctggactctcttgtggtccttccttcccttctcccattcccttagccccgtatgcatggacttcacttggacattccttccccagcctaacctccttgtctcactgcctgctcttctttcatcagatcacctctcggatcttcagggccgggcagagggtgatcccggtgtatcctgggatttttacagcagttctgtgttgggtaagttttaagtgagattcttcccacccttcttctcaaggacaggagtagccctgtggtggtatcccttcttcaccttttagtggcttacagaccctttcagaccaaacctgaacctgaacccatccttccctgcagactcagaagtcatttgtcgaaactgggaaatgcagcactggtttggacacagccatccctcactagccctctaccactccccaccctgggcatttaaaaaattctctttcttccgaggtccctttcttctccctggctttgtcttaaccctgccagaagcctctatgagcactgtcacctattccagtattgctcacactcaagagggaccccacccctcacctgagacctaccattccctccctaccctgcccccacgatgcacacgcagtttttggaatagctactgtcttcggagcccttagccttctggccgcagctttcctctcctggaagaccagcaggcctttatccatggtggtcatctagcattcgccctttgggctagggactgaagatgaaaggaaacacccactcctacccttgggggaagctggaggggagaaagtcaggatggaatgcaactggccacacccagaatgtgggctggggaaaggaacccgctcagccccctctgggcttcgtgggagccctgcaggcagtgaggtggcttgggaaagctgcagctagagaaggacaggtgtttttaccttgcccttgtctgctgatagtatcttcaggcttccatctcccaacagctgagcagctcatccttgacgtcaccttgcttttgccagttggaggggggagtgatataataaatctctggccacacaatgatttctttcagtactagaactttcatgtgccctctgaaggatgtgagccatggaaccggcaaaccgcatccctgactaggggcctgtggccttgtcatttacctcccaaccaccacccctccatgcccctttatctgcttagcgcatttcttttcttcggttttgtacatgtatctgagtcctaatcccctatatgctccccttacagaggaaaaagacgggtttgcctgtgacctcctacataatcctcctgggagctcagatcaagaaggagacgatccgatggaggaggatgatttcatgtttgaactctcagacaagcctcttctcccttgctacaacctccaagtgtcagtgtcccgcgggtaagtgtccgagagatccacggtgactgagtgtcaggatcctggcactcagtaggaaggtggagttctccacgaggaagtgaagacctggcaacgagtgccatcacacatgacaaaggctagcctgcccttttagcccagagtagtcatgttcaaactagaggctgcaggctccatggacattgactatctgcatttcctgaaccttaaatctagattctctctcggaaggctttttttgcactattactgggtataaaagataatctgagagatacttgggcctatgaactgctagaatctctggaacatttttgtagtttctgggggtaaacagatagaacattagaaattgagattgctggaaaagccaggacatatggttgccatagccatggggccactagggtccttcagtaatccacagcctagtttctcagtgctgtaatgttagtagcgtggtgctgccaacattgtcagcctagatgactgtgcatattatattggggatcacccatttatttaaggagactagaatatagaatatacctgacacgtaacattagattgaacccaatttaatacttatttgatggttctggagggagttcgacagccggcagggccatggcccttgttgggtttccccacatgtcagcgtgtggaagtgctggttgagagaaggagaatgcgggctgaactgcccttttattcttagcctccatgattttttccctctgattggtgtcttcatgtatttcaaatacttttccgaacaattgtaaggataatttttctttgatatctatttttaaaatgtcaactctatgttaaaatcctgtgaaccagtggctggtcgcagcagttgtaatttcagcactttgggaggccgaggcaggtggattgcttgaggccaggagttccagaccagcctggccaacatggtgaaacctcgtctactaaacatacagaaattaggcgggcatggtggcgggtgcctgtaatcccagttacgagggaagctgaggcaggagaatcgcctgaacctgtgaggcggaggttgcagtgagctgatattgcctgctacactccagcctgggcgacagagtgagactccgtctcaaaataaaataaaataataaaataagtcagtgaaccagcatgatgtgcacaggatggggagctaggtagacgatggatgaggaggtctttaagtgagagcctctgtttagggctctaaccattagaccacagtttctttgcatcccctgccctcccccccaccaccccacacgcatagcctgatcagaataaaaatagcatgtatgatggcactagtagggatcaagtttcaggggcttttggtccttattcttctgggcataagctgatccctgaggacagggcggggcctctgggatatagtattgcacggttaattaattcctccgatgtattcagcacctccctctctgaaacaggatcttgggcttcaggcagtaaaaggaccagggtagtctgcattaggtgcagacagaacacgggccacggagggctgcgtgcccctcagcgagctgagtggcaggcacgtggttagcccagagcccggtaccagcaaagctggttttcctgacgtgacatcctctagcgctcgctctagagctgcctttccccacagctgcagcacactgtgaaaatgtctgttcttcaagaagttgggggtgggggtgctagcgtagagtgatgcctctgaggccctatggggtgcagaagggccttctgaatcaccaaagcaagactgaattctcatcactagtgtgaatgttctcagggcttttttccattctttggaagtgatggtccaagtgtatgatatctgtagtccccttttcttaacccagagccctccatttcctactcatgtgagataagagcttgctgtcatttgggagaaatgttccattttagggataaggatcgtgggtctggttagatgtttaaggtgctggaacagaacatttgattctataaacatgtcttaaacagctgcaccaggtcaaaccctggggaccttcaaagaatccaccatctagtgcagtagacagacaagtatataattaactctaataaaagacaaaatgtcctaagcagatttattataaaaaactccaacagtttcagaagggtgtcaaatgcaaaaagttccagtccaccctgagcccccattgctatgctgcagagtgaaccacagtttaaggttcttttgcaaccctttcagaaatgggttttgttagtagtattacaatagggatgtgaatcaaatgccacgagaccatgggagatggaagaacaatgagttacaccgggggaaggtttcacaggtgatacagtatctacctgagctgggcctggaaggagagaaggatggagcaaggcactgaaacatacaagttcagaaagtagggggagtcctttatcatgtggctggtgcttggtagggtgggggatacaatgtggggtgtgtgtgtgtgtgagagagagacagagaaagagagagactgggtggacattgggctgaagaggttagaaggtctcatataatatcatgctagtggccgggcatggtggctcacacctgtaatcccagcgctttgggaggctgaggcgggtggatcatttgacgtcaggagtttgagaccaacctggccaacatggtgaaaccccatctctactaaaatacaaaaattagccaggcgtggtcgtgggtgcctgtaatcccagctactcaggaggctgagacaggagaattgcttgaacctgggaggtggaggttgcagtgagccgagattgcgccactgcactccagcctagagactccgtcttggaaaaagaaaaaaaagaaaagaaaactgtaatggtaacagaagatccagtgagggtgggtgggggtgcagaagagtgactcttggcaaagggaaaccggttaggaggctgacaagacagagcccaggccagaagtggcaaaggctggagctggggtagtggaatagtgaggagggaaaaccctgtgaactgggaccactaatgtggggaggcagcgtttcttcccgcattagtcaatgtaagcgtttggcccgggatcggcctctccagcacccctcccagctgtccccaggctgccacccagtcgggtgtgctcagcaaagtcagactccactttctgtaatgtgagctctggccctgcagaaacgatggtgctgctgctggagaaaaaacttgtctaatgcattccagagccaaagagaaatgccttttggattacccgcagtttaggcctttctccacggctccccctctgctggggaagatcttggagagcaaggaggccagggaagcaagagtaagaacaggagaagggaaggcagccagggttggcaggggcgggagtcggaggaaagactggtcccagcagatggcaaatgccaggtcacaggggcgcaggctaagtccccaagaagcctgctaagagttttaggttctagaatgcccctttgcctcctgtttgtgttattttggaagaggtggtcactgattgcgtgctcaccatttagctgaaagccgggccaggcattgcaggggacaggagaagacatttgcctcagctatacccaaggagcctgtggtttagcaggggacgggggagccagactggcagtgagttataatgggagacattgatggtcgtgcagcctttgtgggctttgcagagtgttctgggtcggtgcccccaccgcttcctccagcctccttcaataactcccatccttgcctttgcaggccctgcaactggttcctcttttccgatgtcttgaagaggctgaagctttcctcgaggatctttcaggcccggttcccgcactttgaaatcaccaccatgcccaaggccgagttctacaggcaggtggcctccagtcagctgctgacccctgccgagaggcctggaggcttggacgacagatcccccccaggctcctctgagactgtggagctggtgcggtacgagccagacctacttcggctcctagggtccgaggtggaattccagtcttgcaacagttgaccgggaaaacagcccctcctcttctttctccttccgagttcgcccttcccccacctccttgtctttccccgaccgagcaccagactgcagaatgaggcaataatacggaccaacaagaagccgccttatcaatgccagcattagcgactggactgtttttgtttttttggttacaattagttctcatctccctgtcgtcgtcattgttatcgtggttgctgatgggggtggaaagttgaactccatgtctgaggacaagaggtcccgggggtggtgggaggtggcgccggggtcccttggactggcctccttgttcatgaccaagaccaaacctgggccctggatggccttggcctgtcccgaggagaaatgagaaaatcccagatctctgagcgccccccaactccattcccctgtgttcttctgtcttctgtagtatttattttattagtatttaatttgtattgtttcattggtttctgataagtctgtatcactgtgacgatttgagacaacttgttgtattgagggactttctgtacctccttttctttttctttgttgatgagctctgacaaagctattccctggtgtttttttcccccactggggagggggtgaggtggaatggggtgggggaacatggacttgtgactaacgaagctggttgctgctggcccagggctgggggcttgggggtaaatcctgaggctttggtgctcccccacccacccattcccgccctttgcagcagccccgctatcttgagattagtgttgacagggaggggaggattgtgaggtgaggggttaataagttactctaataaaggagcgtggagaagggatctgaggggtgagggtggcccccctcctcacgccttcttcactgcccccctcagagtgcacaatacgagtttgttcctgcctccactctcccaccccgttctggcctccctgtctcaagatactgagcctctcacctcccagccctcagccacccccatccctgccccttctgagactcacagcacccctttccttcctctcctcccacctcctccctcagcccctcattctccttgggaatctgcagagggctctgggactcactgccggatgtgaaatccaggcgtcagctgtttcctaggcaagggcaggaaagtggtctccagcccttgctccactcatgcctgggggcctggggctgagtggtatccctacctggcctccccctggcctctgggcctccagcgctgggtttgtcgagtgagagagagagaggagcttgggttgcttccctgtccccgccccctctgtggcattgtccctcccactcttatttttctaccaattgctatttttccgaacaatccttgtagagtatgtaccatccaaaggcaggagggcctcgccgtggccggctctggttggagatggtacagttttattgtacaggtgctaaaacaacaacaacaaaaaagaaaatggaaaaaaaaaagattaaaaaaaaaaggaaaaaaaaaaagccagtttgaggatgggacaatctgttctctagaggctcctgagccatgcgggagcattggtggttattttctttgtattgtgtttgttctttgttcctgggggggaagttctcggcccccttctgtaggactgctccccacccccaccatactgcccagttggttttgaacagttgttttccctttttaagaaaaaaaaatacatatatatatacatatatatatataaagttgaggggttttggactttaatttgttggttttgttggggttcctggtattgtgtagtttatttcatgttctgtttgcctttccttttttcgcatttgggtgtatattctggctgccctttatgtttcattttaagcaactggctgtggagtcaaaaacacttgcatact

SEQ ID NO: 1292 - DNA, 77793 bp, mus musculus; identical to SEQ ID NO: 1291

SEQ ID NO: 1293 - DNA, 58346 bp, mus musculus
gaaggtagatcggcggggccgcgagcggagggagggaggcccgcggcggcgcggcggcagcgaaggccagcttccgcggagtttgtgcccgggcttcccgggctctggccgcctcacgcgcacaaatggggctaggggactgagtggtaagcaactccgagtgttagacggtgatcgggcggcgattccgggaaaagcgaggaaagacacagtctgcgattgtgccgcaccccccacccacctcttagcatctggattctgctctcgtagtgggggccgcggaccctccccgccacagtccttttactctccagcactcccaccgccttcccccttcttcagccatctgactctcctaggggtatgtgtttttgggggtggacggcgacgggggtgggggatactttccttcccgtggcggcaacctagttcgtatcttattcctacaaggtagcgtcgcttcgagtcgcatggacattggggtttagataatttaccccccacccaagcgatttaatggcttttaagcaaaaggcgaatacctggatttccatgggagggatgaggtttgaagattgggattcacccctagctcacttccactaccaacccctctttcttgtgagccacttccacgggtattcaaatctgggggggaggggggacgggagtattaatatgcttctctatttctacacagggtcggcgtggcgaaggacggctagccttggagggaaagtagccaccagtccaactcgggtcgcccccaccattatttcggtgagggggcaacgctaagaaggggatactggtgggtaggggcccagtataagggagggggctgggtagtcgtccccagaaggactccgtgtcttggcggggagagagagaggcgagccccggcttcaggggaggggttccggggagggagatgggggggtggcgacgacggtgggggggggagcgggaagaagggggagtcacgccctgcctgcaaggggagcctccctcaggcccctgggagaaggggactgaatgcgtctgttctccgctgcccggcagaggagatctggggtctcgagatttgcacactggatcggcaccagtggcctgagaaagtcaggtcggggcataaggtggagaacgttggaagaaagagagagaaccctttggccgcggctcactgaccctctcccttcctcaacctcccccttcgaggggcgtcgaggtggggggggacgtggggctcctgcagccccgcagattgagcgcctccgcctctcccaggagtctagctttttgcccggcttgctgcagccactgctgcctccctctccggaatccgctcggtcctctcagcgatcccctcctcctctcctcccctcccagtgtcaccggggctgcttggctctgcccccttcgccgccgcttgctccctgctttcgtccctccctctcttgctcgctccctcccttcgcctcctcctccccattcccccccacccgcgtaggccgcattctgggagttgtagtccggtggagcgggggttggcgccgcccgcggacccagccggactccacttcccgtcgagccctgcgaccggcacccactccaccaggcttcgctcgcacacagacacacacacacaccgctctccccctcactctttcgctcgccgcggctgctgccagtgtgtggctctgtctctcctccgctttgctgagccctcccttcttcctctcagttcctagagtccgaccgccgccgccgccgagagagaggagaaggaggtcggtggcgataaggggcggaggggggcatcagatcggggcagtattaggcgggtggcggttaagagggagtaagagggagcccgggtggcggcctgagcctccccgcggagccgacccgggaacaggtgcgtcttttttctctctcccccaatccctccaccccttttgactccccggctttttcgtatccccccacccgcttctttctatcttaagcctttctccaaccctgttccttcttttccctgcggccgctcggcttgccccccgggggcgccgtcctcttcgtgtccccggacgtagcgctccctggagctgggtatgtcttcgcccctcccttcgggacagctcccttccacttcccaccttcgtaccccatcccctgacttgccctacccccttctcgacccccttctctcttagccaggtgagactcgttcgccacgatccaagagagtcttcttcccggctgggcgggggtctccatggaaacgggggtcggttgatcctgggggggaaaccataggaattaccccactcctcggaaagggaggtggaggctatggtcttgttaactacctgactccaacccccgatccaaggatccgacgatccgaagggaggctggctagcagggcagggcgagaaaaggcttttttttggggggggggggtgtccgtgatgaagtgttgaagagaccgggagaaaatgccctccaacctcagaggggaggtgcgacgggtgctcttcagggctgctttcttcccggcgctggggtgcgggaatcgtagggtaaggggtacccctaggtggcggcggggcctgggttcgggagtgggagtgctgtgatgggggcaggggcaattatccgagtccctggaaaaaaggcgggggatgacttcggagcgccctggctccgctgccctcgctctaggggcgggggccgccgggccgggcgcggcggggagggggcttaaattgaaggaagatgagatcgggggcaattcatactagcaccggcaagccagaggggagatccggcgtgcaagccctccacccgcttcgcgccaggcctggaggcaaggggtcggcgagcgaagccgagggctggaaggagggaggctccggttacggggccgggtttcgggatcaggggcaatcccccggcccttggagaaggagggagagggatggccgcgaaccccagggctcccccaccccgggtcctaaggggcgtgagggacggacagcaggcccagcggagctggattcgagcggatcgcggccggggagtgggagggcttagtggtgggcttcggggggagcagtccggcggcggggcgggcgggcggggcgtggggctccggcgggcggcggggcggggccgggggcggcgctgctgccgccgccgctgccgccgccgccgctgctgctcctgctggggccgccgcagccgttgccgccgccgccgccgccgcttctgggcggggaacggaggccaaagagagtcccgtgccggggcagagggcgcaggcggcgcgcggtggggagggggccgtcctgggggcgggggcaggcgggggggtggagcccccgacggggggcggtacgagccgggacgacgacgacgaggagccccgggggccgggtgcatggaggacgaggtgctgggagaaggaaggggggtgtgggtcccgcgactggcctcgtgggcttggctcctcgaggttcggtttcgggacagagccctgcaggggcgccaagaggccggggaagggatagggaggtgaactggtcggtggagggggccctcctcgccggggtcccgccgagaggaaggctgggccagagggacgtccggggcaaggctgggaggagccggccgcacctcggctggggatttcgcgttatggaggtgcgggagattgttgtagggaaagacgtggtcgaggggaaaggtgggagggaaacactgcaaacccgggaggccaacagcacaggcccgtgggggtgcccttctattccgctcgcacctcctccctccctgagtggaagcactatgtttttgttttattgttttgaaattttcaatgttggctgatcgaaactgtcgatggggtgatattcattcttggtgtctcctggagtagacagtaaagacaggcatcctttggcgagcaagcatctagcccagggtttagaggctctttacgttagtgtgggaagggggcccggtaactttgtgccacagcttgactactgttaaggcagtttggaggtcgtccctgtggtacagaggtggagtacaattgcaaaaatcttcagtaagacttctggagatgagttgtaggttagcgttacagtggttagccctgtggttctttcaacttagaaggctctttctcaaaagcacgccgttgagttacatgggaaaataaatgtggattgcatttggggttgggagtggattaggttgattataaaatttcaaggttggaagggagttttaaggttatttacttttctgttgatatgtcctgtccttgaatgttggaattgagggagctttattttggggaagatggtagatggcacagtggaggatgtctggtgcacagtttagggtactttaattgaatggtgatgtcaccatgtggtactaaagatgacagtatgtaggagagaaatttgggggattccactggggattaaatgggataacctaattttaagaatcatcccggggctccaaatagaagcaaaaggctggggaggagcctgtaaaatttcgatggaggcgaaaagttagtagcaaagattgaggtagctgggaagagcaaggggcttggtgagtcaagttaagagaatctgaaggttgatagtagagtttagggatgtggccatcttgactaagtcatgaggatgttgttaggcggacatcttttgacagggcaacttaggcaactgcccttggggcagatgtgagggatgaaaggtacaggccttggggcacagatcctgactaaaattgaccttaagagggctgatcctgataccagctttgcaacaagggtggttaggtttcttttcttttcttttttttttttagatggagtctcagtcgcccaggctggagtgcagtgctacaatctcagctcactgtaacctccgcctcctgggttccggtgattctcctgccttaccctccagagtagctgggactgcaggtgcccgccaccacgcctggctaattttttgtatttttagtagagacagggtttcgccatgttggccaggctggtcttgaactcctgacctcaggtgatccatccggcccagtttatttttgtcctggctgtaagtcattgatgaggaaggagaggggtttcacctctcccttgtctgagttcaggaggatttttaaaaaatttttttagaataggccaataaggaagggacagcaaatttttagaaaaggccaataaggaagggacagcaaaacaaatcgttggcatagggcagagaaaagctaaggccctggcaagctctgctgctggagtctgcatagggcagagtggagggagttccacaagacatgatggctgcaccaaaaacactcatgtgggtctggctattttgatttgccaggaaagcgtagataaagagggaggatccctttctcagtgacatagacattcttgggaagaaaagaggggtcctccacagggctctgcttcatttatgatgcagttcatgaaatagaaaaaaatgggccgggtgcagtggctcactcctgtaaccccagcagtttgggaggccaaggcaggcagatcacttgaggtcaggagttcaagaccagcctggccaacatggtgaaaccccgtttctactaaaatcacaaaaattagccaggtgtggtggggcgtgcctgtaatcctagctacttgggaggtggaggcacaagaattgcttgaacctgggaggtggaggttgcagtgtgccaagatcgtgccactgcactccagcctgggcaacagagcgagagtccatctcaaaaacaaaaacaaaaaaacaaaaaaacaaaaaaagaaaaaagaaaaaaatgttcagtacagggagtggaggatctcaggacactattggttggattatgggttgtagggaagggcttctttgagagaaacagaattatgggaaaaaaggacttggacactagagggaaggaaggcaagaaagagaagtcaggaagagggctggttgagcaatgaaaggaaaagaaaggtgatcatcactggtcccatgtaagggccagctaaggaaaaagtcaaaccttgaaatctctaggacaatgttttccaaagtaaactttgaagaactcttaaagctctttacaatttcatgctggaatcactaaggttggggcaagagagaaggaatatatggggtaaaagtagggtgggggagaaactggcatttagagagaaatacaagcatatttatccataaggaaatagggaacttagagattatatacaggttaaaatgcagaatgtgagagaaaaagagaggaattaagagccaaaggaggaagatatttactcagatatcttttggagccggtgttagggagcggaaaatcttgcctttgatagccactgccctgagagggcccaggaagcagaggttagctgggatccaggccttacacatctaaacattaattagaaaatctagactaaagtaaggatactgaatggggggagggattcactgtcctaaatagagtggccttgaaagaaggaaaaagtgggaatccaccagtgtttccagtctgcaggtgggaaggatcctaggtatcaggagatgagtgatggaaattccagggtgaaactggataaaaaactgagtgacatgagagcctgtgggccagaattggagggtggggttaggggcatggaagagaggctctaatcagggcttggactggaggccacatggagtaattcattgattctgggctgagctaagcttgggatgaaatagaacagccaaagagagtagagagctgttcttcagggccaatcagcatcagaatcagagtgaagaaattcgaggtcaagtttgggtgggaaagtgaacaccggagtggaacagagagggtgctggagaaagtgacacaattgttggggtagaataggaaaaggtagaagccactgatgattacataacccagagggaagaccctaggcctttgagttttcaaagagaagggaagtttcttaatgctggagtttgaattaggtgtgagtccatggttgccagagtgtttagtgtcaggatggccaaagagggaggtaatatctacttttcggccactaggatgctagtacagtatttgatataattttacatatgaactaggctttattaatgcccatttttgaatggttatccttaaaataatgtagaaatggttctttttctaaattaaatcattccctttcccactgttcataacttaaaagcaatcttttatgatgagaactttctttggcgaactgaagtttcattctggtcaagagtaaaatttaactctgtgtttctatccccgtaattcaaatatgctgttctagttttcttttttattctaagcagaagtgaccttttccccataaaacataaaaaaggatcttttttttaaaaaaaaaaagtaactgagtaactgcaggctgcatgtcaaggtcatattttccctggtcaatgaattatgatgaatttgaatacagctgatatattatttgtaaaatgtggtaattttcagatttactcatcacagtatgtgaggcaggatacctcttcatttgtattttaagaaaaccttaagctgaaggtccgtgaggaatccagagtaccaaggagcagggaaagctttgtgttttgggcttctttaccgtgggtctgctgagaaacaaaatttggttacctcattactaaggtatgcctagaaatcatagtgttagtgccatttaagggtactgttgagttttgttataatgctgatgtccagggacaaggagaacaagcagatttttgcttttccaagttttgtggagaagtgcaccgtatatgactatgatcgcagaggtgagttgatgcactgtatacctgaatccatgagatgattatcttctgataatgaggctttactcagtttaacttggttgtaccacaccccagttagtatagtacagtggttctcaaacttgagctcctcagaattgcctgggggggctttggagaccgacaacctcaggttagagtgcttgctgttctacttcttagctatgtggcaggaggcaagtcacttaacttactttcgttcttttttttgacagagtctcactctgtcacccaggctggagtgtagtggcatgatctcggctcactgcaagctccgctgcccgggttcaagccattctcctgcctcagcctcgcaagtagctgggactacaggcgcccgccaccatgcccggctaatttttttttttttttttttttttttagtagagacggggtttcaccgtgttagccaggatggtctcaatctcctgagcttgtgatctgcccatcttggcctcccaaagtgctgggattacaggcgtgagccaccgcacccgtctttttttttttttttttttttttttttttttttttttaaccggagacagtctagctctgttgcccaggctggagtacagtggtgtgatctcggctcactgcaacctccgtctcctgggttcaagctattctcccacctcagcctcctgagtagctgggattaaacgtgcccaccaccatgcctggctaacttctgtatttttagtagagacggggtttcaccatgttgaccaggctggtcttgaactcctgacctgaagtgatctgcccacctcaacctcccaacatgttgggattacaggcatgagccaccgtgccaggtcttcacttaactctctttgtttcttttttttttgtttttagacagagtcttgctctgtcacccaggctgaagtgcagtggtgctatcttggctcactgcaacctccacctcccggcttcaagcgattctcgtgcctcagcctctcgagtagctgggattacaagcgcccagcaccacgtccagctaatttttgtatttttagtagagatggggttttgccatgttggccaggctggtctcgaactcctgacctcaggtgatccttccacctcagcctcccaaagtgctgggattacaggcatgggccaccatgcccggcccacttaactttgttgagcctcagttttctcatctatacaatggagatgataataccaatttcacagggctgtgaggattacacaaaatcatcccaggcccatagtaggtgctcaataaatgggacctattattttatatatatatttttttctttttcttttttgagatggagtctcgctcttttgcccaggctggagtgcagtggcgctatctcggctcactgcaagctctgcctcctggattcacgccatcctcctgcctcagcctcctgagtagctgggactacaggcgcccaccaccgtgcccggctaattttttgtatttttagtagagacggggtttcactgtgttagccaggatggtctcaatctcctcacctcgtgatccgcccgccttggcctcccaaagtgctgggattacaggcatgagccactgtgcccggccctattattatattattatctaatttttcttgttcaattgtatcctattatgttatagtaaacatggtggcagcatgaaaactatcaacagcttctcagtggtccccttatatcttgattctctgtcctctttcttcatattcctgttgtattagtacacatttggcatttacaacatgctaggaagaaagcttgactcatcactgcatctacctttgaggtggaagtggcggcttctttaacagctatgctgtaacactgctcaatagttcaggacaggaactgaggagtgtatatccagttgaaactctagggaacatttcgggccatgggtgacatttttaaaaaccattgctttctgaaaagggctgttgtgtttatttaattaattaatttatttgtttatttattgattgatttatttgaaaccgagcctcactctgttgcccaggttagagtgcagtggcgtgatctcggcttactgcaacctccgcctcctgggttcaagcgattcttctgcctcagcctcccgtgtagctgggactataggtgtgagccaccatgcctggctaatttttgtatttatattatttatttattttttgagatagagtttcgttcttgttgcccaggctggagtgcagtgatgcaatcttggctcactgcaacctccttctccttgtttcaagtgattctcctgcctcagccttctgagtagctgggattataggcacccaccaccacgcctggctgatttttgtattttttctagtagagatggggttttgccatgttggcctggctggtctcgaactcctgacctcaagtgatccggctgccttggcctcccaaagtgttgggattacaggtgtgagccactgcgcctagtctatttatttatttttgagacagggtctggctctgttgcctcagcctcctgagtagctgggacaggccaccatgcccggacaattgtttttatttttatttttagtagaggcagggtctccctgtgttgcccaggctgttcttaaactcctgagctccagcattcctcctgtcttaacttcccaaagtgctgggattacaggtgtgagccactgtgcccggcagaaaatattcttttttttttttttttttttttttgagacagagtcttgctctgctgcccaggctggagtgcagtggtgcgatctcggctcactgcaacctccatctcccgggttcaagcaattctcctgcctcagcctcctgagtagctgggattgcaggcgcccgccaccatgcccagctaatttttttttttttgtatttttagtagagacggggtttcaccatgttggtcaggttggtctcgaacccctgacctcgtgatccatccacctcggcctcccaaagtgctgggattacaggcgtgagccaccgtgcctggcgctttttatttttatttttgtttctgagatggagtcttgctctattgcccacgctgaagtagagtggtgcaaactcagctcactgcagcttcgacctcccgagctcaagtgatcttcccacttcatcctcccaagtagctaggaccacaggcccataccaccaggcacagctgatttttaaaataatttttgggccaggcacagtcgtcacgcctataatcccaccactttgggaggccgaggctagcagatcacttgagcctaggagttcaagaccagcctgggcaatgtagcgagaccctgtctctacaaaataatacaaaaattacctgggcttggtggcgccaggtgtggtggcatgtgtctatagtcccagctacttgggaagctgaggtgggagggccacttgagcccgggagtgccgctacagtgagctgtgattgtgccagtgcacttcagcccaggtgacagagttgagacccagtcttaaaataacaacaacaaactctttgagctaatactgtttaatgaaagctgtatagatacacctttgaatgaataatatatataaaattagttgaacccatagctgagtctgttctgttgtgagaaaatagaaagaataacctgataatggtctctccaaatatttgtgttatgtagtccaggagacttttataaaagcaaaagttgggtgaggaagaattgtcttttttaaaaccatatatatatatttagagaccgggttatgagactggctaatttttgtattttttgtagagacggggtttcaccatgttgccaaggctggtctggaactcctgggcttaagtgatctgtctgcctcggcctctcagtgttgggattacaggtgtgagccagtgcgcccagctaggaattgtctttaggtgaaaaattgcgtatcatgaatatagtatactgaaatggagacaccagagggccactgtcacagtctatggcaggcaggacccagaagcatctcaaaagggattcagaatgtctcatattacaatgattcaagtttagagtgtgaaaaacacactaaatatttatatggtcctgctgaagaccaagattgagggaagccaatttgtgtttttgttctagcggaaattagaagtactcaaaaaatgaccctagatatttagggtgacattttgaggttgctttgccttttgaaaggactgattaatttcacaatgatcacttaagttttgcgtgacatctagaagttgtataaaatcttgtagctagagccgaggtttattataaagctatgatgaggtgtttttgttaaatggagtaaagtaattttcttacagcaggaaatggaagtgagtactgtttgaataataagaaaaaagtatcatagcaatgggtagaaagcaaaaagaatctggcggtatgaaaatgtaagtgaggccaggcacgctggctcacgcctataatctcagcactttgggaggcaaaggcaggaggactgcttgaggccaggagtttgagaccagcctaggcaacatagggagaccctgactgtactgaaaaaaattttaaattagccaggtatggtggtgcacacctgtggtcccagctgcttgagaggctgaggtaggaggattgcttgagcctgggaggtcaaggttgcagtgagctatgatcatgcgattgtactccagcctgggttacagagcaagacccgtctcaaagaaagaaataaaatgtaagcaaaagattaaagcttttgcatttgactacttcattcttggaatagattacgtatggtccttttttttattttttaatttttattttatttatttatttttttgagatagagtcttgcttttgtagctcaggttggtgtgcaatggcacaatctcagctctgaccccccaggtccaagcgattctgctgcctcagcctcccgagtagctgggattacagatgcccccccaccatgcccagctaattttttgtgtttttagtggagacagggtttcaccatgttggccaggctggtcttgaactcctgacctcaggtgatcgcctgccttggcttcccaaagtgctgggattacaggcgtgagccaccatgtccggccagtctatggtccttttctaagtgctttcatgttattccaaatttttagtagggactagtagtttattcccattttgcaggtgacatggtaaatggacatagagagatagtctgagatggctgagaagtggggactgggagtgttctccaagttttcccaccgcagtgtaggctatgggtgctagagtatatcacttttcaaggcattacttgattagatggttctgtttaatattgctgctgtttgagtagattgttctgaatggattttggatgttcctaaacatcagatcgaccctgaaaggatgggttccagcactaatgaggagagtgaaaaggacgtagtattggtctggatgctaacgctcacagaggaactccagggagattgcaagccctggccgctcggctgagatgactgtccagcctcctgaggcgactactttggggtaactacattcatttgaatgataaacgctcatgtgtttaacagcagttaacattcctttgtatccagtctcataaatgtttataggtaaggttttagacatggaagtacccaaagagtctatgaaggggtccatgctagacctatatgccggcaactacctagccttcccactaaataccagaattaatgtatctgggcaaaagatacaatatgccttataagactgatcccttggggtagatatcagtggaaatatttggataggaaaaaaaaaatccaggggaagtagaaagtgttagaatagatttttagtcaggcagaagtttgggatgaacagcagaaagggctgttctttctcctttaaattgcctggcagattatttctagttgattttgtgtgtgcagtagtagaggaaccaacttggcatgaagagaagcaaagtaaagtgtttgggggcatgtctatgggacttcttttttttttttccaagacagagtctcgctctgttgctcaggctagactgcagtggcatgatcttggctcactgcaacttctgcctcccaggttcaagcgattctcctgcctcggcctcctgagtagctgggattacaggtgcccaccactaggcctgactaatttttgtatttttagtagagatggggtttcaccatgtggaccaggatggtctcgaactcctgacctcaagttatccacctaccttggcctcccaaagtgctgggattacaggcatgagccaccacgtctggcctctctatgggactcttgagtttcagggaatatttggttaatggtagggaaagatgagggaatatagatattgggggtaaagattgaggagaattttcgaatacccttatatgtattagatcattaaataagtttatttttatttttattttttgacacggagtctagctctgtcacccaggctggagtgtagtggcctcatcttggctcactgcaacctttgcctcccaggttcaagtgattcccctgcctcagcctcccgagtagctgggattacaggcgcacaccaccatgcccagctaattttgtatttttagtagagatggggtttcggcatgttggccaggctggtcttgaactccagacctctagtgatccacctgcctctgcctctcaaaatgctgggattacaggcctgagccactacacccggccagaacggtttaaattggggtaacttcctcattgggggcaggggttgtggtatgtaatgaagtagggaaaacaggaatgttagtctcctaacacattctgttgaatacacatggaagaaggcagagtaatcaggagggcaagctctgtagtaggagttccacatctaaagccgggtaaagttgtccttgctgggtgtgtgtacattttcctatggaaaacaatgagcagatttgccttcactctaaaagacttctgggcagaagtcatggccttttccctttagccctgagatctcagtgtcagtggtctcttagatctcctcaggggtgtcttagatgctgttttttcccaagtggaatgatgaggtggcctctccttttgctgctgtaaagtttgcctctgtcttatgggagctttaccaagagctctgggtctctattggaggagtaggtcccaaagttggttttccttacttattagtcatcactgacccagccctcctccttaaactgtctgctggccacgcctatcctctagaggacagattcagggccaggcttcaagatgaatattttccggctctttcattttttaaagtcataattgcttccaggtcaccaggcagtatgaaccaaaaggagcctgggggagcaggactacatttcgtttaactgagagcttcttaagcttgggtttctagtttactgtcttgatggtagagtccaagcatgaataaatgggtaggtttcatgctatgtgtagaagaccgagttgtgttccataagttgagtgttctgcacttaaggggtcttcagccacaaagggaactacatgatcctgaagtacttgtcagctgcatgaacatcctgatcattttcttttatttatttattttttgagacaggatctctctttgtcacccaggctagagtacggtggcgtgatcttagctcactgtgggcttgacatcctgggctcgaaggatcccttctgccacagcctcctgagtagctgggaccacaggtgtgcaccatcacacccagctatttttttattttttatagagacgaggtctcactatgttgcccaggctggtctcaaactcctgggctcaagcagtcctcctgcctcagcctcctaaagtgctggggttatggacatgagcccatgcctggcctggtcctttttaaggttaaaaacctcgtaaacagtgcctacctcagtcaaaaacatttgtcagatagatgctttctctgttacctcctttaatgtccttctcttcctcatatgcatgatgacaaccatgcttttgcttgtaattgttgtgaaatctgcatgttttggcatcttcatttcaaaacgaaacaaaaaaatcctatcccacctgtaaaatctcctttgagattttggtgctgcctatcctctattactaactcccccagccccgacataggctataatttgatgttattcttccccttttgagaacacattctctctaaacttttctaaaatgtctgtcttcagtgcttccccacagtgtttcagtttggcccatgatggtgaaatatttcaggttcccctatttcattttttttccttttggttattgcatgcgatgggcttttcttttatgcctatcacacctgcccttgtcttctagtgtgttctatttggattgttttaaagatctctgcttcattatggtttctcttccactacccgctcgccctcagcttagctgctatttttcaccattttaaagttattgcggccaggcacggtggctcactcctgtaatcccagtacttttggaagccaaggtgggcggatcggaaggtcaggagttcgagacgagcctggccaacatggtgaaaccccgtctctactaaaaatacaaaaattagccgggcatggtggcccatgcctgtaatcccagctactcaggaggctgagacaggagaatcgcttgaacccaggaggcggaggttgcagtgagccaacatcgcgccattgcactccagccttggtgacagagcgagactccgactcaccaaaaaaaaaaaaaaaaaaaaaaagttattgctctctcattagttccttttctttttggtttcccctgttctgtagtgtggtgattgtctctggctacctactcttggctgcccacctgttggattcatttcctgggatcttgggtaggccttttacttctctgtgcatgtgcctcctaaattgaagttttacatatatatatatatatatatgtatttttttttcccagccacacttatggctttggattggcagagcacgtgctctcctttgtcctcaccatgagttggatatatcttttgagttttttcccccaaagtagggatagctcacagtggttcctctgccttccaggcagtgaccagggttgattcttgggccatgcagctgttcatttctttaacaattacatggttgtgacatctgggaaaatcctttgaggtatttcatatccttgtgcctgtgcttcctgggtcatttgggattaccaggtttcttccaagttcctttttggaactttgcttttgatgtgatgatttccatcagagagagggagagtaggcggggtggtggggggaggtgggaagggagaacacatgagtaccggtgcttcaagcaaaagcaagccagcatacaagtgtgtaaaccagcagcgcttacgaagtgtggcatgcctgcaaggcttttcctttttgctcacctctcctgggatactaatttgattggctataatataataaaacaaacccctaggcctactgaatcagaatctccaggactgagacctaggaatctgtattttgaacaagctcctcggtgattctggctggggaaacattggttgacattgaccgtcctgactcctcccttctgtgagcattcacgcagtcaggagtctgttctctagggccgctttagaggttccctttgctttccctctggctggggaagaccaatcttgccttcttgtatagaccatgtagctcagtgtcagtgttctcctgcctgtgttttatccctcccctcctctcctctcatctgcagaggctactgttaattagcaacagtgggcttcagataggaagtggcgctcctgggacaaaatcatgatagaaaattgagaggcaaagatttaagtggatgctccatcttgaggatcttgtgaaaatggagttatccagaatcagcgttgctctctacgtggtcataacatgtgtattatatagtaattattttgatattttaactcggttttattttttgtggttttttttttttttttgcctgaaagctctttatctaggtgatgttgtatgatgttctgtttccaaatgccagtgttccccctctgatttctgtcccagaccctacatactactaatcctaatcctctctaaatagagcaatacgaaacctgagagtgaaaaatctagtgtcactaatacctgctgcctatagatatttagtagcaactaaaacttgtactttgtgttgaaacacatctttttttttttttttttttttttttttttgagatagggtctccctctgttgcccaggctggagtgcagtggcgccatctcggctcactgcaacctctgcctcccgggctcaagcagttctcccacctcagcttcccaagtagcagggaccacaggtttgcacagccacacacggctatttttttgtattttgtagacatggggctttgccatgttgcccaggctgatcttgaactcctgagctcaagtgatccacctgccttggcctcccaaggtgctgggattacaggcgtgattacagtgggattacaggccactgctctgggcctgaaatgcattttatggcaagaacagccccttccattgcttgagtcctctaattctttttccccccccccagacagagtcttaactgtcgcctaggctggagtgcagtggtgcgatcttggctcactgcaacctctgcctcccgggttcaagcaattttcctgcatcagcctccgagtagctgagattacaggtgcctgccaccacgctcggctattttttgtatttttagtagagatggggtttcaccatgttggccaggctggtctcgaactcctgacctcaggtgatccacccgtctcggcctcccaaagtgctgggattacaggtgtgagccaccatgcctggccgagtcctctaatgcttagtagagagaaaagatgaaatgagtacctggggtatcagccaataggctgagctggttttgtttttgtttttgttttagacaggattttgctgtcgcccaggctggaatgcagtggcacaatctcagctcactgcagccttgacctcctaggctcaggtgatcctcccacctcagcctcccaagtagctgggaatacaggcacccgccaccatgcccggctaattttttgtagagatggggtttcgccatgttgcccaggctggtcttgaactcctggactcaagcaatcctcccagctcaacctcccaaagttctgggattacaggtgtgagccactgtgcccaaccagtgttgttggttaaaatggggatattccaagatattctgagaaacagtcaaaacttgattaaccaggatgttcagggaacggggtccttgttaaaaatatttctaaaattatgctaacccacataactgtcttcataatgttaaaagataattgtcagaaaaaaggtaaaaaatcatgactctcgtacagatacaaaaatgaacacgtgttaaagattttattttactcattaatcaacaagagaaccagacagatgttatagctggttcaaacaaaaagtcaaaaagcacaaatttatatggagtaaaggaaataaattgcaaatggaggcaaaagtagtttttctacagtggggaggaaagacaatccaaactcaatgggacaagacagacttcgcatatacatcagttacctgcaattacagagatgcaaaatagcttgaagacaataacctgagctaaaatcagatagcccagaaggttatgctatagacagtgcatagttttttcattggagtacaaaggtttttctgtagtaagcaaacatggtggatgctttgtgtgtgtgtgtgtgtgtgtgtgtgtgtgtgtcggggggtggctgttgattttgcttcttgtgatttctcagggccgtcacttcagttcttatccagaattcagttccatataacatgcatttactgagtagttactatacgtaaggtgtcgtggaggaaacaaagacaaaaaaggatgctttttttttctttttcttttttttgtttttgagatggagttccacccttgttgcccaggctggagtgcaatggtgcgatcttggctcacctcaacctccgcctcccaggttcaagcaattctcctgcctcagcctcccaagtagctgggattataggcatgtgccaccatgcccggctaatttggtattttaatagagatggggtttccccatgttggctatgctgatctcaaactcctgacctcaggtgatctgcccaccttggcctcccgaagtgctgggattacaggtgtgagccaccgtggctggccaaggacgctatttcttaccttaggtagctgattggtgggggagacaaacatgccttgtccccaactaaccaagctagagaggagaataagaaccagtgctgtggaagaggtagggagtaaatacttgaggacaaccagagagggaggggttaactgaactcgggctggggctagggggatgacatgatgacatttaagctgagtcttgagagaagacagggagaggaagagggggaagcaggagaggccatttcagggtgaggaggcagaagagtcctgaaactggatggtgtgtttaggaagggttgggagctgggggtggtgagagtggtggggaaatggcaggatgtggtggaagaggaggctggagaggaggtttgaggccaggtcatgagggccctgaaggcagtgctgagaatggctggctgggtgctagaggccggggaaagctattgaaagcttttgaggagggaaggagtgacatgatcgaactggcgctttagaagatgaattgattgtagaatcaagaaattgaaggcagagggagcagttaagaggtgattataatattctgggtgagagctgatgagggcctgcaccagggtagtggcaagaagggtagaaggcaaggctggagatggcattattaaggcctgacttctgatcgaatatgggcggcaggggagagaaggagttgaagatgacaaggcggaaatttccaggctaggggacggtagtgccgttaagtaagctaggaaacacgctgcttactgggcatagggggtggggagcaggtttatgagaacagataatgagtatggtttgagacacattgagtttgaggggcttggtggtcatccaattaacagcaagttgctggcagctggaaattctggtctgggcctaaggagagaggtcaaggctagagatacagatttgggagtcatcagtgcatcaaggggcgagctgaaactgtggaagctcatgagctgagagagaaggtggggcagggctgacaactggcacagagggagagagatgggtgggggaagccagagagagccagcaaaaggcagactaggaggaaaagagacagagggagaccggggagggaccggaagagggagactgaaggccaaagagtagaggggagggggaggcacaggggagggagaaggggaaggagggggagagggaggagagaatgaatgggagactgagggaaatggggaaggtgagataagcaagaaaaagacagggaaggagagaggtgggaacggggagaaagttggaggagaggggattgtgtgtgtgtgtgagagagaggagaaaggcaagaggtgaacagctgggaaaataataggggagagaaaggtgaggaggaggaagagtaaagagagagagatgggtagggggatgagaaagagggaagaagccttgaaagataggaaggggaggaaatgggagagggtggcagaggtgaagagagacagagatcaagggaaaggccaggccccagtgaatgcccaagtctttggggtgggcagtggaagagaagggccccggagaagccatcaggcagtggatcaggaaagacaagagaagggagagaataaagagggcaacgtatcccactctgcagagatgaggaggaggatgaagcccaggcagggtggatgcctctctcctctcttctcctaccacctccacactggtctcctggctctcccttgatctttgtgggcaacctcctgccttaggactttctcatgcactgttccctcagcctggaatgcttttctcccaaatatccacgtggctactcctttacctcattccgatggtttaaatgtctcctttacagcaaggcctatcctgttcaccgtatttcagatagtagccctccccacctagactgtgcccttgccccttagtctgtgttgtattatctcctcctcctcctccttcttcttcttcttcttcttctttttttttttttttgagacagagtttcactcttgttgcccaggttggagtgcaatggcatggtatcagctcgccgcaacctctgcctcctgggttcaagcaattctcctgccttagcctcctgagtatctgggattacaggcatgtgctaccacggtggctaattttgtgtttttagtagagacagggtttctccatgttggtcaggctggtcttggactcccgaactcaggtgatccacctgcctcggcctcccaaagtgctgggattacaggcatgagccactgcacctggcctgttgtactatcttctaacatgccgtgacatagaactatttaacatgctatgacatagaagtattcaacatgtttattgtccatgtcatccccctgggatgtaagctccacacgggcaggcattttgttctgtttcgttaattgctgaatcctcagtacctaggatggtgctggctcatagtaggaatgcaataaattgtgatactgtgttgaaagtggacaatctctgaaaattgaaaaatggatacatgaaacaaatccctcgtacaactatatcttattgtgatttactttggaaagtggagaacagcattcaattctgatcactgtagggttctgttcagttgaacttcaatgaataaggattttagctaataagctaactcaagagcttaagggtctcaaggcaagctcattggataaaggtttttcttggtgcctcattttttctagaaggtaaattaactgtgccctgcttgtcaaagcgagagagggacattggctggtgaagagagtggtggaacatggagacaacagactgacaggaagggacaaggacagaaatgtgtggtttttttttttttttttttttgagacagagtcttgctctgtggcccaggctggagtgcgctggcatgatctcagctcactgcaacctctgcctcttgggttcaagcgattcttgtgcctcaacctcccgagtagctgggattacaggtgcacaccaccaccccaggctaatttttttatttttagtagaaacggggtttcaccatgttgtccaggctggtctcgagctcctgacctcaggtgatccacccgcctcggcctcccaaaatgttgggattacaggcgtgagccaccgcgccctgccgaaacacgtagttctggatggaacgttgttttctgtttgtttgcttgttggtggtcagcgtgcaaggagtactgcacctgatttggagggagcttgaaaccaggttagatacgtgtgttatttccaactcaaagtcaatggagtatttttgaaggacttacgaaaaaaagcatgtgcttcctctgaagagtgtaaattggctacgtcactcaaatacttcagtacccatggattagagagtagacgagaaaaaggtcaccagtagtgttttagtgcaccattcatatatgggtatgactctctaattgtagttggttaggctaaatgtgtgtagaaatatatactgtcatctcatttgtctgaaatagattgaatttcctctactcaagcatatctgtcttttaagataatttaaaactcactctaggtgattaacaatgtcctcatctccatcctgaaacctatggattcctagaaagctggtgctccctcttcccggtttagaccttaattttccatagcaggctggctgctttaacattctgatgctgtaattacctttattgaaacattgctgtgtaaaaggtgattgaagcagctgtccctgttacgagttttgattttctggaattcttttccccagggggagtggccacagcaggtcctatctggtggtgagtggctgtcatgatctctacagcaccgctctacagcggcgtgcacaactggaccagttctgaccggattcgcatgtgtggcatcaacgaggagaggtgaggaggccaggaaggtggccgctgctggcctccagtgagcagtacctcgtcaccagagggatagctgcatacaatagggcctggggagggaccctggggaggagaagactcttagttgtttctaattttcctgtggtgggatggggatggggctgtgtgagtggcctgatctgccatgctatctcttttcagatgaaggtgaggaggccaaaaaaatgaccttttgccagctagcacttgtctactcattaacaactgtcagactgtggagtaaggggaagctcaggcaatggcaattttttttttgttttttgagacagagcctcgctttgtcatgcaggctggagggcagtggcacaatcttggcccactgcaacctccgcctcctgggctcaagtgattctcccacctcagccccaccagtagctgggaccacatgcaagcaacaccacgcccggctaatttttttttttttttgtagttttttagagacgggggtttcgccatgtggcccgggctggtcttgaacccctgagctcaagtgatctgcctgcctcagcctccccaaatgctgggattacaggtgtgagccactgcccatgcctggccagcgattgcagtttttatttgctgcatcaaagtttggtgctcaaggatatgtgtaaggtattttcagtctttgatctaggtctggaagaaagatggttttattgttcagatttctactgggaactggcagtgggcattctggtggtcagcgctttctcacctcatgaggctaattctgatttgaagtgagatccttatgaagtatcaaaggaagttgagaccgcctagcatagtcttgagagttggtgacacctgcctcacgtgtgtattttcagttatctgttccccagaatatttggttgaccaagatgtgccattgcctgatcatgccccatacccaaagcactcaaaatggccttcagaatttatatttggctttcataacccttggtcaaagagctgtgtgtgatggctgcagtgcctctctcattttctttttttttttttttgaggtggagtctcactctgtcgcccaggctggagtgcagtggcgcgatctcggctcactgcaagctctgcctcccgggttcacgccattctcctgcctcagcctcccgagtagctgggactacaggtgccgccaccaagcccggctaattttttgtatttttagtagagacggggtttcaccatgttagccaggatggtctcaatctcctgacctcgtgatccgcccgcctcggcctcccaaagtgctgggattacaggtgtgagccaccttgcccggccgtttttattttttatttattgatttatttattttgagacagagtctggggctacaggcgtatgccaccacacctggccaatttttgtatttttagtagagacggagttttactatgttggccaggctggtctcgaactcctgacctcatgatccactcacctcggcctcccaaagtgctgggattacaggtgtgagccactgcactcggccgcctctctcatttttagagaaggcactgctccttcatgcttgctggtgtttttttgttgtttcaatccattgactgtttaaattcaaatatacatcagataaatcaccaagacacagaacaatatggctttccctgggattcaagatctgacgtttcttgggtaaatcttagaaatgtgtgtgcgcatataggggagtattggtaatttgaagggaaaaggaatggaagtctttgtgtttatctactttgttcttctgttcctaactggagaagtatatacttgtctgaggtcaaggttagcagaatagacctttttattttcttaagccattagtgcctgatagcttaatgttctctgtactgaggaacaagttagagatgggcttaaaaggaatttaattttaggataaaaagagtcaagaccatggaaaatgagatgaaattcttaggtgctcaggaagaaaagtgttttcctttacatatgaagcatgtcctcagatgatcactaagagatgatctagggaaaggcagggtgatgataatgatttgcgtaagtattcattggcaggtcatgttgacctagttataagtagttgagactttgatgcagaaatctggactagagccttcaaaagaccagcggggccgggtgctgtggcttatgcctgtaatcccagcactttgggaggccgaggcgggtggatcacctgaggtcaggagttcaagaccagcctggccaacatggcgaaaccccgtctctactaaaaatacaaaaaaattagccaggcatggtggtgtatgcctgtaatcccagctactggggagactgaggcaagacaatcagttgaacccgagaggtggaggttgcagtgagccgagattgcaccactgcactccaaccggggtgacagagcaggactccgtctcaaaaacaataaaattaaataataataataaaagaggccaatagacaagttaccttagttcaccatctactgtaaatccctgccaagaaaggagcaggaagtaggctcaaaatctgattttccctccatcttgttttttgtttttgagatggagtcttgctctgttgctcaggctggagtgtagtggcacgatctcggctcactgcaacctccgctgcctgggttcaagtgattctcgtgcatcagcctcctgagtaactaggattacaggtgtgcaccaccatgcctggctaatttttgtatttttagtagagacagggtttcaccatgtcacccaggctggtctcaaactcctgatctcagtctgtctgccttggcctccaaaagtgctgggattacaggtgtgagccactgcacccagccagattttccttccttctaaacctgtgcctagtgcttaagaggacattttttttttttttttgagacagagtttagctcttgttgcccaggctggagtgcaatggtgagatctgagctcaccgcaacctccgcctcccgggttcaaacgattctcctgcctcagcctcccgagtagctgggattacaggcatgcgccaccacacccggctaattttgtatttttagtagagacgggttttctccatgttggtcatgctggtctcgaactcccgacctctggtgatccacctgcctcagcctcccaaagtgttgagattacagatgtgagccaccacgcccggcctaagatgaccttttaagtgttgtcacttttgatctcatccaccctttattgtcaccttcttgctacagtctaggccgctacagcctagaccatgctatcactggtttccaaaatgtaatctcaccttatttaaaaatcattttccttggccctttacaacttgtagaatttaggaatttggggtacaaagctgtgcctggggttcaactcttaaagtgatgttttagaggcctgccagctttggcagctgcaattgaggactgtagaacaggaggcatgggcttgcggctggccccaggtggccgtctctaggcaaacctacagctaaatgtgtctgcttgcctgcttgcatcccttctaggattaattcatgccttcattcaacaaacatttattcaacataatgagagcaaaccagtagttctagtacattggtggtgagtgccctagaattgcatgtccgggtccagtgggagtccaaatgcaagattgacaaacctcctggtgggagaataaggaaaggcttcccagaggcagtggcatttgagcccaggcttgaggaatgagtaggagtttgaggtgagagctggtatttccctgagacaataagagcacagtgtggctgggcacggtgactcacgcctataatcccagcactttgggaggccgaggcaggtggatcacctgaggtcgggagttcgagaccagcctgaccaacacggagaaaccccgtctctactaaaaacacaaaacttagctgggcgtggtggcgcatgcctgtaatcccagctactcgggaggctcaggcgtgagcccgggaggcagaggttgcagtgagctgagatcgcaccattgcactcctccagcctgggcaacaagagagaaactctgtctaaaagaaagaaaaaaaaaaaaaaaaagcacagtgtgtttggggaaggtccaagttggaatgaaggcaatcttggggtactgtgggactcgaaccagggaaagtctcccaggactggaaggtaaggagcctggtgtgtgctgggtggtatatttctcttacgggtagtctgggcccagcaggaactgaagagggtccggtttgacagtggtgctagcccttaataattagggaaatggcccagaggggtcatggccatttctggtttaagttccacaaagccttgaacataacagctctgcctcctctgtggtgggaagaaacagcaggattgattttcagtcctgactgaagcctgctatgacctctgttccctcctgccgcccgcctccgccagctgcaccctcataaccttgcctggttgacccagctcttcccgggccccctcccctgcaagttactcctgtcccaggctcttctctcaatggagcaagttaatgtttgcttagctctgcccacccctcttctcagaggatttgaaacacggctgcatgacattttgcagcgccttcggggctggactcaggtgtgggtatggctggagtggccaggactgctgttgcttggcctggttctgtggttctctggcagctgccttcgacggcagggattctgctttcgaggtgtcatttcaggcagggtgggagcttgcaaggggagaatgaggatgcagcccactcccttttgtatggccaggaggggaaagaatgtaaataaatagcaccttcccatgtggggttgcttgggggaagtgctgcttgtttccccttgagtactccccctaaaaccgtccctggcaagtctagtgggaacacgcttccccctggcccaaggctgggcataggtctcgcttttgtggtctcttaggagttgatgtgaaagtatgttttccctttccttcaggccctccctccctccccttccccgagaccaccctgactgcatctaaagcccttgcctctccttacagtcatttctgtttgtcaccaacagtcacttccagcagtggagccctcccacttctgccagtccaactgccttttaaagggaacaagcctttccccctcggttagccccttctggatccctgaaaagatggggagaggcccgtggtgatcccccttgccttttttgcttctcttgccccaggtacaattttggagtccctgtttcagtgggagggaggaagttagcagggccctcccccttcttgttggggttggctccagcaacctgactgccctttggctagggtgactggggaggcgagagctggcttcttcagggctgtcttcaggagcttggggtgagcctctaaagaagggaggcaaaaattagccaggcgtggtggagcatgcctataattctggctatgctggaggctgaggcaggagaattgcctgattccaggaggcggaggttgcagtgagccgagatcgagatcgtgccactgcactccagcctgggtgacagagcgagattcaatctaaaaaaaaaaaaaaaaaaaaaaaaaaaaaaaaagagggaaaaaaggaaagaaagaagggaggtcacctcaggcacagtgtatttccccaggggcacacagagcagtcctgtgccttgcccacccaggaaacgcactgcagcgtctatgttggggttttattctttaatctaaacctcctccttggccactcccacccacagctcccaagggcagggggcaatagttttttttggttgttgttgttgttgttttgagacagggtctcactctgtcgcccaggttgaagtgcagtggtgggatctcggctcactgcaacctccgcctcccagactcaagcgattctcctgcctcagcctcccaagtagctgggattacaggtgcctgccatcacgcctggctaatttttgtattttttagtagatatggagttttaccatgatggccaggctgatattgaactcctgacctcagtgatgcacccacctcagctggcctcccaaagtgctgggattacaggtgtgagccaccatgcctggcctaatagttcttgctgtacttaaaataccaggggagggaggcagtctgatgccaccctctccctttttttttttgtcaggatgtacaattttctatgatgcttacctgaaatttggagaagactttaaacagggggagatgcatttgagttttcctcctttgggacccagctctctggccttgagcccttttctctgggacatatgaacctgaatttggggtctgaggcttttcggacaggagagaacaaagtggtgctgggagactgatgggggggcagggaggggtgctggcaggagataggatgtaggcaaggatagaaggagggtagaagggagggtgttgcctagaactctagaaaaaagggggcagtgtctcctggagggaaaaaagtagtattcttaaaatgcctctcagcacccagtgacctggtggcctccaagtggtatcatcaccagtgctaataaacatgtctctgctctaggcaagacaggaggtgaataggtgacgattcagatttagacctgaaaacacaacaggggtttatttgttttagaagaggattacccatatgacactttcagccagctgcccttagagacttaaaataagattgtatttaaaagaaaaatgggttttgcatgccttttgaggcattcagtggttctcatgtctcccctttgagcaatgccctgtacatcctggatggtcattttggcaggtaagctccagggaaaaggtaaaagtgctagggtgtccacactcctggcaagagccctagaaaacagggtaaacagtccaaagaggggggtctagtcagactgggctctggtagggacttgcaaagctaggtgtggcgcctccgctttgtaaccaagaacccccagttccttgtaatccccctcacaagttactacaggaagtgaggtaggaaggttttatggggacccaggcaggcaggaggcattctggggaaggtggtgttggctcaaatcctgggcctcatgtcccttctctggttgtatcttccatgctagaagagcacctctttctgatgaggagtcaacgacaggcgactgccagcactttggatctcaggagttttgtgtcagcagcagtttttccaaggtaagaggctttatggagccacgtgctgtccaccaaaggatggagctgagctgcctgggaggtgtgcccagcctgccatcccaggaagtgggcaggaagggacagggtctctcccaggagttggtattggtgggacacaaattggctggctgccctctgcgtcttccgagacctggttggtcgagttgcagagaagaccagcagttgcctctcgggcctcaggacacttgcaccatctgcagggagctggctgagatgtgcatgctatcctgtcgttgcaggtggagctcacggcagttggaagtggcagcaatgcccggggggcagacccagatggcagtgctacagaaaaacttgggcacaagtcagaagacaagcctgacgatccccagccaaaaatggactacgctgggaacgtggcagaggctgagggcttcttggtgcccctgagcagcccaggagacgggctcaagcttcccgcatctgacagcgccgaggccagcaacagcagggccgactgctcctggactccactcaacacccaaatgagcaaacaggttgactgctcacccgccggagtaaaggctttggactctcggcaaggtgttggagagaagaatactttcattttggcaactctgggaactggagtccctgtggaggggaccctgcccctggttaccactaacttcagtcctctgccagcccctatctgtccccctgctcccggttcggcctctgtgccccactctgttccagatgcattccaggttcccctctccgtccctgccccagtcccccattcagggcttgttccagtccaagttgccacttcggttccagctccttcccctcccttagcacctgtcccggctctggctccagcgccaccgtcagtgcccacgctcatctctgactcgaaccccctttctgtttcggcctcagtcttggtgcctgtgccagcttctgctcccccttcaggcccggttcccttgtcggctccagctcctgccccgctttcagtcccagtttcagctcctcccttggctctcatccaggctcctgtgcccccttcagctccgaccttggttctcgctcccgtccccactccggttctggctcccatgccagcatccacgcctccagcggcccctgcccctccgtctgtgcccatgcccactccaaccccatcttccggcccaccttctacccccaccctcatccccgcctttgctcctacaccggtgcctgcacccaccccagcccccatctttactccagcccctacacccatgcctgctgccacgccagctgccattcccacctctgcacccatcccggcctccttcagtttgagtagagtgtgctttcctgcagctcaggcaccagctatgcaaaaagtccccctgtcctttcagccagggacagtgctgaccccgagccagccgctggtatatatcccgcctccaagctgtgggcagccactcagtgtggccacactgccaaccactctaggggtttcctccactcttacgctccctgtcctgccgtcctacctgcaggacaggtgtctcccaggcgtgctagcctcccccgagctccgttcttacccgtatgcattttctgtggcccggcctctgacttcggattccaagctggtatctctggaggtgaacaggctcccctgcacttccccatccggtagcaccaccacccagcctgcacccgatggggtccctgggcctttggcagatacctcccttgttactgcttctgccaaggtgcttccaactccacagcctctgctgccagcccccagtgggagctcagccccaccgcaccccgccaagatgcccagtggcaccgagcagcaaacagaagggacttccgttaccttctctcctcttaagtcaccgccacagctggaacgagagatggcctctccacctgagtgcagcgagatgccccttgatctgtcctccaagtccaaccgccagaagcttccattgccgaaccagcgcaagacaccccccatgcctgtgttgacccccgtgcacaccagcagcaaggccctcctctccacagtcctgtctaggtctcagcgcacaacccaggctgccggtggcaatgtcacctcctgcctgggctccacttcctcgccctttgtcatctttcccgagatcgtgaggaatggggacccgagcacctgggtgaagaactcaactgcactgatcagcaccattcctggcacctacgtgggagtggccaacccagtgcctgcatccctgctgctgaacaaagaccccaacctgggcctcaaccgtgacccccgccatctccccaagcaggagcccatctccatcattgatcaaggagagcctaagggcactggtgccacgtgtggcaaaaagggcagccaggctggtgctgagggacagccaagcacagtgaaacgatatactccagcccgcattgcccctgggctgccagggtgccaaaccaaggaactctctttgtggaaacccacggggccggcaaatatttatccccggtgttcagtcaatgggaaacctaccagcacccaggtcctgcctgttggctggtccccgtaccaccaggcgtctctgctttccattggcatttccagtgccgggcagctgacccccagtcagggggcgcccatcaggcccaccagcgttgtttcggagttttctggtgtgccatctctcagctccagcgaagccgtgcacggacttcctgaggggcaaccacggcctgggggctccttcgttccagagcaggaccctgttacaaagaacaaaacttgccggattgctgccaagccttatgaagaacaagtcaatcctgtcctcttgaccctcagccctcagactgggaccctggcactgtctgttcagcctagcggtggggacattcgaatgaatcaggggcctgaggaatcagagagccacctctgctctgacagcactcctaagatggaaggcccccagggggcttgtggcctgaagctggcaggagacacgaagcctaagaaccaagtgctggccacctacatgtcccatgagctggtcctggccaccccccagaacctgcctaagatgcctgagctgcctttgctacctcacgacagccaccccaaggaacttatattggacgtggttccgagcagcaggaggggctccagcacagagcgcccacagcttggaagccaggtggatctggggcgagtgaaaatggagaaggtggatggtgatgtggtcttcaatttagccacctgcttccgggctgatggcctcccagtggctccccagaggggccaagctgaagttcgggctaaggccgggcaggctcgagtgaaacaggaaagcgtaggggtctttgcttgcaagaacaagtggcagccagatgatgtgacggaatctctgccgcccaagaagatgaagtgcggcaaagagaaggacagtgaagagcagcagctccagccacaagccaaggccgtggtccggagttcccacagacccaaggtgagtgctgagctaaggtccagggtggggccgagatgccgctggtctacttcgtgccatggatagcaacctcctgtgacccctaccctgtgacacagtgctgttgggcagctgtgtgaactgaacggattggaaggcttttgtaaaagtaataatgacctgctgtcccctccctaggtcacattttccatatacggtgtctcagcatggggagaggctggcttgtagtttgtaggatgtgggaaatgattctgtccctggggtagggaagccattgtcccagatgagatcggaaagcggaagaaggtattggtgagggaaatcaatgaataacaggctcttccttgaataaccattcttccttttcctttactgagagaacactggccttgagaacttagggatggggagagcaggggcctctgacggggttgttcctttcaccactggttggggggcctgcttaggatttgctgggagccttgtggggtcagagccaatttggcttctgtgctaatcagtttcctacccgctcgaatgcttgaggcagcagctttgggttttggcccactggggattggatgggcaaggcaggttgggtgtctgggtgttggtcttgacaggctatggatggtggcagagttctaggcaaaaaggtgggccaggagcacttgatgagaatcccctggtcccccagaagggaccagaggctactggtgatccaaggagaatcttgaaacatttgaggatagggtttattaaaaatctagaacaacttgaagttctgttagcaagctttcaagttggatgttcatgtacactaagggacaaaatttctggctagagcactgtgaatttggctgtggcacaagtttatggtcttttttggaccatagaccattttgaaaagctggtgagagctatggaccctgttcccagaaatgtgacctcagaattttgccaataattttagggggttcatggacctgacctctgccccatcgcccaaagctcacccagggactgcaggttaagaacccctgggataggtgtttgggtggattttaactcacaaacctcacaaccaccctggtatgtcagagacacgtgaagtaggaacgtgggtcatgacgcagtagagcatataacgtttggcaggtaattgccatctgcgctcggtggtaataagaataataattcatgtcgttagagttgtgtttttacatttgttatctaatcgttacagtaaccatatgaggtgaatgctacaccaatctacaggtgagaaaataaatgaaacagaggctcagagaggatacattacccagttacacagctactaacttgcagagctagaactcagactctggtctctggttccaaagtccatgttcttcttcagctataccatattatcttccactctctttttgtttttttttttttgagtcagggtcttgctctgtcacccgggctggagtgcagtggctcgatcacagctcattgcagccttcaccttctgggctcaagcagtctcccactttagcctcccaagtagctgggaccacaggtgtgtaccactacacctggctaattattttttgtagagacgaggtctcactatgttggctaagctggtctcggactcctgggctgaagcgatcctcctgcttcagcctcccaaagtgctgggattacaggcgtgagccacctcacctggccatcttctactctccgcccatggaactgtttcactgaatgttttgcaagtttttgttgcatggctactgtatgccagtccttcccaggcaatgggaatacctcttcaggagggtggtatcatagattgatgaggagtatgctccctggagccagacacggagcctgggtttgaattttggccccacctcttcctagctgtgtgctattagtcaagctacttaatctctatggccttcagtttcttaatctatacacaagacaataatagtatctactcatagagttgtgaagattaaatgagatgatgatataaaatgtccacaataggcaaatccatggagacagaaagtagactagtggttgcctagggttggggaggatggaagagttggggagtgactgtttaatgggtattgggtttccattcagggtgatgaaaaagttctggagctagataagtagggatggttacatagctctatgactatactaaaaacaattgaattttacacttaagtgaattgcatggtatgtcttaataaattgtatctcagtaaagctgtcattttaaaaaagattaaagaacgtgatatacataagtgtgtacagtagtatctggcacatagtaggtgttcagttagtgttagtggttgctgttattgttagcattacaaacaaaatagatgtggccccgcctctcatgaagcttatgtctctcagatgactcagtgacaggtgggcactgccctatcctatattagatgaacagttcagtgggcccactatcaaatgcagagggcagaaattaaaatgacaagatcaggggcctggaagcagctctttgcaactgcctgtaaggatttagtaaatgtctattttttgggagtgcaaatcacttcgttccttctttttttttacatgccaccttcctgagaaggaaactgttgatcagcaaactaagatcaggggtttgtttgaaatagcccctttcagggcttggccaagagtgaaaatagtctcctgttgccaataccacctgcccaaggcctctcaggatcctaaagggccttctgcatcaccagcaaagagagagagttctgcttcatttggtgctggatgtattttattgtcctctcattccttggaaagctctttggaaaatatttcaaaactgttaaccagaatgttcatctctcacggtctccccatcctcccaacttcatgcataagttggagtgtgcgaaatatttttattcctgacctcaggtgatccgctggccttggcttcccgaggtgctgggattacaggcttgagccaccgcgccctgctagatgttctgttttacttgtttttgtcttcggaagtaaaagttaatgatctgcatttgaaagagccagctaagaatgatattcagaaataaataggacatgttcaaatgtatgtgcatttgactttattccccctgacttaaaatagtttttctccagccgtacctgaaggttagtttttaagcagtagttcctcatcttcctctttccaaccaatgctttcctcctcctaacactttggtttgtaggaactggcagcaagccaagggggaaactgaacttgaatttttagctcaggcctctgctgaaaataagaagcaggaagagttcatgggataggaggagtcctggaatttgatgggtagtggtgactccctgtccctggagaattaggaggccccagcccccgaaaatgttccatcagtaaggtatgtgccatccccttagctggaggtacaccacgataaccttctagcaggcgaggcatgggtcagcttaggggaaaaacagctcaagcaagtttaacccttcctttcctcctcggacctgcttttattgttccaacgttttgcttattctgcactccctgcatactagaatactggaaatccctacattgccctatttcttgtttagtggcacagagagacctcaaagctcgtgagaatacgtgactgttaggctgagagtgtccttgcagtgtgtgagcacagccattgtgcctcttagatgtgccaggcagtgggcgtgggagaagctgagctgaagcagccgaggaagtgattcagggaagataggtagcgagagctgatgcccagaggcccgggctgggggccagacccccgggtcctagtcccaattctgggtctttctcactgcaagcacaaatgtgctaacttgcgggttggcctggtaagtggcagtccctgagccagtggacacatgggattgtgtgttaccctggacaagtcattcaaccctttgtcttggagcctccgttttcttatctgttcagtggggataatattagcttctcctcccagggttgtggggaggataaaatccaataatagagatgagagcatttggaaaggctgaaagtgctacagagtataaagtggcattatgaataatgcttgggccttttcactgggttttataaatatgaggatatttgaattgctcctgtgtcatgtttttcttcttgccttagttgaatctattttctggtattaatttacacgtgaaaagagacaatttttcttgagttggcctgtactgagaattattttcagttgttggtgcaataccattcacagtgaagttatttgaacaatgtagtctcccaacttgcagaagaggcattttgtttaatgccggtctctccattggtgtttgggtacagagagtatggggcctgactttgcaccttttaaaatgactttgggtgtttattcactggcttttgaacgcagactctgtagacctctttaaagtgatgggatgtggacgcctatggggattagctggggccctggactcagtccaaaagagcccctgtcacccactctggaaggcagtgcacggccccttgcccctggtcccccactctgggcagctcatgcctctaggtcagaaacgggacacatggctcaacccctggagagctttcttaagaagcaaaactgacctcagacctgaccctctacctctccacagtgccggaagctgcccagtgacccccaggaatccaccaagaaaagccccaggggggcttcagattcaggaaaagagcacaatggagtcaggggaaagcacaagcaccggaagccgacaaagccggagtcccagtctccaggaaaacgagccgacagccacgaggaaggtaggccccgcggccctggccctctgggctgggctgcagagggatccccagggcacagtggtgagggcagaggggctcaggcgctgactccttcactctggaaaagtgagacttcttcactgtggaaagaagatatgattgacccctctgaagtctaaggtgagcgagcaaggatcgggggccccttctgctcctcctgggtgctagaataaggctgaaggaagtggttttccgacacaaacaccaggcccacaacacagtagccgacccatttccccgcgatgggtctaggctcaaagaaacaagtttaaggagaatttagacaaaaaccacggaatgggggttcattacgctgtcttctttgggtatactggaaaactgctattctgaaaggacaaaaataaatagctagttagctaggagagtttagagaaatcttaaacgtttattatcatttagggacacacaggatatctgggatgacggggctggtatgtgtccctaacctgtccgttttgccactaatagtttctgggcacccttatcagggagagaatccccagcattcctgagcataggagtccaggttcatggtcttgcccacctgacgtgactatgacctgcctcttctggtctgttctttttttttttgagacagagtctcactttgcttcccaggctagagggagttcagtggcacaatatcggttcactgcagcctcaacctcctgagctcaagtgatcctcctacctcagcctcccgagtagctgggaccacaggcatgtgccattacacctggctaatgtttgtagttttgaagagatggggtttcaccatgtttcccaggctggtcttgaactcctgggctcaagccatctccctgcctcagcctcccaaagtgttgggattacaggcgtcagccactgcgtccggcctcatctgttcttagccgttttttctctgttcactggctccttgttcctatcttcccacctcactcaatcctccaagattcactgaggttgccctcctctgggacctgctccagctcagttagaactttgtttattttctttctttctttctttttttttttttttttttttttttttttgagatggagtctcactctgtcacccaggctggagtgcagtggcacaatcttggctcactgcaaactctgcatcccaggttcaagtgattctccttcctcagcctcccaagtatctgggactacaggtgagtgccaccacgcccggcgaatttttgtatttttagtagagtcggggtttcaccatgttggccatgctgggctcgatctcctgacctcaggtgatccacccacctcggcctcccaaagtgctgggattacaggcgtgagccaccatgcccagcagaactttgttgaggtgcagcagcctcagagtcctatgggcagtggggcctcctactttcctactttctggcacaccatcacattgatactgtgcactgccttttctggtatcagcaaaagcgaccaaactctcagtttttaaaaaccacctggaaacactcattgtctacaagagacacatatgtgatggccacgtaaggggagtgaataaatgtaacccagattaaccacagggtaaacacaaactctttctcaatctttcccccgagcctcacaggtgggctttctggtctttaagctttgattgtaacatttctgccttctgtccccaaaccacacatcactccaggttccttggaaaagaaagcaaagagcagtttccgtgactttattcctgtggttctgagcacccgcacgcgcagtcagtctggtgagtgagactaaggtgatggcccctctcagcatcttctatgaaaagagagatcgaaatctggttgagcagttttaccatgggcccaggtgtcgagttgggaatttgattcactgtgccacaatgcccagctccttgcagagataagagagccctgggtgggggcaggggacaaatagtcctcaaatattgcccactgtttgaggattatttgttcaacttttcagagcagggatttgacatctcttgttgggagctgatggtggaaagaggtaaggcctgtgccactcgggaaagctggttcaactccaagctttggcacctcgtcattactggggctaatctcaggcacagacatttaactttctaccttggtcttattgccctatgtgacaggcagcctcaaagttggaaaagtcattgaatcgtcagggctggcagaatcacatttggctccctgaatttgtgttggtcaacctctagggactaaaaaaagctagccctttctagccaccactaccttctgctagcctccacactggtatccagggctggagatagttgtcccagttcacccaatttccatgcaaattggatagaatggggaagcaaggtatagtgtaaactcagttatctgacattctagtaaccggcaccttagcacatggcaagcgaggtggtaattggggctcataatgatggcctggaggccttacaaaatcctgaagtgtcctctgaattatcaaagagcaattacattacagccagtcccattttagtgttaaacacattgtactgtatttgattctttggaaattggtgatccctttgtgatctctatgatgattctgtattaaccagaatattagattaaccagaacactttgttttgcctagtctatataatggaaaatgtgctgttatttgctgtcttttagcagtgtgactaacttgaagctttggtcaagggctacttactctatttgcctcgaaccatttctttcttctgctgacttcgcttgggtctggggactgttgagttaatagctgggccttgggagaaagatggtggtgtctcacagctgcttccgaggaggaaggtgtcaaatctcctgtagtgtgaaaccaggccaatttaggatgtactttcgttgttagcagagttgaaggaaagagtggagagagaaaatggcctcttggcaaggtggctgaggaaggcaggaaaggtaccaatccatcctggggtggtgggggaggagggggaagcgcttgcccagcggtgaggaacagctacaaccgggtggagggaggtgcctgggaggaagctccacccctgaactcttggcaagtcgggaggaggtggggtcaatttaagggaagtgggcgtgcctgggtgcatttgggcgtgacccaaccaggctctgtcacagatcacaggaaagggactccttcttgcttcgcttttcttgagactcttctcttgtgatgattctgcttggccggggtggctctgtccccaagattggtggtgccacaaaaggagtatatcctcccttgccctgtctgagaccccaattgccctctcctagcccctgatttcccagggacccgtggccctctcctgcccttcacaaaatacttggcactttataagagctaagcaagagttttgggtgtggattcaggtgacactgtaacgtggatgagtaagggtgtgtgtttttaatacttgatgttgtctggtatattggactctgtaaagcacatatgcgtgaaaaatcttatttgagcctcaaaacagccctgtgaggtcagtaaggggagaacagtatccccattttatagatgaggagactgcactgaaggaactttcccgaacggtacagctaataactggcagagcctgaacttgaacccagaccttcaaactcctagtccagggcattcacttcgacaccatgctttgtcctttgaagaagtacctgaccatcctctgtacatcccatccacaggaagcatctgtagctcctttgctggcatggcagacagtgacatgggaagccaggaagtcttccccacagaagaagaagaggaggtaacccccaccccagctaagcgtcgaaaggtgagaaagacccaacgggacacccagtatcgcagccaccatgcccaggacaagtctctgctgagccagggccgaaggcacctgtggcgagcccgagaaatgccctggaggacagaggctgcccggcaaatgtgggacaccaatgaggaggaggaggaagaagaggaggagggcctgctgaagaggaagaaacgaagacggcagaagagccgaaaatatcagactggggagtacctgacagagcaagaagacgagcagcggcggaaagggagagcaggtaaggctggccaggggctctgctgtcgccgcggcccgtttggcttctgggaaccctcgggcatctctacgccagccaaaggcttcgggacccagagaaacccggtgctatgatctccagctgccagagggggtcactcaactccagctccgagcctttggctttgggttgacattgaatgagttcggattggcctgcaggtgagcggaggacatgaaggcccaagccctccggtttcttatagaagtctgaacctgtgggcaaggccacggtgacatccttggcatgggacaactggataccagggagttctctggttggcttgagggagtcgagtcttttgggaggacgggttctctctcctagaatcttgggttcaagaagacagagggcatcggctgcctttcctgggatacttgcagcctctaagctaaaaagaagtacagtgggttcttcaaaccaacagaagaacttcaagtagaaacgggcacagcattgctttatccgttaaagccacagtgattattcagaggcggagtgaagctttgaggtgacccaaagtagcatcatttttgttggacctgagttgagaaggcaggcagcccaaagagaaaaccaggctttctctgaccacatcaaatgctgtgatataccattccggaggcacagactgtcacaagatgctaatatcagtatgttccactgagtactgttcaggcccattcctatagtggatttctaaatgagcaaaaagcacatctttgggttttataagaacacctctgtctctcactctcattctctgacctctaccctggaagcagcaattgattgcctcctatgatgtattcatcctgagctgccggtaaacatccgctgtctccttattagctaaaactgaataacctcatattgagtgggtagtagagtccaggtttgctataatgcaaagacggcttaacctcatttccggctctgtttaagtggaggtgtatatgatacccatctctacgctcaagagagtaattgagctaattttcatcaactatgtgacagagtgggaacaattctctttcttctgctagagcaataatagattggtcaggaatgagttgtcaagctgttggcctcagccacttgtgttaggatgaagaggagcttttgtgtatcacctaatcttctctaatggcacctggtttcctagcatggaagcttcctgtggaacatattggcgcttggaaccagaaggaccttcgaggttgcctggtccagtttgccacccaatgcaaagatagagatctccacagcattcttgacaggtagccagccagccttttcatgaacacacctccagtaacgcagagaacaccaccaatcaaggcatcctacttgatttgggggcagctccagttgttggaaagtaggtcattcttcctctgtggatgtgtctaagggttttgcattgaggcagctggatttggcacatggtctggttactttcctccagatctgatgatggcatcttcgtgcaggaatttggcaaaggccaaatgaggcaggttaccctgcttctgtctgagcctcctgacttttcttttcatcctggttttggttatctcccttcttgacctgcggagcaggtaggcagagccacttccactcacacacctgccacctccgctctctagtcctttgtgggctactataaagccttcacttctctgcaattgaataaacacccgagcctgccctgccctgggtaaacaaggtggggggctgtttctttgcctgtagcattgaacactgtaatatgacttcttcatgtttcctggggtcctcacaaggcatggttctgttccttcctcttttgcctcagcccaaatgtgtcgcatcaaaagctggagtttagaacattctgactggaagtgctattagagaccatgtagtacagcaattcctggacaggctatggggccccactagcgggctgaggctagctgggagaaagggatggcatgacagctggccttccaggaactgtgcataagctgcagccaactccttgtgctgaaatgatggcttccacatctggatctgcctttgtcaatgtcacatgtgagagcccgtgtcagggttgagagaggcgagttgagaactcttcaatctcagtcccttcatttcactaattgctaggcatggtgttcattcctttggggaggaaaacacacgggcatggctccacctcaagagcttgtgcttaaataacacaataatgatgtcttacttgttataacactttttgaaaggggttttgcatgtattatcttatttaattctcataccactcttgtgatgtagattatattctccccattttacagatatggcaactgaggctcagagcaattaggacttgagcccagccaatcacacaattgatggccaagccaagcagcactaatcttgagagatgaggttaaacacacagtcgcccctacacacggggttaggacagaccctgtgggatgaagctcttgataatggagttcccggcaggcctttttgaaattagaatgtgctttgttcagcaagctgtggctaaattagagatgttgctggtgtgttctagtgacaccagtgacttgattttcacccagaaaaggcagcaggtttctgcccttgactgccagctaggtaggctcatgatgccttctagtttcagggagttcctgtagctttgatctttgtgtcctcggagagtgacaaatggggcagtcaggtgagtagagctgaggccatgaaggcagccttctaccttttcctccctgttccccatgtacttgatacttaatgtcagcaggaccaccagatttgctttcatacgggactggagaaacagacaaagggaatgggaaaaaagcaaaaagaaattctgatttgctctgggctctgggaaaaatcctgttaaaattacccttatcttagggctagccagatgggccgccccctgctggcagggctgggagctgtctcctgcttgtagatgagggacttcgatgttgaagtatggtgtgttcattcaagaagtatttagtggaatagtcagcacagcactagatatcgatagctgatagttatacaactttgcactgcagttctaatccccaaagtcctctgattcatcttagaggaaggcgttgcttttctgtgttccatttctctgacatccgttcttttcctgtttcttgccttcagatttaaaggcccgtaagcagaagacttcctcctcccaaagtttggagcaccgcctcaggaacaggaaccttctcttgcccaacaaagtccaggggatctcggattcaccaaacggtttcctcccaaataacctggaagagccagcctgccttgaaaattcagaaaagccatcaggaaaacgaaagtgcaagaccaagcacatggcaaccgtctcagaagaggcaaaggtgtgtagctatcaaggggtattgtagaaggtgtgtgtggcggggggtcagaggaggcaggaggggggtgggggatggggaggatcaaattaacccatatttagtaaggcattctcaaactagttctcgaagggttgggggtggatttgaagaatgggaactaaagttatagttaattttaaggtctggcccatgatggcttttcctctacaatctttagattttctttgagttaaggaagagttaaagaatatggcaggatgttagcttgagtagctcgttaacatccaatcaagaagcttttgtctgggtttaacttactggaaaccaatcttggaactttctgagtcaatcaaggtagaaaacaacttgtaggaggaaggattttaaggtccagacaaaggttgattgagggtgaggctgaaggaattccactggggcccaggttctagctactcctcccctaccctgcttcccagttctttagcttctcatggaagcgtagatgctagtgagtgggcagtcaccaatcaacagccaggcaagcattcctaaaaccctcatcccaaatcaacatctcttttgggtctgatgttcatgccattggtgttaggttgcatgttgtatccttagaaaaaatcagtcttcaacctgggttaactttacatttgagagaagtgagggtccgggttcaaatgtatacctataatatgtatttgtcattgacagccaaaaacaaaagcccatcttcagcttgttttggtggtcgtgattcttatttttttttttctctctctctctctctctttttgagagtcacacgctttcgcccaggctggagtgcagtggcacgatctcggctcactgtaacctccgcctcctgggttcaagcgattctcgtgcctcagccttgtgagtaactgggattacaggcgcccaccaccacgcccggctaatttttgtatttttagtacaaaaatacaaaaaatcaccatgttggccgggctgatctcgaactcctgagctcaagtgatccgcccgccttggcctcccaaagtgctggaattacaggcggaagccatcacgcctagcgctttggtggtcatgattcttactggaatccccgaatggcactggcaagaggtgggagccccaagtgctcgtctcccctcctttccccttccccctcccagaacctctttccagctcagacaagactcaagcttatttcttcatcttgaagaatggagctgctgcttcatgccctttctgtctcacaagggtgcttgggggaacaaaggaagcaatgtctgtgacaggctttgataaccataaagtgctctccgagggttgctgtgcatcattgtgcttcgggcggaagcaagaatgagggaacagaggcatagcgtggcagggtagcagcgttcgttcccttgaccccctagagtgggaggacaggggcccagggaaagagcagggaactctggtctgtgccaagcagttcattcacgttatcgctcttaattcccgcagtggcacttgggaggtaggcacctttattatcctcattttgtagtgaggaaactgaggctcaaggaggttaagggacttgtgcgaggttattgggtggtcctgagtgatgcagttgggacgtgaaaaaggcctgtctgcctctggagccatggctcgttccatatgtctctcaggctctgaatggggggcttctgtttgtatttgggaggcactgggggaagggggcagttgggcagaaaatgctgcctccacaagcagcgctgggaaaaggtgggcgtctcaggctcctgctccccctccccttccccctgttcctcccccagacactcagatggatggccccagcccacacaaaggtaaccagcgctcgagattcagcagcacactcacatgcttctgtctggctattctgcctggcagtgggtccgctgcagtgttctcctggagaggtttttgtccctccctctgaccttcctttccccctcccaccttcctttctctcccagtcaccaccacctgctctggttgcccccatggcatggggctttgtagcaggaagcaaggggtgggggagggcggggaacgctcctgcaacactgaaagcggggcactggccaagggcttcttcccacaggggctcagagccagggggaaggagagagggggaggggtccccccacttgttcttgctcctccccctcccaggcaacttgcctcgctgctgctctctggcagctttggcccccagaaaggagagtcaccctttggttcctggcttggcttagtgaaaccctggtactttacccagcatcctccagtcctgccattgtacattctatcctcctggcgataaagcagcattgtaccctcatagctagtgccttcctgctagggcttgtacctctctgccctttcaggatggggactgatcatggcttctcgctgtcttgggattgaccagaggaaacaaatgccccgagccctcatcttctgttctctactgctcctttcctgacttgatgtctttttaggcaacttttctggccatccagggctctgcacacagctggcttgaaacaggtcaacaaatatttgttgtaataatgtggccaggcgcggtggctcacgcctataatcccagcactttgggaggctgaaacaggtggatcacatgagatcaggagtttgagaccagcctgggcaacatggtgaaaccccgtctgtactaaaagtacaaaaattagctgggcgtggtggcacctgcctttagttccagctacttgggaggctgaggcaggagaattgcttgaacctgggaggcagaggttgcagtgagccaagatcgtgtcactgcactccagcctgggtgccagagcgagactctgtctcaaaaacaaacaaacaacaacaactaataataataatgtgcccagccctgagttaagtgctgtaaggaacagaaaaatgatgacaatatgaaccctgtccccaaggagcttaaaatctagcaggagaggtgagacttacgcgtgaaactctgggtggaaagaagaaagtgaggcatcagattacgtggttcagacttggtactctggctacacagaggaagagggcccagagtgttgtggaatatggtagaagacagaggattgaactgagaccttgatgttctgaggggtttggataagtcggaaatactagttatctattggggtataacaaattactatacaacttagcagctttacacaacaataagcatatgttatctcacacagtttcttggggtcaggaattcaggggcttagctaggcctggcttggggtctctcgtgaggttgcagtcaggtgtcagccagggcagcattcctctgagggtgtgactggaggatctgcttctggggtagcttgctcgcatggctggcacattgatgctggttgttggcaggaggcctcctctccctgccccatggatctctccagtgggctgctcaagggtcctcaggacacggcagctggctttccccacgagtgatccaaaagagagcaaggcagaaaccacagtgtcttttaggccctagcctcagaagacacctactgtcatttctgcagtctcctgttggttacataggtcagccctactcactgtaggaggaaggtgcataagagcatgaagatcaggggatcactggggccatcttagaggctgactcccacagtctgccctctggcctcccccagtgattcctgtccctcccacatgcaaagtatgccacctctcccagtgccccccaaagcttcatccaattatagcatcacctccaggtcgagaatctcttctatttatttatttatttatttatttatttatttatttatttatttgtaatggagtttcactcttgttgcccaagctggagtgcagtggctctatctgggctcactgcaacctctgcctcccaggttcaagtaattctcctgcctcagcctttcgaatagctgggattacaggtacctggcaccactcccggctaattttttgtacttttagtagagatggggtttcaccatattggccaggctaatctcgaactcctgacatctggtgatccacccgcttcagccttccaaagtgctgggattacaggtgtgagccaccatgcccggcaattttttttcttttcttctctctttttttttttttttgtaacagagtctcactccatcacccaggctggagcgcagtgccgcaatcttggcatactgcaacctccccctcccgggctcaagtgattctcatgcctcagcctcctgagtagctggaactataggcgtgtaccaccacgcccagctgattttttgtatttttagtagaggctgggtttcactgtgttggccaggctggtcttgaactcctgtcctcaactgatctgcctgccttagcctcccaaactgctgggattataggcgtgagccaccgctcccggcctctcctagtgttttgtgagcacctaccctgctcacagttctggagcctttgtagttcattatctcaaagaccctgcaaggaagaaagtggggctcagagagggagggccttgccccaggtcttctagctaggggatggcagaggcaaggttcaagcccaggtctgccttagatctttctaccaccccaggggagtctgagtatgatatggggacacagtgtgatggaagatgggaacattctgtgaggactggatgtggaaggaaggtttttgctacaagtgtgaagctttagcagctgtgactagtcaaagatagccggccgggcatggtggctcatgcctgtaatcccagcactttgggaggccgaggcaggcggatcacttgagatcaggagttcgagaccagactggccaatgtggcgaaacccctctctactaaaaatgcaaaaattagctgggcatggtggcgcatacctgtaatcccagctactcaggaggctgagggaggagaatcccttgaacctgggaggcagaggttgcagtgagcagagatcacaccactgcactccagcctcagtgacaaagtgagactcggtctcaaaaaaagaaaaaaaaaagatagctgtctcatttctctttactctcagagtttgcttctgcctatttacagataggacttataaaaacctcaataaatggtgattgaggcaggtaaagaaggcatgcagagtcttgagagaagctaggatatcccctcaatctctgatttacaatccctgtggcattccttggtttatggggttgagcatttgaacctcttcatatctccccaccggctacaaactcatgggaacctgtgttgatcctggagagacttcacatggttagcgcctggcccagcgtctggcctcaaacctgacagtagtctcggccatttagggtagtgtaagcaaagtacagcatggacacagataaggtgagatggccttggccactgagggcagtgatgaccctggtggatggataagctgcctggcctgacctgacctaggactgcatctctgctttccagggcaaaggtcgttggagccagcagaagacacgatctcccaaatctcccaccccagtgaaacccacagaaccatgtacaccctctaagtcccgaagtgccagctcagaggaggcctcagagtcacctacagcccggcagatccccccagaggcacgtcggctcatagtgaacaaaaatgctggtgagaccctcctgcagagggcggcgcgtcttggctataaggtaagggagttttcgactgaccacagggcgccgttggtctgagcatctatgaagaagcttttctccatgggctcttctggtgcttgaacccaggctggcctccctctacaccccagattgccctggggctgccttgcccctcatcacttggatgtcagcgtgtgagaatgcaaacttgcttgaatgtcaatttgggatgaatgcaattgaaatggtatcatgcagtatattcctagaccaggaacgcaatttttggatatccacgttgtcttaaatttctctgtatggtggtttcccaactcagaaaggaacaaggggtgatttattgctcactcttcatctcctcctccagcttcccctcattttcgcctctcgcagaggggccaggatcatgtttgaggggcgaggctgagctaaccccaccttatactactaccctatagattagaaagaaggcaagaaaggaagctggcatttattgagcacttcttttgtcatgtgaagagcctgattactttgtatcatttaatctcacagtaagccgatggagtagatttattatccccattttataggtgagaaaatcgaggctttgcagtgttactgatatgtctaagatcactcaactactacgcatatgagtctgaattcaaaccaaggtcttttgattcccaagtgccagggtaggtggaagactgactcattcaccataattcagttacaccttggacgtttccattgttccccactttttattgagtgtgtatctttgcctaccatatggattatttcctcagggtatgctcctagcagtggagttgctgggttagttacagagtgtgcctttggttttaaggctttccatccctatacctgagttgtttcacaccagccacactcccagccagactggtcagctctggggagctgacgtgacagtgtctcactggcaagcagcccatctttcatgagcacctagtgtgcgtgcctggatagctgccgagggagacctaaaacaaaaatcaagaccaatccctgccgtcaaggttaatttaattgtcttgtaccctgggcaaaaccagccaacaggaaaccattggaggggccaatgggacagggctggagcactaaggcagcctgtcagggagggtggaaggagcccttttgggcctgggggaagaggcagacatctgcactggtgaggagggtgggaagcctcgggctttctcccgggtaaaggagcttgacagtttctatatacagccagcagcacccctgacacaggctgcacacacagccgctctagccagctagcctgtgagctgtcagacagaaaggtggagtggcccatctccccagtgccccagagaggactggcaatggtgcagctatgggatccattgtttggaaagccaggcagccattaatgctgccagcctctcccctcctcacctcattcacccagcttcagcccatgctagctagggtgcttcaagtccctggtgtcccacctgtagtcctagcatcatctcaatccaaggaaggcagtcattaaagtgtggatgaatggcagtattggattatcctttttttttttttttggagatggagtcttgctctgtcacctaggctggagtgcaacggtgcaatctcggctcactgcagcctccacctcctgggttcaagggattctcctgcctcagcctcctgagtggctgggattacaggcacctgccatcacactgggctaatttttgtatttttagtagagagggggttttgccatgttggctaggctggtctcaaactcctgacctcaggtgatctgcccgcctcagcctcccaaagtgctgggattacaggcgtgagccactgcacccagcctattggattatcctgatttgaggggagggctagaactgactgtcctggcttgaacattggtcctgccgagacgtgcatccagggatagtccttaaaacaattgtcttccttattcttgaattgccaccagaggctgtgctctccaccacatctcatttctctggtctggggctggcttgccaagctcagggagtcgaggtctgagtgcttgagctctgggcgggcaggtcagcctctctgaggacctcacctcaaataccaccacccagatgagtgtccttggccataaaaaaagtctctccaggccaggtgcggtggctcacgcctgtaaccctaacactttgggaagccaaggtgggcagatcacctgagttcaggagctggagaccagcctggccaacatagtgaaatctcatctctattaaaaatacgaaaattagccaggcgtggtggcgtgcgcctgtagctccagctacttgggaggctaaggcaggagaatcgcttgaacctgggaggcagaggctgcagtgagctgagattgcgccactgcactccagcctgggcaacagagtgagactgtctcaaaaaaaaaagtctctccactgccaaggaaacggcccagagctggggtcctggcaattgtggctcaggactgatgttgttaatgaaagattttgaagtgtgtccctgctataaagggcaggctctgagactcctcagatatttggggagctttgagtctcagggttatataagttcaagaattagacctctctttgctcatggagttgtccctgtccccacaggatgttgttctctactgcctccagaaagacagtgaagatgtgaatcaccgtgacaatgctggctacacagccctgcatgaggcttgttcccggggctggaccgacatcctgaacatcctgctggagcacggggccaacgtgaactgcagtgcgcaggacggcacgaggcaagagggctgcatctccccccagtcccgccctcactcccagctcagcctctcactcaaaagaccttgcctgccgctggcaggcatggtggctcacgcctgtaatcccagcactttgggaggccaaggcgggcggatcatgaggtcaggagttcgagaccagcctggccaacatagtgaaaccccatctttactaaaaatacaaaaattagccgggtgtggtggcatgtgcctgtagtcccagctactaaggaggctgaggcaggagaattgcttgaacccaggaggtggaggttgcagtgagccgcgaccatgccattgcactccagcctgggtgatggagactccgtctcaaaaaaacataaaaaataaaaaaataaagaccttacctcaacctgaaccttcgtagcacaccagactgcgagttgcagagaggccttgacaggaggagttttggaaagacttctataggctcaagagggaaccagtttagggcaggagccaatgagttagttcccagatggccaggccgcatcagttactaaggggaggctgtggttgtctagggatcatcccatcatgtgtagctgtcaccaggaagaccactcggtcttccctcaactcatcctggtgggggacgtgtctcagacagaatagaaactgagaggttgacctgagggtaatatccagatttgatttttaaaatttgatctctagacactgtaagaaaaatacacctgctgtgtcttagagaaattgtacccattctcctctgttctaccagagagcctacttcctgggcaaattagagacaggagctgcagatccaggagggggctccgcttgggttctgcctggcgtgtggagcccttctgctcatctctgctctcagggagtcacccagggccttcagttccctgaactgaagtatccctctacagttgcccccaccttttttttttttttgagatggagtctcactctgtcgcccaggctggtatgcagtggcacaatcttggctcgctgcaacctctgcctcccggtttcaagcaattctcctgcctcagccttctgagtagctgggactatgggtgcccgccatgacgcccagctaatttttggatttttagtagagatggggcttcaccatgttggccaggctggtctcaaactcttggcctcaagtgatccacctgcttcggcctcccaaagtgctgggattacaggcgtgagccaccgcgcccggcttccctgcagctgccttaactttattgtaggtcagggacccatcctctagtgaactccacaactaccaatagagctacattgtgccatgggaactgtcccaagatgtcaggggaacgtaagagagagagagtaatgggagggaggaaaagggggtacagagagaggaggagttggggagatggtagtggagagttgcaaggctacaggtggttcccttgtcctaagtcttaaaccatattacaccaaggttacctgggggtcagctcagttttttcccctgatgcagtagccttaagtgtagacaccccagttcccacttgggccctgttatcctcaccctgtatcacctccacaggccagttcatgatgcggtggtcaatgacaacctggagaccatctggctcctgctgtcctatggggccgatcccacactggctacctactcgggtcagacagccatgaagctggccagcagcgacaccatgaagcgctttctcagtggtaagcatggtccagacttgacactgttgtccttggg

SEQ ID NO: 1294 - DNA, 58346 bp, mus musculus; identical to SEQ ID NO: 1293

SEQ ID NO: 1295 - DNA, 75428 bp, mus musculus
tctttcgctcgccgcggctgctgccagtgtgtggctctgtctctcctccgctttgctgagccctcccttcttcctctcagttcctagagtccgaccgccgccgccgccgagagagaggagaaggaggtcggtggcgataaggggcggaggggggcatcagatcggggcagtattaggcgggtggcggttaagagggagtaagagggagcccgggtggcggcctgagcctccccgcggagccgacccgggaacaggtgcgtcttttttctctctcccccaatccctccaccccttttgactccccggctttttcgtatccccccacccgcttctttctatcttaagcctttctccaaccctgttccttcttttccctgcggccgctcggcttgccccccgggggcgccgtcctcttcgtgtccccggacgtagcgctccctggagctgggtatgtcttcgcccctcccttcgggacagctcccttccacttcccaccttcgtaccccatcccctgacttgccctacccccttctcgacccccttctctcttagccaggtgagactcgttcgccacgatccaagagagtcttcttcccggctgggcgggggtctccatggaaacgggggtcggttgatcctgggggggaaaccataggaattaccccactcctcggaaagggaggtggaggctatggtcttgttaactacctgactccaacccccgatccaaggatccgacgatccgaagggaggctggctagcagggcagggcgagaaaaggcttttttttggggggggggggtgtccgtgatgaagtgttgaagagaccgggagaaaatgccctccaacctcagaggggaggtgcgacgggtgctcttcagggctgctttcttcccggcgctggggtgcgggaatcgtagggtaaggggtacccctaggtggcggcggggcctgggttcgggagtgggagtgctgtgatgggggcaggggcaattatccgagtccctggaaaaaaggcgggggatgacttcggagcgccctggctccgctgccctcgctctaggggcgggggccgccgggccgggcgcggcggggagggggcttaaattgaaggaagatgagatcgggggcaattcatactagcaccggcaagccagaggggagatccggcgtgcaagccctccacccgcttcgcgccaggcctggaggcaaggggtcggcgagcgaagccgagggctggaaggagggaggctccggttacggggccgggtttcgggatcaggggcaatcccccggcccttggagaaggagggagagggatggccgcgaaccccagggctcccccaccccgggtcctaaggggcgtgagggacggacagcaggcccagcggagctggattcgagcggatcgcggccggggagtgggagggcttagtggtgggcttcggggggagcagtccggcggcggggcgggcgggcggggcgtggggctccggcgggcggcggggcggggccgggggcggcgctgctgccgccgccgctgccgccgccgccgctgctgctcctgctggggccgccgcagccgttgccgccgccgccgccgccgcttctgggcggggaacggaggccaaagagagtcccgtgccggggcagagggcgcaggcggcgcgcggtggggagggggccgtcctgggggcgggggcaggcgggggggtggagcccccgacggggggcggtacgagccgggacgacgacgacgaggagccccgggggccgggtgcatggaggacgaggtgctgggagaaggaaggggggtgtgggtcccgcgactggcctcgtgggcttggctcctcgaggttcggtttcgggacagagccctgcaggggcgccaagaggccggggaagggatagggaggtgaactggtcggtggagggggccctcctcgccggggtcccgccgagaggaaggctgggccagagggacgtccggggcaaggctgggaggagccggccgcacctcggctggggatttcgcgttatggaggtgcgggagattgttgtagggaaagacgtggtcgaggggaaaggtgggagggaaacactgcaaacccgggaggccaacagcacaggcccgtgggggtgcccttctattccgctcgcacctcctccctccctgagtggaagcactatgtttttgttttattgttttgaaattttcaatgttggctgatcgaaactgtcgatggggtgatattcattcttggtgtctcctggagtagacagtaaagacaggcatcctttggcgagcaagcatctagcccagggtttagaggctctttacgttagtgtgggaagggggcccggtaactttgtgccacagcttgactactgttaaggcagtttggaggtcgtccctgtggtacagaggtggagtacaattgcaaaaatcttcagtaagacttctggagatgagttgtaggttagcgttacagtggttagccctgtggttctttcaacttagaaggctctttctcaaaagcacgccgttgagttacatgggaaaataaatgtggattgcatttggggttgggagtggattaggttgattataaaatttcaaggttggaagggagttttaaggttatttacttttctgttgatatgtcctgtccttgaatgttggaattgagggagctttattttggggaagatggtagatggcacagtggaggatgtctggtgcacagtttagggtactttaattgaatggtgatgtcaccatgtggtactaaagatgacagtatgtaggagagaaatttgggggattccactggggattaaatgggataacctaattttaagaatcatcccggggctccaaatagaagcaaaaggctggggaggagcctgtaaaatttcgatggaggcgaaaagttagtagcaaagattgaggtagctgggaagagcaaggggcttggtgagtcaagttaagagaatctgaaggttgatagtagagtttagggatgtggccatcttgactaagtcatgaggatgttgttaggcggacatcttttgacagggcaacttaggcaactgcccttggggcagatgtgagggatgaaaggtacaggccttggggcacagatcctgactaaaattgaccttaagagggctgatcctgataccagctttgcaacaagggtggttaggtttcttttcttttcttttttttttttagatggagtctcagtcgcccaggctggagtgcagtgctacaatctcagctcactgtaacctccgcctcctgggttccggtgattctcctgccttaccctccagagtagctgggactgcaggtgcccgccaccacgcctggctaattttttgtatttttagtagagacagggtttcgccatgttggccaggctggtcttgaactcctgacctcaggtgatccatccggcccagtttatttttgtcctggctgtaagtcattgatgaggaaggagaggggtttcacctctcccttgtctgagttcaggaggatttttaaaaaatttttttagaataggccaataaggaagggacagcaaatttttagaaaaggccaataaggaagggacagcaaaacaaatcgttggcatagggcagagaaaagctaaggccctggcaagctctgctgctggagtctgcatagggcagagtggagggagttccacaagacatgatggctgcaccaaaaacactcatgtgggtctggctattttgatttgccaggaaagcgtagataaagagggaggatccctttctcagtgacatagacattcttgggaagaaaagaggggtcctccacagggctctgcttcatttatgatgcagttcatgaaatagaaaaaaatgggccgggtgcagtggctcactcctgtaaccccagcagtttgggaggccaaggcaggcagatcacttgaggtcaggagttcaagaccagcctggccaacatggtgaaaccccgtttctactaaaatcacaaaaattagccaggtgtggtggggcgtgcctgtaatcctagctacttgggaggtggaggcacaagaattgcttgaacctgggaggtggaggttgcagtgtgccaagatcgtgccactgcactccagcctgggcaacagagcgagagtccatctcaaaaacaaaaacaaaaaaacaaaaaaacaaaaaaagaaaaaagaaaaaaatgttcagtacagggagtggaggatctcaggacactattggttggattatgggttgtagggaagggcttctttgagagaaacagaattatgggaaaaaaggacttggacactagagggaaggaaggcaagaaagagaagtcaggaagagggctggttgagcaatgaaaggaaaagaaaggtgatcatcactggtcccatgtaagggccagctaaggaaaaagtcaaaccttgaaatctctaggacaatgttttccaaagtaaactttgaagaactcttaaagctctttacaatttcatgctggaatcactaaggttggggcaagagagaaggaatatatggggtaaaagtagggtgggggagaaactggcatttagagagaaatacaagcatatttatccataaggaaatagggaacttagagattatatacaggttaaaatgcagaatgtgagagaaaaagagaggaattaagagccaaaggaggaagatatttactcagatatcttttggagccggtgttagggagcggaaaatcttgcctttgatagccactgccctgagagggcccaggaagcagaggttagctgggatccaggccttacacatctaaacattaattagaaaatctagactaaagtaaggatactgaatggggggagggattcactgtcctaaatagagtggccttgaaagaaggaaaaagtgggaatccaccagtgtttccagtctgcaggtgggaaggatcctaggtatcaggagatgagtgatggaaattccagggtgaaactggataaaaaactgagtgacatgagagcctgtgggccagaattggagggtggggttaggggcatggaagagaggctctaatcagggcttggactggaggccacatggagtaattcattgattctgggctgagctaagcttgggatgaaatagaacagccaaagagagtagagagctgttcttcagggccaatcagcatcagaatcagagtgaagaaattcgaggtcaagtttgggtgggaaagtgaacaccggagtggaacagagagggtgctggagaaagtgacacaattgttggggtagaataggaaaaggtagaagccactgatgattacataacccagagggaagaccctaggcctttgagttttcaaagagaagggaagtttcttaatgctggagtttgaattaggtgtgagtccatggttgccagagtgtttagtgtcaggatggccaaagagggaggtaatatctacttttcggccactaggatgctagtacagtatttgatataattttacatatgaactaggctttattaatgcccatttttgaatggttatccttaaaataatgtagaaatggttctttttctaaattaaatcattccctttcccactgttcataacttaaaagcaatcttttatgatgagaactttctttggcgaactgaagtttcattctggtcaagagtaaaatttaactctgtgtttctatccccgtaattcaaatatgctgttctagttttcttttttattctaagcagaagtgaccttttccccataaaacataaaaaaggatcttttttttaaaaaaaaaaagtaactgagtaactgcaggctgcatgtcaaggtcatattttccctggtcaatgaattatgatgaatttgaatacagctgatatattatttgtaaaatgtggtaattttcagatttactcatcacagtatgtgaggcaggatacctcttcatttgtattttaagaaaaccttaagctgaaggtccgtgaggaatccagagtaccaaggagcagggaaagctttgtgttttgggcttctttaccgtgggtctgctgagaaacaaaatttggttacctcattactaaggtatgcctagaaatcatagtgttagtgccatttaagggtactgttgagttttgttataatgctgatgtccagggacaaggagaacaagcagatttttgcttttccaagttttgtggagaagtgcaccgtatatgactatgatcgcagaggtgagttgatgcactgtatacctgaatccatgagatgattatcttctgataatgaggctttactcagtttaacttggttgtaccacaccccagttagtatagtacagtggttctcaaacttgagctcctcagaattgcctgggggggctttggagaccgacaacctcaggttagagtgcttgctgttctacttcttagctatgtggcaggaggcaagtcacttaacttactttcgttcttttttttgacagagtctcactctgtcacccaggctggagtgtagtggcatgatctcggctcactgcaagctccgctgcccgggttcaagccattctcctgcctcagcctcgcaagtagctgggactacaggcgcccgccaccatgcccggctaatttttttttttttttttttttttttagtagagacggggtttcaccgtgttagccaggatggtctcaatctcctgagcttgtgatctgcccatcttggcctcccaaagtgctgggattacaggcgtgagccaccgcacccgtctttttttttttttttttttttttttttttttttttttaaccggagacagtctagctctgttgcccaggctggagtacagtggtgtgatctcggctcactgcaacctccgtctcctgggttcaagctattctcccacctcagcctcctgagtagctgggattaaacgtgcccaccaccatgcctggctaacttctgtatttttagtagagacggggtttcaccatgttgaccaggctggtcttgaactcctgacctgaagtgatctgcccacctcaacctcccaacatgttgggattacaggcatgagccaccgtgccaggtcttcacttaactctctttgtttcttttttttttgtttttagacagagtcttgctctgtcacccaggctgaagtgcagtggtgctatcttggctcactgcaacctccacctcccggcttcaagcgattctcgtgcctcagcctctcgagtagctgggattacaagcgcccagcaccacgtccagctaatttttgtatttttagtagagatggggttttgccatgttggccaggctggtctcgaactcctgacctcaggtgatccttccacctcagcctcccaaagtgctgggattacaggcatgggccaccatgcccggcccacttaactttgttgagcctcagttttctcatctatacaatggagatgataataccaatttcacagggctgtgaggattacacaaaatcatcccaggcccatagtaggtgctcaataaatgggacctattattttatatatatatttttttctttttcttttttgagatggagtctcgctcttttgcccaggctggagtgcagtggcgctatctcggctcactgcaagctctgcctcctggattcacgccatcctcctgcctcagcctcctgagtagctgggactacaggcgcccaccaccgtgcccggctaattttttgtatttttagtagagacggggtttcactgtgttagccaggatggtctcaatctcctcacctcgtgatccgcccgccttggcctcccaaagtgctgggattacaggcatgagccactgtgcccggccctattattatattattatctaatttttcttgttcaattgtatcctattatgttatagtaaacatggtggcagcatgaaaactatcaacagcttctcagtggtccccttatatcttgattctctgtcctctttcttcatattcctgttgtattagtacacatttggcatttacaacatgctaggaagaaagcttgactcatcactgcatctacctttgaggtggaagtggcggcttctttaacagctatgctgtaacactgctcaatagttcaggacaggaactgaggagtgtatatccagttgaaactctagggaacatttcgggccatgggtgacatttttaaaaaccattgctttctgaaaagggctgttgtgtttatttaattaattaatttatttgtttatttattgattgatttatttgaaaccgagcctcactctgttgcccaggttagagtgcagtggcgtgatctcggcttactgcaacctccgcctcctgggttcaagcgattcttctgcctcagcctcccgtgtagctgggactataggtgtgagccaccatgcctggctaatttttgtatttatattatttatttattttttgagatagagtttcgttcttgttgcccaggctggagtgcagtgatgcaatcttggctcactgcaacctccttctccttgtttcaagtgattctcctgcctcagccttctgagtagctgggattataggcacccaccaccacgcctggctgatttttgtattttttctagtagagatggggttttgccatgttggcctggctggtctcgaactcctgacctcaagtgatccggctgccttggcctcccaaagtgttgggattacaggtgtgagccactgcgcctagtctatttatttatttttgagacagggtctggctctgttgcctcagcctcctgagtagctgggacaggccaccatgcccggacaattgtttttatttttatttttagtagaggcagggtctccctgtgttgcccaggctgttcttaaactcctgagctccagcattcctcctgtcttaacttcccaaagtgctgggattacaggtgtgagccactgtgcccggcagaaaatattcttttttttttttttttttttttttgagacagagtcttgctctgctgcccaggctggagtgcagtggtgcgatctcggctcactgcaacctccatctcccgggttcaagcaattctcctgcctcagcctcctgagtagctgggattgcaggcgcccgccaccatgcccagctaatttttttttttttgtatttttagtagagacggggtttcaccatgttggtcaggttggtctcgaacccctgacctcgtgatccatccacctcggcctcccaaagtgctgggattacaggcgtgagccaccgtgcctggcgctttttatttttatttttgtttctgagatggagtcttgctctattgcccacgctgaagtagagtggtgcaaactcagctcactgcagcttcgacctcccgagctcaagtgatcttcccacttcatcctcccaagtagctaggaccacaggcccataccaccaggcacagctgatttttaaaataatttttgggccaggcacagtcgtcacgcctataatcccaccactttgggaggccgaggctagcagatcacttgagcctaggagttcaagaccagcctgggcaatgtagcgagaccctgtctctacaaaataatacaaaaattacctgggcttggtggcgccaggtgtggtggcatgtgtctatagtcccagctacttgggaagctgaggtgggagggccacttgagcccgggagtgccgctacagtgagctgtgattgtgccagtgcacttcagcccaggtgacagagttgagacccagtcttaaaataacaacaacaaactctttgagctaatactgtttaatgaaagctgtatagatacacctttgaatgaataatatatataaaattagttgaacccatagctgagtctgttctgttgtgagaaaatagaaagaataacctgataatggtctctccaaatatttgtgttatgtagtccaggagacttttataaaagcaaaagttgggtgaggaagaattgtcttttttaaaaccatatatatatatttagagaccgggttatgagactggctaatttttgtattttttgtagagacggggtttcaccatgttgccaaggctggtctggaactcctgggcttaagtgatctgtctgcctcggcctctcagtgttgggattacaggtgtgagccagtgcgcccagctaggaattgtctttaggtgaaaaattgcgtatcatgaatatagtatactgaaatggagacaccagagggccactgtcacagtctatggcaggcaggacccagaagcatctcaaaagggattcagaatgtctcatattacaatgattcaagtttagagtgtgaaaaacacactaaatatttatatggtcctgctgaagaccaagattgagggaagccaatttgtgtttttgttctagcggaaattagaagtactcaaaaaatgaccctagatatttagggtgacattttgaggttgctttgccttttgaaaggactgattaatttcacaatgatcacttaagttttgcgtgacatctagaagttgtataaaatcttgtagctagagccgaggtttattataaagctatgatgaggtgtttttgttaaatggagtaaagtaattttcttacagcaggaaatggaagtgagtactgtttgaataataagaaaaaagtatcatagcaatgggtagaaagcaaaaagaatctggcggtatgaaaatgtaagtgaggccaggcacgctggctcacgcctataatctcagcactttgggaggcaaaggcaggaggactgcttgaggccaggagtttgagaccagcctaggcaacatagggagaccctgactgtactgaaaaaaattttaaattagccaggtatggtggtgcacacctgtggtcccagctgcttgagaggctgaggtaggaggattgcttgagcctgggaggtcaaggttgcagtgagctatgatcatgcgattgtactccagcctgggttacagagcaagacccgtctcaaagaaagaaataaaatgtaagcaaaagattaaagcttttgcatttgactacttcattcttggaatagattacgtatggtccttttttttattttttaatttttattttatttatttatttttttgagatagagtcttgcttttgtagctcaggttggtgtgcaatggcacaatctcagctctgaccccccaggtccaagcgattctgctgcctcagcctcccgagtagctgggattacagatgcccccccaccatgcccagctaattttttgtgtttttagtggagacagggtttcaccatgttggccaggctggtcttgaactcctgacctcaggtgatcgcctgccttggcttcccaaagtgctgggattacaggcgtgagccaccatgtccggccagtctatggtccttttctaagtgctttcatgttattccaaatttttagtagggactagtagtttattcccattttgcaggtgacatggtaaatggacatagagagatagtctgagatggctgagaagtggggactgggagtgttctccaagttttcccaccgcagtgtaggctatgggtgctagagtatatcacttttcaaggcattacttgattagatggttctgtttaatattgctgctgtttgagtagattgttctgaatggattttggatgttcctaaacatcagatcgaccctgaaaggatgggttccagcactaatgaggagagtgaaaaggacgtagtattggtctggatgctaacgctcacagaggaactccagggagattgcaagccctggccgctcggctgagatgactgtccagcctcctgaggcgactactttggggtaactacattcatttgaatgataaacgctcatgtgtttaacagcagttaacattcctttgtatccagtctcataaatgtttataggtaaggttttagacatggaagtacccaaagagtctatgaaggggtccatgctagacctatatgccggcaactacctagccttcccactaaataccagaattaatgtatctgggcaaaagatacaatatgccttataagactgatcccttggggtagatatcagtggaaatatttggataggaaaaaaaaaatccaggggaagtagaaagtgttagaatagatttttagtcaggcagaagtttgggatgaacagcagaaagggctgttctttctcctttaaattgcctggcagattatttctagttgattttgtgtgtgcagtagtagaggaaccaacttggcatgaagagaagcaaagtaaagtgtttgggggcatgtctatgggacttcttttttttttttccaagacagagtctcgctctgttgctcaggctagactgcagtggcatgatcttggctcactgcaacttctgcctcccaggttcaagcgattctcctgcctcggcctcctgagtagctgggattacaggtgcccaccactaggcctgactaatttttgtatttttagtagagatggggtttcaccatgtggaccaggatggtctcgaactcctgacctcaagttatccacctaccttggcctcccaaagtgctgggattacaggcatgagccaccacgtctggcctctctatgggactcttgagtttcagggaatatttggttaatggtagggaaagatgagggaatatagatattgggggtaaagattgaggagaattttcgaatacccttatatgtattagatcattaaataagtttatttttatttttattttttgacacggagtctagctctgtcacccaggctggagtgtagtggcctcatcttggctcactgcaacctttgcctcccaggttcaagtgattcccctgcctcagcctcccgagtagctgggattacaggcgcacaccaccatgcccagctaattttgtatttttagtagagatggggtttcggcatgttggccaggctggtcttgaactccagacctctagtgatccacctgcctctgcctctcaaaatgctgggattacaggcctgagccactacacccggccagaacggtttaaattggggtaacttcctcattgggggcaggggttgtggtatgtaatgaagtagggaaaacaggaatgttagtctcctaacacattctgttgaatacacatggaagaaggcagagtaatcaggagggcaagctctgtagtaggagttccacatctaaagccgggtaaagttgtccttgctgggtgtgtgtacattttcctatggaaaacaatgagcagatttgccttcactctaaaagacttctgggcagaagtcatggccttttccctttagccctgagatctcagtgtcagtggtctcttagatctcctcaggggtgtcttagatgctgttttttcccaagtggaatgatgaggtggcctctccttttgctgctgtaaagtttgcctctgtcttatgggagctttaccaagagctctgggtctctattggaggagtaggtcccaaagttggttttccttacttattagtcatcactgacccagccctcctccttaaactgtctgctggccacgcctatcctctagaggacagattcagggccaggcttcaagatgaatattttccggctctttcattttttaaagtcataattgcttccaggtcaccaggcagtatgaaccaaaaggagcctgggggagcaggactacatttcgtttaactgagagcttcttaagcttgggtttctagtttactgtcttgatggtagagtccaagcatgaataaatgggtaggtttcatgctatgtgtagaagaccgagttgtgttccataagttgagtgttctgcacttaaggggtcttcagccacaaagggaactacatgatcctgaagtacttgtcagctgcatgaacatcctgatcattttcttttatttatttattttttgagacaggatctctctttgtcacccaggctagagtacggtggcgtgatcttagctcactgtgggcttgacatcctgggctcgaaggatcccttctgccacagcctcctgagtagctgggaccacaggtgtgcaccatcacacccagctatttttttattttttatagagacgaggtctcactatgttgcccaggctggtctcaaactcctgggctcaagcagtcctcctgcctcagcctcctaaagtgctggggttatggacatgagcccatgcctggcctggtcctttttaaggttaaaaacctcgtaaacagtgcctacctcagtcaaaaacatttgtcagatagatgctttctctgttacctcctttaatgtccttctcttcctcatatgcatgatgacaaccatgcttttgcttgtaattgttgtgaaatctgcatgttttggcatcttcatttcaaaacgaaacaaaaaaatcctatcccacctgtaaaatctcctttgagattttggtgctgcctatcctctattactaactcccccagccccgacataggctataatttgatgttattcttccccttttgagaacacattctctctaaacttttctaaaatgtctgtcttcagtgcttccccacagtgtttcagtttggcccatgatggtgaaatatttcaggttcccctatttcattttttttccttttggttattgcatgcgatgggcttttcttttatgcctatcacacctgcccttgtcttctagtgtgttctatttggattgttttaaagatctctgcttcattatggtttctcttccactacccgctcgccctcagcttagctgctatttttcaccattttaaagttattgcggccaggcacggtggctcactcctgtaatcccagtacttttggaagccaaggtgggcggatcggaaggtcaggagttcgagacgagcctggccaacatggtgaaaccccgtctctactaaaaatacaaaaattagccgggcatggtggcccatgcctgtaatcccagctactcaggaggctgagacaggagaatcgcttgaacccaggaggcggaggttgcagtgagccaacatcgcgccattgcactccagccttggtgacagagcgagactccgactcaccaaaaaaaaaaaaaaaaaaaaaaagttattgctctctcattagttccttttctttttggtttcccctgttctgtagtgtggtgattgtctctggctacctactcttggctgcccacctgttggattcatttcctgggatcttgggtaggccttttacttctctgtgcatgtgcctcctaaattgaagttttacatatatatatatatatatatgtatttttttttcccagccacacttatggctttggattggcagagcacgtgctctcctttgtcctcaccatgagttggatatatcttttgagttttttcccccaaagtagggatagctcacagtggttcctctgccttccaggcagtgaccagggttgattcttgggccatgcagctgttcatttctttaacaattacatggttgtgacatctgggaaaatcctttgaggtatttcatatccttgtgcctgtgcttcctgggtcatttgggattaccaggtttcttccaagttcctttttggaactttgcttttgatgtgatgatttccatcagagagagggagagtaggcggggtggtggggggaggtgggaagggagaacacatgagtaccggtgcttcaagcaaaagcaagccagcatacaagtgtgtaaaccagcagcgcttacgaagtgtggcatgcctgcaaggcttttcctttttgctcacctctcctgggatactaatttgattggctataatataataaaacaaacccctaggcctactgaatcagaatctccaggactgagacctaggaatctgtattttgaacaagctcctcggtgattctggctggggaaacattggttgacattgaccgtcctgactcctcccttctgtgagcattcacgcagtcaggagtctgttctctagggccgctttagaggttccctttgctttccctctggctggggaagaccaatcttgccttcttgtatagaccatgtagctcagtgtcagtgttctcctgcctgtgttttatccctcccctcctctcctctcatctgcagaggctactgttaattagcaacagtgggcttcagataggaagtggcgctcctgggacaaaatcatgatagaaaattgagaggcaaagatttaagtggatgctccatcttgaggatcttgtgaaaatggagttatccagaatcagcgttgctctctacgtggtcataacatgtgtattatatagtaattattttgatattttaactcggttttattttttgtggttttttttttttttttgcctgaaagctctttatctaggtgatgttgtatgatgttctgtttccaaatgccagtgttccccctctgatttctgtcccagaccctacatactactaatcctaatcctctctaaatagagcaatacgaaacctgagagtgaaaaatctagtgtcactaatacctgctgcctatagatatttagtagcaactaaaacttgtactttgtgttgaaacacatctttttttttttttttttttttttttttttgagatagggtctccctctgttgcccaggctggagtgcagtggcgccatctcggctcactgcaacctctgcctcccgggctcaagcagttctcccacctcagcttcccaagtagcagggaccacaggtttgcacagccacacacggctatttttttgtattttgtagacatggggctttgccatgttgcccaggctgatcttgaactcctgagctcaagtgatccacctgccttggcctcccaaggtgctgggattacaggcgtgattacagtgggattacaggccactgctctgggcctgaaatgcattttatggcaagaacagccccttccattgcttgagtcctctaattctttttccccccccccagacagagtcttaactgtcgcctaggctggagtgcagtggtgcgatcttggctcactgcaacctctgcctcccgggttcaagcaattttcctgcatcagcctccgagtagctgagattacaggtgcctgccaccacgctcggctattttttgtatttttagtagagatggggtttcaccatgttggccaggctggtctcgaactcctgacctcaggtgatccacccgtctcggcctcccaaagtgctgggattacaggtgtgagccaccatgcctggccgagtcctctaatgcttagtagagagaaaagatgaaatgagtacctggggtatcagccaataggctgagctggttttgtttttgtttttgttttagacaggattttgctgtcgcccaggctggaatgcagtggcacaatctcagctcactgcagccttgacctcctaggctcaggtgatcctcccacctcagcctcccaagtagctgggaatacaggcacccgccaccatgcccggctaattttttgtagagatggggtttcgccatgttgcccaggctggtcttgaactcctggactcaagcaatcctcccagctcaacctcccaaagttctgggattacaggtgtgagccactgtgcccaaccagtgttgttggttaaaatggggatattccaagatattctgagaaacagtcaaaacttgattaaccaggatgttcagggaacggggtccttgttaaaaatatttctaaaattatgctaacccacataactgtcttcataatgttaaaagataattgtcagaaaaaaggtaaaaaatcatgactctcgtacagatacaaaaatgaacacgtgttaaagattttattttactcattaatcaacaagagaaccagacagatgttatagctggttcaaacaaaaagtcaaaaagcacaaatttatatggagtaaaggaaataaattgcaaatggaggcaaaagtagtttttctacagtggggaggaaagacaatccaaactcaatgggacaagacagacttcgcatatacatcagttacctgcaattacagagatgcaaaatagcttgaagacaataacctgagctaaaatcagatagcccagaaggttatgctatagacagtgcatagttttttcattggagtacaaaggtttttctgtagtaagcaaacatggtggatgctttgtgtgtgtgtgtgtgtgtgtgtgtgtgtgtgtcggggggtggctgttgattttgcttcttgtgatttctcagggccgtcacttcagttcttatccagaattcagttccatataacatgcatttactgagtagttactatacgtaaggtgtcgtggaggaaacaaagacaaaaaaggatgctttttttttctttttcttttttttgtttttgagatggagttccacccttgttgcccaggctggagtgcaatggtgcgatcttggctcacctcaacctccgcctcccaggttcaagcaattctcctgcctcagcctcccaagtagctgggattataggcatgtgccaccatgcccggctaatttggtattttaatagagatggggtttccccatgttggctatgctgatctcaaactcctgacctcaggtgatctgcccaccttggcctcccgaagtgctgggattacaggtgtgagccaccgtggctggccaaggacgctatttcttaccttaggtagctgattggtgggggagacaaacatgccttgtccccaactaaccaagctagagaggagaataagaaccagtgctgtggaagaggtagggagtaaatacttgaggacaaccagagagggaggggttaactgaactcgggctggggctagggggatgacatgatgacatttaagctgagtcttgagagaagacagggagaggaagagggggaagcaggagaggccatttcagggtgaggaggcagaagagtcctgaaactggatggtgtgtttaggaagggttgggagctgggggtggtgagagtggtggggaaatggcaggatgtggtggaagaggaggctggagaggaggtttgaggccaggtcatgagggccctgaaggcagtgctgagaatggctggctgggtgctagaggccggggaaagctattgaaagcttttgaggagggaaggagtgacatgatcgaactggcgctttagaagatgaattgattgtagaatcaagaaattgaaggcagagggagcagttaagaggtgattataatattctgggtgagagctgatgagggcctgcaccagggtagtggcaagaagggtagaaggcaaggctggagatggcattattaaggcctgacttctgatcgaatatgggcggcaggggagagaaggagttgaagatgacaaggcggaaatttccaggctaggggacggtagtgccgttaagtaagctaggaaacacgctgcttactgggcatagggggtggggagcaggtttatgagaacagataatgagtatggtttgagacacattgagtttgaggggcttggtggtcatccaattaacagcaagttgctggcagctggaaattctggtctgggcctaaggagagaggtcaaggctagagatacagatttgggagtcatcagtgcatcaaggggcgagctgaaactgtggaagctcatgagctgagagagaaggtggggcagggctgacaactggcacagagggagagagatgggtgggggaagccagagagagccagcaaaaggcagactaggaggaaaagagacagagggagaccggggagggaccggaagagggagactgaaggccaaagagtagaggggagggggaggcacaggggagggagaaggggaaggagggggagagggaggagagaatgaatgggagactgagggaaatggggaaggtgagataagcaagaaaaagacagggaaggagagaggtgggaacggggagaaagttggaggagaggggattgtgtgtgtgtgtgagagagaggagaaaggcaagaggtgaacagctgggaaaataataggggagagaaaggtgaggaggaggaagagtaaagagagagagatgggtagggggatgagaaagagggaagaagccttgaaagataggaaggggaggaaatgggagagggtggcagaggtgaagagagacagagatcaagggaaaggccaggccccagtgaatgcccaagtctttggggtgggcagtggaagagaagggccccggagaagccatcaggcagtggatcaggaaagacaagagaagggagagaataaagagggcaacgtatcccactctgcagagatgaggaggaggatgaagcccaggcagggtggatgcctctctcctctcttctcctaccacctccacactggtctcctggctctcccttgatctttgtgggcaacctcctgccttaggactttctcatgcactgttccctcagcctggaatgcttttctcccaaatatccacgtggctactcctttacctcattccgatggtttaaatgtctcctttacagcaaggcctatcctgttcaccgtatttcagatagtagccctccccacctagactgtgcccttgccccttagtctgtgttgtattatctcctcctcctcctccttcttcttcttcttcttcttctttttttttttttttgagacagagtttcactcttgttgcccaggttggagtgcaatggcatggtatcagctcgccgcaacctctgcctcctgggttcaagcaattctcctgccttagcctcctgagtatctgggattacaggcatgtgctaccacggtggctaattttgtgtttttagtagagacagggtttctccatgttggtcaggctggtcttggactcccgaactcaggtgatccacctgcctcggcctcccaaagtgctgggattacaggcatgagccactgcacctggcctgttgtactatcttctaacatgccgtgacatagaactatttaacatgctatgacatagaagtattcaacatgtttattgtccatgtcatccccctgggatgtaagctccacacgggcaggcattttgttctgtttcgttaattgctgaatcctcagtacctaggatggtgctggctcatagtaggaatgcaataaattgtgatactgtgttgaaagtggacaatctctgaaaattgaaaaatggatacatgaaacaaatccctcgtacaactatatcttattgtgatttactttggaaagtggagaacagcattcaattctgatcactgtagggttctgttcagttgaacttcaatgaataaggattttagctaataagctaactcaagagcttaagggtctcaaggcaagctcattggataaaggtttttcttggtgcctcattttttctagaaggtaaattaactgtgccctgcttgtcaaagcgagagagggacattggctggtgaagagagtggtggaacatggagacaacagactgacaggaagggacaaggacagaaatgtgtggtttttttttttttttttttttgagacagagtcttgctctgtggcccaggctggagtgcgctggcatgatctcagctcactgcaacctctgcctcttgggttcaagcgattcttgtgcctcaacctcccgagtagctgggattacaggtgcacaccaccaccccaggctaatttttttatttttagtagaaacggggtttcaccatgttgtccaggctggtctcgagctcctgacctcaggtgatccacccgcctcggcctcccaaaatgttgggattacaggcgtgagccaccgcgccctgccgaaacacgtagttctggatggaacgttgttttctgtttgtttgcttgttggtggtcagcgtgcaaggagtactgcacctgatttggagggagcttgaaaccaggttagatacgtgtgttatttccaactcaaagtcaatggagtatttttgaaggacttacgaaaaaaagcatgtgcttcctctgaagagtgtaaattggctacgtcactcaaatacttcagtacccatggattagagagtagacgagaaaaaggtcaccagtagtgttttagtgcaccattcatatatgggtatgactctctaattgtagttggttaggctaaatgtgtgtagaaatatatactgtcatctcatttgtctgaaatagattgaatttcctctactcaagcatatctgtcttttaagataatttaaaactcactctaggtgattaacaatgtcctcatctccatcctgaaacctatggattcctagaaagctggtgctccctcttcccggtttagaccttaattttccatagcaggctggctgctttaacattctgatgctgtaattacctttattgaaacattgctgtgtaaaaggtgattgaagcagctgtccctgttacgagttttgattttctggaattcttttccccagggggagtggccacagcaggtcctatctggtggtgagtggctgtcatgatctctacagcaccgctctacagcggcgtgcacaactggaccagttctgaccggattcgcatgtgtggcatcaacgaggagaggtgaggaggccaggaaggtggccgctgctggcctccagtgagcagtacctcgtcaccagagggatagctgcatacaatagggcctggggagggaccctggggaggagaagactcttagttgtttctaattttcctgtggtgggatggggatggggctgtgtgagtggcctgatctgccatgctatctcttttcagatgaaggtgaggaggccaaaaaaatgaccttttgccagctagcacttgtctactcattaacaactgtcagactgtggagtaaggggaagctcaggcaatggcaattttttttttgttttttgagacagagcctcgctttgtcatgcaggctggagggcagtggcacaatcttggcccactgcaacctccgcctcctgggctcaagtgattctcccacctcagccccaccagtagctgggaccacatgcaagcaacaccacgcccggctaatttttttttttttttgtagttttttagagacgggggtttcgccatgtggcccgggctggtcttgaacccctgagctcaagtgatctgcctgcctcagcctccccaaatgctgggattacaggtgtgagccactgcccatgcctggccagcgattgcagtttttatttgctgcatcaaagtttggtgctcaaggatatgtgtaaggtattttcagtctttgatctaggtctggaagaaagatggttttattgttcagatttctactgggaactggcagtgggcattctggtggtcagcgctttctcacctcatgaggctaattctgatttgaagtgagatccttatgaagtatcaaaggaagttgagaccgcctagcatagtcttgagagttggtgacacctgcctcacgtgtgtattttcagttatctgttccccagaatatttggttgaccaagatgtgccattgcctgatcatgccccatacccaaagcactcaaaatggccttcagaatttatatttggctttcataacccttggtcaaagagctgtgtgtgatggctgcagtgcctctctcattttctttttttttttttttgaggtggagtctcactctgtcgcccaggctggagtgcagtggcgcgatctcggctcactgcaagctctgcctcccgggttcacgccattctcctgcctcagcctcccgagtagctgggactacaggtgccgccaccaagcccggctaattttttgtatttttagtagagacggggtttcaccatgttagccaggatggtctcaatctcctgacctcgtgatccgcccgcctcggcctcccaaagtgctgggattacaggtgtgagccaccttgcccggccgtttttattttttatttattgatttatttattttgagacagagtctggggctacaggcgtatgccaccacacctggccaatttttgtatttttagtagagacggagttttactatgttggccaggctggtctcgaactcctgacctcatgatccactcacctcggcctcccaaagtgctgggattacaggtgtgagccactgcactcggccgcctctctcatttttagagaaggcactgctccttcatgcttgctggtgtttttttgttgtttcaatccattgactgtttaaattcaaatatacatcagataaatcaccaagacacagaacaatatggctttccctgggattcaagatctgacgtttcttgggtaaatcttagaaatgtgtgtgcgcatataggggagtattggtaatttgaagggaaaaggaatggaagtctttgtgtttatctactttgttcttctgttcctaactggagaagtatatacttgtctgaggtcaaggttagcagaatagacctttttattttcttaagccattagtgcctgatagcttaatgttctctgtactgaggaacaagttagagatgggcttaaaaggaatttaattttaggataaaaagagtcaagaccatggaaaatgagatgaaattcttaggtgctcaggaagaaaagtgttttcctttacatatgaagcatgtcctcagatgatcactaagagatgatctagggaaaggcagggtgatgataatgatttgcgtaagtattcattggcaggtcatgttgacctagttataagtagttgagactttgatgcagaaatctggactagagccttcaaaagaccagcggggccgggtgctgtggcttatgcctgtaatcccagcactttgggaggccgaggcgggtggatcacctgaggtcaggagttcaagaccagcctggccaacatggcgaaaccccgtctctactaaaaatacaaaaaaattagccaggcatggtggtgtatgcctgtaatcccagctactggggagactgaggcaagacaatcagttgaacccgagaggtggaggttgcagtgagccgagattgcaccactgcactccaaccggggtgacagagcaggactccgtctcaaaaacaataaaattaaataataataataaaagaggccaatagacaagttaccttagttcaccatctactgtaaatccctgccaagaaaggagcaggaagtaggctcaaaatctgattttccctccatcttgttttttgtttttgagatggagtcttgctctgttgctcaggctggagtgtagtggcacgatctcggctcactgcaacctccgctgcctgggttcaagtgattctcgtgcatcagcctcctgagtaactaggattacaggtgtgcaccaccatgcctggctaatttttgtatttttagtagagacagggtttcaccatgtcacccaggctggtctcaaactcctgatctcagtctgtctgccttggcctccaaaagtgctgggattacaggtgtgagccactgcacccagccagattttccttccttctaaacctgtgcctagtgcttaagaggacattttttttttttttttgagacagagtttagctcttgttgcccaggctggagtgcaatggtgagatctgagctcaccgcaacctccgcctcccgggttcaaacgattctcctgcctcagcctcccgagtagctgggattacaggcatgcgccaccacacccggctaattttgtatttttagtagagacgggttttctccatgttggtcatgctggtctcgaactcccgacctctggtgatccacctgcctcagcctcccaaagtgttgagattacagatgtgagccaccacgcccggcctaagatgaccttttaagtgttgtcacttttgatctcatccaccctttattgtcaccttcttgctacagtctaggccgctacagcctagaccatgctatcactggtttccaaaatgtaatctcaccttatttaaaaatcattttccttggccctttacaacttgtagaatttaggaatttggggtacaaagctgtgcctggggttcaactcttaaagtgatgttttagaggcctgccagctttggcagctgcaattgaggactgtagaacaggaggcatgggcttgcggctggccccaggtggccgtctctaggcaaacctacagctaaatgtgtctgcttgcctgcttgcatcccttctaggattaattcatgccttcattcaacaaacatttattcaacataatgagagcaaaccagtagttctagtacattggtggtgagtgccctagaattgcatgtccgggtccagtgggagtccaaatgcaagattgacaaacctcctggtgggagaataaggaaaggcttcccagaggcagtggcatttgagcccaggcttgaggaatgagtaggagtttgaggtgagagctggtatttccctgagacaataagagcacagtgtggctgggcacggtgactcacgcctataatcccagcactttgggaggccgaggcaggtggatcacctgaggtcgggagttcgagaccagcctgaccaacacggagaaaccccgtctctactaaaaacacaaaacttagctgggcgtggtggcgcatgcctgtaatcccagctactcgggaggctcaggcgtgagcccgggaggcagaggttgcagtgagctgagatcgcaccattgcactcctccagcctgggcaacaagagagaaactctgtctaaaagaaagaaaaaaaaaaaaaaaaagcacagtgtgtttggggaaggtccaagttggaatgaaggcaatcttggggtactgtgggactcgaaccagggaaagtctcccaggactggaaggtaaggagcctggtgtgtgctgggtggtatatttctcttacgggtagtctgggcccagcaggaactgaagagggtccggtttgacagtggtgctagcccttaataattagggaaatggcccagaggggtcatggccatttctggtttaagttccacaaagccttgaacataacagctctgcctcctctgtggtgggaagaaacagcaggattgattttcagtcctgactgaagcctgctatgacctctgttccctcctgccgcccgcctccgccagctgcaccctcataaccttgcctggttgacccagctcttcccgggccccctcccctgcaagttactcctgtcccaggctcttctctcaatggagcaagttaatgtttgcttagctctgcccacccctcttctcagaggatttgaaacacggctgcatgacattttgcagcgccttcggggctggactcaggtgtgggtatggctggagtggccaggactgctgttgcttggcctggttctgtggttctctggcagctgccttcgacggcagggattctgctttcgaggtgtcatttcaggcagggtgggagcttgcaaggggagaatgaggatgcagcccactcccttttgtatggccaggaggggaaagaatgtaaataaatagcaccttcccatgtggggttgcttgggggaagtgctgcttgtttccccttgagtactccccctaaaaccgtccctggcaagtctagtgggaacacgcttccccctggcccaaggctgggcataggtctcgcttttgtggtctcttaggagttgatgtgaaagtatgttttccctttccttcaggccctccctccctccccttccccgagaccaccctgactgcatctaaagcccttgcctctccttacagtcatttctgtttgtcaccaacagtcacttccagcagtggagccctcccacttctgccagtccaactgccttttaaagggaacaagcctttccccctcggttagccccttctggatccctgaaaagatggggagaggcccgtggtgatcccccttgccttttttgcttctcttgccccaggtacaattttggagtccctgtttcagtgggagggaggaagttagcagggccctcccccttcttgttggggttggctccagcaacctgactgccctttggctagggtgactggggaggcgagagctggcttcttcagggctgtcttcaggagcttggggtgagcctctaaagaagggaggcaaaaattagccaggcgtggtggagcatgcctataattctggctatgctggaggctgaggcaggagaattgcctgattccaggaggcggaggttgcagtgagccgagatcgagatcgtgccactgcactccagcctgggtgacagagcgagattcaatctaaaaaaaaaaaaaaaaaaaaaaaaaaaaaaaaagagggaaaaaaggaaagaaagaagggaggtcacctcaggcacagtgtatttccccaggggcacacagagcagtcctgtgccttgcccacccaggaaacgcactgcagcgtctatgttggggttttattctttaatctaaacctcctccttggccactcccacccacagctcccaagggcagggggcaatagttttttttggttgttgttgttgttgttttgagacagggtctcactctgtcgcccaggttgaagtgcagtggtgggatctcggctcactgcaacctccgcctcccagactcaagcgattctcctgcctcagcctcccaagtagctgggattacaggtgcctgccatcacgcctggctaatttttgtattttttagtagatatggagttttaccatgatggccaggctgatattgaactcctgacctcagtgatgcacccacctcagctggcctcccaaagtgctgggattacaggtgtgagccaccatgcctggcctaatagttcttgctgtacttaaaataccaggggagggaggcagtctgatgccaccctctccctttttttttttgtcaggatgtacaattttctatgatgcttacctgaaatttggagaagactttaaacagggggagatgcatttgagttttcctcctttgggacccagctctctggccttgagcccttttctctgggacatatgaacctgaatttggggtctgaggcttttcggacaggagagaacaaagtggtgctgggagactgatgggggggcagggaggggtgctggcaggagataggatgtaggcaaggatagaaggagggtagaagggagggtgttgcctagaactctagaaaaaagggggcagtgtctcctggagggaaaaaagtagtattcttaaaatgcctctcagcacccagtgacctggtggcctccaagtggtatcatcaccagtgctaataaacatgtctctgctctaggcaagacaggaggtgaataggtgacgattcagatttagacctgaaaacacaacaggggtttatttgttttagaagaggattacccatatgacactttcagccagctgcccttagagacttaaaataagattgtatttaaaagaaaaatgggttttgcatgccttttgaggcattcagtggttctcatgtctcccctttgagcaatgccctgtacatcctggatggtcattttggcaggtaagctccagggaaaaggtaaaagtgctagggtgtccacactcctggcaagagccctagaaaacagggtaaacagtccaaagaggggggtctagtcagactgggctctggtagggacttgcaaagctaggtgtggcgcctccgctttgtaaccaagaacccccagttccttgtaatccccctcacaagttactacaggaagtgaggtaggaaggttttatggggacccaggcaggcaggaggcattctggggaaggtggtgttggctcaaatcctgggcctcatgtcccttctctggttgtatcttccatgctagaagagcacctctttctgatgaggagtcaacgacaggcgactgccagcactttggatctcaggagttttgtgtcagcagcagtttttccaaggtaagaggctttatggagccacgtgctgtccaccaaaggatggagctgagctgcctgggaggtgtgcccagcctgccatcccaggaagtgggcaggaagggacagggtctctcccaggagttggtattggtgggacacaaattggctggctgccctctgcgtcttccgagacctggttggtcgagttgcagagaagaccagcagttgcctctcgggcctcaggacacttgcaccatctgcagggagctggctgagatgtgcatgctatcctgtcgttgcaggtggagctcacggcagttggaagtggcagcaatgcccggggggcagacccagatggcagtgctacagaaaaacttgggcacaagtcagaagacaagcctgacgatccccagccaaaaatggactacgctgggaacgtggcagaggctgagggcttcttggtgcccctgagcagcccaggagacgggctcaagcttcccgcatctgacagcgccgaggccagcaacagcagggccgactgctcctggactccactcaacacccaaatgagcaaacaggttgactgctcacccgccggagtaaaggctttggactctcggcaaggtgttggagagaagaatactttcattttggcaactctgggaactggagtccctgtggaggggaccctgcccctggttaccactaacttcagtcctctgccagcccctatctgtccccctgctcccggttcggcctctgtgccccactctgttccagatgcattccaggttcccctctccgtccctgccccagtcccccattcagggcttgttccagtccaagttgccacttcggttccagctccttcccctcccttagcacctgtcccggctctggctccagcgccaccgtcagtgcccacgctcatctctgactcgaaccccctttctgtttcggcctcagtcttggtgcctgtgccagcttctgctcccccttcaggcccggttcccttgtcggctccagctcctgccccgctttcagtcccagtttcagctcctcccttggctctcatccaggctcctgtgcccccttcagctccgaccttggttctcgctcccgtccccactccggttctggctcccatgccagcatccacgcctccagcggcccctgcccctccgtctgtgcccatgcccactccaaccccatcttccggcccaccttctacccccaccctcatccccgcctttgctcctacaccggtgcctgcacccaccccagcccccatctttactccagcccctacacccatgcctgctgccacgccagctgccattcccacctctgcacccatcccggcctccttcagtttgagtagagtgtgctttcctgcagctcaggcaccagctatgcaaaaagtccccctgtcctttcagccagggacagtgctgaccccgagccagccgctggtatatatcccgcctccaagctgtgggcagccactcagtgtggccacactgccaaccactctaggggtttcctccactcttacgctccctgtcctgccgtcctacctgcaggacaggtgtctcccaggcgtgctagcctcccccgagctccgttcttacccgtatgcattttctgtggcccggcctctgacttcggattccaagctggtatctctggaggtgaacaggctcccctgcacttccccatccggtagcaccaccacccagcctgcacccgatggggtccctgggcctttggcagatacctcccttgttactgcttctgccaaggtgcttccaactccacagcctctgctgccagcccccagtgggagctcagccccaccgcaccccgccaagatgcccagtggcaccgagcagcaaacagaagggacttccgttaccttctctcctcttaagtcaccgccacagctggaacgagagatggcctctccacctgagtgcagcgagatgccccttgatctgtcctccaagtccaaccgccagaagcttccattgccgaaccagcgcaagacaccccccatgcctgtgttgacccccgtgcacaccagcagcaaggccctcctctccacagtcctgtctaggtctcagcgcacaacccaggctgccggtggcaatgtcacctcctgcctgggctccacttcctcgccctttgtcatctttcccgagatcgtgaggaatggggacccgagcacctgggtgaagaactcaactgcactgatcagcaccattcctggcacctacgtgggagtggccaacccagtgcctgcatccctgctgctgaacaaagaccccaacctgggcctcaaccgtgacccccgccatctccccaagcaggagcccatctccatcattgatcaaggagagcctaagggcactggtgccacgtgtggcaaaaagggcagccaggctggtgctgagggacagccaagcacagtgaaacgatatactccagcccgcattgcccctgggctgccagggtgccaaaccaaggaactctctttgtggaaacccacggggccggcaaatatttatccccggtgttcagtcaatgggaaacctaccagcacccaggtcctgcctgttggctggtccccgtaccaccaggcgtctctgctttccattggcatttccagtgccgggcagctgacccccagtcagggggcgcccatcaggcccaccagcgttgtttcggagttttctggtgtgccatctctcagctccagcgaagccgtgcacggacttcctgaggggcaaccacggcctgggggctccttcgttccagagcaggaccctgttacaaagaacaaaacttgccggattgctgccaagccttatgaagaacaagtcaatcctgtcctcttgaccctcagccctcagactgggaccctggcactgtctgttcagcctagcggtggggacattcgaatgaatcaggggcctgaggaatcagagagccacctctgctctgacagcactcctaagatggaaggcccccagggggcttgtggcctgaagctggcaggagacacgaagcctaagaaccaagtgctggccacctacatgtcccatgagctggtcctggccaccccccagaacctgcctaagatgcctgagctgcctttgctacctcacgacagccaccccaaggaacttatattggacgtggttccgagcagcaggaggggctccagcacagagcgcccacagcttggaagccaggtggatctggggcgagtgaaaatggagaaggtggatggtgatgtggtcttcaatttagccacctgcttccgggctgatggcctcccagtggctccccagaggggccaagctgaagttcgggctaaggccgggcaggctcgagtgaaacaggaaagcgtaggggtctttgcttgcaagaacaagtggcagccagatgatgtgacggaatctctgccgcccaagaagatgaagtgcggcaaagagaaggacagtgaagagcagcagctccagccacaagccaaggccgtggtccggagttcccacagacccaaggtgagtgctgagctaaggtccagggtggggccgagatgccgctggtctacttcgtgccatggatagcaacctcctgtgacccctaccctgtgacacagtgctgttgggcagctgtgtgaactgaacggattggaaggcttttgtaaaagtaataatgacctgctgtcccctccctaggtcacattttccatatacggtgtctcagcatggggagaggctggcttgtagtttgtaggatgtgggaaatgattctgtccctggggtagggaagccattgtcccagatgagatcggaaagcggaagaaggtattggtgagggaaatcaatgaataacaggctcttccttgaataaccattcttccttttcctttactgagagaacactggccttgagaacttagggatggggagagcaggggcctctgacggggttgttcctttcaccactggttggggggcctgcttaggatttgctgggagccttgtggggtcagagccaatttggcttctgtgctaatcagtttcctacccgctcgaatgcttgaggcagcagctttgggttttggcccactggggattggatgggcaaggcaggttgggtgtctgggtgttggtcttgacaggctatggatggtggcagagttctaggcaaaaaggtgggccaggagcacttgatgagaatcccctggtcccccagaagggaccagaggctactggtgatccaaggagaatcttgaaacatttgaggatagggtttattaaaaatctagaacaacttgaagttctgttagcaagctttcaagttggatgttcatgtacactaagggacaaaatttctggctagagcactgtgaatttggctgtggcacaagtttatggtcttttttggaccatagaccattttgaaaagctggtgagagctatggaccctgttcccagaaatgtgacctcagaattttgccaataattttagggggttcatggacctgacctctgccccatcgcccaaagctcacccagggactgcaggttaagaacccctgggataggtgtttgggtggattttaactcacaaacctcacaaccaccctggtatgtcagagacacgtgaagtaggaacgtgggtcatgacgcagtagagcatataacgtttggcaggtaattgccatctgcgctcggtggtaataagaataataattcatgtcgttagagttgtgtttttacatttgttatctaatcgttacagtaaccatatgaggtgaatgctacaccaatctacaggtgagaaaataaatgaaacagaggctcagagaggatacattacccagttacacagctactaacttgcagagctagaactcagactctggtctctggttccaaagtccatgttcttcttcagctataccatattatcttccactctctttttgtttttttttttttgagtcagggtcttgctctgtcacccgggctggagtgcagtggctcgatcacagctcattgcagccttcaccttctgggctcaagcagtctcccactttagcctcccaagtagctgggaccacaggtgtgtaccactacacctggctaattattttttgtagagacgaggtctcactatgttggctaagctggtctcggactcctgggctgaagcgatcctcctgcttcagcctcccaaagtgctgggattacaggcgtgagccacctcacctggccatcttctactctccgcccatggaactgtttcactgaatgttttgcaagtttttgttgcatggctactgtatgccagtccttcccaggcaatgggaatacctcttcaggagggtggtatcatagattgatgaggagtatgctccctggagccagacacggagcctgggtttgaattttggccccacctcttcctagctgtgtgctattagtcaagctacttaatctctatggccttcagtttcttaatctatacacaagacaataatagtatctactcatagagttgtgaagattaaatgagatgatgatataaaatgtccacaataggcaaatccatggagacagaaagtagactagtggttgcctagggttggggaggatggaagagttggggagtgactgtttaatgggtattgggtttccattcagggtgatgaaaaagttctggagctagataagtagggatggttacatagctctatgactatactaaaaacaattgaattttacacttaagtgaattgcatggtatgtcttaataaattgtatctcagtaaagctgtcattttaaaaaagattaaagaacgtgatatacataagtgtgtacagtagtatctggcacatagtaggtgttcagttagtgttagtggttgctgttattgttagcattacaaacaaaatagatgtggccccgcctctcatgaagcttatgtctctcagatgactcagtgacaggtgggcactgccctatcctatattagatgaacagttcagtgggcccactatcaaatgcagagggcagaaattaaaatgacaagatcaggggcctggaagcagctctttgcaactgcctgtaaggatttagtaaatgtctattttttgggagtgcaaatcacttcgttccttctttttttttacatgccaccttcctgagaaggaaactgttgatcagcaaactaagatcaggggtttgtttgaaatagcccctttcagggcttggccaagagtgaaaatagtctcctgttgccaataccacctgcccaaggcctctcaggatcctaaagggccttctgcatcaccagcaaagagagagagttctgcttcatttggtgctggatgtattttattgtcctctcattccttggaaagctctttggaaaatatttcaaaactgttaaccagaatgttcatctctcacggtctccccatcctcccaacttcatgcataagttggagtgtgcgaaatatttttattcctgacctcaggtgatccgctggccttggcttcccgaggtgctgggattacaggcttgagccaccgcgccctgctagatgttctgttttacttgtttttgtcttcggaagtaaaagttaatgatctgcatttgaaagagccagctaagaatgatattcagaaataaataggacatgttcaaatgtatgtgcatttgactttattccccctgacttaaaatagtttttctccagccgtacctgaaggttagtttttaagcagtagttcctcatcttcctctttccaaccaatgctttcctcctcctaacactttggtttgtaggaactggcagcaagccaagggggaaactgaacttgaatttttagctcaggcctctgctgaaaataagaagcaggaagagttcatgggataggaggagtcctggaatttgatgggtagtggtgactccctgtccctggagaattaggaggccccagcccccgaaaatgttccatcagtaaggtatgtgccatccccttagctggaggtacaccacgataaccttctagcaggcgaggcatgggtcagcttaggggaaaaacagctcaagcaagtttaacccttcctttcctcctcggacctgcttttattgttccaacgttttgcttattctgcactccctgcatactagaatactggaaatccctacattgccctatttcttgtttagtggcacagagagacctcaaagctcgtgagaatacgtgactgttaggctgagagtgtccttgcagtgtgtgagcacagccattgtgcctcttagatgtgccaggcagtgggcgtgggagaagctgagctgaagcagccgaggaagtgattcagggaagataggtagcgagagctgatgcccagaggcccgggctgggggccagacccccgggtcctagtcccaattctgggtctttctcactgcaagcacaaatgtgctaacttgcgggttggcctggtaagtggcagtccctgagccagtggacacatgggattgtgtgttaccctggacaagtcattcaaccctttgtcttggagcctccgttttcttatctgttcagtggggataatattagcttctcctcccagggttgtggggaggataaaatccaataatagagatgagagcatttggaaaggctgaaagtgctacagagtataaagtggcattatgaataatgcttgggccttttcactgggttttataaatatgaggatatttgaattgctcctgtgtcatgtttttcttcttgccttagttgaatctattttctggtattaatttacacgtgaaaagagacaatttttcttgagttggcctgtactgagaattattttcagttgttggtgcaataccattcacagtgaagttatttgaacaatgtagtctcccaacttgcagaagaggcattttgtttaatgccggtctctccattggtgtttgggtacagagagtatggggcctgactttgcaccttttaaaatgactttgggtgtttattcactggcttttgaacgcagactctgtagacctctttaaagtgatgggatgtggacgcctatggggattagctggggccctggactcagtccaaaagagcccctgtcacccactctggaaggcagtgcacggccccttgcccctggtcccccactctgggcagctcatgcctctaggtcagaaacgggacacatggctcaacccctggagagctttcttaagaagcaaaactgacctcagacctgaccctctacctctccacagtgccggaagctgcccagtgacccccaggaatccaccaagaaaagccccaggggggcttcagattcaggaaaagagcacaatggagtcaggggaaagcacaagcaccggaagccgacaaagccggagtcccagtctccaggaaaacgagccgacagccacgaggaaggtaggccccgcggccctggccctctgggctgggctgcagagggatccccagggcacagtggtgagggcagaggggctcaggcgctgactccttcactctggaaaagtgagacttcttcactgtggaaagaagatatgattgacccctctgaagtctaaggtgagcgagcaaggatcgggggccccttctgctcctcctgggtgctagaataaggctgaaggaagtggttttccgacacaaacaccaggcccacaacacagtagccgacccatttccccgcgatgggtctaggctcaaagaaacaagtttaaggagaatttagacaaaaaccacggaatgggggttcattacgctgtcttctttgggtatactggaaaactgctattctgaaaggacaaaaataaatagctagttagctaggagagtttagagaaatcttaaacgtttattatcatttagggacacacaggatatctgggatgacggggctggtatgtgtccctaacctgtccgttttgccactaatagtttctgggcacccttatcagggagagaatccccagcattcctgagcataggagtccaggttcatggtcttgcccacctgacgtgactatgacctgcctcttctggtctgttctttttttttttgagacagagtctcactttgcttcccaggctagagggagttcagtggcacaatatcggttcactgcagcctcaacctcctgagctcaagtgatcctcctacctcagcctcccgagtagctgggaccacaggcatgtgccattacacctggctaatgtttgtagttttgaagagatggggtttcaccatgtttcccaggctggtcttgaactcctgggctcaagccatctccctgcctcagcctcccaaagtgttgggattacaggcgtcagccactgcgtccggcctcatctgttcttagccgttttttctctgttcactggctccttgttcctatcttcccacctcactcaatcctccaagattcactgaggttgccctcctctgggacctgctccagctcagttagaactttgtttattttctttctttctttctttttttttttttttttttttttttttttgagatggagtctcactctgtcacccaggctggagtgcagtggcacaatcttggctcactgcaaactctgcatcccaggttcaagtgattctccttcctcagcctcccaagtatctgggactacaggtgagtgccaccacgcccggcgaatttttgtatttttagtagagtcggggtttcaccatgttggccatgctgggctcgatctcctgacctcaggtgatccacccacctcggcctcccaaagtgctgggattacaggcgtgagccaccatgcccagcagaactttgttgaggtgcagcagcctcagagtcctatgggcagtggggcctcctactttcctactttctggcacaccatcacattgatactgtgcactgccttttctggtatcagcaaaagcgaccaaactctcagtttttaaaaaccacctggaaacactcattgtctacaagagacacatatgtgatggccacgtaaggggagtgaataaatgtaacccagattaaccacagggtaaacacaaactctttctcaatctttcccccgagcctcacaggtgggctttctggtctttaagctttgattgtaacatttctgccttctgtccccaaaccacacatcactccaggttccttggaaaagaaagcaaagagcagtttccgtgactttattcctgtggttctgagcacccgcacgcgcagtcagtctggtgagtgagactaaggtgatggcccctctcagcatcttctatgaaaagagagatcgaaatctggttgagcagttttaccatgggcccaggtgtcgagttgggaatttgattcactgtgccacaatgcccagctccttgcagagataagagagccctgggtgggggcaggggacaaatagtcctcaaatattgcccactgtttgaggattatttgttcaacttttcagagcagggatttgacatctcttgttgggagctgatggtggaaagaggtaaggcctgtgccactcgggaaagctggttcaactccaagctttggcacctcgtcattactggggctaatctcaggcacagacatttaactttctaccttggtcttattgccctatgtgacaggcagcctcaaagttggaaaagtcattgaatcgtcagggctggcagaatcacatttggctccctgaatttgtgttggtcaacctctagggactaaaaaaagctagccctttctagccaccactaccttctgctagcctccacactggtatccagggctggagatagttgtcccagttcacccaatttccatgcaaattggatagaatggggaagcaaggtatagtgtaaactcagttatctgacattctagtaaccggcaccttagcacatggcaagcgaggtggtaattggggctcataatgatggcctggaggccttacaaaatcctgaagtgtcctctgaattatcaaagagcaattacattacagccagtcccattttagtgttaaacacattgtactgtatttgattctttggaaattggtgatccctttgtgatctctatgatgattctgtattaaccagaatattagattaaccagaacactttgttttgcctagtctatataatggaaaatgtgctgttatttgctgtcttttagcagtgtgactaacttgaagctttggtcaagggctacttactctatttgcctcgaaccatttctttcttctgctgacttcgcttgggtctggggactgttgagttaatagctgggccttgggagaaagatggtggtgtctcacagctgcttccgaggaggaaggtgtcaaatctcctgtagtgtgaaaccaggccaatttaggatgtactttcgttgttagcagagttgaaggaaagagtggagagagaaaatggcctcttggcaaggtggctgaggaaggcaggaaaggtaccaatccatcctggggtggtgggggaggagggggaagcgcttgcccagcggtgaggaacagctacaaccgggtggagggaggtgcctgggaggaagctccacccctgaactcttggcaagtcgggaggaggtggggtcaatttaagggaagtgggcgtgcctgggtgcatttgggcgtgacccaaccaggctctgtcacagatcacaggaaagggactccttcttgcttcgcttttcttgagactcttctcttgtgatgattctgcttggccggggtggctctgtccccaagattggtggtgccacaaaaggagtatatcctcccttgccctgtctgagaccccaattgccctctcctagcccctgatttcccagggacccgtggccctctcctgcccttcacaaaatacttggcactttataagagctaagcaagagttttgggtgtggattcaggtgacactgtaacgtggatgagtaagggtgtgtgtttttaatacttgatgttgtctggtatattggactctgtaaagcacatatgcgtgaaaaatcttatttgagcctcaaaacagccctgtgaggtcagtaaggggagaacagtatccccattttatagatgaggagactgcactgaaggaactttcccgaacggtacagctaataactggcagagcctgaacttgaacccagaccttcaaactcctagtccagggcattcacttcgacaccatgctttgtcctttgaagaagtacctgaccatcctctgtacatcccatccacaggaagcatctgtagctcctttgctggcatggcagacagtgacatgggaagccaggaagtcttccccacagaagaagaagaggaggtaacccccaccccagctaagcgtcgaaaggtgagaaagacccaacgggacacccagtatcgcagccaccatgcccaggacaagtctctgctgagccagggccgaaggcacctgtggcgagcccgagaaatgccctggaggacagaggctgcccggcaaatgtgggacaccaatgaggaggaggaggaagaagaggaggagggcctgctgaagaggaagaaacgaagacggcagaagagccgaaaatatcagactggggagtacctgacagagcaagaagacgagcagcggcggaaagggagagcaggtaaggctggccaggggctctgctgtcgccgcggcccgtttggcttctgggaaccctcgggcatctctacgccagccaaaggcttcgggacccagagaaacccggtgctatgatctccagctgccagagggggtcactcaactccagctccgagcctttggctttgggttgacattgaatgagttcggattggcctgcaggtgagcggaggacatgaaggcccaagccctccggtttcttatagaagtctgaacctgtgggcaaggccacggtgacatccttggcatgggacaactggataccagggagttctctggttggcttgagggagtcgagtcttttgggaggacgggttctctctcctagaatcttgggttcaagaagacagagggcatcggctgcctttcctgggatacttgcagcctctaagctaaaaagaagtacagtgggttcttcaaaccaacagaagaacttcaagtagaaacgggcacagcattgctttatccgttaaagccacagtgattattcagaggcggagtgaagctttgaggtgacccaaagtagcatcatttttgttggacctgagttgagaaggcaggcagcccaaagagaaaaccaggctttctctgaccacatcaaatgctgtgatataccattccggaggcacagactgtcacaagatgctaatatcagtatgttccactgagtactgttcaggcccattcctatagtggatttctaaatgagcaaaaagcacatctttgggttttataagaacacctctgtctctcactctcattctctgacctctaccctggaagcagcaattgattgcctcctatgatgtattcatcctgagctgccggtaaacatccgctgtctccttattagctaaaactgaataacctcatattgagtgggtagtagagtccaggtttgctataatgcaaagacggcttaacctcatttccggctctgtttaagtggaggtgtatatgatacccatctctacgctcaagagagtaattgagctaattttcatcaactatgtgacagagtgggaacaattctctttcttctgctagagcaataatagattggtcaggaatgagttgtcaagctgttggcctcagccacttgtgttaggatgaagaggagcttttgtgtatcacctaatcttctctaatggcacctggtttcctagcatggaagcttcctgtggaacatattggcgcttggaaccagaaggaccttcgaggttgcctggtccagtttgccacccaatgcaaagatagagatctccacagcattcttgacaggtagccagccagccttttcatgaacacacctccagtaacgcagagaacaccaccaatcaaggcatcctacttgatttgggggcagctccagttgttggaaagtaggtcattcttcctctgtggatgtgtctaagggttttgcattgaggcagctggatttggcacatggtctggttactttcctccagatctgatgatggcatcttcgtgcaggaatttggcaaaggccaaatgaggcaggttaccctgcttctgtctgagcctcctgacttttcttttcatcctggttttggttatctcccttcttgacctgcggagcaggtaggcagagccacttccactcacacacctgccacctccgctctctagtcctttgtgggctactataaagccttcacttctctgcaattgaataaacacccgagcctgccctgccctgggtaaacaaggtggggggctgtttctttgcctgtagcattgaacactgtaatatgacttcttcatgtttcctggggtcctcacaaggcatggttctgttccttcctcttttgcctcagcccaaatgtgtcgcatcaaaagctggagtttagaacattctgactggaagtgctattagagaccatgtagtacagcaattcctggacaggctatggggccccactagcgggctgaggctagctgggagaaagggatggcatgacagctggccttccaggaactgtgcataagctgcagccaactccttgtgctgaaatgatggcttccacatctggatctgcctttgtcaatgtcacatgtgagagcccgtgtcagggttgagagaggcgagttgagaactcttcaatctcagtcccttcatttcactaattgctaggcatggtgttcattcctttggggaggaaaacacacgggcatggctccacctcaagagcttgtgcttaaataacacaataatgatgtcttacttgttataacactttttgaaaggggttttgcatgtattatcttatttaattctcataccactcttgtgatgtagattatattctccccattttacagatatggcaactgaggctcagagcaattaggacttgagcccagccaatcacacaattgatggccaagccaagcagcactaatcttgagagatgaggttaaacacacagtcgcccctacacacggggttaggacagaccctgtgggatgaagctcttgataatggagttcccggcaggcctttttgaaattagaatgtgctttgttcagcaagctgtggctaaattagagatgttgctggtgtgttctagtgacaccagtgacttgattttcacccagaaaaggcagcaggtttctgcccttgactgccagctaggtaggctcatgatgccttctagtttcagggagttcctgtagctttgatctttgtgtcctcggagagtgacaaatggggcagtcaggtgagtagagctgaggccatgaaggcagccttctaccttttcctccctgttccccatgtacttgatacttaatgtcagcaggaccaccagatttgctttcatacgggactggagaaacagacaaagggaatgggaaaaaagcaaaaagaaattctgatttgctctgggctctgggaaaaatcctgttaaaattacccttatcttagggctagccagatgggccgccccctgctggcagggctgggagctgtctcctgcttgtagatgagggacttcgatgttgaagtatggtgtgttcattcaagaagtatttagtggaatagtcagcacagcactagatatcgatagctgatagttatacaactttgcactgcagttctaatccccaaagtcctctgattcatcttagaggaaggcgttgcttttctgtgttccatttctctgacatccgttcttttcctgtttcttgccttcagatttaaaggcccgtaagcagaagacttcctcctcccaaagtttggagcaccgcctcaggaacaggaaccttctcttgcccaacaaagtccaggggatctcggattcaccaaacggtttcctcccaaataacctggaagagccagcctgccttgaaaattcagaaaagccatcaggaaaacgaaagtgcaagaccaagcacatggcaaccgtctcagaagaggcaaaggtgtgtagctatcaaggggtattgtagaaggtgtgtgtggcggggggtcagaggaggcaggaggggggtgggggatggggaggatcaaattaacccatatttagtaaggcattctcaaactagttctcgaagggttgggggtggatttgaagaatgggaactaaagttatagttaattttaaggtctggcccatgatggcttttcctctacaatctttagattttctttgagttaaggaagagttaaagaatatggcaggatgttagcttgagtagctcgttaacatccaatcaagaagcttttgtctgggtttaacttactggaaaccaatcttggaactttctgagtcaatcaaggtagaaaacaacttgtaggaggaaggattttaaggtccagacaaaggttgattgagggtgaggctgaaggaattccactggggcccaggttctagctactcctcccctaccctgcttcccagttctttagcttctcatggaagcgtagatgctagtgagtgggcagtcaccaatcaacagccaggcaagcattcctaaaaccctcatcccaaatcaacatctcttttgggtctgatgttcatgccattggtgttaggttgcatgttgtatccttagaaaaaatcagtcttcaacctgggttaactttacatttgagagaagtgagggtccgggttcaaatgtatacctataatatgtatttgtcattgacagccaaaaacaaaagcccatcttcagcttgttttggtggtcgtgattcttatttttttttttctctctctctctctctctttttgagagtcacacgctttcgcccaggctggagtgcagtggcacgatctcggctcactgtaacctccgcctcctgggttcaagcgattctcgtgcctcagccttgtgagtaactgggattacaggcgcccaccaccacgcccggctaatttttgtatttttagtacaaaaatacaaaaaatcaccatgttggccgggctgatctcgaactcctgagctcaagtgatccgcccgccttggcctcccaaagtgctggaattacaggcggaagccatcacgcctagcgctttggtggtcatgattcttactggaatccccgaatggcactggcaagaggtgggagccccaagtgctcgtctcccctcctttccccttccccctcccagaacctctttccagctcagacaagactcaagcttatttcttcatcttgaagaatggagctgctgcttcatgccctttctgtctcacaagggtgcttgggggaacaaaggaagcaatgtctgtgacaggctttgataaccataaagtgctctccgagggttgctgtgcatcattgtgcttcgggcggaagcaagaatgagggaacagaggcatagcgtggcagggtagcagcgttcgttcccttgaccccctagagtgggaggacaggggcccagggaaagagcagggaactctggtctgtgccaagcagttcattcacgttatcgctcttaattcccgcagtggcacttgggaggtaggcacctttattatcctcattttgtagtgaggaaactgaggctcaaggaggttaagggacttgtgcgaggttattgggtggtcctgagtgatgcagttgggacgtgaaaaaggcctgtctgcctctggagccatggctcgttccatatgtctctcaggctctgaatggggggcttctgtttgtatttgggaggcactgggggaagggggcagttgggcagaaaatgctgcctccacaagcagcgctgggaaaaggtgggcgtctcaggctcctgctccccctccccttccccctgttcctcccccagacactcagatggatggccccagcccacacaaaggtaaccagcgctcgagattcagcagcacactcacatgcttctgtctggctattctgcctggcagtgggtccgctgcagtgttctcctggagaggtttttgtccctccctctgaccttcctttccccctcccaccttcctttctctcccagtcaccaccacctgctctggttgcccccatggcatggggctttgtagcaggaagcaaggggtgggggagggcggggaacgctcctgcaacactgaaagcggggcactggccaagggcttcttcccacaggggctcagagccagggggaaggagagagggggaggggtccccccacttgttcttgctcctccccctcccaggcaacttgcctcgctgctgctctctggcagctttggcccccagaaaggagagtcaccctttggttcctggcttggcttagtgaaaccctggtactttacccagcatcctccagtcctgccattgtacattctatcctcctggcgataaagcagcattgtaccctcatagctagtgccttcctgctagggcttgtacctctctgccctttcaggatggggactgatcatggcttctcgctgtcttgggattgaccagaggaaacaaatgccccgagccctcatcttctgttctctactgctcctttcctgacttgatgtctttttaggcaacttttctggccatccagggctctgcacacagctggcttgaaacaggtcaacaaatatttgttgtaataatgtggccaggcgcggtggctcacgcctataatcccagcactttgggaggctgaaacaggtggatcacatgagatcaggagtttgagaccagcctgggcaacatggtgaaaccccgtctgtactaaaagtacaaaaattagctgggcgtggtggcacctgcctttagttccagctacttgggaggctgaggcaggagaattgcttgaacctgggaggcagaggttgcagtgagccaagatcgtgtcactgcactccagcctgggtgccagagcgagactctgtctcaaaaacaaacaaacaacaacaactaataataataatgtgcccagccctgagttaagtgctgtaaggaacagaaaaatgatgacaatatgaaccctgtccccaaggagcttaaaatctagcaggagaggtgagacttacgcgtgaaactctgggtggaaagaagaaagtgaggcatcagattacgtggttcagacttggtactctggctacacagaggaagagggcccagagtgttgtggaatatggtagaagacagaggattgaactgagaccttgatgttctgaggggtttggataagtcggaaatactagttatctattggggtataacaaattactatacaacttagcagctttacacaacaataagcatatgttatctcacacagtttcttggggtcaggaattcaggggcttagctaggcctggcttggggtctctcgtgaggttgcagtcaggtgtcagccagggcagcattcctctgagggtgtgactggaggatctgcttctggggtagcttgctcgcatggctggcacattgatgctggttgttggcaggaggcctcctctccctgccccatggatctctccagtgggctgctcaagggtcctcaggacacggcagctggctttccccacgagtgatccaaaagagagcaaggcagaaaccacagtgtcttttaggccctagcctcagaagacacctactgtcatttctgcagtctcctgttggttacataggtcagccctactcactgtaggaggaaggtgcataagagcatgaagatcaggggatcactggggccatcttagaggctgactcccacagtctgccctctggcctcccccagtgattcctgtccctcccacatgcaaagtatgccacctctcccagtgccccccaaagcttcatccaattatagcatcacctccaggtcgagaatctcttctatttatttatttatttatttatttatttatttatttatttatttgtaatggagtttcactcttgttgcccaagctggagtgcagtggctctatctgggctcactgcaacctctgcctcccaggttcaagtaattctcctgcctcagcctttcgaatagctgggattacaggtacctggcaccactcccggctaattttttgtacttttagtagagatggggtttcaccatattggccaggctaatctcgaactcctgacatctggtgatccacccgcttcagccttccaaagtgctgggattacaggtgtgagccaccatgcccggcaattttttttcttttcttctctctttttttttttttttgtaacagagtctcactccatcacccaggctggagcgcagtgccgcaatcttggcatactgcaacctccccctcccgggctcaagtgattctcatgcctcagcctcctgagtagctggaactataggcgtgtaccaccacgcccagctgattttttgtatttttagtagaggctgggtttcactgtgttggccaggctggtcttgaactcctgtcctcaactgatctgcctgccttagcctcccaaactgctgggattataggcgtgagccaccgctcccggcctctcctagtgttttgtgagcacctaccctgctcacagttctggagcctttgtagttcattatctcaaagaccctgcaaggaagaaagtggggctcagagagggagggccttgccccaggtcttctagctaggggatggcagaggcaaggttcaagcccaggtctgccttagatctttctaccaccccaggggagtctgagtatgatatggggacacagtgtgatggaagatgggaacattctgtgaggactggatgtggaaggaaggtttttgctacaagtgtgaagctttagcagctgtgactagtcaaagatagccggccgggcatggtggctcatgcctgtaatcccagcactttgggaggccgaggcaggcggatcacttgagatcaggagttcgagaccagactggccaatgtggcgaaacccctctctactaaaaatgcaaaaattagctgggcatggtggcgcatacctgtaatcccagctactcaggaggctgagggaggagaatcccttgaacctgggaggcagaggttgcagtgagcagagatcacaccactgcactccagcctcagtgacaaagtgagactcggtctcaaaaaaagaaaaaaaaaagatagctgtctcatttctctttactctcagagtttgcttctgcctatttacagataggacttataaaaacctcaataaatggtgattgaggcaggtaaagaaggcatgcagagtcttgagagaagctaggatatcccctcaatctctgatttacaatccctgtggcattccttggtttatggggttgagcatttgaacctcttcatatctccccaccggctacaaactcatgggaacctgtgttgatcctggagagacttcacatggttagcgcctggcccagcgtctggcctcaaacctgacagtagtctcggccatttagggtagtgtaagcaaagtacagcatggacacagataaggtgagatggccttggccactgagggcagtgatgaccctggtggatggataagctgcctggcctgacctgacctaggactgcatctctgctttccagggcaaaggtcgttggagccagcagaagacacgatctcccaaatctcccaccccagtgaaacccacagaaccatgtacaccctctaagtcccgaagtgccagctcagaggaggcctcagagtcacctacagcccggcagatccccccagaggcacgtcggctcatagtgaacaaaaatgctggtgagaccctcctgcagagggcggcgcgtcttggctataaggtaagggagttttcgactgaccacagggcgccgttggtctgagcatctatgaagaagcttttctccatgggctcttctggtgcttgaacccaggctggcctccctctacaccccagattgccctggggctgccttgcccctcatcacttggatgtcagcgtgtgagaatgcaaacttgcttgaatgtcaatttgggatgaatgcaattgaaatggtatcatgcagtatattcctagaccaggaacgcaatttttggatatccacgttgtcttaaatttctctgtatggtggtttcccaactcagaaaggaacaaggggtgatttattgctcactcttcatctcctcctccagcttcccctcattttcgcctctcgcagaggggccaggatcatgtttgaggggcgaggctgagctaaccccaccttatactactaccctatagattagaaagaaggcaagaaaggaagctggcatttattgagcacttcttttgtcatgtgaagagcctgattactttgtatcatttaatctcacagtaagccgatggagtagatttattatccccattttataggtgagaaaatcgaggctttgcagtgttactgatatgtctaagatcactcaactactacgcatatgagtctgaattcaaaccaaggtcttttgattcccaagtgccagggtaggtggaagactgactcattcaccataattcagttacaccttggacgtttccattgttccccactttttattgagtgtgtatctttgcctaccatatggattatttcctcagggtatgctcctagcagtggagttgctgggttagttacagagtgtgcctttggttttaaggctttccatccctatacctgagttgtttcacaccagccacactcccagccagactggtcagctctggggagctgacgtgacagtgtctcactggcaagcagcccatctttcatgagcacctagtgtgcgtgcctggatagctgccgagggagacctaaaacaaaaatcaagaccaatccctgccgtcaaggttaatttaattgtcttgtaccctgggcaaaaccagccaacaggaaaccattggaggggccaatgggacagggctggagcactaaggcagcctgtcagggagggtggaaggagcccttttgggcctgggggaagaggcagacatctgcactggtgaggagggtgggaagcctcgggctttctcccgggtaaaggagcttgacagtttctatatacagccagcagcacccctgacacaggctgcacacacagccgctctagccagctagcctgtgagctgtcagacagaaaggtggagtggcccatctccccagtgccccagagaggactggcaatggtgcagctatgggatccattgtttggaaagccaggcagccattaatgctgccagcctctcccctcctcacctcattcacccagcttcagcccatgctagctagggtgcttcaagtccctggtgtcccacctgtagtcctagcatcatctcaatccaaggaaggcagtcattaaagtgtggatgaatggcagtattggattatcctttttttttttttttggagatggagtcttgctctgtcacctaggctggagtgcaacggtgcaatctcggctcactgcagcctccacctcctgggttcaagggattctcctgcctcagcctcctgagtggctgggattacaggcacctgccatcacactgggctaatttttgtatttttagtagagagggggttttgccatgttggctaggctggtctcaaactcctgacctcaggtgatctgcccgcctcagcctcccaaagtgctgggattacaggcgtgagccactgcacccagcctattggattatcctgatttgaggggagggctagaactgactgtcctggcttgaacattggtcctgccgagacgtgcatccagggatagtccttaaaacaattgtcttccttattcttgaattgccaccagaggctgtgctctccaccacatctcatttctctggtctggggctggcttgccaagctcagggagtcgaggtctgagtgcttgagctctgggcgggcaggtcagcctctctgaggacctcacctcaaataccaccacccagatgagtgtccttggccataaaaaaagtctctccaggccaggtgcggtggctcacgcctgtaaccctaacactttgggaagccaaggtgggcagatcacctgagttcaggagctggagaccagcctggccaacatagtgaaatctcatctctattaaaaatacgaaaattagccaggcgtggtggcgtgcgcctgtagctccagctacttgggaggctaaggcaggagaatcgcttgaacctgggaggcagaggctgcagtgagctgagattgcgccactgcactccagcctgggcaacagagtgagactgtctcaaaaaaaaaagtctctccactgccaaggaaacggcccagagctggggtcctggcaattgtggctcaggactgatgttgttaatgaaagattttgaagtgtgtccctgctataaagggcaggctctgagactcctcagatatttggggagctttgagtctcagggttatataagttcaagaattagacctctctttgctcatggagttgtccctgtccccacaggatgttgttctctactgcctccagaaagacagtgaagatgtgaatcaccgtgacaatgctggctacacagccctgcatgaggcttgttcccggggctggaccgacatcctgaacatcctgctggagcacggggccaacgtgaactgcagtgcgcaggacggcacgaggcaagagggctgcatctccccccagtcccgccctcactcccagctcagcctctcactcaaaagaccttgcctgccgctggcaggcatggtggctcacgcctgtaatcccagcactttgggaggccaaggcgggcggatcatgaggtcaggagttcgagaccagcctggccaacatagtgaaaccccatctttactaaaaatacaaaaattagccgggtgtggtggcatgtgcctgtagtcccagctactaaggaggctgaggcaggagaattgcttgaacccaggaggtggaggttgcagtgagccgcgaccatgccattgcactccagcctgggtgatggagactccgtctcaaaaaaacataaaaaataaaaaaataaagaccttacctcaacctgaaccttcgtagcacaccagactgcgagttgcagagaggccttgacaggaggagttttggaaagacttctataggctcaagagggaaccagtttagggcaggagccaatgagttagttcccagatggccaggccgcatcagttactaaggggaggctgtggttgtctagggatcatcccatcatgtgtagctgtcaccaggaagaccactcggtcttccctcaactcatcctggtgggggacgtgtctcagacagaatagaaactgagaggttgacctgagggtaatatccagatttgatttttaaaatttgatctctagacactgtaagaaaaatacacctgctgtgtcttagagaaattgtacccattctcctctgttctaccagagagcctacttcctgggcaaattagagacaggagctgcagatccaggagggggctccgcttgggttctgcctggcgtgtggagcccttctgctcatctctgctctcagggagtcacccagggccttcagttccctgaactgaagtatccctctacagttgcccccaccttttttttttttttgagatggagtctcactctgtcgcccaggctggtatgcagtggcacaatcttggctcgctgcaacctctgcctcccggtttcaagcaattctcctgcctcagccttctgagtagctgggactatgggtgcccgccatgacgcccagctaatttttggatttttagtagagatggggcttcaccatgttggccaggctggtctcaaactcttggcctcaagtgatccacctgcttcggcctcccaaagtgctgggattacaggcgtgagccaccgcgcccggcttccctgcagctgccttaactttattgtaggtcagggacccatcctctagtgaactccacaactaccaatagagctacattgtgccatgggaactgtcccaagatgtcaggggaacgtaagagagagagagtaatgggagggaggaaaagggggtacagagagaggaggagttggggagatggtagtggagagttgcaaggctacaggtggttcccttgtcctaagtcttaaaccatattacaccaaggttacctgggggtcagctcagttttttcccctgatgcagtagccttaagtgtagacaccccagttcccacttgggccctgttatcctcaccctgtatcacctccacaggccagttcatgatgcggtggtcaatgacaacctggagaccatctggctcctgctgtcctatggggccgatcccacactggctacctactcgggtcagacagccatgaagctggccagcagcgacaccatgaagcgctttctcagtggtaagcatggtccagacttgacactgttgtccttggggccagcctctgattcctgaacttgtgaggacatcctcttcatctccttccaccttgaacagctcccatgagggccatctgccctcttcacctgctttcattcaaagagctcaagaatctcagtttgcttgaaaaagtccaaaggccacttcctcttatccccttactgcaagtgtgtgcgtcctcttcagggccctgggagcccacagggacctatttcgtagctagggatctagggtgggcctctgtgtgggggcggcagccccactagtagacctagctgggggcagaatgtgttgacctgtgctttgaatgggatgtcagttgcaacaaagtgatacttagcattttgcttatgtgtttgcaatttcttcttgtttgtgatcaagtggatcacagtggaacccctgggatgcttcccgaagcttcattctttacagcccttgcctgtgggaactgtgatgttccctctgcatcccagggtcccccttccttccgttccttttcctccctcacctgccccttctgtaaagtgtctggtgttgaggcccatggcaagggccacaagccaacatgcatttattttctcattagtggatagcagctgtttgtctgcagttagatagctctactgagttgggcagggggaggagggaaggaggggagtctagcttgggcatgctcagtaggaatctcctcagacttgacctctgaataaaggaaccctgcctcttagtgacatcacagtttggcccttgctctagcagtgacttcttcagactgcctgagcggcggagcagctgggagttgtatctctgaaccttcttggaggctgcagtgtttgtattgtggttagaacccctctctggccaggagccaacaggactaaggattggcccaaagctgctccctcttctcacccagactttggccctagttagccccgaacctctatacctccagatatatggttccaggctcccaaccaggggctcatttgtttatccaacaaaggttaactaagtagctgatgatggaggaagaaacaaaggggacctaactaaaggctcttatggaaggggaggactaggtaggcggtgagtggggggtaataggaggctgtcgcgggagatcttgactcctgctcagccagcctccacccaggtctcagctgagctgactaaaccttggagcacaggccttaggcctgtacagcctgactagcatctcccaggctgggggcaggatggctgccttttctgttttccctccctccagctctgggttcccaagcccctgtccttgaggcgcagagcagccttggaatgttcattcagtcatttgtcctgggccagtggtgactgttgttccccttagctgaaccatccctaggggtgcagggcttggggcaagccaccgttggtagctgcctcccacgtactgtgtacacatgcactctctcttagacacatacacgtgttatctgcactccactggattcccaggaaaatctgagaccaacaagcatccagagcatcttgatatgacaaaggcaccacacgcagctctgtctttgagaaaccggtctagtcccgaggcctccttaggctagaaactgccatcccgagggtctcaggggctcctagatctaaataacactgtgaccaccttagtaaacagatgaactctttgcttccccaatcccttctccaaaacccctaaggagtaggaatgtggaaaccattttaagtagttaaaaaatgggaaataggccaggcgcagtggcttatgcctgtgatcccagcactttgggaggctcaggtaggagaattgcttccggccaggagtttgagaccagcctgggcaacatacggagaccttgtctctacaaaaaaatttaaaaattagccaggtatggtgactgcactccagcctgggcaacagagtgagacagtgtctcaaaaaaaaaaaaaaaaaaaaaagagacagagaggagagaaataaacacgtttctcttatctttctgtctcctcatcccaactactagctatcttttggttttgttttgtttttggcgcgatcttggctcactgcaacctctgcctcccgggttcaagcgattctcattcctcagcctcctgagtagctgggattacaggcattcgccactatgcccggctaatttttgaatttttagtagagacagggttttgccatgttggccaggctggtctcgaacttctgctagccagctttttgacacctcctgaaactaaattgaatgccagtctatgttgcagaattcagagaagacttttattttttttaggcggagtcttgctctgtcgccaaggctcgagtgcagtggcgtgatctcagctcactgcaacctccacctctcgggttcacaccattctcctgcctcagcctcccaaggagctgggactacaggcacccgccaccaagctcggctaatttttgtgtatttttaatagagacggggtttcaccatgttagccaggatggtctcgatctcctgacctcgtgatccgcccgcctcggcctcccaaagtgctggaattacaggcgtgagccaccgcgcccggccccagagaagacttttcttaactctagtacttcacatatttgtggtgtgtgtgtgtatgtacgtatatgtgtttatatatatttgagacagagtcttgctgtgttgcccaggctagagactccagcacttcctaacttgtcctggctgagcacctttatttagatttgttaaaaattactagagacagtgtcttgctctgtcaccgaggctggagtgcagtggtacaatcatagctcagtgcagtttcaaactcctgggctcaagcaatcctcctgcctcagcctcccaagtagctaggaccacgggtgtgtgccaccggtcccagctaattttgtattttatctttttgttgagatacggggtttgctatgttgcccaggctggtctggaactcctgggctcaagctatcttcccgccttggcctcccaaagtgctggaattacaagtgtgagccaccatgcccagtcttcatttagaccttttgctcaatttatgggcatgaatcaggcttaataatgggagtcaggagccaatgggttgctataaagtgcaccagctcttttccatgcaaaggcagcctgggaccttggcctaccaccacaggaaggcaggcactggcaggagtcagcaggctctcaagaagcagggggcccttaggcccaaaggctgtttgtagggtgtgtgagaggacagcactcagggacttttttaaaaattgaggtaaaatttacctaacataatcattttaaagtgaacaattcgggccaggcgtggtggctcacccctgtaatcccagcactttgggaggccaaggtgggtggatcacttgaggtcaggaactggagaccagcctgaccaacatggtgaaaccccctctctactaaaaatacaaaagttagctggaccgtggtggtgcatgcctgtaatcccagctactcgggaggctgaggcaggagaattgcttgaacccaggaggtggagtttgcagtgagctgagatcacaccactgcactccagcctgggcgacagagcgagactccgtctcaaaaaattaattaattaaaaaaaataaagtgaacaattcagtgggatttagtacattctctttttttttttttttttcctgagacaaatctcactgttacccaggctggaatgcagttgcatgatctcagctcactgcaacctctgcctcccaggttcaagtgattctcctgcctcagcttcccgagtagctatgactataggtgtgcaccactgtgcctggctaattttatatttttaatagaggtaggtttcaccatgttggccaggctggtctccaactcctgacctcaagtgatccgcctcccttggcctcccaaagtgctgggattacaggcatgagctaccgctcctggcccatttagtacattcctaatgttgtgcagccaacctcaggggctgtttggatgccttgaactgagtgtttggctctcatttttcatgcctgtgtgcctccctgccaaatctccaggaaccactgggtaggttggtagggtggctgcaggaagcacccgagtgtggagactggaggctggggaagcttttccctccactgctctgcctcctcagcccctacacctagatacatttacatggacttctgatttatttatttatttttgagacggagtctcgctctgtcgccaggctggagtgcaatggcgcaatcttggctcaccgcaacctccgcctcccaggttcaagtgattcttttgtctcagcctccccactagctgggactacaggcgcccgccaccatgcccagctaatttgttatatatatatatatatatatatatatatatatatatatttttttttttttttttttttgagacggaggctggaatgcagtggcaggatctcggctcactgcaagctctgcctccctggttcacgccattctcctgcctcagcctccggagtagctgggactacagtcgcccgccaccatgcccggctaattttttttgtatttttagtagagacagggtttcaccgtgttagccaggatggtctcgatctcctggcctcgtgatccgctcgcctcggcctcccaaagtgctgggattacaggcgtgagccaccacgcctggacatttgttgtatttttagtagagacggggttcaccatgttggccaggatggtcttgatctcttgactctcgtgatctacccgcctcagcctcccaaagtgctgggattacaggtgtgagccaccgcgcccagcctgattttaatttttttactttgctgtctggctgaggtatttaaaatgcttttggctttttgtccccaagcatttgcttgactagaccctctgttgattaattgtcttcatcttcccctagtggagtccagctgggcagaaaatgaaggagaatccctttagggtgcacagggctccatttttggcgggaggaaaaggtgagcattagcgtcagggttatgcctcatgtagcgcttccctggctgtgtgcaaaggcccctgttgtggaaagttgtcgggggaatcaaatccttttctcttttttctttaattttttttttttttaagatggagtctcgatcttgtcgcccaggctggagtgcaatggcacgatcttggctcactgcaacttctgcctcctgggttcaagcgattctcctgcctcagcctcccaagtagctgggattacaaacgcccaccaccatgcatggctaattttgttttttcagtagagatggggtttcacagtgttggtcaggctggtctctaactcctgacctcaggtgatccgcctgcctcggcctcccaaagtgctgggattacaggcgtgagccaccgcgcccagcagtaaatccttttctaagtacaaagaaatgtcactgttttccggtatcctgaagtgagtccttttgtaaagcagaagatagataattcatctgggttgtaaatgtagattttcttatattgggttgacttaaggtgaggcccatttctcctgagatcatgaaggatggagtggcactcctttattcattcgttcatccgtccatttagtgagcacctattagatttcaggtgctgtcctgggtacaggaggccagacggtgaaccctttctacctcatgcttgggcttggagcgccaagccatccaaactccctgagaggcctctggaaggcctcccccttcagccaaattacaggcaggtatgtgactgatttacctttgtccctttgaagaagagagcaatatccaagctggctgaaggaaaacagacttgtttttcctcgtctgttggaaagaatgtagggcttacccagagttgatgcagtttggttcgggacatcagaggaagtatcaggacactctgccttccacctatgaaagggttagtagtttaccgcttgaagtcactgaatcacaggttattgtttttcctgctagatacctctgccatatgaccccatgttgaagaccactagttttttgtttttctcatctttcaagtccctcagctggtgagtgagttagaggagatggggaggggtatgatcggaccctgaggagtagacaaactgctggggtagcctcttgaattgaggtgagaggctctattcttaccatgaggcctgagggtgctttttatttttatttatttatttacttatttatttatagacaaggtctcactttgttacctaggctgaagtgcagtggcgcagtctgggctcactgaagcctcgacctcccgggttcaagcaatcctcctgcctcagcctcccgagtagctgggattacaggcacacattaccacaccaaaataattattgcattttttgtagagactgggttttaccatgttacccaggctggtcttgaactcctgagctcaggtgatctgcctgccctggcctcccaaagcactaggattacaagtgtgagccattgcactgagcttctgcgggtgcttttttaaaaaagaatttatcgagatgaaattcatgcaacatgaaattaacaatttaaaaggaaataattaggctggtcacattggctcacacctataatcccagcactttgggaggctgaggcaggtggatcacttgagcccaggagttcaagaccatcatgggcaacagagtgattcctcatctttacaacaataacagtaacaaaaattagctgggtatgttggcacatacctttggtccccattacttaggaggctgaggcaagaggatcacttgagcccaggaggttgaggttcagtgggtcgtgttcatgccactgcactccagcctgggtgacagagcaagaccctgtctcaaaaaaataaaaacaaagcaaacaattcagtgacatttagtatattcactatcttgtgcaaccacctctatctagttccaaaacattttctttttttttttctttttgagacagagtctcactctgtgacccaggctggagtggtgcagtggcgtgatcttggctcactgacgcctccgcctccgcctcccaggtttaagtgattatcgtgcctcagcctcctgagtagctgggattacagacatgcaccaccatgctcagctaatttttttttttttgagacggagtctcgctctgtcacccaggctggactgcagtggcgcgatctgggctcactgcagcctccacctcctgggttcacaccattctcctgcctcagcttcccaagtagctgggactacaggtgcccaccaccacacccggctaattttttgtatttttagtagagatgaggtttcaccgtgttagccaggatggtcttgatctcctgacctcgtgatccgcccgcctcggcctcccaaagtgctgggattacaggtgtgagccaccgcgcccagcctcccaaacattttcatcaccccaaaataaaaccccacacccattaaacagctactccccattcccccttcctccctgccccccgcccaaccactaatctttctgtctctatggatttccctattctagacacttcatatcaatggaatcatacagcatggggccttttgtgtctggcttctttcatgtagaatactgttttcaaggtctagccgtgtgttagcaggtttcaattcttcattcctttttatggctgactaatattctcttatgtggatatatacgccattgatggacatttgggctgtgttccccttttggctgttctgaatggggctgctgtgagcacgcatgtacaaatacttgtttgagtatccattttcgttctttggggcatatacctaggagtggaattgctggacttagggtactttttcaaggaaaggataagagaaaagggctggaagcgtggctggggtggagggaatcaagggaaaggaaggtccctcttcatctggactgtatgtgaacgtccgtgaggaaatggtaatggaagccacaccaccgaccaaatcttggagctcctcctgtgtgccactcatgggcctgtttgagctttagcttctttgctcacgccagttaacttttggctgtctcaaaaaggcaaattcacctgcaaatgacaaagattggtagtcagtgaagagaattagaggaatgtgccagaggctttgaaggaagttcccagagaggagccccaggaatgtggtgagttagggctgctccgatggaatccttgtgtgtcctcttgtggggaagggggacagcagtcatttgaatgcatgtgtttcggcatgttggttaagcaagcactttctagtctcgccttgtaggaattcctccctcctttcctctccatatatttattaagctcttactatgtgccaggcactgggtttaggtacggcagagacaatggtgaacaggacaggcatggtccctgtctttttagaacttatgctctcactccataatctcccatgacacctaacacagggctaggcacagaagacacacccacctaactgacaaatgtttctggaagaaactacttccaaccctcaagtgacatggggtacaaaggagcacctgagccgacagcgggactgcagttgtttttcagggagtgcacagaagatctaatgtgcatgactagaggtttcccactctggttgctcagccatgactctgaaagcttctctctggctgccttttcctactgggggaaacccgccatcacctggaaggttgctaaagaaatgagtcatttcagtagctcacaatgctaataggtgttcttgtcgataggatgatcccaaagggatattgggtcatggtggtgcttcgcactgggggaaactagctctgctcctttaagttggctgccaacttcctcctgggatttgctttctggggggcaccctcacctcacctgtgccctttggactgtctcctgtccggttgcctagctgtcacctgagggctggtggcaatcatacacaactaagtcagcttgccagttgtacagggtggcatattggttgagccatgtgtacccttagatggtacagttggatttgtcgtgaaagccaatggacctactttttgttcaggtaggaataagaggtgaaacaattccactaggtagtgcctagctaatgaggaggctaagcggtggccttagcctcctcatttgtcttgtcttgtctgtagagcaagtaaacaaaagattgttaaaacttttattgtggtcaaatacatagaacccaaagtttactattttaaccattttaaagtgtacaattaagtgacagtaagtacattcacaatgttgtgcaactaccaccactatctagttttgaaactttgtcataattttaaaggaaaatcctgtccccattaagcataccctcccgctctcccccaggccctggcaaccaccaatctgctttctgtctctatgggcttgcctcttctggacatttcatcttaatggaatcatacaatatgggacctttggtgtctggcttctgtcacgtagcatccatatgggtagcatgtgtcagaatctcctcttaaaggctgaataatattccactgtatggatataccacatttttgtctgtttatccattcatccattgatggatgtttgggctatgtccaccttttggctgccatgaatagaactgctatgaacgtgcacacagagaggtacttgtctgacaacctgtttttagttcttttgggtatatagcaggagtggaattgctaggtcatatggtaatgctgtgttttaccttttgaggaacgaccaaacttttccacagcagctgaaccattgagtatttccatcacaaatttcatcagttggtgggcatttggattgtttccaccttttggcttttgtgagtggagttgctgtgaacattcatgtataagtttgtttgtttgtttgtttgtttgttttgagacagagtcttgctctgtcacccaggctggagtacaatggcattatcttggctcactgcaacctctgcctcccaggttcaagggattctcctgtctcagcctcctgagtagctgggactacaggcgtgtgccaccatgcctggctaatttttatatttttagtagagactggatttcgccattttggccatggctggtttcaacctcctgacctcaggtgatccacctgcctcggcctcccaaggtgttgggattacaggcgtgcgccactgtgcccggcctcatgtgtaagtttttgtttgaacacctgttttcagttctttgggatatatacctaggaatggaagcaaaaggattttatgaagataaacctggccatttccccatgttcttcaaaaatgaaccagaaggacttatgcttatttatattactatacattggagagattatgattcgataaatgaacattgtgaccagcagggaattaaaatcctgggataggtctaagattctgcttgcagggttaaagctctacaccgtataaagtggaggtcccaaacctaaatgccttcaggcttaaaagggagaagcaggctgggtggggagtggcgaattggagcccagcccgcgtgtgtccctgttccctccagccagctgttgacatgcaggaatttggacacaatgttgccagatcagattttttttttcacagaaatattgggaaatctggatttttaagtgaaattgcccaatttaaaaatgtcggaagtggggccaggcagggtggcttatgcctgtaatcccagcactttgggaggccgaggtgggaggatcgcttgagctcaggggtttgtgatcagcctgggcaacatggtgaaaccccatcctttacaaaaatgaaaaaaaaagtattagccaggtgtggtggtatgcacctgcaatctcagttactcgggaggctgaggtgggaggatcacttgagcccaggagttcaaggtgccgtgagctatgatcatgccactgcactctgggtggcagagcaagaccctgactcttaaaaaaaaaaattaaaatgttggaagcaaattgggattttttttttcttttaaagcactgggtcaaacactaggcagtcagtgggttagattggtctcctgtccccttgttggcagtctctgactgagaacaggaagtgtgtgtctctctggtcactcctggactctcttgtggtccttccttcccttctcccattcccttagccccgtatgcatggacttcacttggacattccttccccagcctaacctccttgtctcactgcctgctcttctttcatcagatcacctctcggatcttcagggccgggcagagggtgatcccggtgtatcctgggatttttacagcagttctgtgttgggtaagttttaagtgagattcttcccacccttcttctcaaggacaggagtagccctgtggtggtatcccttcttcaccttttagtggcttacagaccctttcagaccaaacctgaacctgaacccatccttccctgcagactcagaagtcatttgtcgaaactgggaaatgcagcactggtttggacacagccatccctcactagccctctaccactccccaccctgggcatttaaaaaattctctttcttccgaggtccctttcttctccctggctttgtcttaaccctgccagaagcctctatgagcactgtcacctattccagtattgctcacactcaagagggaccccacccctcacctgagacctaccattccctccctaccctgcccccacgatgcacacgcagtttttggaatagctactgtcttcggagcccttagccttctggccgcagctttcctctcctggaagaccagcaggcctttatccatggtggtcatctagcattcgccctttgggctagggactgaagatgaaaggaaacacccactcctacccttgggggaagctggaggggagaaagtcaggatggaatgcaactggccacacccagaatgtgggctggggaaaggaacccgctcagccccctctgggcttcgtgggagccctgcaggcagtgaggtggcttgggaaagctgcagctagagaaggacaggtgtttttaccttgcccttgtctgctgatagtatcttcaggcttccatctcccaacagctgagcagctcatccttgacgtcaccttgcttttgccagttggaggggggagtgatataataaatctctggccacacaatgatttctttcagtactagaactttcatgtgccctctgaaggatgtgagccatggaaccggcaaaccgcatccctgactaggggcctgtggccttgtcatttacctcccaaccaccacccctccatgcccctttatctgcttagcgcatttcttttcttcggttttgtacatgtatctgagtcctaatcccctatatgctccccttacagaggaaaaagacgggtttgcctgtgacctcctacataatcctcctgggagctcagatcaagaaggagacgatccgatggaggaggatgatttcatgtttgaactctcagacaagcctcttctcccttgctacaacctccaagtgtcagtgtcccgcgggtaagtgtccgagagatccacggtgactgagtgtcaggatcctggcactcagtaggaaggtggagttctccacgaggaagtgaagacctggcaacgagtgccatcacacatgacaaaggctagcctgcccttttagcccagagtagtcatgttcaaactagaggctgcaggctccatggacattgactatctgcatttcctgaaccttaaatctagattctctctcggaaggctttttttgcactattactgggtataaaagataatctgagagatacttgggcctatgaactgctagaatctctggaacatttttgtagtttctgggggtaaacagatagaacattagaaattgagattgctggaaaagccaggacatatggttgccatagccatggggccactagggtccttcagtaatccacagcctagtttctcagtgctgtaatgttagtagcgtggtgctgccaacattgtcagcctagatgactgtgcatattatattggggatcacccatttatttaaggagactagaatatagaatatacctgacacgtaacattagattgaacccaatttaatacttatttgatggttctggagggagttcgacagccggcagggccatggcccttgttgggtttccccacatgtcagcgtgtggaagtgctggttgagagaaggagaatgcgggctgaactgcccttttattcttagcctccatgattttttccctctgattggtgtcttcatgtatttcaaatacttttccgaacaattgtaaggataatttttctttgatatctatttttaaaatgtcaactctatgttaaaatcctgtgaaccagtggctggtcgcagcagttgtaatttcagcactttgggaggccgaggcaggtggattgcttgaggccaggagttccagaccagcctggccaacatggtgaaacctcgtctactaaacatacagaaattaggcgggcatggtggcgggtgcctgtaatcccagttacgagggaagctgaggcaggagaatcgcctgaacctgtgaggcggaggttgcagtgagctgatattgcctgctacactccagcctgggcgacagagtgagactccgtctcaaaataaaataaaataataaaataagtcagtgaaccagcatgatgtgcacaggatggggagctaggtagacgatggatgaggaggtctttaagtgagagcctctgtttagggctctaaccattagaccacagtttctttgcatcccctgccctcccccccaccaccccacacgcatagcctgatcagaataaaaatagcatgtatgatggcactagtagggatcaagtttcaggggcttttggtccttattcttctgggcataagctgatccctgaggacagggcggggcctctgggatatagtattgcacggttaattaattcctccgatgtattcagcacctccctctctgaaacaggatcttgggcttcaggcagtaaaaggaccagggtagtctgcattaggtgcagacagaacacgggccacggagggctgcgtgcccctcagcgagctgagtggcaggcacgtggttagcccagagcccggtaccagcaaagctggttttcctgacgtgacatcctctagcgctcgctctagagctgcctttccccacagctgcagcacactgtgaaaatgtctgttcttcaagaagttgggggtgggggtgctagcgtagagtgatgcctctgaggccctatggggtgcagaagggccttctgaatcaccaaagcaagactgaattctcatcactagtgtgaatgttctcagggcttttttccattctttggaagtgatggtccaagtgtatgatatctgtagtccccttttcttaacccagagccctccatttcctactcatgtgagataagagcttgctgtcatttgggagaaatgttccattttagggataaggatcgtgggtctggttagatgtttaaggtgctggaacagaacatttgattctataaacatgtcttaaacagctgcaccaggtcaaaccctggggaccttcaaagaatccaccatctagtgcagtagacagacaagtatataattaactctaataaaagacaaaatgtcctaagcagatttattataaaaaactccaacagtttcagaagggtgtcaaatgcaaaaagttccagtccaccctgagcccccattgctatgctgcagagtgaaccacagtttaaggttcttttgcaaccctttcagaaatgggttttgttagtagtattacaatagggatgtgaatcaaatgccacgagaccatgggagatggaagaacaatgagttacaccgggggaaggtttcacaggtgatacagtatctacctgagctgggcctggaaggagagaaggatggagcaaggcactgaaacatacaagttcagaaagtagggggagtcctttatcatgtggctggtgcttggtagggtgggggatacaatgtggggtgtgtgtgtgtgtgagagagagacagagaaagagagagactgggtggacattgggctgaagaggttagaaggtctcatataatatcatgctagtggccgggcatggtggctcacacctgtaatcccagcgctttgggaggctgaggcgggtggatcatttgacgtcaggagtttgagaccaacctggccaacatggtgaaaccccatctctactaaaatacaaaaattagccaggcgtggtcgtgggtgcctgtaatcccagctactcaggaggctgagacaggagaattgcttgaacctgggaggtggaggttgcagtgagccgagattgcgccactgcactccagcctagagactccgtcttggaaaaagaaaaaaaagaaaagaaaactgtaatggtaacagaagatccagtgagggtgggtgggggtgcagaagagtgactcttggcaaagggaaaccggttaggaggctgacaagacagagcccaggccagaagtggcaaaggctggagctggggtagtggaatagtgaggagggaaaaccctgtgaactgggaccactaatgtggggaggcagcgtttcttcccgcattagtcaatgtaagcgtttggcccgggatcggcctctccagcacccctcccagctgtccccaggctgccacccagtcgggtgtgctcagcaaagtcagactccactttctgtaatgtgagctctggccctgcagaaacgatggtgctgctgctggagaaaaaacttgtctaatgcattccagagccaaagagaaatgccttttggattacccgcagtttaggcctttctccacggctccccctctgctggggaagatcttggagagcaaggaggccagggaagcaagagtaagaacaggagaagggaaggcagccagggttggcaggggcgggagtcggaggaaagactggtcccagcagatggcaaatgccaggtcacaggggcgcaggctaagtccccaagaagcctgctaagagttttaggttctagaatgcccctttgcctcctgtttgtgttattttggaagaggtggtcactgattgcgtgctcaccatttagctgaaagccgggccaggcattgcaggggacaggagaagacatttgcctcagctatacccaaggagcctgtggtttagcaggggacgggggagccagactggcagtgagttataatgggagacattgatggtcgtgcagcctttgtgggctttgcagagtgttctgggtcggtgcccccaccgcttcctccagcctccttcaataactcccatccttgcctttgcaggccctgcaactggttcctcttttccgatgtcttgaagaggctgaagctttcctcgaggatctttcaggcccggttcccgcactttgaaatcaccaccatgcccaaggccgagttctacaggcaggtggcctccagtcagctgctgacccctgccgagaggcctggaggcttggacgacagatcccccccaggctcctctgagactgtggagctggtgcggtacgagccagacctacttcggctcctagggtccgaggtggaattccagtcttgcaacagttgaccgggaaaacagcccctcctcttctttctccttccgagttcgcccttcccccacctccttgtctttccccgaccgagcaccagactgcagaatgaggcaataatacggaccaacaagaagccgccttatcaatgccagcattagcgactggactgtttttgtttttttggttacaattagttctcatctccctgtcgtcgtcattgttatcgtggttgctgatgggggtggaaagttgaactccatgtctgaggacaagaggtcccgggggtggtgggaggtggcgccggggtcccttggactggcctccttgttcatgaccaagaccaaacctgggccctggatggccttggcctgtcccgaggagaaatgagaaaatcccagatctctgagcgccccccaactccattcccctgtgttcttctgtcttctgtagtatttattttattagtatttaatttgtattgtttcattggtttctgataagtctgtatcactgtgacgatttgagacaacttgttgtattgagggactttctgtacctccttttctttttctttgttgatgagctctgacaaagctattccctggtgtttttttcccccactggggagggggtgaggtggaatggggtgggggaacatggacttgtgactaacgaagctggttgctgctggcccagggctgggggcttgggggtaaatcctgaggctttggtgctcccccacccacccattcccgccctttgcagcagccccgctatcttgagattagtgttgacagggaggggaggattgtgaggtgaggggttaataagttactctaataaaggagcgtggagaagggatctgaggggtgagggtggcccccctcctcacgccttcttcactgcccccctcagagtgcacaatacgagtttgttcctgcctccactctcccaccccgttctggcctccctgtctcaagatactgagcctctcacctcccagccctcagccacccccatccctgccccttctgagactcacagcacccctttccttcctctcctcccacctcctccctcagcccctcattctccttgggaatctgcagagggctctgggactcactgccggatgtgaaatccaggcgtcagctgtttcctaggcaagggcaggaaagtggtctccagcccttgctccactcatgcctgggggcctggggctgagtggtatccctacctggcctccccctggcctctgggcctccagcgctgggtttgtcgagtgagagagagagaggagcttgggttgcttccctgtccccgccccctctgtggcattgtccctcccactcttatttttctaccaattgctatttttccgaacaatccttgtagagtatgtaccatccaaaggcaggagggcctcgccgtggccggctctggttggagatggtacagttttattgtacaggtgctaaaacaacaacaacaaaaaagaaaatggaaaaaaaaaagattaaaaaaaaaaggaaaaaaaaaaagccagtttgaggatgggacaatctgttctctagaggctcctgagccatgcgggagcattggtggttattttctttgtattgtgtttgttctttgttcctgggggggaagttctcggcccccttctgtaggactgctccccacccccaccatactgcccagttggttttgaacagttgttttccctttttaagaaaaaaaaatacatatatatatacatatatatatataaagttgaggggttttggactttaatttgttggttttgttggggttcctggtattgtgtagtttatttcatgttctgtttgcctttccttttttcgcatttgggtgtatattctggctgccctttatgtttcattttaagcaactggctgtggagtcaaaaacacttgcatact

SEQ ID NO: 1296 - DNA, 75428 bp, mus musculus; identical to SEQ ID NO: 1295

SEQ ID NO: 1297 - DNA, 1015 bp, mus musculus
tcctgggggggaaaccataggaattaccccactcctcggaaagggaggtggaggctatggtcttgttaactacctgactccaacccccgatccaaggatccgacgatccgaagggaggctggctagcagggcagggcgagaaaaggcttttttttggggggggggggtgtccgtgatgaagtgttgaagagaccgggagaaaatgccctccaacctcagaggggaggtgcgacgggtgctcttcagggctgctttcttcccggcgctggggtgcgggaatcgtagggtaaggggtacccctaggtggcggcggggcctgggttcgggagtgggagtgctgtgatgggggcaggggcaattatccgagtccctggaaaaaaggcgggggatgacttcggagcgccctggctccgctgccctcgctctaggggcgggggccgccgggccgggcgcggcggggagggggcttaaattgaaggaagatgagatcgggggcaattcatactagcaccggcaagccagaggggagatccggcgtgcaagccctccacccgcttcgcgccaggcctggaggcaaggggtcggcgagcgaagccgagggctggaaggagggaggctccggttacggggccgggtttcgggatcaggggcaatcccccggcccttggagaaggagggagagggatggccgcgaaccccagggctcccccaccccgggtcctaaggggcgtgagggacggacagcaggcccagcggagctggattcgagcggatcgcggccggggagtgggagggcttagtggtgggcttcggggggagcagtccggcggcggggcgggcgggcggggcgtggggctccggcgggcggcggggcggggccgggggcggcgctgctgccgccgccgctgccgccgccgccgctgctgctcctgctggggccgccgcagccgttgccgccgccgccgccgccgcttctgggcggggaacggaggccaaagagagtcccgtgccgggg

SEQ ID NO: 1298 - DNA, 1015 bp, mus musculus; identical to SEQ ID NO: 1297

SEQ ID NO: 1299 - DNA, 24856 bp, mus musculus
aatgcttccgggttggcgctgcagtggcgtttccgactgtgggagcctcagcttcccagtcgtccgatgagcccgagcaggtgagggggagctcctggacttccaggctggggagcggggctgggccgcgccaggccgcgcggggccgggctggcctggttcccggcctgggaggggcttaacggtcctctggtctctctctcccctcagctgagtcccttccctgtctttcactcttctggcatcggtggttttacttcttcgattgaaccctgcttcctcgacccccctgggaggccgccttcttcaggcgcctcccttctctccacgagctcgctctgacagctgaggaactggcaagatcctgctacccagagggtgaatgggtatctttcccggaataatcctaatttttctaagggtgaagtttgcaacggcggccgtgattgtaagcggagtaagcaaacacctccattgtattagtgtaagggatactgttgaaagatgctccccttcggtttctaccccctgtcactcctgaggtcaaggcattgaaggcatctattaaaatgcagttcagttacttgattggcatgacagctgttatcaacatgaattagtttctcagacaggataacagcagggacatttatggtttcctgtcagtgattccttgttgttgttgtttttccccccagcctagagatgcctagcgttatcatgaactcttccctcgtcttcattccctacatcatcgagttctttgtgtcttcattggggaagtctatctctaacctcagtgccaacaagcatctttgtctgctgtactttgcaccatcctaagctagtctccctgcctctcccgtttgtaatgtaatccactgtgtttgctgcagccctaataggctaaaatgtggtggatttcctcaagtcacttcgttgttaaacacacacacacaaaacatgcagccccctcctacaccccctacccccaccccttggtttcaagcctttcaacataacatgctccttatcacacttcttgtctgatactgtttcagtcaacaagggaattctctgttccagttaggttcctttcttcttggcacaaaccatactgatgcctgcttctacatgctgtgcttgttcccacatttgtgtttctgttcattctctcttccctgcccctctcccttacctgcacctaaccaggttgtacctaccgtctctcaaggttcaatttaggttctctcacctcggcaattttcaaattagtcaatcccatgctggttgtagtcttttctatgctcctcttgctcttaaagtttgtactacacagtttagtacttaatttttctctaacgcactactttgatttcttccaccagattataagctcttgaaaggcaagtactgtatttcgtacttttttctctgtcccatctcattggttattcagaaaagacaggttgagtggtaaatattgtcttggtgctagaacgaatatctgtgtttttcaaatatgattatacccaaagtgcattgcaggtttgggcatttagcatgccttcaataaatatctgcttggctctccattgttaccttctgaatctgagaatctctaatttctactctttcttaaaggagaaagcaggagaggcacccagagtttcctgaccagatcttgggagtagtatagggcaatgtaacttgtattgtaggacattcttactttcactcattagtctatcaaattctccgaagtcagatcttcagaataaatgttggcattttgaagacaattttcattggtttctttatacagtaaaaatatttagggtactatatttttattttaccttagatatgactacttttacgcatatttggggttagcccctacaagttaaaataatttttagagggcttggggtattttacataagtaattccttggaacaaaagcaagggaacagggttcgcaggcagagaatatctggggatcaagatagtgtcatacacagggtgtgtagcattggccaggtccagcaagttaccttccttgtttcctctgcaatcttttatatacaggctgcatacataggtaaaggatgtcacactgcaaaaccaactaagtattgaatggatatgtattcaattctatgcaagctataatgggggttataaaaagtactgtgagatatagtatcttcccttggggatcttacttagttaagagaggaaataacattggacatcttgaagttgaccctcatcctagtcattatttttatgcctgagattaagatatagaagggataaaagaaggttcaaaaaatattgcacacctgtagaataggtgtgacacaacacgcatgcatgtagacaactttatgtaaaagacttggaggtttcagctgacagtttaatgatttgatagtgtgatgtggctcccaaaaaagtgagtgcaattttaagctctagtaattgaagtataatgtgtcaaatgaagagaaagatcatggatatttagctcaagaaacatgagatgtaagagaacatcatagctgtctttaaatatttgaagggcttgcctagggaaaaaagaatgcatttgttgaatattacctccaaagactgggtacaaattagaggaagacagacttttggctcaatatgaggagggagtgtctaaaaacagatctaatcaaatatgatccaggatttcttcataagattttttcctaacattggagtgaaagagattttactatcagatgggggtagggaagtcgtgattgtggcaatggtgggttttgcctgtggtctccagatttttggatttcatgggccagtaaaatgtaaatgaaaatgtgggaagggtacacaaatacaggctagttagcctgtgctccaggcgtaagaagaatctgatctgttaataatagacagtccctaaattaaatacatttagctgaaaaaaaaaaaaaggactaagtgtccttatttttttcatttcgccccagaattgtgggaacttcattagggaaccactgggctaactggcctaagattcagcgactggtctttcatcttcctgccatgtcctccctgttccttgcctttcactgattcatcattgctccctgagcacattttccttattaaagggctggtagcagcttgtgaagttccgatagaggctttctctgtaatacaaagagttgaaaaaagttgtaaggagaaaaagttttggagagacaactttaagtaaaagtagctgtctgaaacctttaagactatttggggcaatcgataaatttgtgaatggagagttaattttttcctcacaaactcaaagaggggatatgccatggtcttgcttttccatctctactctcaccatatgtgtcatattttactatcaattctaattggaaaatgtgggcatagctagaaatggtgataaggtagtatttagtcttcaagactcctatttccagctgcagttgatacttgaagtggctattcctactttgctcattagaattcttttcaacaactttccctcaaaagggctatctatcccagactctatatgtgctatgcttgaaaggaagcctccataatgatttttgtggcctgtaactaaaacatttaatcagcgtgtttgctatcttctctggaaaattgtattttgcttagttacagagaattccttatgtggaaacaaagcaaaaccttcaaagggatactgtgactcatagctgctaaccccagactgggcaatgggagggaggggtgggcagcaagtaatatctgttaagatgtaaatttgggtacttaaatttttaaaaatgtaataatgatagttaactaacaattattgagctacatgccaggcacttttaaaggtgtttttcatatattatttaattttcacaacaaccctatgatatagtttttattattagttccattttacagttcagaaagtggaggcatagagagattaacttgcccaaggtcacagaactagtaagtggtggagtcaggaaatgaatctggagttagcatttaaattttaacagtctgacttcaggagtctgcattcctcaccataaaccacttggaagttgcttttgaaattcagaagtatacatactgtgaagctctgaaaaaggaatatttgaaagaaatctgagagtccatgctaagaacagatactactttcagatggaccaggatttagtaggcaatgcctagagcagttcttaagtgtggaagtatcagcgttatttgggatcttgcaaattctcagggccataccaccaatcagaaactctgggggagaggcccaacaatctatgttttaatagaccttctagatgattctaatacatgctaaaatttgcaaaacctagaggccagagctctggaaaaaataaaatccaagagagagcaagctgacagtggcagaaaaagagagtaaagctgaaaagattgatgatgacaggtctaacgggggtgggatagggaaggagaaaagggaggctgggagcagaatacgttgttaaagaactagaacataaaagaagaacagtatttatatgtgtgtgttttaaaaggccaagaggaaggaaaaggagatccactagatggatgtacgttaaatgtcagagggaagatagacatcatattgctatcattcctttgggcgctagaaggaaggtgaaaaagttcttagctcagcctgggcctagttggggggacaaagttatatatagctagataccctatagtagagagataggagggctaagaatatgagagagtagtagtgtgagcctgtgctttgcacctgaatcaagctaactgaataccatgaactgcttttatgagatgcctcagcctatataatttgaattccgggttccttcatttgtaattatctagttgaatgtcaaagttgggtgtgctggatggactgaagcctcttctctgggtggggatgaatataacattaaagaaactggagagaatgaagggcacaggttgatctctgagtgaatcacacgcctacccctacaaaatgtcagtaaagaacaaactcatgatcatccagcacataaaacaggatcccccatttttgtgtcattccacttggtggggtttttcttctacatctattttatttgccaattttgtttatctaaattatatgatcagatgctaacaaatgctcctcactcttgtgccttgttctgatttgtgtttatttttagcaccagaaaagtaccactgtaagtcatgagatgtctggtctgaattggaaaccctttgtatatggcggccttgcctctatcgtggctgagtttggtaagaatgtgagaaatgacaaatctgcattatacggtatagatggtagcttatgatgatggttatttttggtgaaagctaggtaaaaaataagaagctcgccttattttgaaaattgtctcaaagccatgaagtaatatttcagggaaagtactactgatggtatggcagatgagttaagaaaagtcaaactaaggaaagcttttttggtagtttagtgatttgttagtttgctaggcttaagtaaaatacatgaatatatagagggagttgatatgtcataagggtttttgctatatttctgtattaatagtcttttatgctaaattatttataagtttatttgtactgaaagtcctttttttcaaacctctttcccattttagaagaaaatgtactaacaagatcaaacaagattctcttctacatgattttgattttgaaatatttttagattgtcgtttttttcatcttccagatgttctcttttctaaactattcatgagtgactactgacgttcttggcatatcctgtggtgttgtgatatttgggtcatcagtgaccagagctacctaatcaccttgttagttttacaccctgaaatatattttgtcaatgtgatgaccacttctgtttgttgatgtaagaggtttggttaaagaaatttcccccccaaacactctgctggtattagtcctgaattacctaagggaccaggatgagtagaaccaaataagactttgccattatctttcataatattaggggactatttgtttcttgtaaacagataaaagaaaaaccccacaaaactttgtaacactatataagagcatctggagcagcaatcccatgctttcctatctttgtgaaaatttagggagattttatgagacacagaggtggggagacttggggtgggaaggggcaggagggagactgataaatgccagattatatgttacagatgaaataaaaaacaacatttaattattttgcatttataatagggcaatctgaaagcattttattatattacagtttgaagtatattgtgggtcaattggtgctgcctatgtatagtataatgcatttcacttaccacatgcaactcatgttctctgacagtggtattctactagagctcttctatgtgttataaaaaggactttgtcttaggattcaaatattgtccttggcttatatttagcaacaacttaactgtgattctttggacatacttataaataagtgtgttcctttatagggactttccctgtggaccttaccaaaacacgacttcaggttcaaggccaaagcattgatgcccgtttcaaagagataaaatatagagggatgttccatgcgctgtttcgcatctgtaaagaggaaggtgtattggctctctattcagggtgagactggttctttccttatatcattaacagaaatgctttttaaagaagccatagttttcagctgtctgatagtttgtgtccgtttcatattcaccatttcaacttgtaattcagtattgatatgccagtttatatttctcctgcttgtaagtcttgagctttggattttgtgttcatttggttataagtgataataacattttaaaatggatatgtcattgcagcataggctttctgtggatttcccgagagtcactaatagccactgttaataacagcaccaattaattatatatatttttgtgatatccctcctgagttggcaaattctgacttcctttaaaattttcctctttgaaaaaatattattcttgcagtttaaacagaaagtgcataatgagagagagggagacccatctttatcatcaccttttgattagccataattttgtggtttactgtctagtttgtagtttatctgttgccagtttcctaggccactcctgcatctaggctaccagtttattactcagagaatagacatcaattttattgttaaactatgttacatcgttaaactatgttagacttaatttaaaaggtaattttcttgggggaaaaatcaagtagtgtatcctgaagcatcctgaagatgatccaccatcctgatttgtggatcatctgtttcaccttgttctttcatcagcatagatcatcacaagatattttctgatagcaagcaataaagtcagaaatatgcatatttagtcatcatttaaaaatcctaaccatttgagctgctgctgtctttctatttatacctcctacagtatagttctgcaatttggaagaatcccaaaggaggtatgaatgagaatgtctccagtttaaaggagaacttaaatagggtggaattttggctctagtacctccttgttgatgtgattaaagacgtatctgcaactgttaggaagtagaggttgatttttttaaaaaaatctttattaggtgagcaatgatgtataattctttttatacattgctggattcaatttaccaatattttcttaaggagttttgcatctaagttcatgagagacattagtctgtggttttccttttttgtactgtttttgtctggttttggtatcagggtaatactagccaaaattagttgggaagcattccctcttctgttttctggaaggaactgtgtaagcttagtgttaatttttaaaatgttttgtagaattccccagtgaaattatctggggctatttctttttggggaacatttaaattcagagtgcaaattctttaaggttatcatagtttggggtgctataacaaaataccatagactgggtgacttataaacaatcggaatttatttctcacagttctggaggcaggaaatctgagatcggtgccagtttggtcaggttctgctgaggtctcttttctgggttgcagactgccaagacttcttattgtatcctcacatggcagacagagtgagggagctctctgggatcccttttataagggcactaatcctgttcatgagggctttaccctcatgacctaatcacctcctattaccatcatattgcgggttaggattttaagatcttgatttggggacgatacaaacattcagtccattgcaatgggtatgagttttattcagattatttgttttatctagttgagttttggtagcttctggttttcaaggaatttgtccatttcttctaaggtgttgaatttatgagtataaagttgtttataccatactcttattgtccttttaatggctgcaggaattgtagtgctagtccctgtttcatttcttatttgcatcttctgtctttttatctttgtgagtcttgctagaggtttatcaattttgttgatttttttttaaagagctaactttttgtttcattgatttttctctattttcctattttcaatttcattgatttgtgctttttattattttcttttgcttgctttgggttattttgcttttctttttctagtttcttgaggtaggagcatagattattgatttgagactctacccccccccccccttttttttttttaaaatgcaagcatttcatgctgtaaatttccctcagcactgctttggctgcatctcatacattttaataggttgaattttgttgtcatttagacctgtgaattaaaaaaaaattcctttgacagacacttggtctgaccaatagattatttagatatatattgtttaatttctaaatgtttgaggatttttcttattgatttctggtttgattccattattgtcagataacatattgtatatgatttcagttcttttaaatttgttgaggttggttttatgacccagaatgttcagtttcttgctgagtgtttcatgagtgcttgaaaaaaatcatattctgctgttgttgggtagaatgagatgggtagtccaaataagtaggctatctagatatgtataatctgaaaatgttgagaataactttttacttttttttttttcagaattgctcctgcgttgctaagacaagcatcatatggcaccattaaaattgggatttaccaaagcttgaagcgcttattcgtagaacgtttagaaggtcagtatacttaccctcttttgaggtgatactcaaagggattgttgaaatcatgcttagtgagaaatgttggtcatgaggtgcctgagaatggaggagagtcactgcaaagacaaagtgagcttgttctaacttggaataaatctttgcagaggtgatatatgaattagagagacctgttcttcaaatttgtcccttttcctatcaacaaaaaaggcatgtgatcatcccaaaagaaacatggaacaatcttgtccagaaaattaatgctatcttcatcaataagaggacttcaactgtaaggcattttctagctggcaattttgataagcttttattaggcagaataattttaggctgttttctaaattctgatgtacctttggctaccttatgcatattcagcattatcatatgtctgtttgctgctgtagcattttccatcatgatactacactaaatggttattttaccacaggcctggggctgttggatgtttggggacagctggaaagcctttcggttagtaatgtcctttgaatcactttattgtcctaaagtcaactttttctgaagcctttttttggggattgtgaagggttctcttccacctctttctgaaatatttttctttcatagattcttcacttgggtttatttagtttctatttgtggggtcttcatggtgtgaaggagcggtaaagattgaatttcactatagaacaatgtgctctgtggtttctttgttcttttttctcactgaggagatttagttctaaatgattgctttttcatatttgactacagaaatattttataaattaacagaggctaggagagatctcaggcctatcaaaattaatattcaaataagttttttgtattagacgtaagattttctcttttaacattcagttcctgaatctttagagttgatgattacccagaaaaagacttaaaaagtatgttctttagatgtttgaaaaggtcgaaggggaaataccaccttctgaatttgtgtgtgggatactgatagttatgtagaagaaaaggacgtgttccagtgtcctttagaaataatgatgtttttagaaatgatttatattttacaagttttaatatattttagcactgaattgagatctagaaatatttgagtttctttattttcctaagctttttggttcatttctaaagtcatctctctaaccaagtttcccttcctccagtaggtcagtagtatgtactcaaactggtgcctaatacaagcagacctttctttttcttttccttttcacagatgaaactcttttaattaatatgatctgtggggtagtgtcaggagtgatatcttccactatagccaatcccaccgatgttctaaaggtaagagagatacagtgtgatttgaaaggagcataactttgagtcagatttgggttcagattcccactctgtcacttgccagctgtagaaccttgggcaaatcagttaactgcattaagcctcaatttcatcatttgaaaaatgaatataatacagtgtttataacatagagttgtaaaggattagcgataatatatatataaactgcctatcattgtacttggtgtagtagatgctcaataaatggcagtcagtttattatgatatgtgttaatccactggtcctcacactggggtatgcaagaccctataggttctttccaagggctatgcagttttataggaatcaatttccagatctcttacatccatttgtactccatcctaaaactggtacgagaatgaatctgttcataatagcccttactcaattttacaaaagaaatgtacgtccccacctattctaaatcttggtatggtatgttgacctgtggtataacctgggatgccaaacagaggggtaaactgaaatacagttcttggagaagcctattttagtaaccaatttgggtatcttaagtctgtaatgcctctgtctttccctgtcttattaatatttctattcagggtgagatttggctttaaacatggtatattttggcctgtattggaatattctgaattcagaaccagaatagtataggttggtggtgctgacttgttaagagtatagttggatttctttaaggttttttcaagtcacagactgaaacatttcttttaatataaattttcatcttatttcataaaatggtaaatattttctacttattaacgtatttaagcttatgattagttaaaagcactaaatataggattaaaataagtgaggggaacccaaagttttaacaaattattttaaggggattgcgagaaaaaagtaagaggacacatgcttttttaaatttgaccactagtgaaaccacaagtggctaggttagcaaaggagagatctatttattgcaattcagagaggggtttgagaacagagagaaagacatgaaaaacaacacacatgaaataaaccactggtggttgatggataaaaatatgagacagtctttctggactaaaatgatagtaatttacagaatttttatatcattttaggtttacagaacaagtttttttttcaccgtttattttagattcagggagtacatgtgcaggtttattacatgggtatattgtatgatgctcaggtttgggatatgaatgatcccatcacccagatagtgagcacagtacccaacagtttttcaacccttgtccccctccttctctcctgcctctattattccctggtgtctattgttgccatctttgtccatgagtatgcaatatttagctcccacttataagtgagaacatgctatctttggttttctgttcctgcattaattcatttaggataatggcctctggctcaatccatgttactgcaaaggacatgattttgttcttttttatgactgcatagtattccatggtgtatatgtaccacattttctttatccagtccaacggtggtgggcacctaggttgattccatgtctttgctattgtgaatagtgctgtgatgaacataggagtgtatgtgtctttttggtagaattatttattttcttttggatatatactcagtaatgggattgctgggttgaatggtagctctctgttttaagttccttgagaagtctccaaactgctttccaaagtggctgaactaatttacattcccaccaatggtgtctaagcattcccttttctctgcagcctcgccagcatctgttgtttttactttttaataataaccattctgactggtgtgagatggtatcttgttgtggtttgatttacatttctctgatgattagtgatattgtgcatctttttatgtttgttggctgcttgtatgtcttcttttgagaagtgtccgttcatgtcttttgcctactttttaatggagttatttggtttttgcttgttgaattaaattccttatagatgctggataccagattttcatcagatgcatagtttgtgaatattttctcccattctataggttgtttctttactctgttggtagtttcttttgttggaagaagatttttagtttaatcaggtcccgcttgtcaattttttgttttgttgcaattgcttttgatgacttagtcataaattatttcccaaggccaatgcccagaatggcgtttcctaggttttcttttaggattcttaaaatttgaggtcttacatttaaatctttaatctgtcttgagttaatttttgtatatggtgaaaggtaggggcccagttttattcttctgcatatagctagtcagctgtcccagtaccatttattgaatagggagtcctttccccatgcttatttttgttgacttagaacaggtatttatgaagagaatttaattgaagagctccttgtacctcttactctaagcagacaaccccacctcctatggcctggccttatacctctcaatttcgtgtcctttctaccttacaggtgtaaacttacttccatctatacccatccttatcttgtcttactgtagtggttttccagaccagaccagtattacctgggaacttgttagaaatgcaaattatcaggccccatccaacacctactgaaccagaaagggtaggatggggcccagcagtctggtttgacaagcccttcaagtgattttgatacatgctcaagtttaaaaaaaacctggttactctacttttattcacttctgtttcatcagagacctttatcatttgtcctctttctcttattttcagtgtcttcctctttaccggttatcttctctcaaatgataaatatggtcaaatctctctatcctaaaatattttcttgaccctctgacctcaaaacaccatgctatctcttttcttaccttctcatccagattttacaagagtaatctttacattccatttccttcataacctgctgtaatcactcctgctacttgattgaaatcactctccacagggtcagcagtaatgtcctcattatccaatccagtggacattttagttctcatcttacttaacctattttgactaattccttctactagaagttcttttttggttttgttactacactatttagattctgcttctagttttcctattccttagcttcattcatgggcttcctttttatgcatatactttaaatctttttcttctcccacccaaggttccatctttagctcttttctcctcttcagtctctccttgatggcctttttcattctttttttttttttttactattattattattttttttgagacggagtctcgctctgtctcccaggctggagtgcagtggcgcgatctcggctcactgcaagctccgcctcccgggttcacgccattctcctgcctcagcctcctgagtagctgggactacaggcgcccgccaccacacctggctaattttttgtacttttagtagagacggggtttcaccgtgttagccaggatggtgtcgatttcctgacctcgtgatccacccgccttggcctcccaaagtgctgggattacaggcgtgagccaccgtgcccgaccgcctttttcattcttaatactttagctctcactatatcagttaggttatgggctaagctactgtcacaaagaaactcaaaaataaaaggtctccatatacaagtatttatctctctcatgtaaccatctagaggactgcagttaatgctggtaaggcagaactacttcatgtagtcatccaggatccaggtttcttcatttttgttgcactgccatctcctagggcagggattggcaaactactgtctgtgggtcaaatctggcccaccccctgttgtgaataaagttttattggaacacagccaccccatttttttatttattgtctataattgcttttgtgcttcagtgacagagttgagtagtcacaacagaggtcataagccctgcaaagcctaatatatttactgtctggacccttacagaaaacgtttgttgacccctgtcctatggtattattttagtctgtatagttgaagttggaccactatcaaacctacattccagcccatgggaagagagtcaagggaaagcagtttccttttgatttgtcaaaaataaagtcaggaaaaattttaaagtttattgtatgcaataagagaaagtacgggtctcgatccaggatacttcaaaccaaatgataacaaacttatcttacagtacagtttataaagcagaagggcagaaacattttgaccttttttgtgattggctgttataaattatcgttcttttaaaggcaagcagctgtttaaggtgattgtctatagttattggtttcatttcactgaagcattctgacaaagatgtaaagcttatgttttgtgtttatgattagagatagcagttccgaggaaataggatgacttaaggttcggttacctgatgatgggtggctggtcttggggtttatctcaattgttgcctccatttttatctttaacagtttaaatctttaaatatgtagttttggagaaacaatttcaaacatatgagtgagtagaaaataacatagtacagtgaacgtctttgtacacatcacggaggtagctaagattttgctacatgtgcttttttattccctttttctgaattattttaaggcacattccagacattgtcattttcccccatatacttcgatgtgcatctcataaaaggaatatttttctatataaccatggtgctattgttacatttaacaaaattaacatttattcattagtaacatctaataatctatgttcacatttccagactgtcttatattttacagttgatttgtttaacttgggttccaaagcctatgcattatatttaatagttatgtttcttaagtcctttttattctagagtaccccactcctgtccatataccttttatttatttatttatttatttgctttttgccattaacttgtcaaataaatgggatcagctctcctttagaattcccaagttttggatttgtctttttgcttccttgtgatatcatttaacttatttctctaaatcttctctctctgtaaaagggaaggtttctgtaaaggtcataccgagtcatgtgaggaggcacacagtgtttggttgtcccaatatagggatgttaaggttgatcagtgggttcaggcgtgacagcccgatttctcctttgtagtttcctgtcaatccttcatctaatggtttcatccattggtggccattacctgaattgattgtttcatttaaggtcgcaaagtggtgattttctaattccatcattccatccatgtttcttagctagaattcttctgcaagggcaatctttttttttttttttttttttttttttgagatggagtctcgctctgttgcccaggctggagtgcaatggcatgatctcggctcactgcaacctccacttcctgggttcaagcaattctcctgcctcagcctctcgagtagctgggattacacaggtgcacaccaccacgcctggctaatttttgtatttttagtagagacggggtttcgccatgttggccaggctggtttcaaactactgacctcaggtgatccgcccacctcggcctcccaaagtgctgggattacaggcgtgagccactgcgcctggccaaggacaactttttctcatttagtggggctgtttggctgttctgaaatataggcaatttccttttaagcaagacactgggaagtttcaaccattatttctgttcacgttccattctgaaggacttggttccatggctacatctagcttcaagaaaggagagtagattttgggagacaataatctaccacactacccagacctactgggtcatctaaactagaaacctagatcatctttgattcttctatatctttgcttccttctagtattggattaggtatcaagtttctacagattttgcctcatctgtatttctcaactttgtcctttccccaccattccttttgtaggacctcatctcagtagcctcctaacttgtcccttcactctagtgtgtaccccactccctcaacccatctccagatgaagctggagagatctatcgaaatccatatctgatctactatgtactgcttctttgcctttgtgcacgtaacactttcttcctgaaacgtctttctcattttcctggtgaatttgtccttcaagaccaggctcataaacagggccaggactagggcaaaacaagtaaggcagtcccctttgatgcagaatgtaagaaggtgccacaaaactcagtaatcaatataaacaacatttgtatgtagtatttttaaacaatcaaaattaacgcaaaaaattcatgatgaaccaaataccaaaatttcacataactcatctcattcaccttaccctaatcctggccctgttgagtcctagctttagttaaatttgatatttgattcattatggctttttgtggattaattttggttaaaaaatatcatattgagacatcatttatcttgattactgagtttttcttgcactcccttacatttcatgcctaagaaaagtacttcacttgcctcacgctagcccctctgttgtcaggaatcacctccttaaagaagtgttctacttaccacagtgtattagtagttttcatttgtctttgtgataggttgtatcttgatttaatgggtttaggtttttataattataatatttgaaaactcttagtagtaacagttaactttctgcataaaagcatgttgccattacatgacttactaaagacatttgttgaaacctagaatggtagcatggtgcttcataaaaatcaggcctacatttgggccgctagtatttagtgactgactactaggattgtatgtgtgcagagtctgtgggaaattgtaccaaaccttttacatggccatttaatgctatctttccttcttgcagctctcaaaggccacttggcagaatataatattatgctttttataaatagaactcaacttaaggtctcataaacataaaattatattttaaaacacatttttcatttttataattacgtaagcaatgcatgtttaatgtagaaaaatatggaaggcagaaaaaacacaaaagagaaaaatgcttacttgtagcctcaccactcagacataaaccactgtaagtatttagttttatatgttcacctcgtctctttgctgtgcttatggatatttttaagtttacatgttttttataaaaatgatatagtacttcgcaattttttttctggttagcaattaatttttgatatctttcagtgtcagcaaataccattgtacaacaaaattttatggctccatagtattctattaaatgaatgtataatttctgtaaccaacctgtgtagttgtttttggatattaagttgtttctaatttttcactaaatgagtcattttttagtcctgctgagtacttgatctttcttttctccaaattttcttctagctccagaaataatagacttagtgtgaggaatgtgaggccgatgaaaaccatttttataaaatacactttgacacaaattctttttctatacagtttaactaattaactttatcataatagcagatatttttctgggattcctgaatacttctttttaaattttagatgaatttaaaatgaatttaaatgaacttaaaatgaatttagcattttggttctctctgacaaaataagatgttcacctcttttcattttagattcgaatgcaggctcaaggaagcttgttccaagggagcatgattggaagctttatcgatatataccaacaagaaggcaccaggggtctgtggagggtaagtactcttttcctgctattatcctacactctcagttcctacaatttgcagagaatttttttttatataaagacataaaatcgtgaattataatccaaaaactaaggtaagaaactcctcatctcccttgaaaggcccaaaacttatcattggccttttatttctgcataatgtttggggattatataggtggggaaagttattacattatttgagatggctgtttcgatcatattcacagtgaatgtagttgttcagtgtatttttttgcaagttctgtactaacacgatgatgtatgtctttgtagtgcttatgttcaaaagctgttaccggctgtgtgctgtggctcatgcctgtaatcccagcactttgggaggccaacgcgggtggatcacttgaggtcagaagttcaagaccagcctggccaacctggtgaaaccccatctcaactagaaatacaaaaattagccaggcatggtggtgcatggctgtagtcacagctactcaggaggctgaggcaggagaattgtttgaaccctggaggtggaggttgcagtgagccaagatcatgccactgcactccagcctaggtgacagggcgagactctgtctcaaaaaaaaaaaaaaaaaaaaaaagaataagaaaaaaaagctgttaccttaaacaattttttaacctaaaaagtctaacatgtactgtaaaatattgagaaaatatagaaaagtaaaaagaaaaaaaatccagtagtcccactgcctagagataatttctgttaaactttttgtcatattatctttcagtcttctatctatactttgcttttcgtcattgttgctctaactttttaatccctaattattgtaatattaataatattattagtagaatatacagagagagtggaatgggaaatctattaatagacttttaaataaaaatgagagctttggtatttttctttataatttttcataacaaaaatttcaagcataaagaaaaattgaaagaatagaactatgaaatacatacctatgagctggatttgatggctgttaaagtttgatcgtatttgctttatctgtttacgtgtatacagacatacactctttttagctaagctaaatgaaagtaggttgcagacatcatggcactcaattaaattcttcattgtgcatctcctaagaataaggatagtcttctacataataataataccattatcatatctaagaaaatgaacaagtccctaatacctaatatctagcccatattagaatttcctgttaatgagaccaggctaatttataatttattttcttccttcctccttttttttttttctttttttttttgacagggtctcactttgttgcctaggctggtcttgatcttctggcttcaagtgatcctctggccttggccttacagatgtgagccaccatgcctggccaggctagttttcttataaagtgtttcctcattgtgtttgtttctctatctttatagagaaaatatctttatatttacagtttatttcctataaactgtaaatagggtccattggcttgattagattcatgttaaacatttttggtaagggtgcttcataggtgatgctgtgtatttcatactgcatcacagcaggaggcacataatattagtttgtcccatgattagtggtgccaagtttgattatttggtaagatgacgtccaccagatctcgccattgtaaaacataagttttttccccctcctttgcaattagcaagtaatctgtggggtgataatattctagtaatatgcatatatcctaatatctaatcacctttcatctaactaatggtctttgcatccattaatggtccttgaggtttgctttttggtaacagcagggtacacttgcttgatatgtctaatttaaagccagaaaatagaactaactagaactttctcacaaactgatgacaaggaacaaaaacagaggaataaatagaattggagattttttcacaggagcatagctactttattttttattgtagtaaaaagtagacataacataaaatttaccatcttaaccatttttgatggttcagtagtgttaattaagtacattcacattgttgtacaactgatctccagaactctttaggtcttatcaaactgaaactctatacccatgaagcaactccccatttctccttcccctagcccctggcaacccccattctcttttgtgtctctatcaatttgactattataggtacttcatgtaagtggaatcacacaatatttatctttttgtgactggctgattttacttagcatgatgttctcaaggttcatccatgtggtagcatgtgtcagaatttcttcctttttaaggctgaataatattccattgtatgtatataccacattttgtttatccattcaaccattgatggacatttgaatggcttctgccttttgcctattgtgaataatgctgctgggtaaatgggtgtgcaaatatcttttttagaccctgctttcaattcttttggttatatagccgaaagtggaattgctggattatgtggtaaatctatgtttattttttgagaaactgaacataactgtttttatgatccaggctacttacatgatctaggcacctaacataaagaagcaaagtacattgttgaatgtattcttctgagacagacatgttttatttgcatgttaaaaatacaggacttactttttcatttcaacaagaaaatatgtttgcatttttcttcaaacgtgctcatctttgtttatcttcctgctctgattgtaacatgaatactgaaaacatttcactttcttcctaacttcattgtaagaaaaaatagcacgagcacaataacaaagtataactagcacttaccacagagttggagagagagtagcatggtggggactgtggtcctggagagcacggagagcacagtccccgttgagagaggacagctactccttagctccagcccattgctgccatgcgttgatggtgagcccggtgtggtcaaattttctggcctttcaagagaagctggaaatctgcatttctgtgtgaaatatcctgatttttacatattaacagccaattcagtcttttggaaacactgtgggccactcgaaacatgcctatagcctgattttggcctgtgggctccagtttggggccttactgttcaccaaagcagtcttctgtgaagggtaccctctttatgagaagcaggtcaaagagccagcaaggaaggcacccttcggctagccagccatatcagcacaatcaaacatcttggcatagctgtgtcacttccacttcattttatttatttatttatttatttatttatttatttatttatttatttattttttgagacggagtcttgctatgttgccaggctggagtgcagtggcgcgatctcggctcactgcaacctccgcctcctgggttcaagcgattctcctgcctcagcctcctgtgtagctgggattattattattatttttttaagtgaaagcaagtttattaagtaaaggaataaagaatggctactccataggcagagcagccccactttataaattgagtttgggaacttagagatgactgaaaactttttaatatagtggttatcccagaaagcagatgtcctcatggtatgttattttcaattttaactgacacctaaacacagttataaaagtaaaacattcattgtgaaaatgtaaaaagaaataggcataaaaatgaaaattaacatctcttatcctaataccagaggaaaaaaatattttgatgtatttcgttctaatcctaagaatttggcctggtgtgtataccttttcccctgaagatagaataatactatatataattttatgccttgctttatttaacatgctatcatgctatcataagcgttttcttgtgtcattaatattcttcaaaaatgtgacttttaatgctctagcaaccctgtgttgtaatgtgagctgtgataggagcatcgtgctagtgagtgaaaccctggtaatgttaccacagcaggacttgtaagcgaaggaccactttcccttggcttttcctcttgcttcttcatacctttgctgtcaccttagtgtttgtcctttctgcacatctgaaaattctgtgaattaaacctgaaagctctcttctccccactgatttttgcttcatgattttatttataacagctttattgggaaaattcacatattataatgataattcccaaattctttattgagataattcacataaaattcaccatctttaaagtatacgatttaattgtttctagtatattcacagattagtgcagccattaccactgtctaagtttagaacattttcattaccaaaaagaaacccttaccctttacccatcacttctcatttcccccagccctcctagctgtggacaaccactaatctactttctgtctctatagatttacctgttctaggtatttcatgtaaatggaatcacgcaatatgtagactttcgtgactggcttcttccatttagcatactgattttaaggtttatccatgttgcagcatgtatcagtactttattcctttttatgggtgaatattaattccattgtgtgggtataccacattgtatttgtcccttcatcaattaatgagcatttgggttctttgcacattttggctattatgaatactgctatgaacatttctgtacacatttttgtatgaacatctattttcagttctcttgggtatatacctaggtgtagaattgctcgctcatatggtaatctgtgtttaactttttgaggaagtgccaaattgttttccacagtggctgccccattttacattcccactgacagcatataagggttcctatttcttcacatcctcaccaacacttgctcttttactttttctttcttaatttttttaaatttttttttgaggcaggatcttgctgtgttgcccaagctggaatgcagtggtgcaatcatggctcactgcagcctcagcctcccaggctcgggtgatcctcccacctcagcatctcaagtagctgggactacaggcacatgccaccatgcctggctaatttaaaaaatttttttaagagatagagtcttactgtattgcccaggtttgtctagaactcctcctcaagtgatcctcctgcctcaccctctcaaagtgctgggattacaggcatgagcccctgtgcctggccttcttttacttaaaagaaaaatcgttatagccatcctagtaggtatgaagtggtatgtccttgtggttttgatttgcatttctctagtgactaatgatgtttagcatcttttcgtgtgcttattggccatttgtgtatcttttttgaaggaaatatcttcaggtcttttggccattttaaaattggattgtttgccttttttgttgtaagagttatttatatattcttgacactagtcccttatcagatatatgagcggcaaatgtttttttcctttgtgtatgttgactcttcactttctgagtggtgtcttttgagtcataaaagtttttaattgtgatgaagtccagttgatcttttttttttcttttgtcttttgtgctttgggtgtcatatcaattattttatttttagtatagcaagtgaattggaaatttgtatatgttccattattagtcattgatttgaaagagtgacgtctgtacttcagacttgtatttttctgttacttttcaactcctgacctattttgttcactctaagacatcactccctttgtatttccttggtgcctaatgtcacttgtgtttcgtagggtgtggttccaactgctcagcgtgctgccatcgttgtaggagtagagctaccagtctatgatattactaagaagcatttaatattgtcaggaatgatgggcgatacaattttaactcacttcgt

SEQ ID NO: 1300 - DNA, 10256 bp, mus musculus
agtcccctgcactctggccccttggaggggcttgggggtggtgggctctctcttcaactgcgaatagcagccgtgtggccctgtgtcccggagttagctaagtccagtggaagaatcaaggactttgcagacgtgagagttgtgtctctacagtgcccttagataaacagaatgataataaattatgccagtatgtttcgggcttggagacgctctctgacttgcccaaggccacccagctgcttagtaactgaggaggcctcctgactcctggtctagggatttttctgattgcgtcatagccatgagagtggtccaattttgaatggggatggatagatggatggatggatggatagacagacagacagatattgatatttttaaaaatatgcttatttgaatgtagttttaaaataccattcctgccatgaaaactacagggaaaaacatctcccacagccccagttccctatgacagccactcagacaggattttgaaaaagaaaactgacagaaaattggatgcttgttggggaagatatgatcaaaggagaatagagggggtaggagtgggggaacaaagatggaggagaagaagctctcagcacggattctgagaacttccttattctgaaggtttctttgatatggcctctgttcagatggcttccgggagtgtccccatcagtcctttatttcttatgcccactctgtagaagccacagatgtggtctggagaggcagatattgatgacccttcttttaattaagtctcatttccctttttccctctcttgtagtgagtacatcgaagaagggaattttgtatgtgtgtgagtgtgtgtgtgtgtgtgtgtgagagagagagagagagggaaaatgcttatgtaagagagtgtaagggtgtgtgtgtacatggatgtctgtgagtgggaatatgtgtgtgtgtgtgtgtctgaaagggagcaggtctcaaagagggaagctttgagagaggcaagggagataagaagaatgaatccgaatttacagagtgcaaactaaaaacttatagctgactagggatctgtccagtgctggtgggcctggggaaatagtcaattcttaatattccttaaaagaacaaaggaaaggaaacatatttaaattagtgcaagaaagatgatgttaaacccatgggcctttcttgatagtcttcagacacttgacatttatgtgaccttcgactaggctgtgagatcccagggcaggaacaagggctttctactccaggtagctctccccttccctccaccatctctagcatgggtggcttccatactgtgccaaggaagccaaagttcaggattaaatccattttgtaggccagttagcttttatctacatttcatagactagactaatccccacatatcacacagttagctgccttgcatctctgatcatgaaagacccagtgaaaatacagttcatcttatcccatctagaagtgtgcttcctgctgacagtgggtgagtacccattttcatcttcaaaggatgatacagaggcattcttcagcaggggacactatctgcctcattccagatagtagcacttctgctaagtcttcctctcaagtttggctcccaggtattttggagggcaattcctcaccttgcttgtttgcttgcttggcatagaaatgtaccctttggagaacactttcattctacccttttattttatcttcacagccacacttaataggtaccatgattcttgttttgtaaggtcatggatctgaggctcagaaaagcaagataatttgctctctgtcacatagttagtgagtgtgtaaacttacatggagtgaagctgggatttgaagctaagttccagtctatatcacaggaccttgccaggataccatgctgtcaggttgggggtgggctggggtaagaaatatggtgagatgcctacacagggcttttggtgtctttctcctctgtcaactcctctcctctacctttcataatagtcttttttttccaaaaacatatatatactcttcctgtaaatatatatatacacacacacatatataaacacacacacacgcatatatatgtgtgtatatatatgtgtgtgtgtgtgtgtgtgtgtgtgtgtccatgtatctatctttctttctatcttcatttcccacggaatggcacagagcaatgtataaaaataatacctcaaaaatccaaccacatccttaggaaagaaggtagtcttggtttagactttcccagttccaggcagcagatgttggtggtgaataccaagaactgctatggtttggtggaaagggcaaggcttgagttggggataggaagggagagctggttcccagatcatattcctccatggcatttttgtgcaactttagataagtcacagcctctccaaagtcttagtttgttgctattgtaaaatggggaggaaatatccaacctacctctttcccaggggttattgtaagaataaagtggcatgattcatttattcatgaatcacgaatagctgttttaattacaagactctcaagagcttataatcctgtgattcactcgacaaacacttattgaacatctattgtgtgctagggtctggagataatgggcatatggaaagcttttaagaaaatgaaaagcaggagacaaattaggcattaaaaacttttacctcctattgatagaacattttatttttaacttcttccaccacaatttaatagaagcagcaaccaaaaggggaaaaaatgatatgcatgacacagcttgtgatgccaacactattatgcaccctgatacatattgcagataatagtgagaatatctgtatcttcgtgtacttgatgtcacattgccttgtttacactatcctttgggatgtttatagcataaaaattgcctttcaccatcctgagcctgagttgtttctttagtcaataaaatttaaaaacaggattccatggaatgacgactgtacttattttacaaagatgctgtaatatgtggtggctgcctgccgtcagatatgacctaccctggcttatggaatcaggctttgattatgtgtattcttttgatttctttatttagcaatgcagaatcttgcagctagtgaaagcaagtatgggtgcgtcaatggcaagagccctgagactgaagagaactgggttcttgtccaagctctgttgtcaaattgctgtgtggtcttgggaaaacccctgtctctctgtgagcctcagttttctgacctgtataatggaggtttgggaccaggtgatggctaaggtcctatttctgaaacattctaatattataatgtttctgaaactttcttatttttttgaagccagggcttttctccatatattttaacagtaatattacctctagtttatgaccttctgctataacatgatgggctgactcaatgtattgatgaacactatccccagatttaattatcttggagcgtcatcaccacattgtataaaatgagccatattgttcattgcatcagcagcctttgctgaaatggaggttatgggataacaactttaaggctaactcattaatgctctgggatgaataagctaatgtgtcagcagaccaaactggtgcccaaatgttttcgtatagagacccatatctctttcccatgttgtgatacattaatggggatgtctttatccattgccgctgcctgtagtcatttgaataatgtagatgcagtaccttctgggcacccagccccattcactatcaatttcctaaactttgaggcactctcagaggcttggaccaaaattctagtgatgccatagagtacctaatttataaggatttaaaccatggcatcagtgcagtccctgcttttttttttccataggtgtttactagtaagcactgcaccattcttaactattttatgggggtaatggagtaaattagtcctccaaatcatgaaggctgtagatttatgcctagttgaaaccatttcagtcctcacaatgttgaagtgggtaacctttctgacgttaatttgtttctccatctgtgtgccatgcattttgggaggacgtgagaaacaggcttgatgccattcaagtgtgtttcccctttttgtattgatggaaacttgatttgtgcctgtccgctctttgttcaaattctctctcttgatatctgctcatattctagcccctttacttatccaaataaaatcatatatatatatatatatatatatatatatatatatatatattgctagtgacaatgtagaattggatggcttgaaagagaaacaaattttgagacatacaggcactttattaatctgaataataacatttgaaatattaacctatgcagttagtttttctaaattttataaaatgttttttttaaatacttgactctgctgaaattggagaatgaagaagaaagatatatcccttaaaatctcctaagatctctttacataattcaaatttagtggagaagagtagattgttcaatggattgatacaaattctaattttatgtaattacttttgaaacatgattttttttgtaaactccagccctctgcaaagaaccttcactattaacatgtttattaaaaaccaatgctaaataccacacataatattattcattcaactctcagacaaccactgaaatggatactgtgtcatttcaccattttatagagaaggccactgagactcagagaattcaactgactttcttaagatcacacagctaagaaatctagaggctggctttgaactcagttatatttggctctaacactagtaaaagtatttgtctaaagatagtgtttctgcaaatgttttgaattctagactgaaactgagctggtttgctttcatcttgcttttgaatctcatggtctcttcaggctagtgccatggtatactgaaggggtaaggggaaaacactttggagcaagagaggtctcttggcacctctttcctgtagggagcctccttttgtgttcagcttgaaatgtcaggcctgaagtattcaaatctcaagatcctgttatgtgcctctctcatagtgcgaaagcctgcctactcattccccctccccaccccacccatctgcttcttgtctggggacattggtcttcctaaatctgcttctgtattgtatgctactggcaccttgagaaggttgaaagcaagtaaggcaatgccaatttttctgttagaactgcagcatataactgctcttaagtttagccctgtgtgctggagcagggaggcaatgacaaacggtttattctaaggcctttgatttccttcggaattgtaagcatctaggctgactcatctctcaaaggcttttctctctctctccttttggggctgttgttgattggggattttactgtttgttcttaccttatatttgggggagagaagggactgattttcatcttatttttgggtgaaaaaaccagctctgctctttggatgatcagatctggtaagcttcgataagaagaaatagctgaaactccaaaacaggtacaaaagatatctggattggggaaaggggagaggggagtaatgttagagaaattaagccagagctaggctgtgtgtctcaggatgagaccctagactaataggctctggacctgctattttgaatggggaattgctagaggcttagtctggaactgtggttaaatgcatgtgcctttggttaaaatggtcactttgcaagttgcagtttggtggttggggttaggtgttcactttgggtccaggggatggagctttgcagttgaaggtttaatatctatgctaggtgttttcctcttggtttagttcaaaagccacaggaaaactcctcatcttttctcttactgcacctatttctgacatctgtgatcctggctactaagggaagtaggcaaaagagttttggagacaaaattcaagtatggtttatttgtttgtttgttttttgttttttgttttttgtttttttttttttggacagaaggtagctcatctatttagattattgcatgataaaccgttacttaacttttctctgccaaagctgcattgcctgatctttgaaatttaagctccccaccccccaaatcatatatagaatgttattgtagattccatgggaaagagacattcagtaaagttgtatgtaactacttcctttcttggcaaaaggtttagttccccatctcctgaattatcttctctatcaggaaccagccatatttacccaaaccatgaacttgggagctatcctaaattgttttctttccattgcaattaaagatgttccctaagccctgtcagttccatccatgagattcgtcccctactccagccctagtgacactgacttgtgtcaatatcccttgcctcttggctcatctacctacttccagctctctacccaaaacaggctttttcatggctttctgtgatttttccaaggtgcaaccctgaatctttcactccctgcctaaagccctattgccttcaggaaaaagtccgactctttaagctggcttatagggccatccatgatctcatccctgcccatccagatttttctccttccaatccctttatacagcttcaagaatatgacaacctctctcccatctcttttcctttgcacaagctgttctctctggatgctcccctcctctgtctccaggcagatttagctgttttctcctttctgctctcacaatactttgtttatatcttggaggtctaacatcacaaggttttgtaaattgttgctaacttgtgtatctccttcactgcactgttaaatctttaaaaaaaaaaaaaaagaaatagtattaccttgctcatcctttcaatctttagcgcctggcacaaagtgggcaattaatacaggtttttgttttaatgaatgaatgaatgagtgaacaaatgagtaatagagaatgtgcgggaaaggatgctgtgtgaggtgtaggggcataccccattggggatgctttgtagtctggaagtagtataagatagtgggcatcatggagaaggcacatataaaataggttttaccattacactaagacaaactccactttgataccaattctgtttaaggagtctcactagaaatggtctggaaatgatgtttgttggttttggtacaaatgatttttttatgaaaaagtaatataatgaagttgtacaatgtttggtaaatagagaaaagcaacaggcaaacaaaatctcaccagttaatgcaaatgctgttagcatttgggtgcatttccttcagtcttttatttttatgcatgtttttcttcacatagttgcaatcaaaattaatacaattctgtgttttgtatttgttgttaaaaaactctttgtaaatataactttaatgattgcataatttttccatactgtggccattacaaaatttatataactaatatcattgctgggctagctttttttccctttttttgttactattatggtttatgtggatatgcttttccctgtctgtaggaagattttattaggatagattcctagaaggggagttactaggtcaaagggcctggggacgatttttggctctagacccatgtgtccattttgttttctggacttgtctgaatttgcagctctcctaacctagatgaaagtcccctttttatccaacctggacagcatcgagtatcgtcatggaaagaaaaaaaaaaacctctaaaaacgctctaattaattaactaattaattaatggaaaatactatcttatttttgtttcaaagtgcttttgttaaaaaatgtttttctcttttattttttcttcttattttctctctttgtactttttttttctaattaggttttctttttcctggactatctgttaagggctgaatttttgaagttggattttttttttcttttttagcaaaaacaaccagaggctgctctgcttgagggtgaagccgcctcccagttttccctccccctctacccccacccccatagttctctccaccaggtccagtgacaattggatgatgcagccttgataatcatccgattccagaatgggtggctgcattccttttctgaaggcagcaagggcactgtgccccagaatcatgccccctttgctgttgttgtccgccttcatttttttagtgagtgtcttgggaggagccccaggacacaaccccgaccgcaggacgaagatggtatcgatacacagcctctctgagctggagcgtctgaagctgcaagagactgcttaccacgaactcgtggccagacatttcctctccgaattcaaacctgacagaggtaagctgtaccccggattgtggcatcctcgccttcgggagagtggaccctccgggcaggacggggcggattaggggtctggcagggtgggaggggctcacgcctgatctcggacttgatcagttctcctggcgtctggggaactgaagaagccggagttgaaggctgtttgttgaattgcggaagaggtaaaaattagttgagtttggtcgaaggctgggagttgagggggcagtaagacagacgggcagatgtcagggacagacaagtggacagagggccggtgaagagacagccgcagcaggtgcggtgcgagaatagggcagagcgagacggaagcgcagagggacactctggagagaactgggagagatagagacagcgcggtcgagagacagagagtagagggagatagcaagacagtgcgtgagagagagacgctcctagccgggcggtgaacgggagggcggtgcgggcgcgggggcggcggcaggaggtgcgcctctagcactgcccacctcagctggctgccggggagcgagcaggacgcggcgcaggacgaggttcgagtgcaccagggaatctcaggggtaagcgcgcggatttggcagcggagcccaggcggttagcgcggacccaggcgcgccccagaggtattggaaagtgctgggggtggcagcttcgctaggcgcgcaccgcgaacgcagcttgaattgagcgaagcaaagggcgaggagcccccgctggcagccactgatgccagattcggagtgcggggacagccaggtgtcgccgcttctcctaccgcagcgcagggagccgacggcaacctggtgcgagcgcgcccgcagtaacttggcgaccctcacccgcggtggcgctgcaggagagcccctccctcccctctcctgttgcgtgatctgggggcttcagagccccggaatttatgttttaagtgttgtattgagcgactacgggtgcgtagcaagatgcgcggtgcgcacgcggcgcattagattgtctggtttggttaaattcttggagtctgataagagtgagataggcttgtccttgttgttaggtggggaaactgaggctcatagaaagcaaattacttttcgcccgctgggcagagctcgcctctctgccgctccctccccctgctgcagatcagggcattgggatgttttagtcacttattaagtcctatttgtaagtgtatcttttcttttttctctttctgtagctctgcctattgaccgtccgaacaccttggataagtggtttctgattttgagaggacagcagaggggtgagggggctcttgtattttctttagaaaagaaatagaatgctaaccccctgtgtagtgtggccctggctattggagactgggtggcgtccactgtcccaggggacactctcctcagctcccaaaccccacagtgggtgatatcaggaaatggcgcagtagctgtaggtgcttggggcggtcctctcagaccttcctggtggactcaccccacacagatcaacccgaagaaatcgccctctttgtttcaaggtagtcacccccagggaaaatttaaggcagggacctcgagcctcgtcggggtggttgagtggagctgagtcctttcgccaaaccactgcggggtctttttggctagctccccagggaggggcgctgcggttctggagaggtggggttggctgcgggtggttgctgggaggagtgctacagcccctgcttcctcctgatttaagcgctgcgaggctttgacgtttctcattctttctctcgtggctccccagctgtatcacacaagacatttg

SEQ ID NO: 1301 - DNA, 10256 bp, mus musculus; identical to SEQ ID NO: 1300

SEQ ID NO: 1302 - DNA, 5034 bp, mus musculus
gcttttcgcgctgctgtcccggggccgccgcaggcggatgcacgtcctcaggcgacgctgggacctgggctccctctgccgggccctgctcactcggggcctggccgccctgggccactcgctgaagcacgtgctcggtgcgatcttctccaagattttcggccccatggccaggtacgttctaggtgaaagcggggttcgcgctcccaggccagggcgcgaaggtgctgtacggggagggaaggcagccgcggggggtagagaagggcgtaaagttccagctggccattggtggcccggctagggtctccggaggggtgcggcgcgcatttgcccacgccgcggctccgtcgctactgttccgcgggcaccggcagcgcagcgtctccgatagcaagtcgggctgccggccggctcattcccccagggtaactctgagcccccggctccgagctccctcgaggccgcctaccgggtgggcaagcgggcgcgggcgccggcaaaaggagggcttcggggcatgcggggagaaacccggacagaggtgtgcgctccaaagaggataggggcagaagagcccggagagtccggcggacgaagcgggatggggatgggagcgggagccaccgagagtggagcgagacacgcgggggcccggactgggggcgtgagttgaggagtggggcgactgggcccggaggggtcccactggggctaaaccccgtggaggggctccggggagctccggagagctctggcggggggagggggcgaacggcccgcgggaaggagtcggggtgggggtgtgtgtgtgccgcagaagccacagcgctgagcctgccgggaaggaaggaagcggggaagggagccgccgccgcagccgccgccgccgtggagtactcggtgcggaggggagggggagaggggcgcagcagcggctccaggggaagggggcggtgcgggggcacgacgagcgcgggctgagctgcgggattgacgtaacgagcttgggtttcccccagcgtcgggaacatggatgagaaatccaacaagctgctgctagctttggtgatgctcttcctatttgccgtgatcgtcctccaatacgtgtgccccggcacagaatgccagctcctccgcctgcaggcgttcagctccccggtgccggacccgtaccgctcggaggatgagagctccgccaggttcgtgccccgctacaatttcacccgcggcgacctcctgcgcaaggtagacttcgacatcaagggcgatgacctgatcgtgttcctgcacatccagaagaccgggggcaccactttcggccgccacttggtgcgtaacatccagctggagcagccgtgcgagtgccgcgtgggtcagaagaaatgcacttgccaccggccgggtaagcgggaaacctggctcttctccaggttctccacgggctggagctgcgggttgcacgccgactggaccgagctcaccagctgtgtgccctccgtggtggacggcaagcgcgacgccaggctgagaccgtccaggtgagtgcgcgccggtagtcgagcgggacccgggcctaggcgggcggagggctgggaggcgcggctggcccaagccggggacctagcgcgcaccctgacgcccgggcgtttgcaccccggctgggcaggtgctgggcgcccagtagcgcacgttcgccgcgctgtggcggccacagaaaggctttccgctccggccccggactgaccgtctgtctgtccgcagggtggcctgcgtgatggttggcagagcgtgcgggggaggcggccgagcggccggaacggggccgctgggacggggcatcgtactcagtctccgcactggagagccctaaagagccgcgctctccgtgcagcgtctctggatccctgctttcttctactctgcacccgggttccgaagtctcctttcagcgctctcttcctcctttcggcgcccgcattcttccctccccccgctttcccccctatttcgtctatttgccttgttctccctctttctctcttgtgtcctagatgttgtctgctcctgtttgctcgctgtttccttctttccattcccctctctcgcttttattctttttctctcttaccctttctgtttttctcttcttgccggacttttatcacctcgctccttccccgctctggctctggtcttcccgggcgactgggtgtccctctgtcgctattttccgacatccaaggagagctcatggttcccaggcttgcttatcactactggctgcatgagaggcatccgtggctctttgggagtggcggggggcaccccgcggaccgaagggcgggctgggatggtgccctggaccccatgtggggttcagtcaccaggagcctctcctgatttacaaaaaatatttaaaaagcttgagccccagcatggggcgctgccagcccatgttctgtgagcctgggctgatgcggtaaaagctgatttattaatagtctgtagccagaagcaagggtattttcctccctccagacgcgatgtccagttgctagaggtcatgcagtactgtaaagtgggtggtggtggggtgggggaagtgagtgctatggggtgcagttagtccagccagggctactgtttcgcaagtctccttaaaacaaatctgggctgaagcagggagtccagggggtgcacaaggtgagtttcatggcctggaggcctctggatggggtctctgggccggcaaggacatgtctgtgtcccatccccatcccccgggtgcacttggtaccctggacaaggggatgctttgcaggtgactgttagaacgcaacaaccagtgtggatttttctgtccaactgcagcaaatagagccctagagccctctgactttcagattaccattgagatttaaggggaacatcaccccctggctctcctcttcactctctcttctctcagtttacactgtcctttctcaaatgctggaattgtgtcagaatctgccaaacttgtatttcctttccaatactaacaaattttttcttccaccccaagaaaaccttagccccaggacctcaatccattggtacaattgtgtaagtcattgtcacaacaatattctggtgtttaataagttcccaaacaatttggcaatattgaaaagaatttctcatactgacagaccttgtaggtgtattgagaggtggtaatatttaaaaagctcttctgggcaaaagtagaattccacagccatgactatagcagagaagtgaaaacaaggtcttggtcaccatgaaagccatggccttgtctggagttccatggggcacatgtgcctttactgatccttttgaacatgtaggtcagagtatgatgtctataaacacacattattaatgtggtctagattatctgtttggtggctactgtcctctggcagattccttcccgcattctccagaagataaccagaacccctcaaagcctcttggattgtcccaaattgaagcaaaattatttgaaatgacataggattttcttggttattaaaagggtgatactacagtagcatctagtctaatcaaagagcaaccatgttctaaaaagtcacagttactggattttacggtgtttgcaaaaatgaaataaaacttgctagagaaatgcattgctacctcaagggcacctttttatttcattcattcctgcccacctccagaaatattcactttgaagaatagggatagcctaggggttccagaatttctctggatgttgacagatcccctaggaggttgcaggaccagttctgtgagttctgataatctgtaagagctaaggtgtgcatgtgtgtgtgagaatgagagagtgtgtgtatgtgactgttgtatgtgtctgtgcgaggcaaaaatttagaggtaaaggcagctgcaccgatggtgaaatgtgggggtgagaagctggtgtctggaaatgggagagtctgcttttgggagttcctgtgtcaaacagcctctccatgccagctggtggtctctgtgctcctctcaactgaggggaacaacagttccacctttctggcctgggagttcagacagctgggccttagttctaggccagccactaaccagccatgtgaccctcgaccagatcctgtgtagagagtgcactccagtttatgataagcgttcatatcccttatctctggtattcctctgtaaacctgcaccatcttcagcaagaggccagagtggacaaaaggatccccatttatcagatgagaatgaagcccaaaaaggctaaagggcttccccggggtcactgagtttttttagcggcacagcaggaatctgactgcacttctgtctgactccacaacccttgctctgttgactgcaccttgatgaacaagggttttttgcaaaaccacagtgaggtcttgagttagtcattcccacaaagtgaatgaacacaataaatgttggctgttgttgttatcacctacatcattatcatcgtcagtcattttacaacatgtgagtttggatgagtttttgggccaggattaccacacccattgggagaagaacggatttctacatccctaaggctttctattcactggggataggttttgtggctagattgcagaggggtctttcattgccatgttgggaatccctgcaaagctgagcaggatgggagcgggctgaggcctggttggatgagcttcagtaggagccttcagctgcgacaggaaccacctactgactcacagccattcatccacattagggaggtatcagaggctattgtggctgcaagccaagactctgaatcctgcttccagtgctacatttgggatgcttctctgcctccgcggatggttaagtgcttgggtgatatataactgctgaatagaaacaaccgtgatcacgttgcctggagaggacaaagagagagagagagagagagcttggctggtgaaaggctcaagttgtttattaagaataatatttctt

SEQ ID NO: 1303 - DNA, 5034 bp, mus musculus; identical to SEQ ID NO: 1302

SEQ ID NO: 1304 - DNA, 584 bp, mus musculus
gcggggaagggagccgccgccgcagccgccgccgccgtggagtactcggtgcggaggggagggggagaggggcgcagcagcggctccaggggaagggggcggtgcgggggcacgacgagcgcgggctgagctgcgggattgacgtaacgagcttgggtttcccccagcgtcgggaacatggatgagaaatccaacaagctgctgctagctttggtgatgctcttcctatttgccgtgatcgtcctccaatacgtgtgccccggcacagaatgccagctcctccgcctgcaggcgttcagctccccggtgccggacccgtaccgctcggaggatgagagctccgccaggttcgtgccccgctacaatttcacccgcggcgacctcctgcgcaaggtagacttcgacatcaagggcgatgacctgatcgtgttcctgcacatccagaagaccgggggcaccactttcggccgccacttggtgcgtaacatccagctggagcagccgtgcgagtgccgcgtgggtcagaagaaatgcacttgccaccggccgggtaagcgggaaacctggctcttctccaggttctc

SEQ ID NO: 1305 - DNA, 584 bp, mus musculus; identical to SEQ ID NO: 1304

SEQ ID NO: 1306 - DNA, 989 bp, mus musculus
agggcgtaaagttccagctggccattggtggcccggctagggtctccggaggggtgcggcgcgcatttgcccacgccgcggctccgtcgctactgttccgcgggcaccggcagcgcagcgtctccgatagcaagtcgggctgccggccggctcattcccccagggtaactctgagcccccggctccgagctccctcgaggccgcctaccgggtgggcaagcgggcgcgggcgccggcaaaaggagggcttcggggcatgcggggagaaacccggacagaggtgtgcgctccaaagaggataggggcagaagagcccggagagtccggcggacgaagcgggatggggatgggagcgggagccaccgagagtggagcgagacacgcgggggcccggactgggggcgtgagttgaggagtggggcgactgggcccggaggggtcccactggggctaaaccccgtggaggggctccggggagctccggagagctctggcggggggagggggcgaacggcccgcgggaaggagtcggggtgggggtgtgtgtgtgccgcagaagccacagcgctgagcctgccgggaaggaaggaagcggggaagggagccgccgccgcagccgccgccgccgtggagtactcggtgcggaggggagggggagaggggcgcagcagcggctccaggggaagggggcggtgcgggggcacgacgagcgcgggctgagctgcgggattgacgtaacgagcttgggtttcccccagcgtcgggaacatggatgagaaatccaacaagctgctgctagctttggtgatgctcttcctatttgccgtgatcgtcctccaatacgtgtgccccggcacagaatgccagctcctccgcctgcaggcgttcagctccccggtgccggacccgtaccgctcggaggatgagagctccgccaggttcgtgccccgctacaatttcacccgcggcgacctcctgcgcaaggtaga

SEQ ID NO: 1307 - DNA, 989 bp, mus musculus; identical to SEQ ID NO: 1306

SEQ ID NO: 1308 - DNA, 109 bp, mus musculus
tcatgctatcactttggactttcatttttcagtctcagatagagataccttgtctgaattcatacaagctgttttcagtaccaagtgatttgaaagtgataaaaagaag

SEQ ID NO: 1309 - DNA, 11800 bp, mus musculus
tttttccgtgtagctttctgcttcttcccggcattcctgtttccgttttctcacagccctctggcttttccaccactgagacactttgcgctcaggacttcagtgacgtcatctttctgcggcgcgcggacacccgccggtggaagaagaaacagctccgccgtccttcgcttcttttgctgggctgctgctccttcggcatcatggcgccgtcgctgtggaaggggctggtgggcatcggtctctttgccctagcccacgccgccttttccgctgcgcagcgtaagtgcctggggcacggggaccgcttcggtgtggaaccctaggggcggtgtgtgggcgcacttctaagggaccatcggaccgagtgtcagattaatggtcctttgagaccttacagtttggggtgactaagaaaatcagtgcaggagttcccagtggaaggttcggagtttgaatttggagagagtgtggcacctgaaattgcaggaaggttggaaggaggtgtctgggagagggttcagaataggagtctccaggaatccaggacaagtgatgtcagatccagcatggggcagatcaggcacagttgtgagattgaggactctggttgctcatggtcccacgacaaccaagtggacaacatcttgggcactcttgggctgtccaggcagagactgagtagttaagtgaccgattgcctcagggaggcactgtggtacaggagaaagagcactggactgggagtctaaaggactggttgttaaaaacttgcattaccgctacatctgtgtgacgttgggcaaaagatttgtgctacactgcgttatgaaattcagttttgggtcgctgtttgaaattgcgctgtgtttaggtgctagagatacagtgatgccctgagccagttcaaagtctaaaggaaaacaagtggatcaagaagtagttacaataaagtgatatgctaaaagtatataaggatgcatggaagcagggacagtcatattttgggggaactgggaggttaaggaaagtatcctagatccttgctgcttacagtgtgatcaacagaccagcatcatgagcaccacctggcaggtaattagaagatactcaggccagacctgttcaatcagaatctgggttttaataagatcccagggtgatttgtatgcgcattagtttgagaaacactgtcctggaagagattaggatacactggagtactgtgtcattttctacagtaagctttaactgtagaattatatgattgtggggcgagaagggcctttggagttcactgaagtccaaccccttcattttacagatgaggaaattcctggttaaaggtagtgttagaagcaggcgaggcttcatgcaaactagcaagctagctaggaattgaaccagataggagattagtcaaaatcgatttttggtgttggtttgatgtttcttttacacttgtctttatgacagagctgtaggttaaaacttaagaaatgtctctaaacacattcttcttcaagagtcaatacacatgcactcaaaaacagtttgaattatttagtccaaagtacgttattaaatagggattgtcctaggttcatctagaattaagatttttgtattttatgttttgggtgatgagaatgccttgtggatttgccactgcagtgagacctctttatatataatgctcatgttagggagagagtaatatgtaactttaagactaagtgtgtcatgtcagactgtagcagcagatagcacaatgtggtgctgtggcatgctcatctttgctgtaatgaactttgttacagtagggcaccagtcatttactgtatcttgtttaatcctcacctcacattattctcattttactgttgtggaaattcaggtaatgaaaaaaatagatactgtatttctttgattctaagacacccaccattttaacactctgaacttgagatatgtattatgatcactgcgggcttctttaattaaatgaaattatagtaaattgaagagctggcactgatttaggcttaccagtttccaaatcctgatccttttcttttatcccttgctgcctcctgaggttaaggcagcagcagcggaattataattaactagtagaggcagaaattgatttcatggaattcctattccaccactgccccagcgtatcctctcaggagaaccatttccataccagtattattttgtccatactgtgtggttggtggtggtgctatttcagagttgagattttctgtagactttactttttaaataattgtgatttctttggcgagttagtgaaagtaacggttttgagaagtttctagtatttctataataatgaaagaaaaattatactaaggtatttctgcctcatacttgctcacttgtcactcttacccattttataaggtgacaaagcaggtcatgatgaaaataaaatagttgactaagatagagctgactaccttagaagatagaaggttttgaggaatccaggattagcattactttatgtagcatataagtcagccacttctttttttattttttattttattttattattattatactttaagttttagggtacatgtgcacaatgtgcaggttagttacatatgtatacatgtgccatgctggtgtgctgcacataagtcagccacttctttggtatattgatttgcttcattttaagaaagaaaaatgaactacagtttccttaatggtatgcttctggtttatagatcgttcttatatgcgattaacagaaaaagaagatgaatcactgccaatagatgtaagttggtcatttatattccgttacatgtatgtttaaaatcagccacatagcttgtaataattttttttttactggtttttcgtaaaatttttcagacatgaaataaaatctgatctccacttttcttttcttttcttttctcttttgagacggagtctcactctgtcacccaggctggagtgcagtggcctgatctcagctcactgcaagctccgcctcccaggttcacaccattctcctgccacagcctcccgagtagctgggactacaggtgcccaccaccatgcccggctaattttttgtatttttagtagagacagggtttcaccgtgttagccacgatggtctcgatctcctgacctcatgatccgcctgccttggcctcccaaagtgctgggattacaggagtgagccaccgcgcctggcctgtgatctccacttttcatcactcataaagctcaaagatttggaaaggtttctctatttggtttctagagctgtagtcgaaatagtctttctcgaagatgctctgtccatagtatgggatggacttaaaaagttgattatttagctttatttcttagaaaagttcatttttatgtaagggaaataaagccaacagtacattgtttagggacatacataggtggtaaaatgaaagtggttttagttttttttcttttttttgagacaatgttttgctcttgttgcccaggctggaatgcagtgacgcgatctgggctcgttgcaacctctgcctcccaggttcaagcaattatccttcctcagcctcccaagtagctgggattataggcgcccaccaccacgcccagctaatttttttgtgtttttagtagagacagggtttccctgtgttggccaggctagtctcgaactcctgacctcaggtgatccatctgcctcagcctcccaaagtgctgggattacaggtgtgagccacagcgcccgaccaggaaagtgttttttaaaactaaaatgataagtattccagcatcactcacaatttttatctttactagacttgaaattacacaagtagtaagttctttgtaacagagtcaaacagtaaaaactaaaactgaccctacacaattataaaaacaccaacaacagaagaactggccccgttccttggcagttccacttctactcccaacagtttggagtatagcagtagttcagtcttcttcctatacacaaacagcattatgtatgtgtagttttacctaatccaaacacgtattattttttctttaaaaagttatacatgtgtatatatgtatagttttataattaacttttttattacttaacaacttcagtcttactttcatgacagctcatatagattcttgttaaaagtgcctgtgactgtgttatataaaacaagtcttctggccaggcatggtggctcacgcctgtaatcccagcactttggaaggccaaggcaggcagatcatgaggtcaggagatcaagaccatcctggctaacacggtgaaaccccgtctctactaaaaacacaaaaaattagccgggcatggtggtgggcgccttaatcccagatactcgggaggccaaggcaggagaatcacttgaacccgagaggcaaaggttgcagtgagccgagatcatgcactcgagatctgcactccaacctgggtgacagagcgagactccatctcaaaaacaaaaaccaagtgttcttggtagactggtggtgggaatgtaaattggtatcgtatatgatgttagattttaatttaaacaggaaaatagattgtggctaattttgactttgtctgtaattaaatatatgattgatgaggctgttaactcctatcaccttttttttgtggtagatacacacacacacacacacacacacacatacacatatttatgtctattttaaagaacttttttctataatctgaacatgcccataatcccatgttggttaaaataaaacattctgcgtttttgctcgctcaacctctttggaaagcagttgatattactcaatcaaattgaacatgtgcatactctacactcagtgtttccatgtgtgaactgggcgacatgcatatgaatattcatgttgattgtgaaggtaacaggaaacaacccacatatccaataacaacagcagaatggataaattgtggtattttcatatcatgaaatacaaagcacagtgaaaactggccgagcacggtggctcatgcctgtaatcccagcactttgggaggctgaggcaggcggatcacctgaggtcagaatttgaaaccagcctggccaacatggtgaaaccccatctctactaaaaatacaaaaatcggttgggtgcagtggcgggcacctgtaatcctagctacttgggggctgaggcacgagaatcacttgaacctgggaggctgaggttgcagtgagccgagattgcaccactgcactccagcctgggtgacagagcaagactccatctcaaaaaaagaaaacacacacacacacacacacacacacacacacacacacaatgacataatgttgagcgaggaaagctagacacaaaagaatacatttgagtccatttaaataaagttcagtatgggcaaaagtaaggcatatatgttttagagattcatatatatttaatagctggtaaaattatcaagaaaaacaagaaactgagtaatatataattcaggaccatagttaactttgagagggaaggtaaaggatatcatctgagattgacatgtggaacttgaaaggtactaggaatgatctatttcttaagctgggtggtgggtacatggtcttttaattgctttatgctgtgtacatatgctttctgcactctatgatatataacaataatactggctgggtgtggtggctcacgcctgtaatcccagcactttgggaggccgtggcgggcggatcacctgaggtcaggagttcgagaccagcctgaccaacatggagaaaccccgtctctactaaaaatacaaaattagcctggcgtggtggcgcatgcctgtaatctactcaggaggctgaaacaggagaattgcttgaacccgggaggtggaggttgcagtgagccgagattgcaccattgcactccagcctggataacaagagggaaacttcgtctcaaaaacaaaaagcaaacaacaacaacaacaacaaaaaaaaaacaaaaacaataataccttaaaaattcttagttgctcttggaagcaggtaatatttgatcattgagttctgagtggctcagtaccattcagtactcagtgattttgcttatttgaacactagatttatttattgaagcatcagaggtatttttgcagccaatccacagaatttatagattgtattgtgtctgaatcccagtcatttcaagtgagcattgtctccctgatggtggccctgagaggactacctgttagaggcaatgaagaggtagagagaaaattgtaaatatttataataatgtttgtgttatttagtattatcaatctttatactcacagatagttcttcagacacttctggcctttgcagttacctgttacggtatagttcatattgcaggagagtttaaagacatggatgccacttcagaactgaaaaataagtaagtctttctcttttcataggcattgcatttcatagaggtttgctgtattcacataattttaaaaagtatgttttctgatacataaaagttggttttgtttctgcattttgattacacagtttgtatgaataatgaggtaaaaacattgaggcggtatttgatactgtaagaaaatggaagatgaatgccagattattcacagtagaatcaaaaaaatacgttgcttaaaattattggttggttgtatggatgaaaatagatatatagaaaaataatgcctcagaatttttaacctttctccttccattccttccttgctccctttcttcccccctcccttccccctttcactccttccatccctctcttcctaccatcctctttctatcctcttgtcccagcttagtctttggaagagtaagtggttttcggtttcccctctcacttgaacctagtatgtgagataagctctgctcccaggcccttttctactactggattaaaagtatatttgttattctgctttcttttttttctcctggactacttctaagctattttcatgagctatgtttgcttttatttttcatatttttactttcctaaaatcatcctttagctttgttcagttccatctctggactttacccaccttcttgatcctggacatgatgcccctttacaatattttcttagaaggagtcacagtgaacatttatgtgttagaggaaagtcatatcccccttttagttcattatgtacattttatttatttttatttctttctttctttatggagacagagtctctatcaaccaggctggagtgcagtggcatgattttggctcactgcaacctctgcctcctaagttcaagtgattctcctgcctcagcctcctgagtagctgggattaacaggcacctgccgccatgcccggctaatttttgtatttttagtagagacggggtttcaccatgttggccaggatggtctcgaactcctgacctgaagtgatccacccgccttgggttcccaaagttctgggattacagatgtgagccaacgtgccccacccaatatgtacattttaaggagttacatatcaggcctcttttttgtatgggagtatgcttggatgtttaggtgggctgagatttgagtttttgtcaaaggaagagttctcctatcctttccaggaaaataatattgaaaaacaaaaaccataaaggccacacaccaaggtgtttgtgaactcttttagactacatatctctcactggaaaagtagaaaggatactttactgtcatcactgcttgctcttacaaagagtctaccaagaatcacaggcaaggggccaggaaagaaagaagtaaaacaatgtcattaagtaggtggtagaaaaatatgtgtttggacaatagcaggtacagagggccaaaaggaattttttgttgtgcttgaaagattcttggaaaacagatctgtgaaacgatcatatggcttgaataatgagggccaaatgagaataatcaaagctgtaatctatgtgctgcttttttaaaaagactattcgacatgcgttactgttagatttacaggggagattaatagttgagctagtatttgtgttgttattcataggcattctggaaggaatggctggataaaaaaaaatattagaagccgggcatcatggctcatacctgtaatctcagctctttgggaggctgaggtaggagaattgcttgatcctaggagtctgagaccacctgggcaacattgggagaccctgtctctacaaaaaataataataaaagaaagccatgtgtggtggtgcgcatctgtagtgccagcacttggggggctgagatgagagggtcgcttgagtccaggagtttgaggctgcagtgagctatgattgtgctactgcactccagcctgggcaacagaatgagaccctatctctattttttttaaaaagaagaaatttgagagctatatgctgcttttccaggtttcttattttctttatataggaaaagagatacagtataattattatttacagtctgatttcatgtattaatacttgttaaaaaatataacccatagtaaattgataattcgttagaagcctacttattttcaagtagggttttataaaggtttatctaaaattgatgcttttttcttctttcaaggacatttgatacgttaaggaatcacccatccttttatgtatttaatcatcgtggtcgagtacttttccggccttcggatacagcaaattcttcaaaccaagatgcattgtcctctaacacatcattgaagttacgaaaactcgaatcactgcgtcgttaagatttttacaaattataataataggacaggacacagagctggaatattggagtttggggtataaaacactcctccctgcccccattagtatttatattgatctttcagacctactttagtaaaaaaaaccatggcccttgtttatatactgttaatccaatcattaatgcagtgtaagttatatgtgaaatgagtctttggtatttcatataggaattattttttttttcatttaaaacaaatccacatcttttgtaaaagccactgttttgaacacatttccttgaaaaatgttggtggtttttgtgattatttatttttttagatttcttttcttttgcactacaatttttggaatccttttggaaatactgtgtgactgctgtgttttgcagcatgaattatagtaaaatggtcttcaattcttaacaaatggacttccctgatgagaccaaaatggtgatttaacagtttttcttgtgtcccctaaaaagtggctctgcttcagaagtacttgccagtttttaatttatttgtgacttttcaccctaccctgctcccatataccttctaccatcagctgtcttgtttcatcatttctctgagattctgtgtgcagtgagcaatttttgtgtcagaaattctttgtcagaacaaatatatgtaacaggctcaacttactgtaaagctacttgtgttctcttcatttgtctgtaaaaatttccctaattgattatatagtgtaagaatagttgaagactagttgaagaccttttgtgatttcattatcatgcctatgcagaagaaaaatcattgaggaaaattgtcattagccagtttaactgattcaaactctgtttatttcatactaaactagtgaataagtgaaataaaggaaactcgtcattaatctaaagacagagttcaaaggaattgggccaaatatattctcagtatttggaactaatgtttttaaggtttttaggaaaatcaggtcatttaagaaattgttttgtagtttctggtttatagcagtcttcaagttttccatcttcactgtatgttgctgaaagtgaggatgaggatacagagttgatatttttagaaacagtaattttacttttaaggaaattggctagctctttgagctagagagctgtaggaagctcaacatttctttgtagagaacgttgctttttttggattgtacaggtataaaaacattgcttttgttgaattgtataggtgtaaaaagggaataactgtatgcaggtttgaaaaggaaatgtgctttaggcatgagtcataagatgccattgtacttgtaggcattttattttcctttagaaatggacatcagctcttctcttctgactggtaacacatagccccaaagcatgagattatttttcattgggtttttattgttgtttagttttggtttgttacgccagcccagtctgtctgcggaacactgactctgctctctaatgagaacaaagttagaaatctgccgataacctaaaataatttagaaatgaattaaaaatgtgaaatcgggttaaagtgatgatgataaaatagcatgcaagaaacaagctccttccatcagacttggctactgttttcttctggtacgatttggtttggaagagcctcttgtttccttctctttggggtatgtcttcgtttcttaatatgtttgtaacattattgagatataattcacataccttacaattcacttattttaagggtacaatttagtggtttttagtgtattcacaaagttgtgtaaccgtgaccacagtcaattttagaacatttcgttaccccaaaaagaaaccctgtacccttgagcagtcacctctcattttctcccagtgcccaccccatccccgagcccctggcaaccactaatctatttctctctctgtagatttgcttattctggtcatttcatataaatggaattctacaatattcggtcttttgggactggcttcccaaatatgattttctatatggagtgagaaaattcttctcatcttgagaactcttattgctgtgaaagggagtggttggtaaaatcaatagatttcaggcaagagggccagatacctaacaggtttttctccgtgaatcttatgctgagtagtttttcctcataaccaagcatttatgatatattactacttataatactgtggctagtctctagaatggatgttgaaatctttgcctcctcagtcgggaagagtcctgctaaaaatcaggctaaaaatcaggccaaaaatcaggccaaatgacttggcaaataattgacaaagtggttttcacgtgtgtctatctttgctagcagcttgtatacctcaggccaggtgagctccccaaatttcttttttcatttactccagtgagtttctgctgtctttttcaagtatgtaccataggacttaaaggtgatttggatgcgttgtaacactgctaaatatgctaagtacagaattttatctacagtactgtgagacagtcaattattgcctagggtagttcaaaaatatgatgtgagctagttaagcctttgcttgactgatttcagtgatattcagaagtgtgtaccaatcaaggctctttaaaatacggaacgactcacttaataaccagggaaccagccaaatactgtgcagccgcagaatatgcatatcaatgagttggaggtgattattctctgtaactccctaatgattgttttctaagcattgtggcttctcagtggcttgacagcatcttcctggttgtatgtggcctgtttacatgatgtattgaataatgttgtttgttgtgagcatcaatgcctgtaacaccaaactaaacacgtgtttttgggatatgtttccaatctttaaatgaccttgccctgtccaataaataaatgattgtct

SEQ ID NO: 1310 - DNA, 75 bp, mus musculus
aagctatgatgaatttgattgcattgatcgtctgacatgataatgtatttttgtcctctaagaagttctgagctt

SEQ ID NO: 1311 - DNA, 75 bp, mus musculus; identical to SEQ ID NO: 1310

SEQ ID NO: 1312 - DNA, 77365 bp, mus musculus
gtgttgaagaggggatttaagctcatacccagactgtggtgcttttgaacattttcagtggtaggagtagcgcgatattccagcgactggaaattcagctctaggtgtcaggttgcgtcaaggcagaccttcaggcgagcatgcagtttatttgccattcttaaccaaatgaatcttttacactcttttctgccttttactagataaatattacaaaaaaaataagagtcaccgatctgttatttctccatttatgtgtgctacaccctgggatggaaaagcagacataacgttttctgtttgcacaaagtttttaatgcattaactgtaaattaggcttgtttcaaaaaggcttaagtggttgcaaagcatgcttatgtggctcgaataatcacataaatattatttcagcgcaggagtctatattcagtaaaagaaaattttggataacatggctgttattggtaaatgagacacttgattgatctatggttattcataattgaaaatcattttaattaagaactcatatttttgataatcatacttctgatatgaaatttgaaaaattagtatgcactgattttttccttcctaccaacaaaaaccctgctcttttcacacacattttcactaatgataattaatatgacaagatttgttaatggtggttgtatctccctcctcccttttttggtataaaaggctcaattttccaaatacagtttccttaatggggttccacgttatttatgcattttctaccttcttagaataaaggagattatttattcaaattgtggtcattctgaaggaaatctttgctagtgggtttttggtccttggtcggttggcagacaactctgaattatctttctatttctccttttcctttcacatgaaaagtagcacaatttcaaaaggcagaatagccatttgccaacccattacaaatactcagtgagatagagttccactctgtaaaccaaaggacaggttatcagaaactatagacactttcagaagctttaccaatgtttccagatagaaataaaatgtttctttagtttgaaaatttattctgaaactcagagtttgttttctttcttccagacaccttaaaagtgtagtttgactttttccattaagatttgtaaatgaaattagaaattgaaattcctagtcttttcaactacataggcacaatttatcaattgatccaaatcattgttctctttgcagagcctcagcttaagggtatagttaccaagctatacagccgacaaggctaccacttgcagctgcaggcggatggaaccattgatggcaccaaagatgaggacagcacttacagtaagtgactgcaaaataaatagtatatgccagcatgttgttaacattctgtttttatttattttaaaaataaatacgctttcctaaatcctgaattaaatgcaaaatatattcacactacataatcctgtttacacaggttaacctaaaggaagttgaatatgagtctgtctaagatagtaaactagggcaaataatgttgacaccatctgaagaataatccaaatgtcatctccatggaaatctagatagatttatggctatcctttggattttattacttttttcccacagaaaatttactcacccacacactgatccagaaatagcatgttatctctactcttaagaaccggtcttaacccaagagagaggagtggtttcataccatgaaaattcatcattacaagctttcacttctgctccctgctccacacacacactgataactctgagactagtggaattttaacattgagatacctccgcaggtgggtaaagggatttcttttagttctttctttttaaccatggtttcagaccaaattggagactataatggtgagcctaaaaaagaaacacataaaaaataattaggttttatttccaattactgaaagaaggtgattccaagatgttacgtaacctttaattacatgttttatttattaggagtaataaaaatataaactcacaaatagtgcaggcttctcctcaatgatgattgatgttttcttgcaatttacagatttctggagacttactaaatgttccacaaggctaaaacacttagttctcacaattttttttgttttctccaatttctactgaatttctctcaaaccctttgataatttcgcattaatattccaattgtcggctgagaaaataaccaaggaaactaggtctgaatgctaagcagtatactctgcagctttttaagagttgtatggctacagcaatgccattgacgagggtctcaataagtgtaaagagtttcccaccttttaggaatgcttcgtgggctgatggccgatctataacctcgagaggaagtcacttttaattaccattgaagaaagctttgttggtatggaggatgaaaaaacctcatactgaatggttcttcactgttttgcaaaagttctatgtcactgttgtgatattaaagttttatagtaaatcctagttgttcttttatgcatagtcttctatttgaaactattaggcaagtgtaactagagggctttactgtaatcaaataacagacattagtgtatagtgatcatctgcaataaaacattcccataagttattgtgcaaattgatatttggggaaggaattaggggatgtaagctgccctgctttccagagtgcctcaggaaaatgggtctgttgagcattattgaaggcaagttcatgattagctgccagtgagcctatccagtcacgtttctttcccctttttaacatctccgggtacaaatcagagaagaaatattttggatctggtgttcacatgtgtttcctgaaaagaaataaaaaaaaagtagataattcatgtgctgtgtcctatgaacagcaatataccaaattcatcgagatcacattctaagtaatcattttaagagatacacacacacacaccacacacgcatatatcaaggctccatttcttactgtggagctttaaatcatacagtaggttttactcttcagttcctacatatgcatagcttctgcctttggttgtcttataactgactgatacgcatggcatttctgtgtactactaatgatattgaaagaccattaaagaacatagcctgataacaggaatctgtatttaggcagattaaaatagagaggtaagtcaactaaaggtaagtattgtcataacctgatgcatacaaatggaaagtatctcaatagaaatagcaagtcagtagagcttggatctgctcctgatgttaagagtgaccagaagctagtgagctagctcagctttgccattgaggatattgtggggcataagccatcatgaaacaagaaggtttaatgattaaactggtatatcatgaaggccagctatccaaatgtattctttttttttccttaaaaccaagccgttttattggtattaattgtttaattgtgcataacgagaatacaagttgtttttttcaactatcactcatgtatataatatttccctaatatgtattcgtgatactatgtttatatttttcttactcttcttatttttattaaccttcattattttcagcatattttctcatttagtttaatttgattgaattgcgttatttttattcagacatagtaagcaatgtcctgataaatcagttcacatttatccagatatatccatttctgaaaacatatgtttgatattatgcatttcaccttaccttacgtagatttattacaatgataaatgtcagttcaataaaatctcatcatgaggaaatcagccattgtaaattatgtattttcccttgaaaaggaaaagatgatagacattccatggcagtaattttattatgtctgccctgggtgcaaggaaggacattttaaaagactagttttccctttctcttcaaactcacggtagcattatcagttcaacatgttgcctttccaacctacgttaatatatactttcattaattattctcttttgagaaattgaccttggccaactgatgaagaagcatggcttcagtgttgccttcagcaaacactgggtgccaactaggtacatggctctgattaagtggcccttcaaatagaaggtgtttgtttttatgcagacataacagagaacaaacaagaaacacaggcacatttatgttttaaaagcttcttcaaaactttcactgaaatggaagaagagattttaggtatttaatgaatgtgttttaaatccataaatgaagtcaactgttttcttctcatgtttatagtatttttatcctgatcaaaataatatattaaatccatgaggaaaggtaccagatatagagaaacaaaagcacataggaggatatttatttggtttaagctcacccctgatataatttctttgcatttttatctgggcagactgtccctttagacatattttaaacaaacccggtttatgatctatcttgaatgtttaaagaaatgaaaagatcgtagtagtatgatcagtcaatccctagattcgctactctcaacaagtttttattttggggtgatgttttttgttttttaatcaggcttcatggaaatttaaagtacatagtgaaaagtacatagttttgctatatagttaataccattattcaagattaaataatcacaggaatgtactgctgatgtttttttcttctattcctccttctgttttctgatgtttgaaatttagacatttcattgctcattaaaacctgagtcagagtgattggagaacacggtgaaaatcaaatcagttttttttagtctctctctgtttctttcttgtgcttgttataagctgcattaagagaactaagaaagttcataatattattttaaaaactgaagttctataaataattctgaatttcatttatcattctctgtcatttattactatgactaaactaggtgtcaagcatatactgatattatagttgtcaagtggtatgtagtgatatggcttttaaaccaaccccatgttggaagttttgctttagttttttagatctcagattttttgaagtatgagcttttatataaatgggattgtggtctcttacttttcaaaaacatagtatcatattttcaccatacagattgctatcaatccacaaatgggtgttgaacacctgctgtgaacaagacatcgtcaacagaaagggatatgacaaacatgacatgctcagagatgtcagacttcttgcctgtgtattgcattgtcaaatatagcatgagatcttggcttgcaatctgtgcaattacattcctttacctcacataacagaagggcacagcttttaatttgatgagtattgaatgaagtgccatcagtggcatgtggtaggaacacttgtcttttgaaccgtacaatatgtcctagctcctctttggtaacaccctggttttaaaggaacgatacgttgtaggctcaccaaggaatatttaggtcttcattagtatttctcatccatattaccccacctactgcagcagaatgtatatgcacagagataaacgatcccagaaaaactattcttacccacagggtgactcctttacattcttgttcacagaaaccataacagactgatttattatcctcaataaacttacaaaacaaggcaaaatcatcaacattggtctacgactcctgagagaaaggtgcacaggctattttcaaaagatgtgtgtggcaagcactacgttttaaaaatgtactgttttatttttattcacagtgtgggagggagtagacagctggtagtgggaggacacccactagttgtctccagtgagtggtgtgtggttgtgaggaaagcctgggtgtaagtttcacgcagtcagatcttcaaatggagaaatgaagtcctcactggcaccaactggctgcccacttgcaactattttgctaaaataataataataaaataataaaataaacctctttcaagttcattatttttattcctatgtcctttgttcttggagactaaaagctaggagccctctcaactctaatcttggaaaatgttggtcctttaagaaatactactctgaagccgggcatggtggctcacgcctgtaatcccagcactttgggaggccgaggcaggcagatcacctgaggtcaggagttcgagaccagcctgaccaacatggagaaaccccgtctctactaaaaatacaaaattagccgggcgtggtggcacatgcttgtaatcccagccactagggaggctaagacaggagaatcacttgaacccaggaggtggaggttgtggtgagccgagatcgggccattgcactccagcctgggaaacaagagcgaaactctgtctcaaaaaatgaaaaaaggaaatactactctggaaacataggactacaaaatgactttttctttttacaagacctgaatttattttggagttcttgtatttggaataacacagataatttagatgagggcattggactcttctaaaagtctaggactctctacccaacaggtagattttaaatatgactgtgagaatttcagcagttatcttggggagcagtttaaaaccttaatttgttgagaatgacactatttaatgtacagaacaattcttgggactgtatctttccagaagcatcaagattccccacctccaacactgtaaaaaccatgaaattgtgaccaaaagccttccattttctccaggctgttaaataatatgtagttacagctccagttacctggctgcaaccatgaaattaaatacactaaaaggtagaatgagacctatctgtctgcctcggggtatgtgtgggtgtgtttgtgggggtctgtatgtgtatgcatgtctacataaacagacatatatgcataccctcaccaactacacactacttttggaggaccaggcagtcctgctggaaacattgaaaagttctgaaattcagaattgtaacactgttttcattttcttttttaatttcagctctgtttaacctcatccctgtgggtctgcgagtggtggctatccaaggagttcaaaccaagctgtacttggcaatgaacagtgagggatacttgtacacctcggtaagcttttgactgtgtgcatgttttgactattctagttttcatccaatatgaaagaaaatgtgctttatatgtgttatcattacagatttctgtgatgaggagaagaatgttgatggaaatatttcattgaaaggacagattaactttctgtgaaaaatatatctattactaatcagttatttgaagcaagcattttagtatataatcaaagattcactgaacattttttaatacagtgtcatttgggtcatcttatgtagcatataatggtctgtcttgctgccttgctttgcagctgtgggaaacaaagtcatttctataactcagttgaacatatatttatccaggtttactcctaaaaaaacatgagatctctccctcagatcagctcgaggacatgaaaaccagttcttgaagggtttctagagttctatttcttatcttcagtttaattgaacaggattcctgattgcttctgctttaaatataagcactatttaacctttccttacctataaattcctgcttgtctttttcttgtaactttggagtgaacagaatgaaaaatggaactttttctcagatgaatgtataaacaatgtagattacaattcaatatggaacatggggccaaattaaactttaaaaaaagttaacatttagatataagcaaaatgatacagtattagggttaagattttattcttattggcagatctagtttcagattataagagactatttgatatatgaatttttattttaacttaattaattaattaatttatttatttatttatttgagatagaatcttgctctgtggcccaggctggagtgccgtggtgacactccatatttttagcagagatgggtttcaccacgttggccaggctagtctcgaactcctggtctcgaatgatccgcctgccatggcctcccaagttgctgggattacaggcgtgagccaccgtgcccagcgtaatatatgagtattttttaaatctttgttttgaattcatgtattttaataaaggaaaagaatgtttaaaatggagaaaattgcttgtcgaacttcttactagcaagtcttgaagcaggttgttagtataacaataaaaatctgttcctcaaacttcaggtgaaacactacctttaaccactcttgcttgcttgtttcctgaatttctttcaaagccaggtgtgcaggaagactcttggcagatatggtggaaaccatatgataaccctgttttgcagaggccaagatgggaaagaggtgggaatagagtaaggccccagagggcctgtttatttggtaaatcaggtagtttgtttcatatgatgagaaaagattatgaaaaaaagagaattatcagcatatacctcaaaccctggtcactatcagttttcctatcaggcaatttcagtggtctggttgcttaataaatatgggggtttgctctttttactaaatgaaaaatgtgattttatggcaaagttcatgaaatacgtcattttattactagagtgctactataaaagataggaaaggggattttattttagatttgtgtactaaggtaagataatttaataatgaaggattttaagtaatttcctttagatcaacagactgcctcagcaggaccagatacaaaggtaggttttttaataaaatagacgctttctgaaaatattgtgaaggcatgataaggaaacggaatatactgggcatacttttgagaaagcacatgccagatatcatatgaaataattactgataaatcatccagaatttcaatgggttgcagtcaccgttatggtgccctgatgagaaaagctaactaaatataaattttgcaacatcacaattgaagaacgtactttggaaataatatttaagtaagaatgtggaaaattatttaacttgggttatatgtcaggtgcccccactcaagaaaattagggcactcagcattacacttaaggaaccagcgttgaaaatgcatagcctaccattcaaattaatcattattccagcaaactggtaaatgtcaatgtgagctcatttctagaaaggcttcccagggaaatgaggactgtagattggtgaacttcctttccgtgatgggtgggccaatatacatccaaatgtggcacatcttgtatgtatttcctattaagaaaaaagaagccttaagtaagtgtttctattagagaaaaggaactatgtttttgttaaggaggaaatatgcctgcttgatgatcctggagttcatatatggaaagaatatccaaattagtctgctccaggaaataaatcagaatcctctttagaattaattttccaattcttccaattactccttattaattgtggctgggaatccattcaccaagttgatcaccatcctcagtgggcacttcattttgttgtcatcttatttaaagtgtggtgcccagattacttaggatggagttctatcctaataacttcagcaacttatattgctgagatcaaaagcttaatgaaatatcatgtttcatcaagaagagacagcaaccaaagaggaaggatcactcttcccttgcgtaaaaccatggcacttctactacaaaatgctatatgcaattttgcaaagtgcctcttagcaaagagaagacagaacaggacaatgacctaaagagaaagcaaaagtaagcaaaggaggtaaggggctactgatgtgggcaagttaaaaaaaattggtgagggatgactacagtctgcttaaaaagcagttgcagtgggaatggctaaaaggagatggattgctgagatattttagaggtagaatcatcaggatttggtggctgattggatttggaaggaaagcaggaccaccatacatggttaaacatgtatggttgccattcactgcacagatgagaatgaggtgtcttcaggtaagaattaaaaaaaaaaccttcacagaagtcagaagtgctcagtggattatcaggcgtcatgagggagagggggaattttgcctctggcatttaggctgaataaagcgggaaaaagcagatttgaggaagttacctgagtatagctttcaagggatatttgaaaatatgaacctagcacttgagaaagggacatgaactagaaataaaactcgggagttatcacatgtaggtagcagtccatgccatggaaatagttatgaaaatatgtagcataagaagaggagagagcttgtcaaataatgttagaaaataacagcatgaaagtgaccagcagaggaagaataactaattatggcagatatagtggtattgcaaaagctaaatggggaaggagttttaagaagagtcagcaatgtgaaatgtttcatatgttgtgggtgatcttaacaaaaacagttttggtggaatattgggaacagaagccagattctagtggcttgaggagtaaatgggatgagaggaagtagaggcaacaggtatagaatttctaagggaagggaagggaagggtgggtgtgtatttagggcagaacacagggttgaggaagactgaggattctttggttaaggatgtcacttgaacatatttgttaagtaaaagaaatgaacaaatagaaagggagtgattacagacataagaaatggtattctttatggagtcgagctgcagaagagatggaagggtgatggaattaagtataagtgaaagaattacattcatcttgaaaagaagggacactgaatctctaataggagacaaagagatgaggacagatgcagacataggtttactgagtctgcaagtaatagacaaggaagtagaagaattttctaccagatgatctgcatttttccattaaagtagaataagaggtcacctactgaaagtcaaaggtatgggggtaaccacaggtaaacaggggtgggaacaactgttttgggcaaggggaatggaaacagtttaataaacaggagtaggtaagctaaggccgtgggtcaaatccagcccactacctgtttatgaaaataaagttttattggaacgcagccacacccattcatttacttattgtctacggctgcttttgcactgcaacagcagagttgaatagttgcaacagagcccttatggcccacaaagcctaaattatttactaaataacttgtcccctttacctcccagaaagtttgctgacccctagattgtaatcagataatgattctcagccttaggtacccatcagaattacctgaggaactttaagaaattccattctttgtgttacatttggaccaattatatcaatatccaagggtgggatctacgcatgaatattttcgaaagctccccagctaatgcttatgaaaaccactgatctgagcttaagaaaaatggttgttgaatagcactgaggcactgaggacacgccactgaagtcagaaaccatgagtttatatgcacttaatcatttgttccaaattcctgataccaatgtttttctgttcttgcaagcaaattgcctttacatttttgaaggaatatttcttgagatgatggaaaatgctgatccctggaagagcgttcttattttatctctttttctttattctaccttcttttgcatttctacttctatatccctcaattttgggggggttgaattcaactttatagtttttgccatttattttctcccttttgtccattaaataaagaaacgacacctccacattgttattgttacagagatagcaatttactttccatgattaatctcagaattcttgcactgcaccctcccttccccgccctttttttttcttgttgccatgggggacagacttgatgtaggcacatctgtggcacagagaatcataattagccattatttcataacatatttacttttgtccatgatatatgctgagtctttctgggactgcaagaaagttgttatttgttgtgcagagataattttgttcttacctttggttttctttagcaataataaggagttgtacacaagcttttgagagttcctcaaaacttcacagtatgaatatttaataacataaagctatttgtaataaatgttttaaaactgcttgaaataaataatcattgactatagaaagtcaagtgtcttaaatataaaaaaaattcccgttctatgtctactttaataagaaataacagatattagaaacaggatagcaaaaactcaaagttaaaccaaaagcattactattattttttttattttggaatgttctagaactcattagcagcagttctacccatataattacttacctttcaaaaaattctagttttcctttttcacaatacacagtattgcttgggttgaagttggggcagacaaaacgtatagacaagtagaaatcctttgacaagcctttttcattcatggatttccagggaaaacttgtaggagtgattttactgtcacgttttgtagtcctgggactaccatagcaaactagatgcaagaccagaaagcagtcctctttctgagagtcagcttgatgccatgggaatgagacagcttgtgttactgatcccaacggctcagtcagattgcaatctgaactaaggggacatatttttcttctctactggattattttcacataccttaaatttaccgtttcttctctcattacatagagttgttcttacctatcactcagaacatctcataatacaatctcctttgaaggagtcactatcagaaatagtgacaaatgaaacaataccagccccttagcagttgtgacaccttagcttcacttgttttattctttgacaacttagatttgctttcctttaagaatgttacatgcctaagttaatatttaggttatatttaatgcatttagcttggtttttaaaattttataatttttcaacacatattgcaaatttttggccattgtaaaatcagttaagaattactgttttaaacaaactaaatatgagaaatataaatattaaatggaaaaattcttcatttgaccatgcctctaaacacgttacatttagagagatgcatttgattactgaggtgtgtgatatatgaatacatgcataaatattcttagaatgcttttgctgatgaatagggaaaagcccgagatggcagcccaagatgcagcatttgctacagataattcaattagtaagtgttttgtcattttccttgttctcaaagacactgacattgagtttgtcagtcatatgttaacattcttggtaacttcagaatccctgagatgacccgtccaacaaaactggtctcaagttctgtgaccttttttagctgtaaggatatttttctattcctcagccttatcaatctcatggccatactcttggaccttttcatattccagactattgaccgcttttccattatctattacctccttctttttttaaacagcttgaatgagatatagttcacagatcttaaatttatccatttaaagtgtgtacaattcagttgtttttagtatatttcacaaggctgtccaaccatcaccactgtgtaattctagaatacttttatcacgctaaatgaagaaattataccaattagtagacacaccttatcccgttccccagtctcaggcaagcactaatttactttgtctctctatggatttgcctatttggaacatttcatacaaaaggaatacaatatatggccttttatgactgtctcctttcacttagcataaagtttagaagactcttacatgttgtagcatgaatcagtacttcattccatctgatggctgagtaatattccattgtatgttcctacattggtttattcattgtcagttgatggacatttggattgtttcccccaaatacctgcatagctgcttccttctttgttcacgtctcaactggaatgacattctttagaaaggccatctctgaccaccttaactaaagcagtacattcactatctgtattatccacatttatcttcttcaaggcattatcactatttaaaattattattttgtgtgtttttcatcttccccaactagaatttaacatgttgacagcatatattccatttttcttatacactactatatccccagtgccttgattaatgcatgctgttgttttctcaatacatatttactgactttgttgtcttcaaaagggaaagcaaatatgtacttatagtccgattttagttgcgttgcttaaaattttttatttggaaacaacttcaaacttatagaaagtttgcaagaataacactagtacaaatgactccatatatcctatcctccgattcattttgctccatttgctttatcatttgttctttctttcccacacacacacagttttctgagccatttgagagtatgtaccctggcactttacacctatttcctaagaatagggatattttcttatatactgacagtaatgaactgcagtaaatgtaacattaatacaatactttagctaatctactgtccatattccaattttttaagtaaaaaatatgttcattttttccttccgtagagaatccagtctagggtcagttacagcattggcatgtcttcttagtctcttttaatctagaacatttccagagactttctttgtgttttatgacattagaatttttgaagacaagagtccactttctaattttaaaataagcattcacaattttgggtttgcttgatggtttttcttaattcaattgagattaagcattttagccagagtactgcttaggtgatagtatgtccttcttagggtatcacatctggaggtatgcagtatccatttgcccctcattggacgttaattttgatgataaaatcaaggtgttttctcattttcccctgtataactcttggttttctgggtttgtgtgtgtgtgtgtgtgtgtgtgtgtgtgtgtgtgtgtgtgtgtgtttcaactagtaaataatccactgggagacactttgagaccatgtaaatatcctactcctaagatcccagtttttaatgttatgttttcagcaatcccaaacctctttagaaaagtaaaataattagtccataaattgagaaataaccagtgattcccagatatgtcatataagtttactgatagctaaactgaggtagaaaaaattaacatggccgggcacgtgggctcacgcctgtaatcccagcactatgggaggccaaggtgggtggatcaccaggtcaggagatcgagaccatcctggctaacacggtgaaaccttgtctctactgataaaaaatttaaaaaaataaaaataaataaaaaaaaaattagccgggcttggtggcaggcgcctgtagtcccagctactggggaggctgaggcaggagaatggcatgaacccaggaggcggagcttgcagtgagccaagattgcgccactgcactccagcctgggtgacagagcgagactccatctcaaaaaaaaaaaaaaaaagaaaagaaaagaaaaaagaaaaaattaacatgtatttccaaaaaataaaaaatgtcataaaaaatatgatctggcagcaatttctggattccgcattctagtcactgggcttaaatacaattaatggaaaggttgtttgcattgtttaggtgcaataaaatcgattctgatatatgttttaatttcataccatgagtagggggttggttcatgttaagatgcctcagatgttcagtatgtttacctgtcaaatgcagggttacacttttgctgatttgtttacttcctgtgattttaatgtgtgacaatcgaagacctaattttcaatggtatggctttgcatctttagctcttattctaatacagaaaggatgtcaaactttagatgaactcattgatcaatttacagtgatgaatgtacttctagcaaatatttgtagcatgtaaaatgtttgaattatattagatggtatatcagcaagtacatctaatttaaattctagggttactttttagaggcttaaaaatctaatagaattaaatggagagctttgtttaataatgaaaactctttaggaaagtgatatggactcaattattgaaggaaattgatctaaaataaacacaagcagcatcacatccaatattgaagaaaatgatcattatcaaataaaatcaaaaagcataggcacaaaggtattttaacttcagattaaaacttttgcttattgatatatatcagttaattaacaaattgttgaatttggtttatttaaaattggaaaagtgtttactatcaaaacttaggttcctaattttggtgtgtagtatacatttgataaacttttttgatgaatcatttagttttatgggattaaacatttctgatgaatgttttcagttcacactaatggtttgtatgggtaattatacaaacacatatatttctgaatgctatcactagaaatggaaaatatagaaagttaaatttttacaggaaaaaagcagagaaaataagcaaattttatttattaccaaatggatctgctagctcaaagagctagattttatgttttaaagaggtgtccagctattgagttggtgttattaagatgaaagtctttaaaattattgcagtgaaaaatatacagaagtagcagtattcatcttagattttacttccaaacacaagtaaatcagcttaattttcaaggccaaaaaacatttcctacatcacagattatttcacgtttattattctttgcaattaatgtaagtttcactaaaatatgaagaaaacctagcttggcattatttgtatgtgaaattgcataagtctggttgcttgtacctattttctctttatggactctaagaaaataacaaaaatgggtaaagtattcagggtgatggtctagtgttttaggtgtaagaatgactgagaatggtactttctgggaaatcagggagactattggttgtagctaaatagaatgtgactggctctgtattctgtttttgaggccaagttgacaaaaaaaatccaaattagaggtcatggagcacatatttaacagagtgtttcatgattttaactctgaagctaaattcatatttgtgggaaaaagccagactcttgaagctaaacaataaaataattggcaagaaagactaagaggaattttagcaagtaaagccagatgtaaggggatttacacacacacacacacatacacacatgcacacacacatataagaaagacaaatggaaaaatgtaatgttatattcattgctctgttgctataacggcactagttattttggaattcctaaaataattctaagttttaaatacataacctacactgaacatttggaaattgctctagcaacatatttggtaatgctaagtacctttatgaaagagagcaaatatgactttttagctttattttatgtgattacccagtgattctcatgtcttggtgaagacgttgtttttagtctctatctcctcgtttgtataatgttaatccacaacatgatagaaaaaaaaaaaaaaacagctcaacaaaacatttttccccatcaaccttgtgcattgaaatagtttgcctacaaaatcctatgctcattaattagtaactgatttgttttctctctacttcccccttagtcatagagcagcctagcaaaagtatgtttttaacacatatttattgaaataattaatagagatgtatataataaagcataaagactgatgatattgtttctgtcaggcctattgaatattttaaataagttacagagaccaattatgaacttttgtgggtcctctgaagtgttaacatttcaaaattacataagaaagtgaattactgagacacaagaaaaaaaattggaagctacagcactggtttcagtgactacaccacttaaagggaattgtgacttctgaacagggaagttttgaatgaaagcattttctgatcattataatagctgtaaccaaggttaataacgggcaagcccctgaataatacagttaatatgttttgtccagctgaatgtgtgagtagataacacatctatgctatcattctgattaagttattcatcagataatctgatgctaactacttttgacagttctggaaatagaactactgtgaaaacctcaattgatttcttggatatataacacctccttttaaaagggcctcagatgtgtataggaattctggcatatcatataacaaaagtaattaaaattaggtgtgatgttcatttttacccaagaaaaaatgtcctataaagatttggaagagtcaaatgtaaataacaaccccaaagtattataacttagactgtaataatacgaagagtgaaaaatgtctgatagaaagagatgtgagtcattccataatactttcataattgtcaatgagataccaggaaatgaaagtcatagctttcagaaatgaaattcgaaaaggtaaaaacttcattgtgtatagtaaatactataacaaaaaagcctgtgtgtaacaaatctactgctatatcctggccacaaaatcagcaaggctacaacaacaaaagtcctctttagagtgcttggtggttgatctgattaaagacttcttaaaaatatttaaagtattcccgggctccttcccatgtcataacagtgattcactgtaattaacgtgttaatgaaagagcctctttgcagtgttattttcactgaggaagatagagcctatgggagacctgaagctgagagcttttatattgtatcataacctttgaagcagaaatttcctgaaaactcccttcattgctcttcaagtctcagagagcccagtcacacatctaatctcccagggaagtcgaagcataaaatggtccacaagctttgccaaccaattgattagcatatacctgttgaatatccataagatactaggcaccccaaaccatgatcatgttgatccattcatactgtcaatgtctggaatttatagtatacataaggagattcatcccaaattcagatctgtaattgttaatagttgatctactacaggatcagcataaactgtttcatcctgacttctgcagcttggcaatgctatttttagcccagaactcactgtaagaagattccatatagggaaacaatttgaatgccttgggatgggggtgggtgagagtgcatcattatggaaatttaccagttatatcaaacaatatatattggttgcttggcaccacagactttagcagatcacactaagatcatgcttctatgccatgaggaggtaaaattgaatacactggacaatggttttcaattatatcaagaaatgatgtaggataaaatgctttaaaatttttatatatgtgtgactcagaaaaaaaaaaggctcccacttgcccagcacaagtggattacagtagattcaaccaaccaaagcttttagatgtatcaaagtccacctcacatgtttggccaatgacacagggatatatttccctccatttttctataatttcaagttccaatagtaggcataacaaagagaaacaatgctgacccatagagatataatttcctgaagctataacatgcaatatatattaacacctgatattttgaggaacagaaagtgcttatttctctaaaaaaaagagttatcattttctactattgactttcatgagtgatgaggaaagagcaaagttttgaccctcctatctcctccttctttgagatccccattactcatttaccccttctctgtgattagatgggtggttaacactagaagcaataagtggatacaaaacacatgtattaaagctcttcattacatttatgttcctcatatctttaccagtaagggaagcgacctggccaactcattatgtttctctgtactcctctagtcccaaaaataattatttgcttgaacaaaaaagttctgctttcagtagggctgtcaaaaaatcaaagctcatgtacattacaagggtatttcagtcaaacgattattaaatttcacataagaaaatacactcaacagacactttaactgctatctctgatcaaggcatgaaactgttcaaacaaataattaaacttgaaaatagggtgtcaacagaaccatgatgggtggttttgctgagttattttctttgctgtggaactcggccttaaatgtccacatggagagcaaatagagcagcattttattttatgttctcttttccaataccctacttacttgaggtatgctttctcttcagattttgaggttagacttttcttctctataactcatctttttgcctcctctgctcagcggcagctatcttgaacctcagaagccttggtgagactaggagtttcagcatcaagagaggtgtttggtttggtttggttcatttgtttttcagtatctgtaacacattctagtgatgcctgtcagtttgctggaaccactcatggtccttgctgtcagaggcaaggctctgccacttggggcgtgagtgtaggtgtagacccatggagaaagttgttttgcaacaaactgcctggatagtagtgttgctttgtaattatgtaaaatcaaaacattcaaaagatgctggcagataaatgagagataataatagtaaagaaatgagaattccagaaatgtaaaacaattctgaattagatttatttcagacttagctacctttctttttggcagacagagcaccattcttgggagtttcagggaatcaaaatgaaaatgaaaggcagtttcttccacaaggtttttagtattctctgaaattctgactagcctctgcccctcagggttcaacagtgtgagagctcttggtccagatgcccagtaatctctgtatcacctctgtagtaagaaatacagtataaaaaggagtaaattcagttatttagtagtggaaattacatgatgacagatattttcaaagatgcttatcattgattttctctccatctgtgctaatattcacatgcatacctatgcaaataggctttaaatgatttgatttcatacccaaaagtcagattctcctgttgttcatttagcatttttctattaggatatttgaaaaaagtattttttatggtaaatatagaagcatttgagcagtcttctttttatatggtcagttttccattttgaaggggaaacacttgtccttgtcagaattattgtgaactgccttagtttaaaaattggaaccaaaatgagatttgattgttactggggtaggtttttttttaagttttttactgatatgtaataattgtacatatttagggggtacacgtggtattttaatacatgtattcaatgtgtaattatcaaatcagggtaactgggacatctgtcacttcagacatttctctattctttgtgttgggaatgtttcaaatcttttcttctagctattttgaaagatacaataaatttttgtaaactataatctccctactgtactgtcaaatactagaatgtattccttctatctaactgtatttttgtacccatgaaccaactttgctgcattccccctcccacctacttttcccagactctggtaaccatcattctactctctacctccataagatccaatttttggggccgggcgaggtggctcatgcctgtaatcccagcactttgagaggcccaggtgggcagatcacaaggtcaggagatcgagaccatcctggctaacatggtgaaatcccgtctctactaaaaaaaaaaaaatacaaaaaattagccgggcatggtggcacgcacctgtagtcccagctacttgggaggctgaggcaggagaattacttgaacccgggaggtggaggttacagtgagctgacatcgtgccactcactgcactccagtctgggcaacagagcaagactccgtctcaaaaaaaaaaaaaaaatccaattttttagttcccatatgcgagtgagaacatgcagtatttgtctccctgtgtctggcttatttcacttagcataatgacctccagttccatccaggttgctgcaaatgacatgattttattcttttttgtggctgaataatattgcattgtgtatatgtaccacattttctttattcgttcatttgttgatggacacttaggttgattccatatcacggctattgtgaatagtgctgcagtaaacatgagaatgcagatatctctttgatatgctgatttcctttcttttggatatatacccagtagtgggattgctggatcatatggtagttttatttttagtattttgaggaacctccatactgtcttccataatagctgtactaatttacattcccaacagtgtacaaggattctccttccttcacatccgtacccagcaactgttattttttgtttgttttatattagccattttaacagagttgagatgctatctcattattttgatttgcattttcctgatgattagttatgttgagcatatttttcatgtgtctgttgaagagttgtatgtcttcctttgagaaatgtctattcaagtcctttgcccaatttttaattggatttatttatttatttatttatttttgctattgagttgtgttcattatatatgctgcttattaatcccttgttaggtggacagtatgcaaatattttctcccattctgtaggttgtctcttccctctgttgattgtttccctgctgtgcaggaactttttagcttcatgtattgtctattttttaaattttgttttctgtgcttttaaggttttacccaaaaaatctttgccaagaccaatgtcctgtagcattttctggatgttttcttctatttcacagtttcaggacttacatttagatctttaatacattttgagttgatttttgtatatgttgaatgtggtaggttattgtactagtgaaatgctgacaaaagcatgctgaaggaagatagatcattattttgttttggattcttacattgctttaaccacccgtgcttaattgttttattattatttcctgaaatattattatgcatcattgaatactaagtcagcctttaagaggctttatatatacacattctaggctttttctaagtataactaatcatcaagtataggtgtcatttacacagtttgtttgagtcactcctttaatatgatataattttcttagctgacattgtatagattttatcaaacctaaaattgagtaatacaagaaattctaccaagacatcagtgtcatttgcatagaggcgtaagtatattaagatctctgtatgaaatgtgttgtaagagtatgaaatattatcctactgatttattgaataaataacatgtattaatagttaaatcttgctttttatatgtctcagagccctgaaccttacagatctcaaacttcatatagtatttgcaagtcaagaaaaatgaaaattgggcacattgtgaaaaatcctggaatgtattaccaacaaattgttcatttctggcacattaattatttcacaaattgttcgtcatgttcccatttcacttttataagcacagtaacactctcttttacagaatgttgccaacatttaatttcttaatgaatcaatgactctttcatacattataaataagaatataggttcaccttaccaagtggctaaacagcattctctaatatttgttggagcattagggaaaagctgatggcaaccagtatcagttttgcataaatagtatttttttcccttagaacgtaagattaaccttttttcttaaaagttagcagcaagatgttaaaacgtaatattattcataggaagtttaagtacagccatagtaaagaatttttcttttttattagattttattgaacgtttatttgctgttactgtggtcacgcaacctgttaccgtctcatcacaaacagcatttcatttagtatattgagaaaagtgctgtttcaggaagccacatgcagtgctactagatcagaatacattgagggtcaaaagtttatagggacccttgataaaaaaaataataaatgttctcactctatatagggggatctcatctgagggaatttagtttgtaacatgccaaataaactttgctataaaaatagtttccatttaaattgcttctaggattctaagagtaggattatagagacagctcagtgtaataatattaaaatacatacttttaagtatggcaattcatacttttaaagccctattgcctgcattatcttacatcatactgtgtgcacttgtcaagtgatcgagaaaagctgctgtatttgggttgctattttgaactgttgaattaaatataaagtccaagtaaatatatttgtaacagtaagtaaatcgtgataatgtgcaattcatcattttgtccatttttttttcatttatgacagtttttttatggtgtagggtcacactgaaagggttatttcattctagaagttgtagatgaagtacctttatttgttaggggtgctggccaagaaaccattaattggctttcttgcaagatacaataacttttctttagttgtttgatgagtctcaatctcgtgtagaattctcaaatcactgcccctggtatgatcttgtggcagatttgtatagattccggaagtcttagaaagtttctcttgctgttacgacattgctggtggtccccaaggcaattatgctcctttagtggtcatcccacttaattaaagggagaagtgttgctctagatagttttattatatctccttgtggttgctaaacgaagcataccagctcaacagtacttcctgcttttaattgaagtttcgttttctaagaatatttagtagttcattttcctttcaggtgtaacattctaaattcaaatgagttaggatcttcttttggtttgtttttgctttattgtttgttgttctctgcaattattccctttcttgaattgtttatggaaggactcactgccttcatatttttatttagcaaaaaatctcttgagtagaagaagttggattgcatgcccatgagaccacataccctgtttgggcttcattaagtccgttgtaaatacagatattagagataagtaatattggctaatatcaggctattttcttgtgatgttacaacctcataaaaagcctgcagaggcatcactgtgcctcattttgtgttcttgacgcacaatgtgtgtaatattttctcatatctcctttatttccaaatgtttgttgcatgtaaatctgatatttcccaaaccatattttaacctatttgaatataagaatggtgccttccccatcttttatatttcccaccataccaaattcattactaaataccaagtaaatattttaccaatatttagtaaataaatgatagaagataattttactatgtacgaagccaaagacagaaaaaaaatgagtgatttttctctttcacataataagagatgactggatcaaaatgatacactttagtaaggaagaatttggaggttcaaattatgtgtgtttcacaatatgggcacaccgaattagaaatacaggagtgcagtttctaacccctgttcaaatgaatgtatgaacttgagcagctcccttcctttgtcaggttatcaattaccttaaatatcaaatgatagtgtataatatatttctttgacctcttaagtctattttgcaagtaataaatcccttaactttgcatgcattattaaatttttaataaaatctacagcaatgaggttatgtagaatatagatctaatgagtgctctttagtactgagtagccaggggatcatatttgaaatagatgggatatacctagggaaatgaacagttatttcctgctcgtgattacaacagtggacataggtttctaatgagtctttcatgacagcattcttttattttcctctgcctttcattatttggtttatttatataaaagtaacagaattccactggggcataactggacttgaccaataaaggatgactctttgtgccttctatttgcctccacttaattgtcctgctcgtcatcccgctgaattatggaaaatgtcacatttccttggcctatgactcatataacaaatgaatgtgtgaatagtgtcaaaatacagcaatttgctctatgtaaagggaggtagacagcttttgaaaatggtaaggtatataactagatatttctaaactgaagaaaattctcatttgggcttagacgtgtgcatctatggtgcaattagttgttaaatcatttaattgagggctcacttgcctagtctgtatacttgcctcactgatagtgactcaggaagcaaatcaagtggacttaaaactaaaatatcaataccctatacaacaagagaagagacatgatttctttattaacattggagctgtgtgtgtgtgtgtgtgtgtgtgagagagagagagagagtgtgtttgtgtgtgtgtgttagtttgtttagcttccatccaagcactgatggtcctgcaaattaagtggattcagaatcttcatagttcctgaccgataatccccatcttcaaacatttttttgcaggaggaacttggaatcattgatcttactgtgtttctctaaaatataataatttgtgcataaataggaattttatgacatactctatgtcctctaatagttttgtgtaatttcattgccatttagtgatcaacaaaaggagtttgtaaactataaactagctttttcctggctcgcttatgagggaataggacagaactccttgggtttaattttcagaaatcctaaatatcaacattttttatacttgatagagttaaatataaaggaataaataagcaaaactaaggccaaccttgtgcattagcccttccactcacttcagatcaccagagcttggatgtttcatctgctaacaattcctctgaagcattctcaagcatgttttcttgccagcaaaagtaatataagtcctaggcaataatagcttgataaattcatagaagatagaagattcctatgaatataagcttgctgacattttacagtaatacaaataaaacctgttaacatagtaaataacaggtactttcgggggggtaaaattattttaatttgacctatgattacatgtcttgtctattctgctatgcccagagatcctttctgatgaagatcaacttttctaatactattttactgagtttggaatggaactatagattggataattaccatccgagggagtaaagcctctaactaccacaattactcacatttattcacatgacatgaaaataaaaataacaaatggtttggaagactgcactgtagggggcaaattaaacaaaggtgcgcacacgcacgcacacacacacacacacccctctgatattaacagaggaaaggaacttattcaatgatgtagctttccactattggcactttttgttttctgttttagagacatagctcacctgaatggcacaacttgtgtgggtactgtaaatatttcctagacatggcaatgcattatattttccatttcaaaatatacttatagacagctatgggaaagaattacagtggtagctacacacagccttgttttccttgtatacagagttagaaaatagagatataggggaatccactcctgataccaaatatagccaccataagcatgtacaggcataccttgtcttattatgctttgcagatattgcagtttttacaaatcaaagtttgtggcaaccctgcatcaagaaaatctatcagcgccattttttccaacagcatgtgctcactttatgtctccaggtaacatttggtaattcttgaagtatttcacattttttcattattgttgtatctgttatgggtgatcttgtgtaatcagtgatctttgatgttactcttataattgttttggggcaccacagatcatggccatataagatggcaaacttaattgataaatattgtgtgtgtgctgactgctctactgacaggccattcccccatctctctgtttctacttaggcctccccattccctgaaacacaatattgaaattaggccaactagtgactatacagtggcctctaagtgttcaagtgaaagtaagagttgcacttctcttactttaaatcaaaaactagaaatggttacacttagcaggaagggcatgtcaaaagctgaaataagccaaaaactaggcctcttgcaccagctaaccaagttgtaaatgcaaaggaaaagttattgaaggaaagtaaaagtgctacaccagtgaacacataaatgataagaaagaaatagccttacggctgatatggagaaaggtttaattgtctggatagaagatagaaccagccataccattcccttaagccaaaggctaatctagggcaaggctctaactctcttcaattctgtgaaggctgagagagatgaggaagctgcagaagaaaagttgcaagctagaggtggcttcatgatgcttaaggaaagccatctctgtaacataaaagtgcaaggtgaagcagcaagtgctgataacagaagctacagcaagttatccagaagatttagctaagatcattgatgaaggtggctacacaaaacaacagattttctttttttctgattttttttttttttttttttggtctcactctgttgcccaggctggagtgcagtggcataatattggctcgctgcaacctctgcctcccgggttcaagagattctcctgcctcagcctctgaagtagctgggattacaggtgcctgccaccacgccaggctaatttttttgtatttttagtagagacagggtttcaccatgttggccaggctggtctcaaactcctgactttaagtgatctgcctgcttcagcctcccaaactgctgggattacaggggtgagccaccacgctcggccatacagattttcaatgtagatgaagtagccttctattggaaggagatgccacccaggggtttcgtggctagagacaagtcaatatctggcttcaaagcttcaaaggagaggctgactctcatgttaggagctagtgtagctgcagccaatgctcatttaccattccaaaaatcctagggcacttaagaattatgactctacttctaatctataaatggaaaaacaaagcctggatgacagcaaatctgttttcagcatagtttattgcatattttaagcctacttttgagacttactgctggggggaaaaaaagattcttttcaaaatattactgcttgatgacaatgcacctagtcacctaagagttctaatggagatgtacaaagagattaaagttgttttcatggccactagcacaacatccattttgcagcccatggatcaaggagtaattttgattttcaagtcttcctatttaagaaatacttttcataaggccatagctgccatagatagtgattcttctgatggatccaggcaaagcaaattgaaaacctgaaaaggattcatcattctagatgttattaaggcattcatgattcataggtggaggtcaaaatattaacaggactttgaaagaagttgattccaatcctcctgatgactttgatgggtttagggcttcattagaaaaagtaactgcagatgtcatggaagcagctagagaactagaattaaaagtagggcctgaaaatgtgacagaattgctgcaatctcatgataaaactcatgacaaaatggatgaagagttgtttcttgtggatgagcaaagaatttcttaggatggatctattcttgaatggtgacgatgctatgaaaatttttgaaattacaacaaatgatgtagaatattccaaaaacttagttgataaatcatatacagggtttgagaggatataatccgattttgaaataagtttttccgtgggtaaagtcatatcatacagtatcacctgctacagagaaatctttcatgaaaggaagagtccattgatgcagcaaacttcattattgtcacagaaattgccagaatcatcctgaccttaaatagccaccatcctgatcaatcagcagcaattaacatccaggcaaaaccctcaagtaggactaaagatatgacttgccaaaggctcagatgatcattggcatattttaacaatgaaatatttttaaactaaggtatatgcactgaatgtttagacataatgctgttgcacactttatagaccataatatagtgtaagcctactttttaaatgcactgggaaagcaaaattcatgtgacacactttattgcaatattcactttattgagatactcactttattgcagtagtctggaactgaacctgtaatatctccaaggtatgcctgtatattctatcactcccaagctgtgtgctcttgggaaagttacctaatagaatccttaataaaaaatggagtatggggctgggtgtggtggctcgtgcctgtagccccagcagtttgggtggctgaggtggaaggatcacttgatcccatgagttcaagaccagcctcggcaacatagcgagaccctgtctctacaaaaagaaaaaaaaaattagcggggtgtggtggcatgtgcttgtagtcccaactactcaggaaactgaggtgggaggattgcttgagcccaggagattgaggctgcattgatctgtgatcatgtcacagcactgtagcctgggtgattgatagagtgagaccctgcctctaaaaataaaatggagcattatctattcatggggttatgtgagattatttgtgtgaattgttagtcatatatatttgccaaataaatgtttgcatcccatcaccgtggctgaatgagcatcggactaaggctaccttcttctatgcgccaaaagttttggatacatttcttgaggctcatgtagttgtagaatctaaaatctaattttagcttagaagtgcaacttgaggaaaagcaatcaggatttttgaacttttaatgaaacattttataaagaaaaacatctcttgtgagtgctttgttccctgtttaatttggttgagggtactttgttcagtagaggccaaaagcctataagttaaataagctgagactatcagtggaaaaagaaacactacattcattcaagttcatgttatataagtttgccatcatttcaaagcaaagattttacatggctcacctgtgtaacaataaaaaaatctacggttcagttgtaaatgtgcacaaatagggcatgatgataggctcacagttgtagcttcctctaacttggtcatggactcaagatcaatgtgaatgccatatatcagaaaggagcaaagagtgctttaaaactacaataagaaagattggcatgcgtgaatctaacggtttagttatccattttgagggataatttatttggaatgctactttatttctttattttattttattattattatactttaagttttagggaacatgtgcacaatgtgcaggttagttacatatgtatacatgtgccatgctggtatggtgcacccattaacttgtcatttagcattaggtatatctcccagtgctatccctccccactctccccaccccacaacagtccccagagtgtgatggggactccccacaccacaacagtccccagagtgtgatgttccccttcctgtgtccatgtgttctcattgttcaattcccacctatgagtgagaacatgcggtgtttggttttttgtccttgcgatagtttactgagaatgatgatttctaatttcatccatgtccctacaaaggacatgaactcatcatttcttatggctgcatagtattccatggtgtatatgtgccacattttcttaatccagtctatcattgttggacatttgggttggttccaagtctttgctattgtgaatagtgccgcaataaacgtacgtgtgcatgtgtctttatagcagcatgatttatagtcctttgggtatatacccagtaatgggatggctggatcaaatggtatttctagttctagatccctgaggaatcaccacactgacttccacaatggttgaactagtttacagtcccaccaatagtgtaaaagtgttcctatttctccacatcgtctccagcacctgttgtttcctgactttttaatgattgccattctaactggtgtgggatggtatctcattgtggttttgatttgcatttctctgatggccagtgatggtgagcattttttcatgtgttttttggctgcataaatgtcttcttttgagaagtgtctgttcatgtcctttgcccactttttgatggggttgtttgttttttttcttgtacatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctgtgtcctgaatggtaatacctaggttttcttctagggttttcatggttttaggtctaacgtttatttcttaagctaccatcccacaattcatcactattcctgatggtctgttttacagaaattttctgtcagcacataactataatagatagtacataatatagtgaaatatgaaaatctctgtgaaaggatcaacgaaatttgaagagagagctagtttgaaatacgaatcatattctcaaccttttaaatttctgattgaatgatttatgggaaacattctgtagcaatgtgaattccttataaggaaatagtgactgtgtccataaggatgatgtactctataattcagataatataaccatttatgctttgtagcaggagttccccaacctctgtaccaattcatggcctgtcaggaacctggctgcacagcaggacctgagcgatgggggagcaaacattaccacctgagctccgcctcctgtcagatcagcagcagcattagattctcatagaagcctgaaccttattgtgagctgcacatgtggaggatctaggttgtgtattccttatgagaatcgaatgcctgatgatatgaggtgggatagtttcatcacgaaaccctcaccgcttccaccacccccatccgtggaaaaattttctcccatgaaatcagtccctggtgccaaatagcttggggaccactgttttatagggtccgtatttcatagattgaaagactgaggacacagttaaggcattatgaagtcaatgagacatagtggtgaagaaaagataaattcttaaagataaatctttactggacatttaagtgggttttccaagtccattaatcccattcatgttttaacatgtctttgaaccctgaatggcccctaaacttagcctgtaccttagttccaactcacccagttttcttagtgtgcctacaaggctaacagaccttgtaggcttggtggggccaggcatgaggtagctgtggattcactgtgctattacaagtctaaaatatggaagtgtttttcagctttttttccttatgtctttttctgctgactctaatctttagttgcttttccccctttggttttactgcagattgaaaatgtttccattcattcaaaacaactatttcttgtttaaagtaaaactgttagttaataataatgatgctttagcaactatcatttttctcgatgatttagcagaacactgaattactgcgaaatgcaaacagtgagagggtataacagcaacaaaaatatatcttggaagactcaggtctcatctcttaggtctccttccctaccaaagatgaacattccccaaaaagattcaaaatggctgtcaccacatggtggaatcatatgtgattcttacgtttatgcccgtatgcaagtttctaaattagttttattacctttgttaaagaaaaaaaaagcagaagaatggaccctttagacagtgtctaacttatctcaattttccactcccctttgtgtaggcattgatttaatttgtggcatcgtttttaagatgcatattagattatcagaattgcatcaatgtgaaaaaaggagtaaaattaagaataataaatcaaaatagaataaatatgaaaataatagtaaatagaatttgtaatattttatagatgttattcatacttattttataacatttatataataaatacaaaaattagcaaaagaatttttctttcacagaattattattgcatgtaatatacaatgtagagttaaaaatgtggcagatgaatattatgatttctcaagattttcataataaaattatgaatgtttcaaatgtcaaagatctagattccatttatcctttgccttgcagttgagtaaatcctatttcttcggctaggttaccaggactttaaagaaaaatatttttctaacaaatatttctgtttggagctttttacaacaaatgagctctgcgtttgcatcgtacaaagtctagcttgcttcattgggaagaaaatggcatgagaaacagtatccatagatttaacaagctcatgacaacataagttatcaagtagcaaactgatagaaacgtaaactgattacttgggaaagcggcaagagtttggggtgctcatcagagccataaccatgagaactgccaaatgtttgtccttaactattagtttaccttatactgtacacgactctttagttctcccttgattgcacctcctgtaaaggggagataaaactctttgggagcctttcctgtgtttgattatcattctctccaacaccactatcaattgcccttgacaattttgtcacaccctccagcattactcttgctataaatcttgataattttagtatccatatagatgattcttaagtgctctgccatctcagttccttgaacttttgtcctccaatgatcttgtccaccctatctcagccatccactctaatggaaaaccttagactgtcatcatcagtaacctctgccctctgccccatctccatttcaagcatcccactgtttgactgttaccttctacatttacagattattccttcttgttctcagacttcaaatttcttgaccccacagagagatagtatatttaccctaacaccttttctcagttcctcaacctccactccctctttcagcttgcttccatgtcttcacttctctctttcctcatcttaggtgatgcagacctcataataatcacactttcagatattgattcaattttctgtttctcccaccgtaattaatcaactggcaatactccagcccttgttcaatccacatctgtgctaattcagcatctatactagttctgctggaggaaaatacaaccatgctgattggttttgcttaaacttaatgaccatcagtgcagaccaataagtcttctactcaaatgagttactgactttactttgttctctcatctataatatggggataataatagaaaactatagtcatagagttgagggatttaagtgtattcccatatacaaagaacctgacaatagtgcctggtacctagtaagggctcaatttattctacttctccccctcctctctccctccttctccctctcctcttccaccttctcctttttagtagtactacattagaattcccctagttaaattacctttataccaacctaattaattattttgaactttatttctcctgaaatcctgaatgcctccctctccccctcctaaggctaaggcttttaattcgcagagaaaacagaaagtcagaacaaaatggcctcatacctccaccaccatatctactcacccacttctagctgtgacccatattctgtctttttctttgttactatggatccttttccttgttcttatataaggccagctcttacagtcatgcagtatattcaactccatatttcatactcaaatttctcagtctagaaattgttcttttctttctttctctctctctcatgtcttcgtatccctctccaccatatcaaccccatcagcatacaatcattactgttatttatcccatttgatttaggcaaataaaaagaaaaaggggtccttaaaaggttttttgcagttccaagtaatttcttgtctagcataaaatccctggctcttaaacccaaactgacagtctttaatatgcaaatccaagccaagaaaaactgggtccacccaacatggcaattcccaccgttgtccccttgcccttgcccccacatgtgcttggcagcatggctactcccacatatccccatgtgtgtaaaacatcatggctccctgcatttccatattaaaagactagggtggaagagtcagtttttccgcgggctacgtaaataacatgcctggtcaaaccaatcccctgagccctatgcaaatcaaacaccacctcctccagccatcgcatgtaactggctggtatcccctaaacacaaggtctcctctttcagcttcatttaaatgagaaaaaatattcctttattgcatatcccttaccagctaccattccatttaccagtttccctttacagcaaaatccctgaaagtattgtatatcattgtgtccacttcatctcttcccattctgtctatttaaacctattccaatcaggtttttacccctccccgcattattctacccaattactcttcctaaagtcaccagttacctccaccttcccaaatatggtgtcttgtcctcaatatctgcttccttgacctaaacagtggtggttgatgcagttcatcattccttcctcctgaaaacattttcttcacttggcttcaggacaccacactcgcttagcttttcttctacctcactgactgatccttctaagtctcctttattggttctttttcatcttcctaacctgtaaactttggtgggctccaggactcatccttgaacttggtcttttctctgtgcacactcaccctctttgtgtattactctcatgacttcaaacactgtctacatactggtgattccccaaattctccagcctggcattcttatttaaagttcaggcatatttccaactgcttccttgacttctccatgtagatgcctgattatcgtatttcggttaacaagtcccaaatagaaatattcatgtcacttccctaaatattatatgttcacagtcttctccatctcaataagcggcaaccccatccttccatttgcttaggtcaacatccttggagttttccttgccttctctctgtctctgacatgacacatcaatgcaccacaaatctttggctttctttcagaatatatgcactccagaactaaaccaactctcatcacttccacttctaccttctacatctaccctctcacacctgagttattgttatagtctcctcattagcatccctgcttccatccttatgcctccccactttgtgctccacagttatcctgttcatagtaagtcagataatgtgacaactcctctgttcagatttctccaatggattcttcaacgtccaaaatccttagtatggaatttaatgccctctgtgacatggcctaggggactatctttctgacctcatctccctaacccttactagctccttacttaccactcactgtgctccagtcatatcagttttcctgccgtttcttcacatcatgacaaacccacccctgctttagagcctttgcactggctgtttcttctgcttggactgctctttcccagattccccattgctcactccctcactaccttcaggtctctattcatatatgactttttcacagaggcttccctgactacttaatttaaaatagcattttgtcaccataatttcctatctcccattatctattatttatatatccattttatgcatccataatttatacagcacatttaaataaatcaagtcatgttaaatatgttaaatgtacatttattgaataaaatgcctatttgtatattgtttgtgtatgcacagtagagtataaattttttggcggtcaggatttttgttttgctcactgttttttgttgaatgaatcaatacgtacttgcttatttgtttattgtcttcctctactagaatgtcagctccttgagggcagggtctttattttgcttagtgatctttcccgagtacctggaacagagtctggaatatactaggtactcaataaatgttgcctacaatatttaattaattgattagttagttcagacattgaaagagcttccaagagtaatgtttaaactcaatcaatgtaatggataaatatccaagtactgtatgaggaaaagatattgataaacgttgcctgtatttataagattcataattttactcaactctttgatgaggaaatgttgacttgtccaaaagcaggtaaatataaatagaaaaaccggaggtttttcttgataagagtatccctctatatgaagcagagacgtaattcagcctaatttatattgaactcctatagtccaactattgattccttatcacttgctgacatttgttgctagggagcattgtgagtatttgaaatatacatttatttccactaagagttatgtaatcaattttaatatattttaaatatactttatgatgatgtagattaataatggaaatgatgatggcggtggtggtggtggcgatggtgatggtcatgtgtgtttgtcatagctaaagaacagcattgaaacttttccagtgcacacaacacacacaaaatccacttataactaaaaattaattatgaagtaggtcagtcttataaaggatttttaaggaaacataattacatgaattttctagattaactcaaactatgctaactcttgtcctcagatgacttgaattaatgaaatgatatataattagtgtttcagttgtttacatgtaaatataagttgagtattccagaaaagtttgttcgtaggcactttttcatctctagtttttattttatactgaaacaaaaagaaataaaacatcaccccaaactcactacacagatatttcagtgtctatcacctgtatgcctccctgtgtatatatacacatatatctacttgattgtatgtaaatgagataactttatatgacctgttctgtaacttgcttttttacgcacatcttgtgcatgtatttctatgtcaataaatgtacatccacattattgttttaaaagatgaataacattctgttgtatgtatgtaccataatctgctcatccagtcctctgctgatgcatttttttctttgttgctgttacaaaataatgttatggtaaacattcttatgcatgcatcatctttataatttgacttgcaagtatttttaaagtttctttctcagtgtcattattttgttctatacgtataaagggatctctaaacaaaatcaagtttcttccctattctgtttttaaattattgtaaatttcaaagtagcgaaattggaataaatgagattttactgtgtactttgcctggagccctctcttgaagtgtattcaaagggaattaaagggcttattaacggataggactatttgtgttaaagatgaagtctgttgaacattttcacctaaatataccaatctgatattcttgacgtttttttgttaaatttgatgctgacaataaaaactttggaataagctataatttctgcatccatgcatattcaggtctgaaaatgaaagaagagtgtgacaggtttgcatgtagaacttcccacccactcatttctttcctttctgcttctgacacttcagcctttgaaacagtttcccatgagcaatactgagattcagactatttagatctaaaggaaaaaatgcaagctcttctacagcttgtatctagcacctggaaacgtcttagaagaagtgctaaaatgtaaataatgctgttatttgttatgcacataggagaaatcctaaaggtattttagggaagagatggaatccagagatattaagaacaaggtgtgggggccaggggagaaggggagaggcagaaggatcctatccacattattaaagtgaaatatttccagtatactcttatcaactgacatgtagactgcatgccgctttcatgcaaaggtatcacatttcaaacttagcatttaaaagaagccagacaagaaaggaaaagagacagttatttgttgaaaaaagtctgggtttagcatcaggcacaggggttattggtagttgtctgaagtacactggagccttgtaacattgttttgtgccatgtattgccagcctgataccactggagtacatcctctgtctagttttccagaactcactacaataactgtaggatttttccatcctttatgaaattgcatcagtattgtgaagggccttaaaagccattcagttcaacaaccatctcccaaaagaaaagttcctcttctttttccatttattttatctcttcccaaagccatggggacctagatacatcaattatcctttgtcctgtaccttcactacctcctggactactaccttttttccactggcatacagatcatttcaagacttctcatcctaaaaagtccctcctaagtttctctttcagactgtctctttcctttgataggcaagagctttcttcattttctcgcctatttttaaattattcagcttcacctttgcttttattttctcatctaattcttaattattcagccctccgcattctatcttctgcccacattgccatccatgaactcctcctgctaatgtcgctagtgactgccaactaaaatccatttctcccttcagtccttaccttatttctcctttctacagcacttgaccaggttggtcaactttttcattgaaaccatctcttctgtgggctttcacaacactgctttttctctgttctacaccatcactatttttcttttaatttttacacttccctcgtcttttctgaaatgtttgatgtcctccccacccccagtttccagcctcagtagttgtcttgtattctgcttgtgttctctagattattaaatgtattcttgtggtttcagttaccatccatatgcagacacctttcatcttgagagccaggcttatatatacaaatggctgctgcacattaacctatcactaatggctctttaaactcaaaataaccaacaatggagtcattgtctctatctctgaaatagaacacactaccctcccccacttcttcccctttttaccctgtggcaacaaccttttgctatcctgattttaagcaggctgcagcatcataataaatgatacataatatctgcctttaaaatgcctgtagtggttaagagggagggctctgacattacatggatttgaaacacaattcaaatgcttataaggtttatgatttggggcaaaggaattattaatccatctgtcctttagtttcctcatctataaaatggaggtaatagtagtatagacctcatagggttcttaagaggattaaatggaatgataatacatgcacagcattttacagtgttaagttcattaagttaacaaatgcttcatattatttgccgttacagtccatataataacatgctgccttcaggccaatatatataagcctataattcttggaagactatggaaatcctatcatatattaaattgtcattttttttaagactaagaaaaatttatgtaaagtccaaaagtacagctgtttacaggggacgaactgatccacaaggccacagtctaccctcatcagttagtgtccatcactgaagtggaataactcaaaaggaaaaggtaactcaacgagccatccatttcccacatagattcacaacagaagacagaaaatatggagtggaatgttgaatcagctgctgttgggagaccctggtctgcactctatctgtattcttactgaagggagtgcagggcagggtttcccatacagagggcacagactaccaccgtatggcaaatgttgactggaactcaacttcaaagccatttcacctggaatcttaccccaccaccccaatgcttcatgaaaattcaactgatcctcttctatgaagaaactcaatcctgataagtctctttagtagttattgaaatgtctttgtaactctcttatagtcaggttcagtaagaatgttaagtttctaattgagcttttctttctgaacagttattttgtgtatgtttattttctgtttaccaatgtaatatatgttctttgcagaaaaattggaaaatacaaaaaggtatctacaaagtcccccaaccaagagaaaaccaatattaatgttctgttatagatccttgtagtggctagctggaattcgtgtatatctctctctctctgtctttgtctttctttctctctctctctctatatatatacatatattccaaatatacatttttatgtaatatatatgtatattatatatgtatacatatattccaaatatacatatatatcttcatgtaatatatacgtattttatatatatgtataaatacataatatacatatataacctaatatatgatatagcataatatatgtatacacatatatgtgtacatatataaaatacatatatattacataaagatatatatgtacatttggaataactatgcataccatgtttcaaacctgctgtttactcgttattatgactattcctctatatattaaaatattattcttaatctacattttagtggttgaatagtaataatctatttagtttgttctctgtttatttgtttttgtttttgggaacaaggaactgttcacacctaaatgtgtacaacctttatgtctagatcaggcacttgaattcttaaaaaagtgttaggaaatggaataatgatcttttatttataagttgtatatgtttctgtattctgttcatatatgataattgaaatagacctatatctaacactttaaaatttatagtattttcatctttatttcctcatttgatccctgctacaccttgtgagatagagaagggcttattattctgtccttatagataaggaaacttatgtccagaaagatgaagtggttttccaaaagacacgtagctaataaataattgacaacattggaatttggaattagaaagcaagtcttgtgactcctaaccaatactctttccagtacactttgccatgtcccaacttcactttctttaagtgcttctttctagcacctcttattcaattattgtcatacgtactttttggatcataccttaggagaatgtagctttctcatgaatttcctcattagctgacaactgaatatggctagattttaacaataaaaacacatttttttcttttcaggaatgcaaatacacagtgtattatatgtagaaaaaactctcagatattggatccttattgatgaggcttatgagataatatagcaactcagacttttctcaggaagaagaaaatccatgtcttttgttggacagtttagagagtctagactaccatcattcagcatttgaacattttgatttcaaaatgtagacaattgaagaaatacaatgtaaatgccagggaattaaatcataggacaaaaactccctatgaaaacatcttagtgatagcatacatgttaaaatttttgaaaacactgggaatggtttcacttctcatctgagtatctgagaaacagatgattatgtacctcccagccctgtgtcagccctaatttagttgatggcattattgctccctgctttcttttttttctctttatagcagattgctattcttttttactttaaaatagcaccttttgctgccctgtcttatccttgtgctcttttaaaaagtggtcaggcacacacttttgtcactagttttacatgagggtaggggctttctcttttcttttcaaaaattaagtgccactacatctcagttaaactgccttcatctgacaagcacttacagaatactgaaatataatctactgcaaaaaatctacatgtttttcataaatacgaatgaaatgcttttaatattatccctgtgttcagagttaatgcttaggcattaactaaagtacgctagacgcttttgatatatttccaaaggcccagccagaaagatatattgcagatacacatattctaagtgtttacaaaatcttccaaaattattttgcctgtgtctgcttaaaaggcacaggaaacagctcccctactatctcctctatccagtcaggaacacttgcagtaaggacactggttgttcagtgcacaaggattaaagtaacttaattacacagtcaaatcaataataaattgagatcattagagccttggctcgagctgaaccccaggtagccgtggaatccctatgatacttgaagaagaattgacacagattctaaggcctcacaggttcaaggagaagcagacagcctcactttgttccttcaaattagttttgagtggaggaatcttaggtttaagtgagacctggatcttgttttggggtgatctctggaaactgggatataatctactctccagggtagaagactatgaagggactaaaggagcaaactctaggtcactgagaacccctttcctacaaacaaagatcttggttgtgttccctcacttccagagagctcattggaccgagcatacccttgagtattaaggtcagtgcatactgagtttaaaaacaacataggtataaaattgaatggagcagtggtgaggaaggtggaaaaggatgagaagggaacttcctttggacttctttgagccaaaataagtagtatgtttcctaaattcttgtaatcagaccattgttggctattggtagagggaggttcagattttccatctctatcttttttcttctgtttcttggtccttctgccactgcttcttttaaaaagaaataaactcatttttttctcagccttatgtgggaaaccctcttggcattttctaactgccaagtgttctataactagccatctgtggaatatttttttgttaagttaattttttaaattaattcatttcccttttctctctctctctctctctctcacacatgcaaactagtgtttgaagatcaatgagcaaatgatctttcttgtaacaacttccctttttcagctgatcgcttttctgaattttatctcctaaaatcacttaaataatttcactgaaacaaaggaatgattggtcttttaaagactcgtacatgtattgaatataacatttccgacctgactaataatttgaagtaactttgagcttttcgagggccctagccaaaacaaaatgttagatggcctttaacatttatgtcttcaagggactgtgctagccaaagtttcctcccaatctggaggcagctttgtgccatagcaattttcaggcttcattgcatcaatcaaacaaattgttcttgtagtgcttacttactggggaattcaccagctggaagattgtaccattgagccaaaacaggccactggaacagccatactctttacttcatttatggagccatttaagaagatgctgtagtggcagctgcctgtttgtcagaacagccttggaggtgtgctgaatgaaacctaatttagactagtagatgatcagatgacaaagaataccagagatacaggtgaatcacaaaagaagatgctgtgagactttctgtaaggaattccccaccatgactttagaaaaactaaagtttcagctgcagttatgttgagtgaagtgtaaagccttgaaaacatagactaaaatggtccccctcctctctctcttatcatataaacacaccccaaccctataatttttctgatacaaattgtatttggattttgcatagatggccagtttacttttaaataagaattatatgcctgtttatttgaatgtctgttcctaagattatccacaaccacaactccatttattatatgtttacataatgttgggtgagggagagtagtcaatgatgattcatttgggactagatacagaattaaaatataaaacaaatattatcattctcaaggttttaatagatggctgaacacaaggtatgagtttagaaattgtcatcctggattatggtgtggattttatgtgcaccttttcatgatgggcatcagctgctttgtatattttgttcccaaatcttgttagtcaactttcaactatctgtgtatataaataatcaaggtgatgttaactgctttatggattttcttgagcaatttaacacaagattgattagtgatttctgtctgtagaaaatgtttgattccaggctggcttagcctcaccacacttctgactgcctcctccctatctgaggaggctcagaaaatacacaatcatttcaatattcacctaagcaaaataaaataggaagataaatttctgccctgaatactgtgatgcgtaatattaatacaaaactccaagagaaatacatttgaggtaattttttttttaacttggataacttaactgtgagtagaggcctgtgattccacaacttcactaatgtggaattttttctttctttccattagtccagactctagactttgagggtggagggggaactagtcttgttcaagctggagttccttattaatgagagatagtttagaaatcctgaataaggctttggaccagacaataaaaaaggaaatgtgaaagctcagagccttctagaacaaagaaacaccccaaatcttatgcctgtcagctggatggtgacagtacccagtagctctgcagtaggcaccagagcatctgaagtacaactggtggacctcgagagaatgggagctagctgaaaaccattctctccttcttaatgattatccattagcacaccatgtttttattgcagaatagattagaaacaattagcaaatggaaaattgaagaggcccttgctgcttttagtgtttagatgtaacttttgaacagaatcaaaatgctctttttggagtcagatttgccattttacctgaattccattttatgcgtctgccatgggttacatgcttcattccatttaaaaacggaaattttctggatgtagattcagtatgtcttgctgattgctgcatttatttcagatgctctttagaaagcattgtttagtaagctaactttttcatgctgagcattaaagtgatggttgaagcatattccaaagtcatcttttaactcacaagaatatggaaccatattgacttctaccaagacagtttaatcattcattgttaacaaagaacattatcatttttattgtacttgtcattacctattactgtactcttgtctgaaaaggcactatggtataagaaaaaataatgaaattaaacgaacaatggatctgattttgtcaatgctcaggaagtgaatcactcaatgccagtcctatagaattcagggaaacatcattagggcttcaggaatttcgactttactaatgtggattttgttatatttctcacatagacttggatgaagctttatgtgaatgcaaattttctcatttcttatattgatgcattgtttatttgcatttttattgtaactcctccaaagagaagaaaatcttggttaatatgcagattagaatttttattgaggattgtgttttattgttcttaaagactaaggtggtaaagaaggttagaaccccctgatgaaatctgcatcacattcaaagaaatagtacttagtgagattttgtcatgaacactttcacagcttgattctatttctcattatatcccaattatcaaacgaaataaaacaaagccattcctatagaatgaaacacatgaaaatggcaaactgcctgtaaaaatgaacaaggaaatactgatcttcaactattcctatacccttatttctaacctaatgtaccaactctccttctctcattttcttttaccaaagtactctgaggcagagaaattaaatttctatctaatactattggtgaaaacagaagactatatgagaaacagagaaaatctccaaacaatcatggtgtctcctggacttcctaatatggaagtcatctaatatgattaagtaatgcagcactagtaacatcaccagagttcacagtgaaatgttttcattcatccccactggaactccaaagcaccaagtggacttagcatcagaacttaagaaactgaagccttcgttagccgtaagtctttgcaaagaaatggaatcacagttttgatttatgtaagaggcacaaagcaaaccattactctgtatccacaaatgtcaattgtagaggagcaccaggtatctgagaggaagatctttgagggatatgctgcttcttatacccttttccaagctcttatttgtttagagtacaacaaaaggaaaggctgagtaagagaactgtgatagggtttgggagaaggaaggaaaattccatggacatatactagccaagtaacttacgtagtttgggtcacttgttatctgttaactacccctaactcctctagtgaatgaggagtagtggtagtagatttctgaaaagacaacacagtgtttattacctaaaggagcagacttcctcaaatgtgtttctgttggacctttggattgtataacatactgtttggggacagaaatgaaacttcctagttatatttttcttagatgtatactatagtgggtgtgtattatctgtgtaattcccccaactgtaatatatttcaaatcactttattctaaaaatgaagtacatcttacatagagcaacattcaaataaaatatttgccatagaaaatagagggtacaacgatggttactagaggttggaaagggtgaggcagggagtggggatggttaatgggtacaaaaatatagttagataggataagatctagtgtttcatattcacagggtgactactgtcaccaataatttattgtacattttaaaataactaaaagagtataactggattgtaacacaaagaaagggtaagtgcttgaggtgatggataccccatttactctgatgtgattattacacacagtatacctgtatcaaaatatctcatgtactccataaatatatacacctgctatgtacccacaaacaaatttttaaattcaaatttaaaaaattaaatgtgtgtcatgagaatttctaagaagggcactccaaatcattggtttgccttgctagacaaagtgtaaattattttaacacaatatacagctgggtaaaaggaaaaaaagactgtgacttgtttgccacccacagggctgtcaggaaaggctacaacatttcacttctcaaggagtaagttccttttacagattaaattggaaatacagttacattttatttcatctcaccaatgttgaattaataacctatgtgaaacctttatttagaaatgaacacttcaagcatgcgttaaattagcaactaagtacatagcttataagaccatgaagaatggttatgtttataatgttcatttttaaaaaaaaatattatactttaagttctgggatacatgtgcagaagtgcaggcttgttacatagttatacatgtgccatggtggtttgttgcacccatcaactcatcatctaggttttaagccccacatgcattagctatttgtcctaaagctctccctccccttgccccccacctgccaacaggccccagtgtgtgatgttcccctgcctgtgtccatgtgttctcattgttcaactcccacttatgaatgaaaacttgtggtgtttggttttctgttcctgtgttagtttgctgcgaatgatggttttcagcttcatctgtgtccctgcaaaggacatgaacgcattcttttttatggctgcatagtattccatggtgtgtatgtgccacattttcttcatccagtctatcattgatgggcatttgggttggttccaagtctttgctattgtgaatagtgccacagtaaacatacatgtgcatgtgtctttatagtagaatgatttataatcctttggttatatacccagtaatgggattggtgggtcaaatggtatttctggttctagatcctcgaggaatggccacactgtcttccacaatggttgaactaatttacacacccaccaacagtgtgaaagcattcctatttctccacatcctctccagcacctgttgtttcctgaatttttaatgatcgccattctaactggcgtgagatggtatctcattgtggttttgatttgcacctaatgttcatttttatacttaattattttagaggcaggttgttgctatgttgtccagactggactccagctcctgggctcaactgatcgccctgcttcagcctcttgagtagctgggactataggcatgcaccactgcacctagccttacttaattaaaaaatatctttctagaacatttttagctcattgcttcagaaggtattaatgtgatggttcagatctgtcattcattttttcaagtcattactcgtgtccttcacatttcagaaggattagagagataagaagatcaactttcaagattatgtaagattgatagaaaaagcaagccagtatttccaccatcagcttgagataagattccatattttgacttatacaggtgatagaggcgaatgtttttcaatttgaggtatttgtcagaataggcaagagatgaggacttacactttaaaaaattcttctttaaagacaagtttgagaataaaatcaagctatgattatgtagcctagtagaaataatatttatcatcccttaacttgtaaatgagaaaggtcagtatcattctttctgttgtataaattttgaagctcaaggctcagagcatttgccagactttagtaagggtcatctttaaaccagtgaccgatccagagattcctctccattagaattcctggatgtaaaagaatgtaactggtcttgaccttaagctactcccgacactcgaatgttcaaatgtctttcagacaaactgaaaagttattttccgtactattatataagaatgattattcttttgcattcatagattgaatttaaatttgtcataattgtaacttttgacttatatacctagcctaaataaataaaaatgtttactttaaaaagtccaattagaatcattggcttaactagttgctttcatttaagtattcatacaaaagaaaagaggttttaaggattagtttctttcatgtgctaggcagtctagctgatagctgttgtagtgaaggcaatttctgttagtaattgctggttgtatttgcttacacctttatttaaaggaaacttgtctgttttgacagtctcacattttttgctcattctgaaaattacttgggaaaattacttgagtgcagaaaagttattttctttgtattgtagaaaaacatccttccctcctgaacacaaatattgtagtcctggtgaaagctaactgctcaacttcacttgttggctttgtttcagtaaggttctgccattacaatggaagcttatttcatagtttccactttcacgactgatcctcaataaaagaaaacaaccagttaagcataataaatatttgatttagtaacttgaacatagtcactttaaaaatcagaagcgactctataaggcaagacctttattagaattctctgctgtcctatgcagtaatggaggaagaaacataattatcaaagatctacatcaatgacatatttcagattgtgatttctgacatcagtgtagtaatcatactgggaattggttgtttttatttctagcaggcagaatctgaattttggttttggattaccagaataattgcttctcggccttttggctaagatcaagtgtggattaccagaataatccttcatagagcccagtagtcagtaaaagatttggtttccttaagtatatagtcaaagccattaagtggaaaattgagataataaaagtaggcaatgtagttccgtcatcacatgcaatatgattgtataatattgtgtcaaaatttcaaaatagtttcaaatagtttatgcatacccatgtggcttgaggcaaaagctcctaatattggctctttagggctaacggcaaatgcccatatttaaatgcttgtgtctataggaagtcagtaattgctaaaggtaattctgtttgcagttctaataagataagtgaataacatggtgattaatgttattttaataatagatggagtcatataaacacctaattcttaagttagtgggttgtgtttgttcatgacaaatgggaccccggaggatcaaaattaaagattcaactaaatattttcattcatttccaagaacctagtacattaccctgcccataggcaatcaataaatatatgccaattaattggctttttttttctaaaattgatttccaataattcctaaagaacaaggtcaaggagaataatatgtaggagtcattttaccaataattgataattgagctcagagtgcacaggggtgatctatgaaacgccatcatgatttctgaaaagctttagcaagggttattaaatataacagattatttcattcagtactatcagtctgattgaaaagttaggccttaatgatgtccatagctggtattttgttcctttctatgtgtagcatttccctggttaagatgcctcacaatgttctcaaattagtatctttcagccttctttgttttttggacattgtgtctgttttttgaggaggagtctgcctgccatttgtttcacactttagtagtacctacctataagattgaaaaggaggttgtgccccctacttttctgacactttaacccaccagcattaagctaataacctactggcgtctgccagaagatttgttagtgttaaacccatatgcttctagtgtttggcaatgtgaaatattataccaagtcttatcattcaccggttatcatgaacccctcaaggtgctatggtctcctcctccaataagctcagttgaactccttgccaaccaagagatactgtgacaggattgttcttatttgctgttgctatcagctttgaggagccactgcagcctggagaaagccttagaaaatttcccaaggcaactctgctattcccccctaacacctacgggatttacatacgctatgccattgtattccctatgataatatatgtaaagtcctgtacacattactgacatgctatacgtgttgaataaatgtcagctatttctattattaaatatccattattatgactgagcctctctagtggcccttaggctaaaatgactgttatacctcagtctaggatgctcttactaaacagcagctccttctctgattaaagcaccatgtgttctcaaagttcctatagtgcactatgattactcctactttggtactcatcttgccaaacaatacttgcaacatttatccttcctgtttctctaaccagactgtaaattctgaaaaagcaggaaatagctgtgacttgttcactgtagtatccctagggctttagcatagtgtctacacttttcatgcatgtagtaggtgttcagtaagtgtttattgaattaatgaatgaatgaaaagtatcctagtatcacaggttctgaattattcctacagagaagtccccaaagaagctatgtattctccagttaccctctgaaaccatagggtaagcataatcaacatattttctatgaatagatgcaaagcgttaatattagcaattatgctccaaatactaatctcaggatggatgtaacataataataacactttaatattaattaaaattattttattgcataatattattttaccatcattattcagtatcattactgattggctaaaatctgcttagagtagcagcttcgaaaaggcatttcacctctcaagtaactgtcacccacattcatcaaccctggtagcccctccttagcacatcttaaccctctctcactttttactttgtctacctgttatcaatagtctcaccaaattatatacacaatctaaacttctcttgtttttctttaaccaattagcaagattctgaataaatgtatttttgacctttttatatttactccttctaccatcgtcaagatagcttcctacattatatatttctatcccttcatccatccaaacatttattcactcaacaataatccacagattgtctgatacttgccaaaaacttcctctgccttatctgagcttatcgttaaatgggagaaacagatattgaacagacattgaattaaaagccagtggatactcagggtttccttctttctatgatacggccactcccaaatgaagactaccaggcacagattactgttgcagagcaacagtttgacaatattttagataagggtattaacaaaacaacaagaaaaacctaggaactactatgtagacaagaagaaggtacactagaatgaaatgcatttttaggtggtcactatcaaaatttaagctcttggaattcatttcctggcaatgggaggagcagcctcactcctcaaaagctatggaagagcagaggagtggaaaagcacttgcagagaaatctcctggggatttcttagccagatatttagaaatagggtttaaattcttcaagttggaggattctaacctatgctctaaggatgactgatgaagtacagaaagaaaagcaaagtttaccaaaaaaaatgaggtcacagaatttcattacctgccatcaccccgctatttatgtatgtatgtatgtatgtatgtatgtatgtatttttgagccggagtttcactctgtcacccaggctggagtgcagtggtgcaatcccagctcattgcaacctccgcctcccgggttcaagcgattttcctgcctcagcctcccaagtagctgggattacaggtgagtgccaccacgcccagatgatttctgtatttttagtagagacggggttttactatgttaaccaggctggtcttgaactcctgacctcaagcgatccgcccacctcagcctcccaaagtgttgggattactggcatgagccaccatgcccagcccatcaccccattttgaaaaccaaaagcctaaatcactcaccttgaagcagatttgatgctgactatagacactaattgattgttagtcctgttttggtttatacataggggcagccattactatgctattttattcaggcacgaagtaattgttttatatgaatgcaaacattctaaaatactgccattcattcctcaatttataaacttcttctttaggaaattgtattccttattataggctgggtgaccctttacaaatcttaacttattttatcctcctaacaactttatggagaatgtactatattttccccattttaaagatgaggaaactgaggcatggaggtaacattacttgcccaaagttactaagttagacccgactgggttctaattattgttctgcaacttactgacttaaaaactcaaccagtatgcaaattcaaagcttccttaatacagaatgtaaagtgaagaacaagagtgtacagcacaccaatctgggacgctatttgccattagttcagatttttttaaaggcatgtaatcaccccttatacatttttccttttcccagtgtgccaaaatcagcaagccaagacagttgattgcagtgggcatgtcttaaaaaccagtttccatgaaaggagcgactaaagggcctattgtgcttgttgccttacttttattttgagtccagtatctagtctgttagtttatatacagaagagactatcttgcagggaattcagctaaccctctgcactgctcttaggtcagggccctgaacctttgctcctggctaagccatcccaggtatttgattagatacgttacttctgagttcacttattagcaaggcacactatgatggagtcctgatgtacctacttgccagtgagtagaataaagatacattttgtgtttattgctgttgataaaacacttgtgtaaagtgtaatttataatttaatcacttttaattcaatttttaattaaaaatttaactttttaattttaataattaattactaataattaacttaatcattctttttttctttctccttcactatgcttcctttgaaatcatttccttctctaaacaacattggaagcgtggcactgaagtgatagatttttgtatcccattgtacttaattagcaagttgtggcatgtatttggttaatatttctctttctaaaaagattattatctttgttttggtaaattgaagagaaattgtggtccatggcaaaaagaatgaaccatgaacccatctgtacggtatgtgctcagcctgagatgcccatattctacaaagagcaatttaagcatgagtgatatcaggtgttaagcccccatgaaacatcagagataaatactaggtccctggctaacctgctttcgatgttttactgttcaatctgtaatctgcagtgtattttaattaaatcatcaaaattacagaattttctttggaaagatgtattcttcatttgttgtttggttcaatacaaggagttggcatttctgatatgttgagaagatttcactttcacatattactaggataagtccttgaaatttactagccatcaggatttgctgcttttaatgattaattacctgttggcacacttttcaaaggtattctctttagctgtttcctttcatcttgccctaccttttttgtgaatagcctttcatgtttagctcaaaagagtattcataaaggtttatttcgtttctttgggtagagatgctgatttataattttaatgcagttcgtaacagcagtgaaaattaaagtcctgagaactgtacctcagtagggtcctaaatattttatgacaggtctaattgtttaataattatgcaaagaccttaaaaatttggaataatttgtcccttcactgtaccaggctaccaggattcatctatcccttaatttagtaaatttttatgtcaggaatagagtaccatgtactgttccaaacactggagtacagcaatgagcaaaacataatccttgcccacagggagctcatattatagagagggtagacagactttaaacaaataaagatatagttttctttggagaataaacaagaagggttagaggggtagagagtgcggagagataagggtttctctttcatataggatggtcaggggaagcctctctgttgaggtggtatttgaaggatgagaggggaaggttcaggcggatatctggaggaaaattattcaaggcagaggtgtaagccagttcaaagagtcagaggtggggatatgcttagcatattaaagggacaagcttggaagccagtgtgacatataaaatgaaaaaagaggacaaatgatacataagatcaaagacgtagtagtggtcagatcacagatgatctcataggccaagtcagggactttgtctttgactctgagtgaaatgaaaagctattgggaggtgtagagtagaagaatgacatgatctgctttatattgtaaattaatgttatactacatgtatagtttacatgtatagtggccaactaacagagtgaattagggaatgctatcaaggagtccacaattttccctccaccccatgtggcctcactggctttgctttgttccacagacaaagaatgaacctcagattttaacaaaacattgtggacatttgctctgtaggtcagaatggaattggcaagaaagtataattagctcagcccatcccatctacactgcacaaagaaaataatgagtacactcatttaactcagctatcagcagtgcagcaaaaacaactcccactgaagtgagtcaggagcatcttcataaaccaaggcaagcatattacaccctaaatgatggctcagtggcctcaaggaaataaagtatcttcctaagcacctaatttactaccaggctgtgactcaggctcaggaaaaatcgaatctattattatatattcagaatacagtgagcaactgtggctaaatattgagaatacttaaaagaatggagagttaatattgctaagaaaacaaatgtgtagtctgaaattattttcactgcttatgtgtatgtctgtcttcctgtcactgctgtttacacacccatctctttgcttttttgttggagttgtacacataatttgatgtgcttgcacagagttaaacatccctattctaatggcttcatacctgctaaatttgtctactcctatttccttcaaatgctagaaaattagtgaagtccctggcaactaagtatagtctgcagagcttaccccaaagctatgagatttgaaactctgttagtgtttactcagagtcttcatactatcttttactctggtcacttggcttatggttcccctgttccttcctcctccctatggttttcagcaaatatccagcttctgtaaacattccttcagtagatctgaattgcatagagtataacttcagtgacaccaaagtgtgttttgtagcatgttgtttctgatgattgaagcaatcttcctgtgcagaaaggtgatttaaaaatggagccgccttatacaaaattacagctagataagaggaatgaattctggtgttgtgcagcagtaaagggtgaatatggttaactataatttattatatagtttcaaaaagctagaagagaggatttttgaatggtcacaacacaaagaaatgatgaatgtttaaggtgatggatatgctaattatcctgatatgatcattacaccttgtatacatgtatcgaaacatcactcttatcccattaatatgtacagttattatgtgtaaactaaaaagagaaagaaaaaattgaatcttaatatcttatattggcatagaatgtagtgtattgtttatagttcactatgattaattgactcatatttggctagtcataacatgtacgacttgtatgttcttgtaggaacatgtacgacttgtatgttcttgtaggtactgtcatgatggcaacttgggtcattctgaagtgtgattctgaaagatctggttttaggtttcaacaaaagttatttaaattttaatctgttccttgctctaggataatcacatttttttttagagattggtaagcaattagctgctgccgcttctaatgataatagaatacttaactataacatgaatttaccaaatgaatccttttggaatggaataaatgctcaagcaggttattctagtaggaagagattcatgcaaagtagagttatatcttgtttggccagtgtagactatagaactcagttttggtctgttgtcttcttgctgtaagaatacactttaggatacttcatgagttcaggctgagacctgggaagtgctctttggacaactgtctagagaaggcacatgctattccaaaagtgctaagcaccatggttgtcagaatctagtttaggaaaactagtgcacgtgataggcacttaagaattctttgttgaattgaatgagtaaactcttcattaaatggcatatagaaaaaatggtcttcataagtcagccagaggtgataccacacattctgctaaacaacaaacattatgtgaagatgttgttcagaggagttctgactgtctagggaaatcatgcattgtgattctttacacaaaccactttctttctggaaccagaacttatacctgctttacctagagaacagaatagaatagctaggctcatctgaaaatgttttagttgatataaaccagcacacataattgaatgtcttcttttctgaacaactgacatttgagagtcagtcaaagaacaagtctatgtctcctttccccagtagtgagcttcaaagcagagcaaatggatccatgacagggccgaggagggaagaatcagatgtggagtgcatgcaaccctacccccagagacataacttgggcaggagaggaaaagaatgtatatctggtacaccctgtctcccttacagttatcacctttccatcaactgactgtgtttattttagttggaagtcagcatttaaccagttctgcctgaagcttagtgagggagtttgattctgagaactgtgttctcactgaagggcaatattctctttctcttggggaaggagtgttgtttgtatcctcctgatgttgagggatatagtagccatcatcatgtaatgacataccaaatgtattttatctgagagtttaaaaattagaagcaatccaattgctgatgtgattcatgaataaatgatgcaacttataatgacttggtgataacaatttattgtataccaatcacgtgcactcagaagaacctgtgcatgaaatcaatgtgagcgctaagactaaatgcaaatatattgtggacatttaaagttttagcccccttgattatctttaaggtaatatatacaacatatttgccaatatagatttttcttcaccagccatctggtaaaaattagtatgagataaataatttagcttccttctgttcagatacaacttcattatcctcttccttgatgctgtgaaaagtcttcagaaataatcaatggtaaagtgcatttgcattcctgtcaaagctgagcctggaggtttctgacatgctgacgtttgattctttttctctgtgcgctgtgaaaaggagaggtgcctattatcaactggccccaaagaattgcgtgcatagtggcagccttgcacaagtgcactgcctgctaaatcacagtgtgaggaagcatgacatgacacaactgggatgttcgagaactgcaagtcatttttcaggatttaaaaaaaataatactgcagaacataagaaagagatttaggaggaattagttacatactccttgtgacctaatgattctctctctacccacagagactatcttacccttgaagcacagtaattggtttgtaggagatatttttccattcataagaaaaaaatatctcctacttttcatcctggacttatttctccaatctggcttgagttgaggaatcttatgctagagttgtaggagagcaggtgccagattgtggagggccttgaacgcccggccagggagtttagattttatcctgtaggcagcagagagccattaaaagattttgagcaggaggaatgtaaaaaataggacttgatttggatgcacgcttagtataaaagtgcaatgataagatatattaagggagtgttacggttctgttcacagcatgaatataactgtaggattcatctctactagctgactagttcagtttttatagcatgcaaattttcagagccagctgtaagaggttgatggtaaaagaacaaagtacgaattgatcatgtgaatgtaattgtaaggagggatttttaaatgatcaagatcactggtaacacagaatagtaatcattttaaagggtgactgtagaattatttgttattttgtttgagttatctgaaaccacttctatgctatataattaccttaagttttaagtgctccctgcagggataatttatgcattttgcattctcatgcaaatactttaacagtctacattgttgaaaatagaactgaacattatttcagataggtaatggttgtacaaagcttatgaagtattcatcatttttatatattctcatggtttatattatattactgtgttgtgttttcagctacagtgatacttaggtaacaaatatttgaaaatttaaattgcatgttttgataaagaactgtaatttgccaatttcaaaatttaatgtcatcaaaatccttttaaaatattaatataaaatgttgcagtatttcaggaaatacaaggcaagccaaatttaatttaagctactaggggctcagttatgaattgtagctagatacgtggccaaacactcccgtaaagcattgcatttttaggattcaggcttcaccgcagtggtttctgtagagccataatataagatgataatcataaacagcatcacaggcgatggcagtttagtcgtaaataggaaaccgttgtcttgttcactgcaacatagctacacatgtaagcattatatatcccttgtgaaaatgtgattcactttatgatggtgacattcatatttcaaagtgtcttgttttaatgagctttcacaggatttctttgcaccaatcttgaacttctcaagagtcctggatttccttttttttttttttttttttccccagagatggatgtgcattaagcataggaaaacctccaggaagaaatatgtttactcctctgtttggctcctctatagacactaactttacagaagaactttacttaccttgggcagcctatcggatttcaccctgagctctgagcacagctgggagtttggacagtaaagagatgtcttctccagcaaaggggagacaacttactttccagccttccccgttaaacattcacgggtgagggtggtggatatttctcaaagtccacaggtttatagaattggggaaagcaaatggcccatttttttaactttctgtgttttcactctctgttgtctttctccgctttgtatttctgtgtttcgctctgtctctctcatgtatgtatgcatgtgagtgcacacatacacacacacgaatctgactaaataatttatatatctccttatatgtgttacctgcgtctgtacctgaaaaggcagaagcctaatttcagtaaaggtgctctagggtcatttcctgaatacctctagagtagagttcactggaaataaaaaacccaacatgtgcccaaactcagttgtgagtatttttgcagtagaagagtgaacttttcatgccatgatctaggagaatgttaagtggacagatttatataagataaatggaatgctgctgcccgttgtaatggaaaaagaagcggcctaggggataggctgcctggcttggcttctgctctgtgtcagacctcttcctaccctctggaactcaggatcagttggagctcctggatcttcagtgtcttgcagccccagaaatatcacatgccagtaccagctaccgtaaacagattccagcttcctctagaaggagctgcttccctgcactggattagttctccagcagaaagtgttaatgccaggttccagtgtattagcatctcttgtttcatttctttgactctaaaacaagctctttagagatttttttaaaagtctaccaaaacccattataatcattacttttgttatcattacttttgttaaactgtcccttacctgtcacttgaatgccataactattcaagcagttgtagaaaactttaaatgtaggcactgcttaaacataaaatactgttatatttttcattattgttattagtaatctacattatgaaagtagaactagtaaaacagtggtttggaacaaaagaagtgagataataacattgtagttttgtagcatagtaattaaagtgagatgtgtaaatgtcatctggcctattaatatggaattatttcacaaatccctttattatcatgtggtctcactgatacacattatagtaattctagtattagattcttagaatattttaagcgctaaatcaaaggctcatgcattgtcatccttgaaaaggaatcactactgtaagcatttctcacacatacaattaatgtgtagcattagcccctcacagaaatggaaaggtgcttttcttctctgtttttattgaccaccaccagtttttataccaatttcaagttgcggggtggggagaatactacattttcttatatatcacacaaatggaaagttaaaggaagggaagagatctggtagttgtcgagcatttccacttaagctaactgcttccccatgccttctgtgatcttccgtatgaagcacatgatgctgtccccatcttgcagatgcaggatcagaaaacacacgaattgcctacagtcagaaaacttggaagtggaagaggcaactttgagctgagctcttcaaaagggccagggcacacaaataggagggagggctgagccttcagcaaacgttgaagttgcgcatttagaagggagttggcattacagctgttgtctacccagtgactactctgtgggtgaaaaggtgcacttgcaattgagtttattttaaaaatgacttgttaagggcaccattgctgtgattttctcacctgtgaggtgggaggaactctcctctcaggccagagggaagtaattactgagaggtgccttcaagagtaaagcagattgttatatatttcaaagggggctgtcacagtgcctgggacacagtaggctttcattaaatcctagattagaattaattcttctatttgggtctcaaatgaataaattggctccctccattcagattcgtgacaaatgactgccactagcatcctctcatgtagctcctttcaaggggctgatgagtagaaatgcattcttcataaaaaaggttcctctctttagcacttgttatcctcagcagtcatttgcagatgtaatgtgatgcagcagtttaatagtcctctgcagcaccattctcatccattcaaatccttggtttatagatgaggcctttgcaccttgccctgtgacaccagcttttatgttttgcagcagaaagaatgctatagtgacttccatttgagcagttgctgttggctagcattactttcctacttgttcaagaaagtctcctttcaaagtttttgaagaagcagactcctaattactgtgacacttttcttcagagacaaaccctaccaaatgtaacagagctgctatccaatgtgtgtcaaaagtgtgattctcaaagattcctggccaggtgcggtggctcacacctgtaatcccagcactttgcgaggccaaggcaggtggatcacctgaggtcaggagttcgggaccagcctggccaacatggtaaaaccccgtctctactaaaaaaatacaaaaattagccaggtgtggtggcccttgcctgtaatcccagctacttggaaggctgaggcaggagaatcccttgaacccgggaggtggaggttgcagggagccaagatcatgccattgtactccagcctgggcaacagaacgagactccatctcaaaaaagaaaagaaaaaaaaaatcctgaggtacaagaatataatatgcacccaccttggtatcattttatttttaataggccttgccagagcttttcaattcatctaggaggaaaggacctttgtcttgtgcatgacagttggttggatctctgtgaaaatttttcagagctcctaagctttgaatttttagtcaagtgcttgcaacagctatttaaaaagacacaacctactaagcttgttctcctgataacatgtacttcagaactcatattcttgcagctggatttagatcccactctgaagtcagtacagagaagaggactgccacaaatgagaaagcttcatagtagcagagactatgtatccaataggcacaaattaattacagagaatggctaaaagactagaaggtttgtttttagaaatcatatctgatatttgattcacctttcaaaacacatagatcaacactgccattaaaaaaaccaatatactgaattaatacacataataagcaggttaatagggggttttttagggggttattcaccttagagaagtgttcttcgcttgaaataaaaaattccacagatttctgttaaacagtgagatgccctaataagttttaaaatatacaacagttcacacagtctctctagaacatattttatgtaaaatgaattacaccctctgccacctaattggattgcctaaacaatccgtatccttctgcagggttaaggtcagactaacacagtcttgggccagtcacacagtcttgaagacatatggcctatctctcttctttgtcacgagtctcaacaagctacttccatgtcaaaatgtatttgctgaccagtcttgcaggagagtgaggcgtttggatcatgtaatttttgtatcacgacaaaaataacccatcttagcctctggaagggatgtattgtatttgtttgttctcattctttaacttctagcttatttcagtgtgttttataaaacattgttttggaagaatggagagcctgggtaatccattgtatgacattgctttagagaaatatatgaaaatccagaacaattcagtatagaggactaaatgaactccagggctgaaatatggtcatatctgagtcctagctctgttttcagcagtccattggttgacaggttcctgaatagttttcttatttttgtttgtgaagaactaaggagaaaaagcaacactgtgttgacatattttgtggggccaacataaggtaaattaaaatatctatgaaatatctaggaatatagaaagtcttggtaaagaattcagtgtaaccatatgaggcaaaatagtcccaatgtgcatactcttaattccaatttgcatttctttagaaatcgttgctaattaacctgtgtatttttaagtcattttgtggcatggtatttcatgaagcccttttatttaagcactgcatttctttagtgctatggcttggattactgcagccatttcagcctattgcagacagaaatgaaaaatgaaaggaggcaaaacagttctctgagaaccaagcttgaaggagagtgctgaacacaaagtgtaattcatgtacagtcctaatttttgatagaatttatattcttccatgttaataaaacacatatagccaggccttttttttgtaaattgattccatagtgaaaaagaatcttgaaaagtggatttatttatttggccttgatttctgggcccgtattatcagaagcaatcccacatttcatgtttatggagctttacaatattcagagcttctttcaccctagatcatctcattgcatcctcatacaacaaccagtaagatcagcagaactggtagatttttttcaccattttacaaaaatcggtctaatagaatttaattgaaacacttaactatttgcagacaaaaagaccaggagtatgaggttcttgcctatgtcaggattattaggaatttctttatttttgcttaagtattgttttgcttttgttattctctattcttttcctccttttctccctccctccctccctgcttccctccctcaccctctcccccttttctctatacctcccctccttcccctttctctcatcctttccagttttgaaattgaatttacctctaggccactttcctcctttgatcgcctactttttctgctctcacaggcaagtttctgacttgcctgtatctactttaaaatagtcctctattcattggaaaatgtagtgccacatttaacccttttttggatttacacaagggagcttccaaagtttcttcatatattctatttttaatttatttgtttcactaggtatgtattgataatttactgtatgccagcccttatgttaggagctgccctcaagtatctaatagtccagcagatatttgagtgagcaatccatattctgtttatcgtgaattaataattttgcttagctacagtgcactgggtgagtattgattccctcttccccagtctctcccttcccatgctttgatctcagtaataatgaaattcattcacatcaaatataccctggaagagaacatcaaagccctaaatataataattagtcctggattttgaaatcactggtggaggggaagcctgtatagagaatataggtagttacattgtcacccctatgggcatgatttatgttttaagattctgttgtttcaagttttttaacagagttgaaaatctaattttaatctgcatattaatttcattaggctggggaataattgatgtacacaagtcaaacctgcttaaataacctaacttttaatctggaaaattaattatcatcggaacatggctcagaattagaagagtgacccttgctattggcagtaattgttcaattaattggaatgatcaggctactgaaaatgtgactggaagagaggagaagaagagagaggtgggaatatagaaggaaaaggtagattagttaaaataggtttataaaacctactgaaaagaggaaactgtgtttctaggttcattatgaaacattctttaaatgcctactcataatatctatcaactgtttttctttctgtgttctatggttcttgctttaaaaaatgttacatgtgaattaaacaaaatgtattgagacacattaatctataccaggatgtgtgcacttggcaacactgccatcacaggctttgttcgccaggctgaggacttagtgttcccattttatgtatggacaacttcagtaccctctgttgttctctccagatccaagggaatcagtgcagcccatgtaaaaaaaaaatatgtttttgagagaaatgtgttaaagggaaacatttacagtctgcatggcaatcctcaaagcctcccatcctgctgagatacggacacacatgaaacagtgccaccctatcagttgcactatagctgaaaatacaagagcagggtgaaaaaaaagtatgaaaaacctgttattaaggcctatgtttgccaaattacttatttgcatcaggaaggcatttagtcttggtgtgtatcttttggtattggagatgtgtttaagacgctgaaacaacataaatgttttacagatattttagctctcatcattttggtatggctactgaagatatagctacacaccatctgctgactgacatggtccttacttggctcaattcagggaagccatcatcacagcccactcgtctattaacctggctccagctccgggaggccaaagagatactacactctgtccatactttgccctcggtgccaggggcaagccaggccactattgcttcttctgactgtaacagagaataacaatttatattgctcccaagcctttgttcgggggaaaaaacgttttctggcacacctttgggtcttgcggttatttccatatattcaacataactggttgcactaatgcattctttacttgcctctctaaagtctgtgtggaggtcttaatatgccctgagaagggcagctgatcattaacatctgtggctgtaacaattccccaatatgttatacagatgtggtgtttagggttcaaatgttttattcttgtcagtgatatttcaacctccaaagaattatttcctccttaataatgtgagtacattggtaaaaaggagtattagattttgctcctggatccacctactctctgaatgtagattcctcattccttatccaaaatattatcattatactataatgatactaactgataagaattttttttttttattgagatggagtctcgctatgtcacccaggctggagtgcggtggtgcagtctcggctcactgcagcctctgcctcccaggttcaagtgattctcctgcctcagcctcctgagtagctgggactacaggtgcccaccaccatgcccggctaatttttttttgtatttttggtagagacagggtttcactgtgttagccaggatgctcttgatctcctgacctcaggatccgcctgcctcagcctcccaaagtgctgggattacaggcatgagccaccatgaatttcttaaataaaaggttcagtattcactgagaagaaccaaacattgaactgcaagagaaatagacatgattatacagaggaaagatattagagacagattgattatttcattaactaaaaagttgttatttttctgaaaaaacatagatatgccaaacatacatttcttttaagagaaatcaacacataaaaggtcagaagacttaaagcatcttttattttgtactcatgtcaagtaatttctcagtaactatgcagggaatgcatgacatctttttaactcattcatgcattaacgacaatagcagacatttatccagtgcctgttaaatccagaacacagtgattgctgcctttatttagtgcctctcatgtgtcaagagcgctatggtaccttcttccagggcactagtgagcatcttccagatcagtcaaagtaggttggttccttggcatacatctacttagtctcctctgaacagggatttcgtgggttgggacaaatccaatttctattattcatatgaatcactgcagagacataggggtgaaactgtatccttttggtggacctgcctgtgttgggtgacatgctcacatttttccacatttgataaaaatcaagcctcttctgcctactcaacactggataaaatgacagtgtcatacacagagaacagaacactcctttggttgcttcagcattctttttttggcctcatttttctccctctttactgagtttttgagtccaaatttagtggtgatgactaagaaattgccaggatgtgacagagcattcagttcattgagtccttccttgccatttttcaatagttgtaacaattgccaagattttctcctgatgttataggtgccacgttataggtgccagatactaaattacacttgcagaatctgtccatgcagtgacagcctcattttacatacagctgatttcatgatatggtattaaggaaaatccctgcagactttttactagttgataattctgagtcctagaatttccaatatttaaatctgaatctctgaaattcaaatcacataaacaataatcaagcggtctgccatgtgctaacgtgtcatttttgttgggggaaggtagattggggaaaaaataagacaagttccctaccatctggagctaatcatacagttgtatgagtcacagggccatgctagagatgtagatagagtttatgggagcacagataacaggtgtaatcagttctgattgggagagattatatgtgattctggaaacagtcatatttgagctaggccttggagggttagaggaaagccagtaggtagagaaacaaaggaatgacattctaagcaaaggaaatgaatggcatcagtaaagcgcaaaggcacacatggttctgtggtgaatgacactggaagatgacgctggaaggcatggtagtgactgaattgtggagaatttttaaatgttacatcaagttgtttgttgtttttactataggcaaggtgaaatcatcaaaatttcccaaggaagggaactttgctttaggaaagcaaacctgccagctgaagagaagaaaccagttaggatgttatgacagcagtccagtgaagaggtaataaggcgcaaagtagagcagtggcattgggaatggaaggtgaaggtcatggatcacggactagagggcacaggaatgaaatgaaaggccctctgaagtgttaagtgagcaactgccaggatggtggattccagttactaagacagggaacacaggaaaagtagaggaagtgtggccctgtgcttcaaatattattcttccctgttttctgtattgaaaagctcggctaaaatgataccctctctgtgaatccctccctagtccctcagtcagaattaagtctggctttttctgttttcatacagcacctcctgtaagcctccctttctttccttatggtagcacacattgtatctatgacatttgtgtacatgcttgatacctacaaatatatgataagctgtctgaagccacatattacttacctatgaatatttagcaccgatcaactacataatggatccttagaaaatgtgtattaaatgaatgtatgaatgctgctatcacacaagacattaaatgcagcccatttttgggacctgacttagaatatgcaatgatcccatctcaccattctggagtcagccatacattgtttatgtggctatttggtatcatttgccttgatcatatgcatttttcaccagatatattttcaaaatggtttgattctttatgaaaggaaaatccattctccaatgatgacttttttccgtacagtgatttaattcccaaagaatttcagcaacgttctatgtacttgtcctcatcactaaaggaaatgtggagacttctagtcaaatttcttggtactttcttggctttctctatgttgagaaatcctacaaagaggagttttcacagcccataaatagaacattttggttcctaacatgtgacagttgccttagaagtacattgcttcttgagtaggttgaatttgtgtgaatcctctgaacatctatcgagtgtgcccctaggctgaaataaccccaaaagatacttcagttcgtgcattctgggagccagattgggaagatggggggagattaggcagattactgtgtgaaacactgtttgtagaatcccagaaaaaaggaaaggaaattgcttgagtgcttaaatttcagagaaaagctgccttgcctgaggaatatatccctctttgctgaagtgactgagagggcttcagatgttgctgctcagctagtgtgtattgcttaaaatggtatccaatatgaaaaataaaggaaggtagaaccatggagacattgtttttaaaagactagtgccccagaaagcttgcaatatttgtttgtatacatgtttttggtgatagtaccaagtgtttttcctgataacatctcagcaaattagcaaaaatctgatagtttaattggtgcctctatgacatgtagctcacttagcattttcctaataatcttccactccaagtaggccctttgctactctatggattacttatacattcaaatctactattcatttcatttagcttagaaattatcatttttaatggctgtttattgtacacatagacacgtgtacactcaaacacacaaaaggttttttgttgttgttggtttttttgtttgtttgtttgtttccttgaaatggtctattgagggcaggagcccttcatttgaaaaatccagtctaaagtaaaaatggccaaatgcatgacagaaaaccatattcctgagttcaaagtccactgggctgctctatcgtgtctgctagtaaaattgctgtaaattccttgcttttgtattgatttgcatgtaaatgttactgtaaggcaaggatggggtgaggggggaatttttctttctgtctcaagtcaaggtccaatgatccaaaaaaaatcaatttggtttacctaaaagtaaaaggtaggctttctttgtagcattcttttagaaatataggcagaaagcattgtaacacagatttcagcctgaggcaattgacaaccatagtgtataataactcaagaatccatgaaaattaagtacaaggaccgaatgtttattttctcatattgaaccctgaagggaacaaagctccatgtgtcagttttatgcttgtcttttcaatccttggctcttgtagttgtccaatatatttcacttatgtggcttgttctaatgttcccattacctattacaaagagagctaatcattgatcaatagcactttcacttatgactttttctaaagcatcatgtgaaatgttatatgtagtctgatggtttccaatgatgatagtttatgctattaaaatagagcaccagtcacacgagcttttacaaagtatgtcttaatctcctaaaaggcaataccacatgattctacaggaaattcatagctataaacactgaacttttgtttatttacttttgttgcaggaacttttcacacctgagtgcaaattcaaagaatcagtgtttgaaaattattatgtgacatattcatcaatgatataccgtcagcagcagtcaggccgagggtggtatctgggtctgaacaaagaaggagagatcatgaaaggcaaccatgtgaagaagaacaagcctgcagctcattttctgcctaaaccactgaaaggtacatttgatattgtgggaactatggattatgctactaaatatacttatttatttattaaatttcaatagttttgggggtacaggtggtttttggttacatagacaagctatttagtggtgatttctgaaattttggtgcactcatcacccaagcagtatacactgtacccagtatgtagtgttttatccctcaccccactctcaaccttccccccaaccaagttcccaaagtccattatatcatgcttatgctttatgtcttcatagcttagctcccacttaagtgagaacatacaatatttggctttccattcctgagttacctcacttcgaataatggcgtccagctccatccaagttgctgcaaaagatatcatatcatttctttttatggctgagtagtattccatggtgtatatatataccacatttttttatccactcgttgattgatgggcacttaagttggttccatattttggccattgtgaattgcgctgctataaacatacctgtgcagttgtgtttttcatatgatgacttattttcctttcagtagctagccaggagtgagattgctggatccaatgctacttttagttctttaaggattctccatactgttttccatagtggttgtactgatttacattctcgccagcagtgtaaaagtgttccctttcaccacatccatgccaacatctgttgttttttgacattttaattatagccattcttgcagcagtaaggtggtatctcattgtggttttaatttgcatttccctgatgattagtgatgttgaacatttagaaatagtaatttaaagcagtccttaataatacttttgaaaatgaaacagttgttccacattaagacatttatttaaaaaacttacattttgtaacactcaaaaacatttgctctcctgattttaatttttccatagtgcatgtacatatagtgacactttacttatgtggaagtaacttacatgctaactcaggacagccaagatccccaaattatgctaaaatgttgcctgggcagaaacataggtgttaaaaatgtgtatacacagccgggcacggtggctcacgcctgtaatcccagcactttggggaggccgaggcgggcggatcacgaggtccggagaatggcgtgaacctgggaggcggagcttacagcgagctgagatcgtgccactggactccagcctgggcggcagagtgagactccgtttcaaaaaacaaaagaaaaaaaaaatgtgtgtacacttaacacttaccagaaagctccttgggtcctctctaagggcccaacatattatttcagcaaattttgcttatagttttcccatcattattagcagattaatagcaaattagaaagggtgagggacaagaataggctatggaagatagggaggtaagaaatagtgagatatggtagagaagagacagaaaatgcgggcaaagcagaggaagacttcaaagagattactagcctgaggtaagagtaggggtttagagtagaggcagacactgtgcaattcgaataagcacagcactgtgttttacagcacattttttggagccagactacctaaattcaaggcccaacttcactttttgctaactggatggtcttgaacaggttatttacctgtgtatgcctcaagttcatctgtataatatggataagagtacttataagattctcatagggactaaatgggataatgcatgcaaagaacttagagtagtatctaatgttatgtgttccataactataagctattatgtttatttatagcacaataataaattttaccatttactgtaccaagaattatccaatacttagactcttgaagtgtttcattttaaagtatgatagaaatcagtgttttaaaatattttaaattttaatatttgccttgtacagtatgctatagatcatatttaaacttctaagaggtttattaaatgcattttttattaatcctctcttacataaccatatgtggttgaagttaggcattaaaattctttacacactactacaccaaggctagatttttgcttaatctgaacctgtccactctctactgagtccttgaaagcagtgtttttcatgtctggcttaaggcacagaagcctagtaaccaaaagaaaagttgaggaccagtgtggtaggcccatttttttaatgtattttttttctctttttccttttctgaatttaatttataattgacacaaaaattgtatatatttattatgaacaaggtattttgaaatatgtatacattgtggaatagctaaatcaagctaattaacatatgcattacctcacatacttatcatttaggtgtgtggaatagaacacctacaaactattcttagaaattttcacaattggtatgcccatttgaaggccttttacaccatctttgtgtgcttttcagtggccatgtacaaggagccatcactgcacgatctcacggagttctcccgatctggaagcgggaccccaaccaagagcagaagtgtctctggcgtgctgaacggaggcaaatccatgagccacaatgaatcaacgtagccagtgagggcaaaagaagggctctgtaacagaaccttacctc

SEQ ID NO: 1313 - DNA, 79 bp, mus musculus
gtgctgtctagacatcaacagattgagctgctcccatccctggggacccccttccccactacactgaccagtgcagccc

SEQ ID NO: 1314 - DNA, 133 bp, mus musculus
ggtggctggaacacgagctgggagcacaactggcccccggctagaaccttgcgcgcagacacactcgcgagggcgctggggcagcccttgctgccccacgtcggggcggctacttccctcagtttgggccgaa

SEQ ID NO: 1315 - DNA, 525 bp, mus musculus; identical to SEQ ID NO: 212

SEQ ID NO: 1316 - DNA, 546 bp, mus musculus; identical to SEQ ID NO: 213

SEQ ID NO: 1317 - DNA, 35276 bp, mus musculus; identical to SEQ ID NO: 1023

SEQ ID NO: 1318 - DNA, 31405 bp, mus musculus
caggtttctccgggcggcggcggcggcggcgacggcgacggcgacggcagcggggacggcagcagtagcgggagcagcagcgtggacgcggctggcgctggcgccatgaacccgctgtaaggcgcaggctgtgcagcacggggtgcgggggaggaggaggaggacgccgcggtgaagttctccgccatgaacctgaggggcctcttccaggacttcaacccgaggtgaggcggcgtcgttggcgcccccgggagtccgcgctgcgggctcgggcgcgggctggtgttcggctccggggaggcacggcgggcgagatgctgcagcccgaggacccgggcgcctgcccgagcctccctgcgggtgcaagcggtccccaggcaaaacagtcggcctcggcgcccgcccgcttcctcctcccgtgcccggtgctttcagcccctgcccggccacggccggaagggcccggccgcgagccccgtcctgccccaagggaaccccattcttttctgcttgctgtccctcattggtgtcccaacttcttcgtctcggttccatcctcttctgcgccgctgcgggccctccattctccgcgtcagggccgtctcactcgacccaacacccctacccccaccccagctgtttcctccagttcctcgcagtccttggggttttccttgggtttatgcccatccctctcttgtttgcttctttgttgaacggatacctgaaacactgttgaatccttggagtcagtgtcggggtatggcaataccttatataatgcatttctgggtgagcctgatcattttccatactcattttctcatcagtcttcactacaagtttatttgcaggaagtagatattgctgtccttcttttccagatggggaacacccagtggacagtgtggagaaaacactggctaagcactcaagcgcctgtccttgcacttgcccgactgttttgtaactgttctttaccccaggctgtgagctccctgaagctgagaccatctcctgctcatctcagtgtccccagcgcctcccacccaccgtatctggcacatagtaggcacatataaaatgtttgtggaactaaactgagcccaaagacttggattggagacgaggccatatgtaactgggtgattctctgcccttctttggcccttctgtaaaatgaggagttggcctaactgatctcttaaatgcactactctccgaaaggagtatccgtttcccttatttgccagttgggaagacgtgctcagtaaatatttgtgtgctgtaacctatgctaggtgctttagatgctggcggtctcagcatggggtgaagaagggcttgtacacttaagatgccttacagtactgtgcagtgctgtactgcgggggggccaactctggggacctatgccttggctgcttgttgaggatgaaaggaagttttaggggagtatttgtatgttgagggtgcagtctccctagggatggtgacattttaacttgtgagtcattgtgactttgtatgtgctcttattccactttgagttcatgttctggttaggagtgccagtgtctctaacacggtgcagacattatcattgttggcttcgaaggcatagaggaggtaacagaactaactgcagtcccttcctctgctgcatcagggggttaagattggtctgcagggtagtagggttggtgctgtggctggacaagccctgtatgtcttctatttggagatggtgataagaaagttaagtaaaaactgaattgttttgtgcccttgggcaactcacttatctattgttttatctgtagaatgagtataatctctcagtggggtagggaggccaattaaggattgattacaaagtgccttacaaatagaaagctacagtgacttgtttgcaaggtgacagagaattcagaagcctcaagaaactgccttaagtgatcaaacaggctaacagagttgccaaagcaaaatagtgctgcactgatactacctttaaccgttttttcctttagcccttttccccccaaaaaaattagtatatgaaattacagtgaaatacctggtatctaagcagatttatagtaattctcaacatattcatcaatctcttaattctacctgcattaaaatgtatttctacctgaaaagtttaaaggtcttttatactgtgccattttcctgattcattgttgccagaggtagtgagttccttaattttacagatatttcaagaggacattggccaggtattattggtaaatcagatttgtttttttagctggtagtgtttcacctctcctgagcactcctagtttttgacagtgtgctttagtctccttccatgctgaggaaggccttctctataggagaaagaaaactgaggggtgtacacaggaagttaccttatgctggggactcaaaccttgatgctactgctttgctccctgcctctatttttgaaccaattcaacatctccctcctaccccaggaccttgtcacacactgttctctttaccaggaatgtttccctctcttttcctctcctccagacctagtgaactcctatttatcctcacttggcacttgctaagggaagcattcctgacttccctgaccagatttactgctccctgtttctacagttcctgtagtatttactactcctccatcatagtgcatatttgtacccttgtgtctgtctggatgcttatttgattaatacctgcctcccccactaaactttaagctccatggggtcaaggccgtgactgtgtcagtatcgtagcctgcatacttggaatagtacctggctcaataaatatttgtggagtaaataactgaataactctccagagcctataagataaatctagagctgctgctttcaatcactgctttcctggtggtctgtggcctggttctctttcttctcacactcttcccaccttcagagtgcagccattgctttggagagatgggagagaacatggcactaaggcagaatatggctatatttactttgaagagcatgtctttgtcatagaaatagtcactgtcatggtttggtgggtcccaaggcatgggtcatggctccagatcccctttccagccttttggatcttggtaagtctgaacccactgctgcgttggcaaggctctggaaactatagtgacagagaatgattcacaagtgtcaacactcagatgtacagggctgccagctgacccactctacctatttccatctggcactgaactggttgatcatgaacttcttttcataattgctttttagttatgcaggttaagacatgccgaaacagatgtaccggacccacaaacaagtccttccttgaatgcctgaggcttcctaacagtgaaagagccctgttcttagagtaggcaaactgattctgaggcattgtaggtggtagggatctggtagtaggtagcattaggtgggctcccggcactcaccatggagccttgaaattttctgctactttgggggagttgctggttcagagaaggcccttccaccctggtagccatgtggcactggaaggctgtgaaaactctgctgggccttcttagtcatctgttgtgagctcctgatgggagtgtggtgtatccctcaggtgtgctagactggaacaaaggctgagaagtgttgctctgggggttccaacttgtgggcatggggtactgatgagatcagtagtgtttggagacttctgtatgctccatcttcagaagacattctggagtccatataagttatcttgtctcttgtttgaagcaggaaaaaggaatgcgattgctggtaatatagttcactaaagtcagctacctggcctctaacagttatttgcaaagtatattataacattgattcctcaaacatctagattcctatctcgtgccaagtgatgtactaggtgctctaagtacaaaaataaaggaatatagtcctcctctcaatgcgtaagcctagtggaagaagcagaaatgaaagggaaataagaattcaatagagtatgaggcattacagtgaaagaaaccaaatgtcttagaagtacaaatggcagagctactaattctgtctcgagcaggcagggaagagtctatagtggaaatgacttttgagctagattttgaattgagctagtcttttgagccagacttttgagctagaattgtagggttgtcatcagaccagagagtaggaagggtaccttgtgaggaagagagagagagatcagattgttactgtgtctatgtagaaaaggaagacataagaaactccattttgatctgtactaagaaaaattgtttctgctttgagatgctgttaacctgtaactttagtcccaaccctgtgctcacagaaacctgtgctgtaatgaatcaaggtttaatggatttagggctgtgcaggatgtaccttgttaacaatatgtttgcaggcagtatgcttggtaaaagtcatcgccattctccattctcgattaaccagggacacagtgcactgcggaaggccgcagggacatctgcccaagaaagcctgggtattgtccaaggtttccccccactgagacagcctgagatatggccttgtgggaaaggaaagaccttaccaccccccagcccgacacccgtaaagtgtctgtgctgaggaggagtagtgaaagaggggggcctctttgcagttgagataagaggaaggcttctgtctcctgctcatccctgggaatggaatgtctctgtgtaaagctgaccattcccattcgttctattctgagataggagaaaaccaccctgtggctggaggcgaagtatgctggcagcaatactgctctgttactctttgctacactgagttgtttgggtaaagagaaacataaatctagcctgcgtgcacatccaggcacagtacctttccttgaacttattcatgatacagattcctttgctcacgtttccctgctgaccttctccccacctgttgccctgctacactcccctcgctaagatagtaaaaataatgatcagtaaatactgaggtaactcagaggctagcgctggtgcgggtcctccgtatgctgagtgccggtcccctgggcccactgttctttctctatactttgtttctgtgtcttatttcttttctcagtctcgtcccacctgacgagaaatacccacaggtgtggaggggctggcccctttcagtatctcagaagggacaaagtacacaaaggcatggggtcatgatagtgcctggtatgttcaggtagtgaagaggtccatgtggtatgagcactgcagatgatatgtgtcgtatgaattaaaaatacatagttactgcaaatagtttttacaggttattgtttttaagaaagcagtatctaatgcacgagtgtactgtcagtactgtcaatgaactacttaccactcaagtgactgcttatctgttgttctgtcctctcaagccacctacagtcagaaaatggtcttgattttactgatgttgctgttaataatagctgtgacttcttgagtacccaccacatgccaggcccaatgtaggggctttgcatccattatccatgatctttacaacaaccctgcaaaattaggtatcagccttattttaaagtcttgacagcttgtgacttccctgaagttgcataggcaggaagaatctaagtcaacattcgaatccacgtcagtctcatgaagcctgtgctctttcctgcgtgccatgccatagttctagttaagtgacaactcctttcctccatgacattgtagatccagtatgctaaggaaccctctatttacaaattgtaagtgattaaacaaaacaaacctgttagtggcgcttatacatccaaatgagtgttgttattcaaagaggttacttggggaaagagaatgtatacacctattccattgttcatactccttgttactcatctggaattccctttaaagtcagtttacatatcacataagaagatccatctcattgctttatgatcatctatcattttcaaccaaaatagttccacctagtttgatcacacatcttattcactaaccttggctctgactgactgtttgccatttccaaaatttgaatccaccctcagtgaaaatttagcaccatttgggatagtcagaagatcagactgcaggttctcaaggtgcttccaagaagaaagcttcaaagatgatttgagtaatgaagtaccattggaattactgcattgcctcccaaggggactggttaaaggagagaaatctcatttgaatgtataatttccagttttaaaagtatcattcctattacttgataattacacacacattgttcttagctgtgttctttgagggccaggatttggaggtgctgaattacgtgctgaatgagtggatgttgggtacaaatagacatctaccactgggaagtctttgttgtacaggagagaccgtggattgaaggagttttagatagtttcctaggactccagaagttaagctttttaatatggagcttgagttttctaatcattttgcctgatatgtcatgcctgtacaagatgactggaatttaagacaaaagcctcgaactctggagatagatgctttataagtggagactcatactttgtcagctccaacctaatagtgacaacaatgattgctaaatgagattattacctacaatgtggcagaacttttgtctttcataatactgctaaagctagaatgggtaaaatgtatcatttacacagtgctttcacatacccttgtcttaatgaatcagtatatgaggaatcagatgaggagacagacctgggggaaaataactcacccaagaccacaccgctgatgaatggcagttgaggaacttaaatgcagatcttcctactggcctgggctctgcttttatttggcttttgtgcttttttgtatctactggttaaatgctcttaaacattttttatcttaataaaaccagctaaagtctccactaaaagactttaaatttggttaataaggtgtaagaggggcagttcccttgatagtttgtgagtatgtcaggttgtcatttggagccattctgtcaagctttagactgggatgtgccatccaaagtttgtgtgtgtgtatgtgcttgtgcgtgtgtacgtgcatgcaggcatgtgttaatgcgcgtgtatgtgctccagtgaagccagcagcttccactggaaaaaaactgataggtctaaaaagagtccagctgcattcttatgatatgcagaaaacagatactagaacttttacattcagagtcatcattcctttgctaagtatattctctctctccctcccttcttccttttctccctccctattctcccaaccctgcaaagtggagagagggaatttgagcctgagcagaaagctccatgtaaatttcagagaggatactagctttggcccaggtagcactacttagtgattcatcgtatactaacactacagattcaaatgagagtggaataaatccattctaaaggtgtaactggaaaagtgaattttaagaagtagtgattaatgttaaaccagaacctcccatttctcccaggtttgtggagaattaagcagtctatttttatacttggaatctggtctgaatgtttcttgaaaagtaactcaaagtagtttaggctatgaccataagttatttttgtaaatacattttcttatcactgtattattgcatattattgtgtattcttttgcaaatcaggcttgatatttccttttggctatgcagtcaccttttagactttgcttgcaaatatattgatatagttaagatactattctttctttccccaactaggagtgtgtatgaattacatcttttgaacttactgattgtattactttgttttacttgatcaactttgtagtttaatttttttaaaaagctagctgttgggattactgatcagtttcatttttatatctatatttctacttttagttttattattttcatgttttggctttttccccaaatttcttagaaactcagtttactagttttcttttgcctcttttttttttctttgttttctacttttacttaaacattttaaatgaacacattttctcttgagttttgttttggcagctgcccaggtatttttatgtttcaattgtattttagtaactctactaaactgcttaacaaatcagtattgaaaatgatccattttttgtcagtgtttttatgaattgtataaaatgtcaacctctggtctctactgattacaatctaccttacacactcatatgtatcttctgtcactcttgttgagaaaatctgcagtggccccatattacctattaataaattccaaggactttaccttgatattcacattcccctaccatgttaccacagccaacttctggcttattccccccagtaccctttctcctgtctctgcagcaccctacccaccacgatttatagaaagtattctgtgtgttccagtctgctggaattggagaggggaggataaagaggggatgagcaatgggtacaataatacagttagatagaaataataaatctagtgtttggtagcacaagagggcaaatatagttaataatgtatatttgcaaataactaaaagagtggaattgaaatgtgcctaacacaagtaagtgatcagtgcttgaggtgatggatatcccagttactctgatttgatcattacacattgtatgcttgcatcacagtatcacgtgtaccccataaataggcacaactgttttgtatccataataaataaaaataatttttaaaaaattggaaaacatcttattccctttgtctggaattccttattcccaacttgttgcccagattccacttctcttcccatctctctcagggaaattaatcttccaagtcccctagtttaccatatgtagttacttgttgatacatcatctccctctgttcctattagtctgagcatcttgagcgaacgcattgttgctcctttttatgtatctcacacatttcaggcactcaaatatttttaacaattgtaaattagatgtgtgtttattgtgtattgctgccccatgatcctttttttctccctggaaaaactatatatatgtaaagcaagtatgttttcttgttctgctacgtaattatcttcatataagcttgctgttttttaaattttctcgttctgctacttaattctcttcatataaccttgctgttttttaaatctactcttgtgttcatttccgtattttccttaggaactttgtctgttttatctgtcatgatttaagagtagcatgaggaagcccacaattaaaatatttctgtgtatccttaaaaaagaaaaattgtaaaattatttccatattccatggtcatgttaggtttttgttatttaggttttccttattagtccttttagcattttaatactttcggctttgaaatctaatttatctaattttaaagatagtaaattgttgctcttgtcttcatccaggcgtgctaaacctctgtcatctgatttctgatagttggttcgacttttgactttggttccaagcgtaactcttgaatgtaacaggtttactttcttaatctaggaagcaacctttctttttacagagctgtggtaggcagaataatgacgcccccaagtatgtccacatcctaatccgtggaaccagggaatatgttctgttacatggcaaaggggaattaaggtagcagatggaattaagtttgctcatcagctgaccttaaaatagattattctggattctctggctgagcccaatgtaattacagggcccttaaatatagaagagggagacagaaaaggaggtcagagtgattcagtatgagaagaactgcattctccattgttgactttgaagatggaggaaggggccatgagctaaggaatgtggcagcctctagagctagaaaaggcaaagaaacattctctcctagagccttcagtagcatagtcctgctgacacctcaagtttagcccagcgagacccatattggactctgacctccagaattgtaagggttatgccttttaaaccactaggtttatgctttttaaaccactaggtttgtggcagttttgaatggcagcaataggaaattaataagagaacattcagctcatgtatatttttctaaccctagtatttgaatcatgaattatattttgtgggtccttttgtaagtttatcttgttttctatttttcatgtaatagacataaaattttaagtttcctttaaattatgtcaaaaaccacataaaataatcccttttccaacatttaaaacattttggtacttctcttttctttagttccactactctctttttttattaaataaggaaactgttttacagaggataatgaagttagcttacagcatttaccaccccccccaccaatttactttttatttatagtctgaaaatcctttaggataaaaattacctgtacatgttatctaatttacatatgaatcctgtgtcgtcattatcttagcatttgttaatgtttgaatccactaatttcttttttaaatagtctgttttcaagtccattgtttctggtaattatatttgtagccacaggctttagttgacaaattggttctgatttttttagattttggaatatttccctctgctttaagagagaaaacttctgcctctactaattgtgtactgtaattgtggtgataactccatttctattaacttgtgaatcaccttgacacaggctctcttcttgtccaaagtctaagggatgaagtcatttttatcttggtttctttaaatgttctttctttgtagcagcttataaaagcctgtttttgttttcgagtattaataatattagctaatgtgtattgagtacgctggttatcagactgtttcccacagaccttgggagtgggccttgagaccctttccaggtatctgcaaagtcaaaattataatactaagacattctttgccttggtcgacattggcactggtggtacaaaagtagtgcatcaaacagctggtgctggagcacaaatcaggacagtggcaccagctgcactagtcttctgtcactggattcttcaccaccacgtgctggacttgcagttaaaaaaaaaatgccagcttcacttacgaatgtccttgataaagcagaaaaatattaatctcatttaatcttgacccctgaatgcacatctagtttaatattccatgtgatgaaatgggaagaatgcataaaggcctgttgtatgctgaagtgcaatggttgactcaaggaaaaacgtgtgtgcctgagttacaagctgctgttttcatggagtatcatttttatttggaaggacaactgacagacaagactgtggttatttgtgttatggtgtttggcagacattttcttgaaaatgcaggaagccacaataaacatacgtgtgcatgtgtctttatagcagcatgatttatagtcctttgggtatatacccagtaatgggatggctgggtcaaatggtatttctagttctagatccctgaggaatcgccacactgacttccacaacggttgaactagtttacagtcccaccaacagtgtaaaagtgttcctatttctccacatcctctccagcacctgttgtttcctgactttttaatgattgacattctaactggcactattcacaatagcaaagatttggaaccaacccaaatgtccaacaatgatagactggatcaagaaaatgtggcacatatacaccatggaatactatacagccataaaaaatgatgagttcatgtcctttgtagggacatgggtgaaattggaaatcatcattctcagtaaactattgcaaggacaaaaaaccaaacaccacatgttctcactcatagatgggaattgaacaatgagaacacatggacacaggaaggggaacatcacactctggggactgttgtggggtgggggttggggggagggatagcattaggagatatacctaatgctaagtgacgagttaatgggtgcagcacaccagcatggcacatgtatacatatgtaactaacctgcacattgtgcacatgtaccctaaatcttaaagtataataataataaaaaaaagaaaaaaaaagacaaaaatactataataaaagatgcttctatcacacacacaaaaaaagaaagtgcaggaagcaaaacttcaaggaaaacaactcatggtattttttgtaaatggtaaaatttgatctttcatgggaaaaccagaatttttgaaaagttgtatctgctaccatgagcttgacaacctcccagtaattaaaatatttctgatgaagttggtgaagatagtaagtaatgtgattttttttgctattgtatatgaaatgtgtcaacatttgaaagatctttataactcagtaaaccaatattttccagtcgacctacattgcattatacaataatgctgggataaaagattcattgaaagtataagagagaccagtggatttcagtgtagcagagtacaaaaaggtcattgatacgatttcagattccacatcatagttaacctttaagaaactaccacttgttgagttttagtgtcctgttgaagaacgtctaccattatctgaaagagctattaaaatagttcttttctaactacagatctctgtgaggccagattttctttgtatacttgaaccaaaacaatgtattgcaacagaatgaatgtaaatatagatattagaatctaggtgtcttctatgatatcatacattaaaaattttgctaaactgtagaaacagtgtcgctactctcactaaatttgtgttggttttggaaatgtttttaaataatgttatgtatgttagtatgtaatgtgtttattattaccttcgaagagtagatattttttgaataacaactgtatcgtaaatattaaataccaatagggataacccatatcaaccagagctctttgggatcctcagtaagtgttagaactgaaaaggagttctttttaagagttaaacgtcaaaatttttgatactaaaaactttgagagccactgatttagtgctttatacaaagcacttgttatactcattatcttatattcgtagccaccttatgaggtacatattattgccctaactttatgggtaagaataccatgacacaatgatgctatgtatatttttttagcaacccctctgaatctcatgatcttcccagcgtagttttctctctgggaggcttgcttccaagtttaattttgtaggtccagtcttcttacaaccctcctcccttttttccaatcgaagtttcttatgttatttttcatagtacaaaaacagtacacgtaccttacagaaaactcagatatcataagcaaaagagtataaagactatccttaatcttcccgagtggagacctgttagctgctcagcagatatttatacagatgcttttctaaacatgttcatttatcagtgtaaagccggtatagtataatactcaattagaaggattttggagtcaaatggtttgactcccaactctgagctcttagacaagttatttaacatctgagctttctgttccttatctgtaactgcactgatctgtttttctgtgtctagagttttgccctttccagaatgtcaaataagtagcattgtacactatcttgtgttttccatctgaattattttacttatagtgcattttagattcatcaatgttgttgttgtcatccatagtttgttactttttactgctgattagtattccattgaacggatatatcaaaattcagttaaccattcaccagtttatggatgtgtgagttgttaccagtggcaattatgaataaagcttcttggaatatttgaatacaggcctttgtgtggacatacgttttcctttttcttgagtaaaatacctaggtgtgggattgctgggccatagaataagtatacacttaactgtataagaaacttccaaaatgttttctaaagtggctgtactattttgcattcccaccagcatatataagagatctagtgtgtgtgtaatcttatctcattgtcattttagtttgcattgtcctaacatctgaaaatactgagtattttttgtgtgcttatttgctttttgtatgccttctttgatgggatgtctctgaattttttggccattttaaatcgggttgttcacttatttttttagttgtaaaagtcctttttatatactggatacaggttactttgtcagatacgtgttttcagagtatggtctcccagtttgtggcttggctgtcattttgttaatgataggtatcttttggagagtaagagtttttcattttggagaagtccaatttcatatcccatctaagaaatgtttgcctaaccgtaggttgcaagtatttttttttcatatgtgttttggacattttatagttttgtgtatgacatttaggtctatgatccatgtcacataaatttttgtatatgttataaggttaagagtcaaggtgtactttcctcatttatccagttgtaccaccatttattgaaacataattatttctccattgagttgttttggcacctttgtggaaaattaactgactctatatgtatgggtctgttttccaactctctagtacgttctatatatctattcttatgccagtactacattgtgtttattactgtagctttatagtaagctttgaaagcatgtagtataaattgtccaactttgttctttttcagaattgttttgcccattctaggtcctttgcactgtcatatgacttttaaagtcagtatgtcaatttctacagaagaacctgctggctcccaattttcgctgggattgcattgattctttaaaataatttggttaatttggtgtgtgtggtaggctaaatcatgacccacaaagatacccacttccatggaacctgttaaagatcttgagatgatggggttatccaagtggggcaataaatgcaatcaatcacaggttcccttaaaagagggagataatattaagaggagaaggcagtgtggtggaaacagagacagagatttgaagattttatgcagctggttttgatgatagagaaaggggccatgagccaagggaatacagctctggaaactggaaaaaaacaagtaatagattctcccatagagtctccagaaggagtaggtcctgctgacatcttggttttagcccagtgaaaccctttttggacctctggcctcaggataataaatgtgtgccattttaagtcaccaattttgtggtagtttgttacagcacccataggaaactaatacacagaggatgtaaatcttaacagtattgagtgttctatgaacacagtatatgtctccatttatttagatctttaatttttcttggcagttatgaactgaatgtgtccctttaaaaatcacaagttgactctagtccccagtgtgatggtatttggaggtggggcatttgggaggtgattaggttatgagggtggaaccctcatggttggaactagtgcccttataaaaagagaccagagagctaactcactctcttttcaccatgtgaagggtattgagaagtctgccatctgccacccagaaggcagccctcgccagaacccagccatgctggcatcctgatctccaacttccagcctctggaactgtgaggaataaatttctgttgtttattagcttccccacagtcctaccagtgttttgtaggtttcagtatataggttttgcatatatgttgttacatttatccctaagtgttttatatttgtgatgctattgtaaatggtggattttttcataaacttttaatttttgaatagttataaatttataggaaagttgcagtaaatgatacatatttttaaatttctgtttccaatttgtgatagctactatatagaaatgcaataatttttgtaaatttaccttgtgtccttcaattttgttaaattcacttactagatctactagcttttttttagattacttaggatttcctacagggaatatcatgttgcctatagataatgacaggtttacttctttcttttaaaactatattcttttaatttctttttatcatcttattgttgtggctaggacctttagtacaatgttgaatagatgtgttgaagtggacatacttgctgtgtttcctgtcttaaggggaaagtattgagtctctcaccattaagcattataactgcaggtttttcatagatgctcttcttttcctaatttgtttaacgcttttaacttgaatgggtagcaaattacgtcaaatgctttttacacaactattgagatgatcatatgatttttctttttcagcctgctaataccacgaaggttgctaactgattttcaaatgttaatccaagattgcaatcttgcaatcctagctaaaccacacctagtcgtaatgtagtatccttatatattgctgaattcagttggctaaaatcttttcaggatttttgcatctctgttcatgagagatattggtctgtagttttctttctttgtcagttttgttatcagggtaatgctggcttcataaaataaattgggaaatgttcccccctcatcttttttgcaagagtttgtgaagaattggtggtatttcctcattaaatgtttggtagattttgccatggcctgacattttctttctgaaaaaggttttaactagaattgcagtttccatgtctttgtttcaagaaatttcctggcataaagttgtttataatatcccctacttatccctttagtattattaggatttgtagtgatatccctgttttcattcttgatattagtaatttgagcctactcttttttactgattattctggctgtagatttaccaattttcttactttctcaaagaaactgcttttagtttcattgatttttttctctaatccctttttactgtattttattgattaatgtgcttacatttatcattttcttctttccatttactttttaaaaatttccttccgtttcttacatggaggttccttacctccatgttctttctagtttcataagatagaatcttagattattgacttgatatcttttctaatgtaagtatttgatgctaaaatttcccttaagtactgctttagtgtatctcacaaattttggtatattgtgtttttgcctttagtccaaaatatttttcaattttcttcatagtctttgacctatggattatttcgcagtgtggcatttaattttcaagtattttgagaattttccagatatttttctattgttgatttctagtttgactccattgtgcttgtttactttgtatgatttcagtccttttaaatttgttgagctttgttttatggcccagaattcaatctatcttggtgaatgttccgtgtgtgtttgaaaggaatctgtattttgcttttgttgggaggaactcattaatattaattaggtcaagttggttgatagtgttgctacaatcatatatatccttagtaattttctgtttatgtgttctattagttactaagaaaggaatgttaatttccatttataacagtttgatttttttatttctccttttagattgatcagtactttctacatgtattgtgaaactttgttattaggcatatgacaaattgacccctttatcattatgaactacctctatttgtccctggaaatagtccttgttcaaaaatatactgtgtcttatgttgtggtaggcagaatgccccacccccacaaatacacagatacccaggccctaagccctgaaacctgtgaatatgttattattttacatggcaaaggggactttgaagctatatttattagcattcgtttctgctgttaccatgacaaattactctcagttctttaggtcagaagtccgggtacagcacaactcagatgggtcttctgcctagtttcacagggtcaaaatcaaagtgtcaggagggctctattcctttctggagcctccagggattaatctgctttcaagcacatttgggctattgtcagaatttagttccttggggttgtagggctgaggtcccatttaccttgctggctgtcagctgcgagttattctcagcttctgaagcctgcctgcattccttggctcatggttccttacctccatgttcaaagccagaagtaacaggctgaatccttctcaagtctggaatctctctgacttctgcctcatctctcttccaccacatttctctgacttactcttctgctttcttaagggcttatgggattacactgggcacacctggataatccagtataatcttcctattgtaaagttagctgattagtaaccttaattccatctgcaaagtcccttcacagtattactcagattagtgtttgattgaataatcaggggacaggaatcctgggaaacttctttagaattctgcctaccaaccacagttatggaccttaaaatagggagagtagcctggcttaaccaggtggactcagtttcatcacatgaactcttaaaagcggagaactttctctcagtggaagcagaagcgatatggcagaagtagtgagaaaacatcccaagcatgagaaagattgaatatgctatagcttgttactggctttgagatgtaggggcctatttacaaggacccaggagaggcccctactatcgcaagatcagctgctgcgtgacagcaagcaaagagacacatacctcagtcctacaaccacaagaaactggattctgccaacaacctgaatgagcttagaagtagattctgccagagtcccctgataagcattccaccaacagacatctttatttcagccttgtgagattctgagtagagaaaccaaccaagcccgtctcgccttttgtcatatagaactgtgagataataaatttacgttgttttaagctgctaagtttgtggtaatttgttacagcagcaatggaagactaaacagatattaatatagtcattccagctttcttttggttagtgtttatttggtataactttttctttccttttgcttttaatctatctgtgtctttatagatagataaagtgggattcttacagacagcatatagttgtcttgcttacttatccaatctgatcatctttgtctttcagttggccatttatatttaatatagttattgacagggttgagttttaactgttttcttgctgcagcctggaaactgcctctgatctgcaaactggggcaatagtagggtttacctcctttatttcctccttctcacctgttctccactgcctgttgtcaatgtctgaaaactgttcttttgtagactgtatcaagcttcttatttaggcgggaaggtaaattatattcctattattaagtcaaggctggaaatagaggtcctcaagagtataatttctaattatttcaaggacatcctctgtagcaattcccttttatatgagacgtgagcatgtgtgtatgtgtaatttattcattcatggaaagtataatacatacactaaaatgttcatgccatatgaatatgacagatggctgcctttttagaaatagaatcagttagtgatagaacttgaccattttcagagcatgtcagccttttccagtctctgtgtcttggtatagctagttccttctgcctggaatacttcctcatctcacttgctttcctgcctggcagcttcctacttgccctctggaaccagctctagggtcaccacatctctgcttctgagtgcctcctcagacacagtctgtatttcctcttccaagctctcatcacaaacattgtgctgtattatatgtttctgtgtggtcttccttctatgaggaagccttggaaagcaggagacttattttagtcttctttatgtttcttttattcccaacacattatgtctgccccatagaccttttcaataaatgattattgagttagtgactccttttacatgctgacaaatgtggctcttattactccccatttcagtatcacatatttgtaaaagtgaatccttcttaatcgttttacttttctcctagtaaattcctcatctatgcctgtctgctgctgttctctgtgctgctggcccttcgtttggatggcatcatacagtggagttactgggctgtctttgctccaatatggctgtggaagttaatggtcattgttggagcctcagttggaactggagtctgggcacgaaatcctcaatatcggtaatactgctttatacaacccattggtctctagcatgagggagcaatatcttgacttttctcacttttgatgaagtaaggaccattttattttctacctatctggggtcttagaactatagtataagctaacagatctcttctgtgtttttgaaaatttagtctttggtatgtattttcttacaaaagcagtgccatttgggggtaagttgccagccagctcacagatgcctatataatccaaaatgcacccaaaatacagaactggtatgccatactagactaagcagcatgaaaccaccctgtttttaggaaaagacactcatattatgtttggtcatgaaagatctttctccaatacagttttggaactggggctccccttgtcccaccctcctagtcccagagctttaggactattagcagtgtaggggaggtggcttgaccaggagaccatgagtccctgagacagcagctggggaatgaggaaagtcaaagattggatgccgagaaggaaagcagagcctttgggggcaggggagaggggtaccctttaccgtttccaactcttgccctccctgctcttggatgcctccgctggcccaaattcctgggagttggctcacgccagcatgcaacctgcttgttgctgggacctgcgagaggctttcccttctctgccacagagactgtaactacataaagggaaaaagggggacttaagactgggaggctattatgaacctccactgggaaaatgaggagtacaggaattcccagaaggcagctgctcatgtgggaaaagtgtaaagttgaaactaccgcaccttttttttttttttttttttttttttgagacagagtttcgctcttgttgcccaggctggagtgcaatggtgtgatctcggcccactgcagcctccacatcccgggttcaagtgattctcctgcctcggcctcctgagtagctgggattacaggcacctgccaccatgcccagctaattttttgtatttttagtagagatagggtttcaccatgccaggctagttttgaactcctgacatcaggtgatccacccgccttggcctcctgaagtgctgggattacaggtgtgagccaccacgtccggccactacatcaactttttaaatttttgtttactaaatatgaaaatgattcagattgtgtaaattacatatcacatacatgtctaagaactgtaaaacagttacacagagagccttggcaggtgagggacattcatgtatagctgtttcagagttcttagattttttttgaaagattgatgacctgtgtggctgtatgtgttttatttttttatgagatattttcagatatctaatattaattgcttctcaaagaatgcaaagttaaataaacatttaggttctactaattgatatttagaatatattcaaacttctctttgttggtcttatttaagatgttttgagcaaggaaaggaattgtgtatgtggggttgaatgtaaggaatgtacaggcgtggtcattctcatgttaacattaaccagtggaacatggttgggtcctacaggaataacctctgatagcattttctctatgatctaacttccggtgtatttgtcacccacaatacatgtatatcataaatgttcatctgtattttgaataaacattgtaggcctttcagatgcattatagagccttttcctgattagcggccttaccattgctcaattgtagatctgttaaggttattgtgcatgatacttagctaattaaactgattttgtttgagaacagttttaactcttgttcttctttctctttcatctgcaggtgttaatttatcttaatggaatagaaaggaaaatgaaaatcatttatacgttttatttgcatttaaaaatagcacctaacaatagttactactatcttgaaatataactggcacttgttcatagaactagagttatttttataatattgtgtgaagggtggtttacatggtttcttgaaaaatgaggatcatgagacttaaggggtatttgcctggttttagcagcagaagcaaatcagcttgaataatcttggaagtaactcttgttgttgaatttaaagatgtgaacagaagtgtttatgtacattgtcagggaaataagaactggctattacttttgagaatatccttatacggttaaaacattaaattctggtttggttgtaatgttcattttgtattatgtagtagttcttcgatgtttcagagattgcctaccaaagcttaggtttaagttagctttctacctgatttccctttgcttttgtcaaattttcaagtaaaattcaaagtataaatataagttggtatttgccctgaactgcttgcttatagtggagattctgaactgagggtgttttcttcttctctcccttttttagagcagaaggagaaacgtgtgtggagtttaaagccatgttgattgcagtgggcatccacttgctcttgttgatgtttgaagttctggtctgtgacagaatcgagagaggaagccatttctggctcctggtcttcatgccgctgttctttgtttccccggtgtctgttgcagcttgcgtttggggctttcgacatgacaggtcactagaggtgagatttcatatatttaagaatgttttccactttgggaggtcaaggcaggtggatcacttgaggtcaggagtttgagaccagcctggccaacatggtgaaaccccgtctctactaataatacaaaaattagccgggtgtggtggcatgcgccagtaatcccagcttctccggaggctgaggcgggagaatctcttgaacccaggaggcggaggttgcagtgagccaagattgaaccattgcactccagcctgggtgacagaatgaaactccgtcttaaaaaaaaaaaaaaagaatgttttcaaaagtaaaatattttgctcagttattcagatgtcaatttcttaccctttgttaggaagagcttgatcattaccaactctacatcatgagacaacaaggcaacaaaagatgatggaaataacaatttttctttcttcacttagaacactagcttttcacccaggacatcagccttctcccagcttcacatcctgtatcaatcagacagaaacagaactgataggttagatacagatatatgtataaagagagttaaggaactggctcacattactgtggggctggcaagtctgaaatctccagggcaggtgaacaggctggagacctaggaggagttgacactgcagtcctggcacagaattttttcctctccaggaaaccacagtttttgcttttaaggccttcacctgattgcatgaggcccacccatgctatggagggtagtctcctttattcaaagtcagtaccttcactgcaacagcaagcttagtgtttgattaaataactgggtactatagcccagccaagttgacactcaaaactgaccatctccccacctcagaccccatgatttagcacctcccctgctgtctggttagcttatcctgatgtgcccctgtgtttgtttattcattcaataaacatttatcaagtatttactagatgccaagccctttttccctaagcatagaggatatgcagatgaataaaataccaggactagtaataatagtaatgaaagtaattgcagataacgtttattgagcacttactgtgtgccaggcattgtgcgaggcacattacatgtggtagttttcttactaactaactctgtgaggtaggtccagagaagataagtcatttgttcatggccacatgtgaaggggcaggaccaggattccgtttgagtcagcccgactctaaagcccgggcacataactacataactgcatagaagctgagggcccaaagctgaatactgatgggttgaggggagaactagaggctgtagatgcctggttttgagccgtgtggatgaagagtgaagggagaagactgcagttggcttaggaagtaaacatagcagctgtagggtgggtcaggcatataagcctagaccccaggtatgggcgtgaggggaaggtatgtagacagagggacggtgatggagcaaggccctgtgggactcagggagaatgggacctagagcaccaggaagggtttggccttgaacaaggggagctattccctgattttcatgctggtggaaaggccacagcatgggtatagtggtaggtaggagtgagccgtggagggagagtatctgatggtccactttcaccctccctacaattcccagtttatatcagggacttgagcatccatggattttggtatccacagggggtcctggaaccaatcccccacagatactgagggacaactatacaaggactaggactgcattgggcctgaattacagaaagtaagtctttcatatattcacactctaggcattcctgcccttggaagaaacaacataccaggagctgagctccctcctcctgtgatgcaagaacagtacctatgttggtgagggggtggtctggagtaggctcatacagagatgggaaggaggagttgagggtctgccaggaagccctgtgttgggagggaagggatggcatttttgggacacattgaagcctagaggcaggaaacactccatcagctgagtggactgtggcgattcagatccgacgggagcacaaggtggaaaggaaggaactgtgggagttgagaagagagggagcctctacagagggattggggcaaataggggccacgtcctcagcccacagagcatgtgctgaagtgccccaggcaccccagtgcactcacagggcaccaggggatagtggacattttgaggaaaacagtaatacctgacatttgttgggacaccatacaaactactagcttgaaatagtttacaggtttatttttaggccacactgcattcctttcagtgacgtcgtatctttaagaagctgggttttcagcagttgctgtgaaaacaaaaaaggctaatgctgtgtgaaaatccgggtgaagaacaggtaacgagtgggagcaccttgtctgattccaaggcgtgggaaatggtgagctacctgacaggcacacgcatcccactgggaattagttttggttatttaagaataatattaacatttttctttagatttatatgaattattttttctggtggctacttagaaatacttactaagttagacgtaattacttaaatcagtgcaactgttggcattcccagccacattagggatttcttttggcctagaggtctatggaggaattactaaattccccatgtacctatgtactgagaacttttgggaagctctgggcctggtcccagatttcaattttgtgggcaagaatgtactttaccagagtgaggagcagcctgcagggcgtttgggctggaggcgggaggttagtaaggggttgctgaagtggtaggcggatggtgccgaagaaggcctcactaggcagtcatcatcaggataggaagtgggcacgggattcaggagaaatctggactttacagtggacaggatgtggtgactgaacgtgacagtgtgggaaaaagaatgcagggtgattcccgggctcatggcttgagaaatgagaccactgttgtgcctccaagtgacatgggaggctatagaaagtgacatgggaggctatagaaagtgacatgggaggccatagaaagtgacatgggaggccatagaaagtgacatgggaggccatagaaagtgacaagggaggccatagaaagtgacatgggaggccatagtgacatgggaggccatagaaagtgacatgggaggctatagaaagtgacatgggaggctatagaaagtgacatgggaggccatagaaagtgacatgggaggccatagaaagtgacatgggaggccatagaaagtgacatgggaggccatagaaagtgacatgggaggctatagaaagaggagatacaaggttctaagtgcaggcgataatgatctctatttgggactggcttcatttgaggtgcctttaggagagccgagtggcctatgcacagctgggtctgctatgcagcaggaaggctaagttggagacagatgtgagaactaaccatgaaggaggtaataatgcagaccaagggtctggttgaaatttcttctcccccagtccagggtgcagcgggtgagtgaaaatatgtgtgtttgtgtgtctgtcttcctagtcgggagagaagactgagtttgtggctctgcggagcatcaccatttaaggagggggaaaaggagacagaaggaattaccagaacactccagagggctccaagactgtatggtgggatcctagatggccaggaggaggggagcaaaaaggaaagagtcatccacagtatcagtaggatgccagttgaagtgtttttgctgcctcccggttatcggtgactttgatgaaagctgtcttctggtggtcatgggggtggaggccagatcacaaggaagctgggaatggtagatgagatagtaggggcttgcatattcattactgtctcgcagagagaaacctgaggctaagaggggtcttggatcaaaggatggggtgggtttatctggtttcggggcttttgtttttaatgagaaggagtcatttctgtgctgctaggagggatcaatggaataggtggggttaaagatacagtacggaatctacagttgatggcttgatgtgacaaggtcctcaaggagcctgaaaggaaggggtggggtccaagggcaaaaccgaggtatgagaagaaggatgcacaaggatggtttcgagtagacagtattgttggtagggacatgaaggaagcttagtggtctattgcagctagcctgtgttcccagtgaacctggaaacaaggttctcatctgtgctcaggcctcaggccagaaagggcaaggcagcagaggggcaaggcagcagaggggcaaggcagcaggctgagccccatttccccttgccataatactgctgtgcccctctggtaccgaaaatcaggagtttccagtgcaatataatattatacaagttacactgtattataatgtgtattgtcttttagtgtgttaaccaaattactgcagtattaaatgcaaattatactttgtttaactgattcttctcttcatttttagttagaaatcctgtgttctgtcaacattctccagtttatattcattgccttaagactggacaagatcatccactggccctggcttgtatgtaacttttaaaatccttaaataaacttcttttttattataaaagtaattcatattcactgtacaaagcttggaaaagacggacaagcagaagtaatagcctaatagtcacccataatcccaccatggggagataacatggttagtgtttttatgtctgtgttttatacaaacagtttggatataactgtgtgcaccattttgtatcctgatttttttgttttaatgttgtatcataaacattttatcatgttaataaaaggtctttataaacatgacttctaaagtttaattgatacaaaatattcttcaagtgcatgtatcagaccatcctcttatttctaaaatatggtatttccattgttgccagtgttgaatgattttaaatcatactgcagtatatatgtttatgcattaaaatttttgccttttgttttttggttgttttcttaggaaatagtccagaaatagtgttactgagctagaggttgggaactatttgagattcctatatacgtatactgcactgccaacttgcttttccaaaagccatacctggccaggcgcagtggcttacacttacagtcccagcactttgggaggccgaggtgagctgatcacttgagctcaggagttcgagaccaacctgtgcaatgtagcaagaccctgtctcaaaagaaaaaaaaaaaaagccatacccatttacactcttgctggtggtggcatctatgtcatgcttctaaactgtgacttcagttactgggcatttggttgaaattaactgtgaataaatgggtagatggatgcagagatagaaagataagtggcaaggtagaaattagagaacacagtatagattccactattaaatgcatggaaaaaagatggagactaaaggcagaagagttccattgccactgggaggtaaggtcatgctagtgtttttgttcggttttattttctctgttgtttgatgtataattttgcatacaatatattttatgtattaaatatagctacccttaaaaagtgaaaagtatagtaaagaattgggagcagagaagaaatgaagggaacctaagtatactccatatttaaagatgggaataatcacttctgcccaaagtctttgataaaacattcataataaaaaatattcagtcactcatcctacaacttcacagtgctgtatctggagaatggtcattgggttcaaaactgtttctgttgtgacgtgaaggaaacatatctaaacaagaccaaattttttcgtataagatactgtcagggaaaaaaaagattagtaattttgagagctttccacaaatgagaagaaagattttttctgcccttcatcctctgtagatcccagttgatgaagcagtctgagtacatgtttcccatagtgagcaagagaaaacaaggaagcctattgagatctaacattccacccatgaagggaacttcagtaaaaaggagaatctcatcacagaatggggaacggggaagaaaggctgtgcatagactctgcagagaaacctacaatcaagaactggtcaggagaagtaaaattcgtatgccaactcaaatcatagatctaaaagaaaatgtaaaactatagatctgttaggaaataacataggacagaatctttggggtttgcaattaggcagagagtacttagaaatggcactgttaatatggtccatacgagagagaaatcataaatttggacttcctcaaaattaaaatgaaatgaagacaggccacagactgggagaaaatatttgcaaagcacacatcaaaacactgacttgcacccagaacatacagagaactcttaaaaactcaaaactgcaaaaagaaacacctaaaaattggcaaaagagttgacaatttgcgaaggggatatacacatggcgaaaaagcacaggaaaagatgctcaacgccattacaggttagggaagacaaactacaaccaggatgagggcccgaaacacatggcttcagaatggtgaaactcagcaacactgacgaggccacgtgcctgggaggatgcagaggaactgggacactccagtgttactggcgggaaggcaggtggtacgggcactgtagaaaatggtttggccatctctgatgcagttaaaagcgcacttcccgtgggacttggctgccccactcctgggtataagatttacccccagagaagtgaaagcgcgcagccttgtagaaacccacacaccagtgtttgtagcagtcttgtttgcattttggatagcggccttgtttggttttcacaaaccaccctcagcggacagtcagataaactgtaggcatccatacaatggaataccactcagaactgagagggaacgacctgtggatacagggagggaacaacttggatgaatctcattagagacattatgtggatggcgggaagccagtctcaacaggttacttgtctcgcgatgccatctacataaagttccagcagagacaaaagtacagtgacagagaacagatcagtgtttgccggggctaatggtggggacggtgtgatagtgaagggacagcacggagagttttgcagggtgacagacctcttctgcatcctgccaacggctgtgcgaatctacttgtgtgaagactcagggaactcacaccaaaggaagacggtcacttttcctactgtatgatagataattaataaaaagggagaacggaggagtgtcgtcccaggaggcagggcaggagggcgaagacgtgtcacaggggagcctggccaagtggcgcccccggaactcgtcctctgggcttgtgtgtggatgagacaaggtctacctggtacgacagggacatactgggaatgcgcccttgccgtggaggcggggacccggcagcgctacgtatccagcatcaacctgtatccagcatcaacccgccaagttcactaacttggtaggggtgaggttagggatccttaggagcccaggcagccagactttctggggagcccattcccatttgtgttgccaaagtacccccagcaggttgtgggaatgttgcctgtgaagagagtctgttggggtgagatcttgtgtgtgtgcacagggtgacagttgtgtcccatttcccgggaagctgtgatggcagcagaacctagaggagcctgagagagtgtgggagagtgggcctctggaagagtagaggctgcggagccaggtgcagggctgtctgtcacccaaaggaagagggactgatgactcactgagcgtgtgtgtcccctggtggcagcaggccccatagtgaacataccataccttttctgtcctgagcgatgctcccagcagtcctgggagatggaacggtccttattcggctcacgggaaggaccgccttaactggacagacacagcaaggtgctaaagatgccttccatcagaggccaggttggaagctctaaagagacttctcttgctgttctctcacccacccccaggttgtgtgtgtcccgctgtggattctcatgtcctttctgtgcctggtggtcctctactacattgtgtggtccgtcttgttcttgcgctctatggatgtg

SEQ ID NO: 1319 - DNA, 285 bp, mus musculus
tcgggggtcggccccctcggcggacgcccgcccgtggcggccccaggggccgcagccgggaacccagggcccccgaggccagatgtttgggcagctgcggctgcggcggctgggcgagcagaggggcggctgcgggctgtgggcgctgggcggcggcagcgggaagggggccgggagttccccggcccgcgacggactccgctggggaacgggcggccggtgcccgccgggggctgcgcggctggtgcccgccgggggccgccgcacgggcaaacttcgctcccg

SEQ ID NO: 1320 - DNA, 411 bp, mus musculus
ggcaaacttcgctcccgggcttggcccggcgccgcgcgggcccgcaggctacgccgctggctctgcgttaacatggccgtcgcggagcgcccggtggcccgggggggcgcgggccggccgcccccctctcgcctcccgcccgcccggcgccgccgccgccgctaacatggctggcgcggcgctggcctccggcgagggcaggggaggcgggcggagcggtcggcggggcgcccggcgggctccggcctcggccccggcgcccgcggcccggggcgggcggctcggagggccgggggcgccgctgcgggccctggagcggccgagcgtcatggctgcacgggcgcctttgttatcccgaggagtgcgccccgcgccggggggcggggaggtccggcccgggcccccgagccc

SEQ ID NO: 1321 - DNA, 4820 bp, mus musculus
atggccgtcgcggagcgcccggtggcccgggggggcgcgggccggccgcccccctctcgcctcccgcccgcccggcgccgccgccgccgctaacatggctggcgcggcgctggcctccggcgagggcaggggaggcgggcggagcggtcggcggggcgcccggcgggctccggcctcggccccggcgcccgcggcccggggcgggcggctcggagggccgggggcgccgctgcgggccctggagcggccgagcgtcatggctgcacgggcgcctttgttatcccgaggagtgcgccccgcgccggggggcggggaggtccggcccgggcccccgagcccccgggcggcccgggcggggcggggcggggcggggtgggggccgacgggcgggcggcggcggcggggcccgggccgctttgttcgccgctgtcgccgccgcccgcgccggccgcgcgcggatcagccattttagcgagtgggactccgaggcgcggcggacgccgccaccagtgccgcggctgccgccggcccggccgcacaccccccgcgcaccgccaccgccgccgcccccggccccgcgcgtcccccggggatgacagcggcggatttcaggggcactttctttcatcaggaggcttttgacaaaatggaaggtgaattacgggtgtcccggtgacccggcacgggggccgaggcgggctgcctgctgccggccgggactcccccgctcccggtcccgccccgcccgggccgccgctgcgggtctctgttgggcagcctcctgggcggctgctgccaaggggagctctttagttttacatgatgaccttgggtgtgggaaaaggaaaagatggcgggaagctggggggtgggacagggacgatgacatgccgcagctgcatttttatttggaaactttggagaaagtgttctcggctggacctgcattctgggttacagatgagcacgactagccctttttatacaccctccccctttagatagtgacgaagtgatgaattgaactaatagtacgggggtacctgctcactttccagatctcccgtgttgtaaagccgtttttttagtaagccaaaacacatcaacaatagtgacaatttcagatgtcccctacgtatagttctcctgctttggtcttgtgttcagcagtggtaagagttgttgtttttaattgtgttaacagttagcagatgaccagatagtcttaagtcatagatttcaagcttctatcacccccaccaaatgtgtcctctctctacccttcccactttgtgattgtagtttccaaaacatagcagttctgtaaacgtaacactgagtaccctacttgggtcggctccatttggagcacttgatcgcttttgagaagtaactcgcaaaccagcgcgcttcgtgctggtcaaaagttaaatgacaagcgacaatgaagctgatttctttcctactctgccttctgccactggtgtccggcattgggggaaggggacttcctaacagcaagtgtagttttagttttgctctgcctttggtacgtcttgtacttcttgtcaattcctccttgcttttcctcattgtatttctttgtttctcttttatcacagtcaggatggctaaaggtgaccccaagaaaccaaagggcaagatgtccgcttatgccttctttgtgcagacatgcagagaagaacataagaagaaaaacccagaggtccctgtcaattttgcggaattttccaagaagtgctctgagaggtggaaggtatttttctttggtacccttcaaactagtcttagttgggtttcttactttggggttacttaccttcagattttctcccagatagctgcttgcttcctcttttacttttacttagaatcatttttgcttgtcttaagaattttgtgtgtgtgcttttatttttttaaggccctgcacaggtttcaggcctttacctacccccttttgcaagtggttctagcaactgctagtttaatcacaagaaactgaataggtatgtgttcactgcatcgagggatttaacgagtcctgttctttgcagacgatgtccgggaaagagaaatctaaatttgatgaaatggcaaaggcagataaagtgcgctatgatcgggaaatgaaggattatggaccagctaagggaggcaagaagaagaaggatcctaatgctcccaaaaggccaccgtaagtgactataggattcaagataacaattaataccttttcttctgcttggaggatttggttttttggtcgtcctgtatttcatttcaaaatgaaatattttttaaaagatacttaaaagatggcaatacctctgcaaaccattctgtacttgggctttacgatgcagtgccagcgttgtctgtggttaaggctgaagtgtttgtgggctgtgcttgcacattcacagtggttgtctgttggcctttccattgtgaaggaggcactctagttttggttgtcagggtccttgaagtatgttctttatgcctttcctagtaattgaaagactgggacagcaccatatatatatgcgcgtatatatacgcatatgtattatatatgcatacacacacacagagcaccatatatatatgcgcgtatatatacgcatatattttatatatgcatacacacacacacgcatacatatttgagatggagtttcgctcttgaccaggctggagtgcaaggtgtgatcttggctcactgcaacctccacctcctgggttcaagtgattctcctgcctcagcctcctgagtagctgggattacagacatgcaccaccatgcccggctaattttttttatatttttagtagagacggggtttctccatgttggtcaggctggtctgaaactcccaacctcaggtgatccgcctgcctcggcctcccaaagtgctggaattacaggcgtgagccgcgcaccacatatttttctaaccttatatattttagaacctacaactttgtagcattgtatatggtatcatagattacttcactttagggagaagtcatagtggtaggagggagatgcttctcaggaatgtgggatttcaactttaactcaaattttttgtggtttctcatgtaatgtatgtaattcttccaaggtctggattcttcctgttctgttcagaattccgccccaagatcaaatccacaaaccccggcatctctattggagacgtggcaaaaaagctgggtgagatgtggaataatttaaatgacagtgaaaagcagccttacatcactaaggcggcaaagctgaaggagaagtatgagaaggtaaggtggggctggaagcctggactggtgaacaggcagtggttctgctatcagtaggttgcagggcatgtggcagctttgctgggctgagtacttagcatagcgctcaagggcccatccccctgcaaggtagctacgggtgctggtgttcatgcttttttttgacaggtctttgttttggggacaacttcaggcttgaaaaattttccttactctttaaggaaaaaaaaatgttaacagaggatttgatagtcctactaatgtgacttgaaggacacttgaacacccactaacttttaaattcgaatggctaagaaccaaattcatatatggaaacacttcagatatatatgatagcagcactgtcttacttgatttcaattcctgtcctcttacctgagatgaggactgcatgtttctactttgtgttaaaacagccgcatactcatttgaaatgtgtccctgttcctctaggatgttgctgactataagtcgaaaggaaagtttgatggtgcaaagggtcctgctaaagttgcccggaaaaaggtggaagaggaagatgaagaagaggaggaggaagaagaggaggaggaggaggaggaggatgaataaagaaactgtttatctgtctccttgtgaatacttagagtaggggagcgccgtaattgacacatctcttatttgagaagtgtctgttgccctcattaggtttaattacaaaatttgatcacgatcatattgtagtctctcaaagtgctctagaaattgtcagtggtttacatgaagtggccatgggtgtctggagcaccctgaaactgtatcaaagttgtacatatttccaaacatttttaaaatgaaaaggcactctcgtgttctcctcactctgtgcactttgctgttggtgtgacaaggcatttaaagatgtttctggcattttctttttatttgtaaggtggtggtaactatggttattggctagaaatcctgagttttcaactgtatatatctatagtttgtaaaaagaacaaaacaaccgagacaaacccttgatgctccttgctcggcgttgaggctgtggggaagatgccttttgggagaggctgtagctcagggcgtgcactgtgaggctggacctgttgactctgcagggggcatccatttagcttcaggttgtcttgtttctgtatatagtgacatagcattctgctgccatcttagctgtggacaaaggggggtcagctggcatgagaatattttttttttttaagtgcggtagtttttaaactgtttgtttttaaacaaactatagaactcttcattgtcagcaaagcaaagagtcactgcatcaatgaaagttcaagaacctcctgtacttaaacacgattcgcaacgttctgttattttttttgtatgtttagaatgctgaaatgtttttgaagttaaataaacagtattacatttttaaaactcttctctattataacagtcaa

SEQ ID NO: 1322 - DNA, 3767 bp, mus musculus
ttggctgtgacgaagaacaagaagctccggaattctggtaagccaccccttcttctccctacccagtgtgcagagacttgcaacccctagggcgttagtttttgagctccccgaatagagaatctatggacagtgccctcatattgaacatccctgctcccaaattccccgcaagcctgggggtggtagtattctgtcccggccctctaaacgtggaggttctcaaggccgagagagcacagagaattagctttgggcatccaagtacaaagcgttcccgtggtgcgcggcagcccgaggatccctgtcccgtcggggcctgatgcggagggagccggcacccgagcgggagagtcaggcgattcgcccggggacagcaagccgagccggacgccgcaagggcggccgcgctgaggcagcgcggaccgaactgacgcggagggagcagcggggctgcgacctgctctgtgaaagttaagttcgcggcggccgcggcggcccttaccagagcgcaacgcagtggcctctccctagccgggccaagagcccgctcgccgcggccctggggctccaggacggctcccgggcagatcccgggcggcggagcacagacccccgcgcccgagaatcgagcagggaggtctgagcccgccggagccgagctccgtccgcccgtcccagggcgaacggcagagagaggcaagcggcgggtcgggcacagcaggcggtggcagcgacggcggcggcagcggagatcccaaggtccgtaagcggggaactggggggtcgcagggcgggccggccaagaggcttgggagctgggcgttgctgggggtggagggatagaaggcagcaaaaccgagtagggattggcgggagggcgacgggagagctcagaggcggcgatgggggactcagagaggctgcaaagggctggggtctgggagccgcaggcgggacttcccccgctgctagccactgccgagcgggaggaggccgggggccgggggccggcggcgagcagggcaggagggaagcgtgggaggatgccgggcgctgcgacctgtgctgggggtgggggcggcagacactgcagagcagctagtccggcttacaggttgggcgggagagggctctggaagggaggggaaggggcaaaggcgcccaaactccgagttcaggccgggggagggaggggcggcgcctggaatttccaccgccagattctcgatcggctggggctaggagtggggaccgaagggggtctgagagggtggggagaccagctggattctcccgggcagggcgtgggggagaggtggcggccggggtctgggggattactttgcttgggcaaggagtcacgaacactgaacaagtttaaaaacgcactgactggcacacagtcattaaaagttttcttacaaagtctggtgggtgtctccgatttctccttcgtctcctggaatcgtggggccatacactaggtcttcaccttcacccccgcggtgcggtcccgaggtgcaaacccacggaatcctgggggcgacctgcgaagcccattttattccctttagatttcttttctttctttttctccttctccttccttccttctataattcaaataaaggcttttatggttgttgtggttttgtttttaaggctttgccccttctcttttcggctgtatttccctgaattcattactctgccggaaaaccatagaaagaacctcttcggtagaaagtgctgaggccgagtgctgacagcgctggaggaaggaggaagaaggagccatacctttgcccttttcaaaagcgctcattttctcctagtccaagatgaagtgcaatattttgccaaaccaatgctaattagcaacgaggtgtctccaaagaaagagggctctgcgcctgcacctggcctcttccttctcttttttgtgaaaggttttacaaaaaagttcccacctcagccctacaagaccggagtgggggtgacccttcttctctatcctgtttaacctgaaggctccagtaaagttcagtgcccggcgctgggagctctgtgcagggcgctgaatgtgccagtgcgcggctctgcgcgtggacgtggacgcggcatgtaactgaaacaggcacttctgctaatccttgcaggattttttctcctcccccccacccccgcccacctcgcgccacccttcccgcccgccctctcactacttctttggtctcagactaaattttacagggcttccctgcttcccctcagttttcactcttaggttacctcggaacggtaagtatttgacttggcaaggttttaggttactgcttgatcccatcggaaaagactgtttaagaagatggcctctaatgccttttctcagaatcttctctctagtaatgtgtttattataaatgcaatgctaggctataggagggagatggctaatttatctttttctaattatttaattatttttaatttttttagtttgaggcttcctgacatccctccagtgtctctccttgccccccactctccagcctccttcctaaaaacaagtccctctagctcacctctactcccctcctccttctccctccccctcacctccagtgaaggaaacgtttgcattttgtttttctctaagatggtggcagcatgaccctgtctcattgtgaaggctcctggcagggattttgtgctcactgctgtctgtcttatgttcgcttctttctcagagcatttctttaaaagaattctggaattataaaaggtcataatccagctggccttcccctgcaccttaaatgtgtagatttctgtacttaaaccacttattcttctctgtctttcccctttctccctccctcgatatgtttttcaggcaacatcttcgtggtcagtctctctgtggccgatatgctggtggccatctacccataccctttgatgctgcatgccatgtccattgggggctgggatctgagccagttacagtgccagatggtcgggttcatcacagggctgagtgtggtcggctccatcttcaacatcgtggcaatcgctatcaaccgttactgctacatctgccacagcctccagtacgaacggatcttcagtgtgcgcaatacctgcatctacctggtcatcacctggatcatgaccgtcctggctgtcctgcccaacatgtacattggcaccatcgagtacgatcctcgcacctacacctgcatcttcaactatctgaacaaccctgtcttcactgttaccatcgtctgcatccacttcgtcctccctctcctcatcgtgggtttctgctacgtgaggatctggaccaaagtgctggcggcccgtgaccctgcagggcagaatcctgacaaccaacttgctgaggttcgcaattttctaaccatgtttgtgatcttcctcctctttgcagtgtgctggtgccctatcaacgtgctcactgtcttggtggctgtcagtccgaaggagatggcaggcaagatccccaactggctttatcttgcagcctacttcatagcctacttcaacagctgcctcaacgctgtgatctacgggctcctcaatgagaatttccgaagagaatactggaccatcttccatgctatgcggcaccctatcatattcttctctggcctcatcagtgatattcgtgagatgcaggaggcccgtaccctggcccgcgcccgtgcccatgctcgcgaccaagctcgtgaacaagaccgtgc

SEQ ID NO: 1323 - DNA, 3767 bp, mus musculus; identical to SEQ ID NO: 1322

SEQ ID NO: 1324 - DNA, 3767 bp, mus musculus; identical to SEQ ID NO: 1322

SEQ ID NO: 1325 - DNA, 3767 bp, mus musculus; identical to SEQ ID NO: 1322

SEQ ID NO: 1326 - DNA, 7871 bp, mus musculus
cggccgttccctcgcggagcttactgagcgcggccgccgagcccagctccgccgccgagcgcctgtgccggcacggctacaccatggagcgcccggataaggcggcgctgaacgcactgcagcctcctgagttcaggtagccctgagcggggcctggaccgcgaggcggactggccccagcctggagcagggcttgagggaaggccctagctgaatgggtgggcgtgaggtctggaccccggggacctggcctcagggaagggggcggggaaagcaggttggagcctgagacgtctaaactcccggccccgaactttcgctcgggaacaagggatccggggtcatggggaataggtcagtgggccttcagctcatgctcctatcctagcactttctctcgctgtgtctatattgcagtctctttcattaccgcagggtcagccttctgaggacaggaatgcagtctccttcatctccgtgttccctagggggcctgcatagtcggggcttaataaatgtttgctgtatgaatgaaggagtagaagggaatagtcccctggtgtgagattgcttcacttggggaatcagtaagatagaggctggtgactgagttgaaggaatgtatgagagagcaggtggttctggcccaccccagtaggcaagggagtggtgagggagttagctatcattcgttaagacctactgtatgccaggctcagtgcacgtgctttacatacattgtcagaattcttaatttctctaactgcttgatttcccaattttgaagaggatgcagttgagggtaagtgacttgaaactgagggtgagtgattacagaattaggcgacaaagttagtatgtaattgaagctaacgtttgaccaagctcactgactccaaagcccacgatctttggagctctgtgatgccttctctttccgacagggtcattgtgagttttttttttttttttttaacttttattttaggttcatgagtacatgcgcaggtttgttatataggtaaactgcatgtcacgggggcttggcgtacaggtaattttgtcacccaggtaataagcatagtacccgataggcgttttttctgattctctccctcctcccagcctccaccctcaagtagaccgcactgtctgttgttcctctcctagtgtccatctgttcttgttgtttagttcccacttatgagaacgtgcagtatttggttttcttttcctgtcttaatttgcttagaataatggcttccagctccagtcatgttgctgcaaaggacatgatctcattcttttttatggctgcatagtgttccatggtgtatatgtaccgcattttctttatccagcctcaatgtgggtttttttttaattattcatttatgagaataccaacatatttttattagatacacttacagcatagtccttctagactgattctggtttcctaatggaatttgcagtgaaatcttgactgtgggagaaagaattcctgttgtcttacttgctacaaaagggaatgtggtaggctctgtctgctcaatgttggctgcagaagtttgtatgaagtgggaaaactaggtggtgttataaatggaggcagattaaggttcatcctgaactttttcctttgtgtgaggacaactttaattccagcctttctcattcctcacttctaacaaatctctgctcagtaacacccaaagatacataggataaatcaattgaatagcatcagttgctttgtcttggataagccactgattttacccaaggtggcttgcatcagcaaaaccaacagctcttgtggctggaatccagggagaaaatgtcctataaacagtagaggaagtttgctagttttcaaaagtttgtatgtacactttgacttaatgcttagtcccatattagtgaggtcacaacacagaaaagtagtcacatttttgaagtttgaggtaaagagagaagtgagaaggaattagccataaattattaaggtatgctgtgtatagattgtgtgggggctagaaattaatatgtagaaaggttatatttgggtggtgggattataggtgattttgtttactttaaaacatttttatggtgttatatcatcttttcaataataaactttttaaaagccagaccagataatagatactcaagagaggtcatgtaaagaacaaaacaatcagttaacacttcctttctgttcctttaacaagttagataatctgaaagttgcattcctaaaacatacttttttactcaccatagaaacaccaaagtcaagtgctttttttagggtgcacaaaagaattggccaattagtgactctttgtattttttgtagattctccactgcagacactcatactcttcatgaggattacacaataaatttctctaaaaatttactagtaggaaacagtttaagggagcttatgtatattaaatgagagttgtatagctcagtaataaccaaaatgaggcctgctaaaagatgatccatttaagtaccaaaagaaaatattagaacttttttttttacagcagtaagcatttaatttctcacacatgtgcagagcatgtgatcaagaaataggcatgaggttagttatatttaatatatattttactcaatgtttttgtgggttttttgttcaggttctttttaaataaatttcattgtgtatatttgaggttcataacatgatgttatggcatacatatagtaaaatgattactatggtgaagcagattaatatatctgtcatctcacatacttttgtgtgtgtgtgaccagaggcagctaaaatcttatttacaaaagtccctaataccatgcaactttattgcctatagtcctcttgtacattagatatctcacttgttaatccatatatctactgctttgtgtcctttgatgtatatcttcctatttcctcccctccagcctcccacccccaccgccatggtaactactgttttattctctgtccctgtgtagttgaccgttgaccttttttttttttttttaaagattccacatataagtgagctcatgtagtattcgtctttctgcgtttggcttattttacttaacatgtcttccaggtccatccatgttgtggcaaatggcagatgtcctcttttaaggctgaataaaatattcccttgtatatatacactacggtttctttattttgtctgtctacatacacgtaggttgttttcaaatcttggctattgtgaataatgctgcaatgaacatggaagtgcagatatttttacgaggtagtgatttcatctcctttgcttatattccagaagagagattgctgggctgtgtggtagttctatttttaatttctttaggaactgttttccataatggctgtaccagtctacatttccagtcacaatgtagtagggtttctttttctccacacttttacaaacatttgttatcacttgcctttttgataatagctgtccttagaagtgtgaggttatatctcatagtggttttgatttgcatttccctgatgatttagtgatgttgagcacattttcatttatctcttggccatttttatgtctttggagaaatgtctgtccagctgttgtccatattttaatcaggtggtttttctgctgagttgtaagagttctttataaattttggggtattaaccccttacaagataggtggttcgcaaatatgttttcctagtctgtaagctgccttttcattttgttgattgtttcctttgcagtacagaagctttttagtttgatgcaagccgctttattttttcttttgtagcctgagcttttggtgtgatatccaaaaaatcattactgaggccaatgttaaggacctttccctctgtgttcttttatgtcttaaaactttatatctttatgttttagttattttatccattttgggttgatttttgtttatggtgtaagagtccagtttttttctttgcatgtagaaatcctgttttcccagtaccacttattgaagggactgtcctttccccattgtgttcctcttaacacccctgtcgaagattagttggccatatatgtttggatttatttctgggctctattctgtttcattgttatatgtttctgtttttatgccaataccatattgttttgattactataactgtaatattttaaatcagaaagtgtgatgcttacaactttttcaatgttgctttggctatttggggctttttgtggttctgtatgatgaattttaggattgtttttctattttaatgaagaatgctactgtaattttgatagagattgtgttatatctgtatgttgctttgggtgctgtagacatttcaacagtattaattcttccaatccatgaacacaggatatctttacatttatttgtgtcatcttcaatttctttcatcagtgttttatacttttcagtgtacaagtcactcatcgccttggttaaatttattcctaagtttctttttttttgaaatagagtcttgctctgtcacccaggccagagtaaagtgccccaatcactgctcactgcagccttgacctctggggctcaaacaatcctcccacttcagcctcttgagtagctgagattacaggcacgtgccaccatgcccagcgaattatcaaaatttttttttgtagaggtggggttttgctgtgttacctaggcttgcgtcaaactcccggcctcaagcctcagccttcccaaagtgctgggattacaggcatgagccactgagcctggcccctaagtatttttttttaatgctattataaatgagattgttttcttgatttctttttcagctcagtaaaggatgcggaagtttgtcaagtgctttttctgcatcaactgagatgatcctacttggtcataatatataatctttttgatgtattggttttgtttgtttgtgacagagtcttgctctgttgcccagactggagtgtgattttggctcattgcaacctctgcctcccaggatcaagggattcttgtgccttggcctcccaagtagctgggactataggcacacgccaccactctcagctaatttttgtatttttagtagagactgggttttgccatgttggccaggctgatctcgaactcctggcctcaagtgatccgcctgcctcggcctcccaaagtgctgggattacaggtgtgagccaccacacctggcctgattattgttgaatttggtttgaaaatatgttattgaggaattttgcaccagtgttcatcagtgatgttgtcctgtagttttcttgctgtgtctgtctggcttaggtatcaaggtgattggagcctcttaaaacgtgtttggaagtattccctctagctcgatttttcacccataacagaagttcctattccagctggggagggcgcactggtccgttcgccctgcctacctccttcagtggtctggtgtctggtgctggtggtcagggttgctgcacgggctcagggactggtgtggcagtggcttccctgggccaaagctctgatcccagtgggggagggcacgctggtgcgtcggctccacctggttagtttgctggtccactgtctggtgctggaggacaggaggctggcagctttcccagatgcaagctccgattccagcgggagagggcacactgctccacctgtggtgcctgccgagttccctggtctggtgtccggtgctggtggtcagggttgctgcgtgggctcagggaccagtgtgacagtggcttccctgggcaaaagctctgattccagtgtgggagggtgcacaggtgtgtctgcctcgttagttccctggtccactgtctcatgctggaggacagcaagctggtcgcttcccgtgacggaagctctgattccagcaaaagagggcgcgctgatccacccatggtgcctgctgcgttcccagctctggtgtctggtgctggtggacacggttgccgcatgggttgggcactggtgccgctgtccgccgtggcttccctgggtaaaagctccagttccagaggcaggggcactgagtttcttcacttagtttgttcacccagcttgttggcagttgatctgaggtgccctgacgcttcgtcttacactggatatgaatgacagtccctaaaggtggtgtataatcttcatgttccagctcaagaaattcccactacccacagctggttctctaggatcttcggattacgagtccctgcctgtgatcttcctcctgcatagcatctcatttgtggatgtttatagtttcagggacataagagcgtttggatatgactgtgcaggttctgattttctctttgtttactttattccagaaatgaaagctcattagcatctacactgaagacgctcctgttcttcacagctttaatgatcactgttcctattgggttatatttcacaactaaatcttacatatttgaaggtaatcttagacccattaaaacaagatgttttcccccaatttaagattctgtgcttttatgacctctttatatctttaaactgggtattcttatttttttcttgtttagcttttcaaaaaatcatattgctcataatgagtctttatgaaataacttattgtttcagcttgacagttttcctatggttttctgtgaaatagcttgcaaatcctttctcttagtaccttttaaagaataggggttggctgacatgggaggaggaattttgggggaatggactttagtgtcagataacggaaggaagagagaatgaagtcccctttttgatgttgaaattttttttttttttttgagacagtttcactcttgttgcacaggctggagtgcaatggcgcgatctcggctcaccgcaacccccgcctcccatgttcaagcgattctcctgtctcagcctcctgagtatctgggattacaggcacccgccactacacccgactgatttttggtatttttagtagagacggggtttcgccatgttggccaggctggtctcgaactcgtgacctcaggtgatccacccgcctcggcctcccagagtgctgggattacaagcgtgagccaccgcacccggcctgaagtctttataattatggttttgtttaaaacaatgtttgtttgtttgtttgtttgtttttgagacggagtctcgctcagtcacccaggctggagtgcagtggtgcgatctcggctcgcgtcaagctctgcctcccaggttcacgccattctgctgcctcagcctcccgagtagctgggactacaggcgcctgccactacgcctggctaattttttttgtatttttagtagagacggggtttcacggtgctagccaggatggtttccatctcctgacctcgtgatctgcccgtcttggcctcccaaagtgctgggattacaggcgtgagccactgcacccggccaacataatgttcttaatatatagaaggtactcatatcttttagtgaatactttattcattaccacccaaaatattactttttaattgcctgactagttaaataaatacatcataaaaattaggatgctttgttttttttttttgtactttggtaaattttgcaataaaatggaaactgttttttttctcttgataggcgcccttgggatgtccaatagggacagctatttttacgctgctattgttgcagtggtcgccgtccatgtggtgctggccctctttgtgtatgtggcctggaatgaaggctcacgacagtggcgtgaaggcaaacaggattaaagtgaacatcacctttttatagcattaaattcattttt

SEQ ID NO: 1327 - DNA, 7871 bp, mus musculus; identical to SEQ ID NO: 1326

SEQ ID NO: 1328 - DNA, 5326 bp, mus musculus
gaggagtgaaagttggagcccagcaaaagcctccgccccgcgctcagtgcggccagagcgtgagccgcgacctccgcgcaggtggtcgcgccggtctccgcggaaatgttgtccaaagttcttccagtcctcctaggcatcttattgatcctccagtcgaggtgagtctccatcccgggacccgggagcccttcgcgcccagctccctctccccgggagccgggacggctcccgggaccccagcggccccgcgttcctcgagccccgcgcccgctttgccccggccctaccgcgggctggccgagtcccgcgtcccctcgatgcgcgccggcctcggcccgcctcactgtaggatgggctcccggggtccttgagggggagctccaaaaggaagacaggacgccagaaggaagacgggactccagttcgcggattcccgctctcagaagcactgcggtggcctggtgacaagcactcctcggagtcttgcgcaggaacaggggagcggccccggggtgaccggccagggcaggcttcagctactgggggggccggaggtgcattttgagaagggggtgcgcgggctgagggagcttagctgcgccaaaaatgtgtgagtgttgcctcgtgtgttctctgctgctcacattttttttaagagtgcctactgagttccaggcactgcgccaggcaactctgacattacttgcttcccatgccgctgctcctgttggtgccagtctcaggcacgagctttggtttagtctaagggttcccgcaccagctatgccccctctccaccgctgacagcctcccacttccttaactcatccctagacaccctgctgggccttgggcagactggagccagaggccaggaatattattctcctctgaagtctgtggtttgggccgtagatttcaatccccttctcccctttcaggtttcccttgaacaaccatcttccctcacaccttctcctcgccctgagacttggctaggagggtcgtgccctggatttgtggctttttggggtggaagatgactgcttcgttttgttgttgttgttttgagatggttcctgctgtgtgtgaagtgtcacaaatttgcaagcttcctgatctgtggagctttctcgaagattccatggcactgggcttgtgtcttgtttgtctgttctggggagggagggtggcttctctccctaccccagattgcgttagctcatcagagaaggggatgtgtagctgcttgctggctcactggtgccctggagtggggctagcctcagcaggagcttgataaatgtctttctatgcgtgctagcaatttccagtcatccacatccctcaaaatgggatgtggactagttgagaaagctgacgtggtgactggctagggcaaaagatggctctggggtgggggaaataagaaggggtggtcagagaggaaaacagcagggaaaagggactggggaaatggaaactgcccttcaagcatagcaacctgtggtgtcaggaaagagctgaggaggtgacaatggggtgtactgggccacactgaaccagaagacctctccctggtccaggcttagcctcaaattagttgtgtgacttggggcacagtccttcctctatctgggcctcagtttgtccatctgtagaatgaaaaaaaagatctgatttagaaaaaaatccaacatcttttcttatgcgcccctcccccccccacttctcacaccaccaacagtcgactgtttgggagggggtagtgcagagattcaacttcatgctggaccattatgtctagagacatgtgaatgtctgaaaaactgccctggaaaatgccactattccaatgtgtgagtgtttttcaagtttttattctgtctagccccgaaagtgagcttaatggctggctggggaaaggtatgcattgtcagcagctctttaaccccaaggacctcaagatgaggttttgttttgtttgtttattgttgtgttttttttttttaactggcaaaagccaattttaggattaaagccaccttatgaccctctgatatcatttttattgcagacctagtctaggggcaggagggctttggtggtctcagtgctttcaggtttatttgtttgcctctgcacttttaaacttggggcagcggggaggatctcgtccatggatttcagacatctgggaggggctgcttcaggcgtttaggtggtcctgtctggcagtgctcagtctaccactgactgccagttctgattgtgccacgtttccagccacatcactcattttacagggtctcagggctccatttttcctcctctcttcccatagtcactggcccttatcttttgagatggctgggagtttggcctcagggaaagaggacatcttctagatatggcatttgaaagtagaaactgtattttccaagcccagttcttccctcgcccacaatgggaagtagccacttcagacatgagaaatggtgtggatttggcacatctgtatgccacttaagcaattctaacagcttgaaatactgcagaaaaaatgcattttgcttcttaagttggcagtcccttggtccgcaatacaggggtcatgccaacgtctcttgccctgtttaccccttattttaggaaacaaattgccttatggcttaaaaaaatccttttggaagtgtgacgtgccagtagaaaagcatagacatcatgagtgaacagctcagtggcttttcacaagtaaacaggcccgtgtaaccaacacctagatcaggaaatacagcattgcaaccccctcaccacacacacacacacacacacacacacacacacacacacacacacagacacacacacacacacacacacacacacacacacgcatgcatctccaaaatgcctgtccccgtacactttcctccccaaaggaaaccactctcctgccttccagtatcacagattaatatgggacgatggcttttaaaaagacttttaattataattttttaaagacatataaaggtagggggaacagtgcacccccattgtttgtgaactcatggccactcttattttcttttacaccacccaccctccaattccaacttagattgtcttgaagcatatctcagacatcatatcattttatatgtaattgttttagtatgtatttctagtcattaatatttcacaaacataagaaaataccataattacaccaaaaattaaagaataatttattcatgtctcaactgtccactcagtgttcaaatctctcctattgtgtcataaatgatttctgtttgtttttcaagagtttgcttttaaataaaataagatccagatattagcaagtggggcattttgatttttaaaaacactttttatggaattagaacatgtatacagagaagtgctcaaatcataagtgtacagctgatgagttgtcagaatatgaccacagcggtgtaaagaaagccaaatcaaggacccgaatgtgagcaggacctcagaagccccctttgtcactgcctcccagcaaaggcagcactatccggacttctaacaccatcggtgagtttcataccttggcagatggcctttaacatttttgtttaattcaattattcttactaatcttcttctttttcttggctgtggtgcatggctgtggagctcagggtggactcctgttgggcagccagttcctggatggctgtctgtgggtggaggactcctgcctttcctgtttagacacccacaaaggctgctctttagcctccttcccttcatccccttcccctgcccccagtgcaacgagtattacacaaccaacaaaaccgcaaaatattcccacaattttctggtcctctctgggagaggccgctctggctttcgcaagcattcctctcagccctggccctctgcctgctcctcactcctggttggtgctggtcaggctgactagaggccaaggctagtcacagtgggccagcgctcagacataaatgccctcttcatttcacgtgtaacattcttttaaaatctaggtcttggttttgttgattttttcttaaataaaagagtgatcataaaagagggacagcatagaaagtccccaaagagcagcaaggtttaaaagaaattcacaagcctaatctgtcactgtcttataatttgctattaccagtcacaatttaactaggttttgtgttgaaaacttgttttggtttgcttctgtcccaagaggcactagctggggcccctacagagtgcagggcagagcttcatttttcgtttgaatgttctagggtcgagggacctcagactgaatcaaagaatgaagcctcttcccgtgatgttgtctatggcccccagccccagcctctggaaaatcagctcctctctgaggaaacaaagtcaactgagactgagactgggagcagagttggcaaactgccagaagcctctcgcatcctgaacactatcctgagtaattatgaccacaaactgcgccctggcattggaggtgaggagcagaacgacgttcttcccctcctagagggtccaggggttgagggcataggcatggagaatgcacctgggcagtaacagagggtgccatgctcatggacaggaacatctgctattgacctgtcaggtaagagatattaactctattctcagcagtgtcattgaccttgatcaagacttttcccttctctcgccctcagtttttccagtggtaaaatgagaggactaaactagattgttgatcttcaagatgtgtgtccaattcttaacagtccgtgagcttggttttgccatgaaagaataaataaagaaataggattagatgctgaaactgtgtggtccaacacttacttgactcccctttcatcccctctgaccacttcctcccccgtcccatgcgcctgtttgacacttaccctctgctgcttctgcttcccttatagagaagcccactgtggtcactgttgagatctccgtcaacagccttggtcctctctctatcctagacatggtgagtactaagcttttttagtactatttcctagcccaggggctgacctatgggaccttccacagacttctgctttctgctctgtacttctgtaacaactccaataatttattttctggagggagaaagggattttttaaccactggtttgagaatgagactggaaaaggtaagtcccttgctacttgaagaggatcttcagaatcatgaccatatcttccagttttttcattcaaaatagaaataataaagcaatgttaaaca

SEQ ID NO: 1329 - DNA, 346 bp, mus musculus
gaggagtgaaagttggagcccagcaaaagcctccgccccgcgctcagtgcggccagagcgtgagccgcgacctccgcgcaggtggtcgcgccggtctccgcggaaatgttgtccaaagttcttccagtcctcctaggcatcttattgatcctccagtcgaggtgagtctccatcccgggacccgggagcccttcgcgcccagctccctctccccgggagccgggacggctcccgggaccccagcggccccgcgttcctcgagccccgcgcccgctttgccccggccctaccgcgggctggccgagtcccgcgtcccctcgatgcgcgccggcctcggcccgcctca

SEQ ID NO: 1330 - DNA, 75453 bp, mus musculus
gttctcctgcgggcggagcccagtccgcgcctcctcgcctccctgcgcgctccccgctgtgcaccgcgccccgcgccccgcgcctgcctccccggcccggcccggcccggccgggcgccgtccacccgagggagcccgcgccctgcgactgcccgaccctccacccgccccacgagccgggcaccggtgccaggtagggctgtcgagtcgccattggatgcggccctgcttggaggcagtggggggcacccagtccgtgcccagctggggacaagtcagggcctcagtttccccatccataacccttaccagctccaagcatctctcttcgggttccccccgggagtcagtggatttctggttttcgctgtgagtgaaaagactgacaggcagaggaggccagcgtcccctacagaggcaagtgtcccccttgccagcctgatccctctgtcttgccctttaggaaagacacggtttaattgttagtaaacggcgaggggccaggatgctctgagagttgactgcaggcctttaagaatcagggaatctcatatccctccgtccccctgtgcccattttatagatgaggaaactgagacccagaggctggctcacccagaggatcccctcaatcgccctggggcctgtgaggtgcatgtgctgggtacagggcaatcttggggagggccatgaggatggtggctgctcacactcagacagaaggcgccgaatcaggtgtcactgggtgttatcgacaggatcggcactgcaccagctctgtggctggattgttttgatgggggcagagggagccaagagtctgtcctctttggaaaggcagagggataccttgccttacaaaaaggccgaaagctcaggtgctcctgcctgatctgccacttctgagctggggacacctgggtactctgtcggtttaagggggtgacacgtcaagctgcctcccacccagggctgctggggactcagataaagtaggtggtgggtgtgtcccggctttgggacatctgaggcatggtaggagttgtgttcttgctgagccgtcggcacgaagccttggcatcatgggaggccccaaagctgtgagccccgagagagggcctctcacaccccatccagcagtgcttgaggcttcagtacctggactaagtcctgccttggtctcatggcccttcagacttctggctgtcgtacctggctgggggcgggaggcaggggtgcacaggttgataggcctgaacagagctgcagaggtcctgccttcccagggcctccgctcctcatctgaaaaacaaggggcagctcagaggccagcaagtggccaagacacagatgcacagatgaggggccagccttctggcaggccttggtgcctccgctgttcccctcatcgctcccaggccacttcaggatgggaaggaacagatccctctcacctgcccctccttccagcaattcccagcccctggctggatgctgtgcattcagccgtgtggagctgatggaaggcactcagtgcagggccagacacgcagcaggtgctcaagatctgttcatttccatcctctggacactcatgactcaagcaacagaggtggcccaggaccacttaggatgttgcagctccgagtagcatgaaaacattaggggttcctcagtcctggagcagcgaggcacccctggctgggaagatcagggaaggcttcctggaggcgaagggcttggaagcaggaggaggagctcggcagccaccaggtcaaggcccgcacgtcctttggagctgctggagtctaacctccccgttactcctgaaagatcataaaccacttcttgctgagctcctgcatatgggggcccacagagaaatcagctccatgccttgccctgaggagtgacagagaggccatctgtcagtaagaagttgccatctgaatccaaatggcagcagtgcttgtccacctcacttcctgctcagctcaagtccagactccagaaaaagcctttcccacgtgaggccagtgatgccaggggcagccagcgcctcagctcagcctccctcagcctgacttgtgctccttgtcttcctgcccagtgtccccaaggcctcctgagatctggcagggcagggactctgggtccctagcactgggcccaggacctggccacgataggcatcggcacttgttccctgaactgtcttcagttgcatgccaagcaaactcccccaattctggctcggtgcattctggaagccagaagcctgccttcctccttccctactcaagcttccacaggtgactgccccctttggtgcgggttttgcttcaagccacaacttataaggtgccaggtcacatgtaacacaagctttccttctgttgctgagccctgaggctgcccccactgccagtccctggcggcatgggacaggaccagtgccagagaggagagctgctctccagtgcggcaaccccttgcagtccgggcctttgggctctcatgtttagggtcagtccagggactttgcattcgttaccactgtgcccatagtgaaccggctgatgccaagacaagggcagtgccatcaggggaccagtccctgagagatgctcaggagaggttgccatcattgcttccaaaggccgggaagaggaggaggggctgaactgtcccacacctggtcaggtgtgtggcaggtgagggtggcaccttcatagcctagtggttaagagaatggctcagaggtcagcctgggttcaaaccccagctcagccaccatccagttgtgcaaagttcggcccttcatgcaaccccttgaggcctctgttttctcaccagtactgaagggtggctaaagccaggagcacctgctgcactgggtgcctgcaagtgctaggttcctggcacagaggtgctctgtcacggaaggtagctgagccaggactatggtgccctccttcagggctgtggtggcaaggagtgaagtgggactaggtggagagagagatgctgactgggatgtgggcccctacctgaggaaaacagtttagaaattactgctgatgatgcaaacagtatctacccacatttaaagtgactcactaaagaacacttaattcttagggtgatttctcatgcctactaaagtctgactcgctttcttttttgttttcactttttttttttttttttgttagagctggggtctcgccttgtcacccaggctggtgtacagtggctagtcacaggcatgatcatagcacaccgcagcctccaactcctgggctcaagcgatcctcgtgcctcagcctcccgagtagctggcactacaggcgagtgccaccatgccagcactgttgttactttttatctttaattttttttttttttaccttgaattgatttaaaactcatagaaaagttgtacgaatcgtgcagagaactcctgaagccttatctgaattcccgctattaacattttgccacatttctcattagctttcttcacttgtagcctttggatgggtcagagggtgggcagggctgttgtcagttcatttttccaaagggaaactgaggcacagagagggacttgctcaagtgccattgattagaaactgagccagattaacttctctcagggacacatattgatgcatttggcaggtgttttcttgatcactttctgtgttgggcgctggggcacagaaatgactgagaactgacagcaaagtgggagggacaggtctgagtggagaagagactggaaaaggaaaagacaagaggccctgtgggtatcactctcaatgtcggaggtggaatgcaggaaggaatctgcagcttaagcgtgtctcccagggaatttgactgccgaagggtcccagaggccactttcagaaacacggtctaggcttttcctgttgggagtgtgctcatttctcacctcaaaagggagctaggaactgggagggtgcctgcctggagcagggaggtgggtccaggccagccaagagagcaattcctcacccactcattaacgcccgctgagccatccctcttcccgcagagctgcccttggggctgctgctgctgagatggcggcagagctctgaagccacgccctgggtcagagaggagacatagcctctggggccagtgggcaagccctaggctgctggtggttgctggcggtggtccctggccttggccccatctgtaggcccagctcgggcacccagtccgggccccttggtctagtccctgtgatctttggctcagcacgccactttgtgatgactaggtcagtttcccagagagcttgatgtggcgaagagttgctatggagagagcaagcacaaggattttaatcacaagaaccggcatccctggtgaaaatgcttacatcaggcagtgcctgctttaaactgaaataaaaataaaaataaaaataaaacccaaaaccccaaaccaggacttgcttcaccacttgtgccagcgatcccttactcatgctttcattcctttgggcctgagcctgggcacctccttgggaaatgcagtgctctggcaacattccgctaggccgatccccccagcacccagcctggcggttagggctctgaaaatgcttgttgcatacatggcagtgtgatcctgggcaagtgctttcttctctctggacttccttattcttatccaaaaataggggcagtgttagaggtaagggtggggttgaggggactctgggtctagagtgggcagaaagatgagaaagagggttgtgggaggggagaaggaggatagggagtcagagctttgggggaagtggggaggcagcgggctctttctgttccttttgctcctaactagtgatcacctgcatctaggacagaaggaattagctttggctgatgttagtcaagggcaagaaggagtgacttcctgtcactggcctgctctggcaaagactgaatggatggcagcagtggtgtgtgtgtaggcgggggtgttcctaggggagagcgaaagagggtaaaagaaagtggccgagtgcggtggctcacgcctgtaatcccagcactttgggaggctgaggtgggtggatcacttgaggtcaggagttcgagaccagcctggccaacatggtgaaaccccgtctctatcaaaaatacaaaaattagccaggtgtggtggcaggcgtctgtaatcccggccactagggaggctgaggcaggagaattgcttgaacctgggaggtggaggttgcagtgagccaagactatgccactgctactccagcctgggtgacagagcgagactcgtctcaaaaaaaaaaaaaaaaaaaaaaaaaaagaaaaggaaaaaaaagaaagaaagaaagtagggggagagggagaggtgctgtggagattggagtgtgggctccatgacctctgagcctcctctgatctcactggctgccttgtctgcaaatgggactagcatctctgcatgactgggattggctgaagaccacattggttccctggctgcagagacaactgcaggatgaggggtacagaagcagccagggccctacaagagggtccctgcccagccctctgttctccacagagacatctccaagggcccttgaagccaagccagccctgaaatggcccagttccctgaacggtcgcttgtatctggctctctgagaacgagaaaatgggcgcatgaaagccaggaggaatcccgaggccccaaggagcggtgggtggcccagctgccttctcccctcctcctcacccccagcgccccaccaccttgggaaggagctggcctgccttaaaagtctgcctcccagggcccctccagtgcagacgccgagaagtctagatgctggggtgttaggggtgggatggggagaggtgaaattccagactttcatgcagaagtcatttacctgtaaagcacatttacaaataccacccccgccatgcgttctttttccatattatattttcccctctgcaactcaagtctttttcagctctttttttttccacttgctgagcctttttcctgccaccctgttggcctccaggcgagagcccctgggactggagcatcccaggcaggtcgtgcactctggctctggcaagaggggcccagcctaggcctcctgggagctgcacgctgagcagcagactaggaggctcagacgggatccagctgctcagccctgcccacggtccctaaatcaccgttgaagtgccccatccccctggatctcagcaactcctggaacagcagctacagccgctgcagcggtgcctgtggcggtgcctgctccatccccttcccagaggaaagcaacctgtctgctgactgttgccttgccagctgctgagactccagtgcaggagactgggaatcagaatgtcctgattcaccagacctggccacaggaggctgcttcatcaaatggaacgtttcatcattccaacccttttggtccagaaaatcagcacccgcaccggcttaaatcagcctgggtccaaactgagtcagccaagtgcgtgccttgagaaaggacggggtgagggcatctgagtgggggtggaggtggtgcttcctgactttataattcctcaggcttgtccttgcacttcccatggcagcctccagggggagtctgtgccacagccaaggctctccccactgcgctaggcttttgaccttagccccctccccgggaagtatcattgcttggggtcctgtggccttggtgatgaccggaggggctgcactgaagcctacaccttcctcacatgaccaggtgcaggggccagggagcattttgagaatggggcttccttaagcccattccccctcccatgggcacagagcattctcttttacctcaaagtttagaagtgaaggtcagggagggtgagtgacgcgtccagtgactaaaacccaggtccttggactcctcgtcagtactccttcctttgctccagagttggaagagccagcatggatgtgtggctttgtggccttgaccaagccctccacatctctgacggcaccgctgtgcccgtctcatgacatgacagatgataaggcatggctggctctgcgccggggcctcctgaacatgtcatgcccctactaccctctcagcatctgtttctgctgccccatctggctcagggctgcagtctggccgcagagagggaagctctctaaggaaggagaatgggctgggagaagccacctgctgccccttgtttagcaggctgcattccctagcaagccagctctgactatctcagtgtcgcccttctcctggtcacccagaccgccctgttcctggggcagctcatgacactgcgaggggtttgtgaagggtctttcgtgggagggcccttactcagagctcacaggcatttgctcgaaagacagcaaaagaggacctaagacatggggacttttctttgagtctttttcctgacactaggtccagtggaggctctttgcccaaatggaacatttacagtgagaaatggacaggagcctcgacacccccaccctatgcagaatttgacctccacccctattttaccaaggcaagccctccagcaaatgaagctgtcagacaggcttggggggggggcggggtcacagcctgggagggaactgcctccctctcaccccttggtgctggtgctggtggtccccaggttgagttggaccagaatggaggggtggagggactcccctccaggggactcccctcccctccagggactcccctccagagtccctcccctccagggactcccctccaggggagctacctgggctggctgggctctggggcttgggcagcctggagccttgggtttgtaaagcccaactctggctcttgtaggaggactggggggaaaggtgtagcagctggggtcacccttgcacatgtgtttttccatggtttggtcattgccacccttatcgagtggtagggaacccagacaccatgaggggagaaaggatttgcccagggcagcaaagctgggatgagtctccttcccagagaccagccatcttctctgagggttccagcaggcatgagccccagcaggtatctaagctgagggatcagcactgcctgggtccgcccatctctaggagcaagttcttgggagacaagggagttatcccttcaccacttacctcatgaccagatgggagtacttatgtttctgctggagtgatgggggcaggcctatgtgctggtccccagctatattctgggcctctgcctccattaaagctccttgtcccagagccacgtgaaagtgcttgcagacagagctttcctgaaacacagccagaggtttcctaaaacatagcaatcagcctctgcagtgggcagcccaagtcttgatggcttcatccacttgtacttgacagatccatatttggtccctgtacttgactgcaggggcagcactctgggctgtgtcccccttcttgccctgtccagctgtttctttatgctgactcctgacccaccccaaaggggtccacacagatctgagctgtgagtgatccctgtgagcctagctgaggttggcacacgtggggtggcagagctgggtgtctgctcagctcctggatgcaaagcatcccaattcacctttgggaaagaagcccttctgcttgcacctctgcctgtggcacacctgctcctgcttgtgcatggcgcccagtgcccagcacacatgcactgagacaagccctgacacctgtgccctctggctgcatctcatccatgagcagcgatattcagtgctccgggaaggcaaggctgaaggcgttttgctcccttgccctcccagtttgcttaggaggccctgcctggcgtcctacttcccttctgcacagtttgggagccatcctaatcccctgcgagccagcttctctgggaggtgccgccctcggggagtcaggcagcggggaagttctacaaaactttctctgagttagtcctctcatcttggaggctgagcacgtcctgtggtgtgagagggagtcttttctcctgccgctcccgtctgtgtccatctcctcacgctccagcacctgcgtcattgcctgctgccgcccccgctcctccagcgcacgggaatctgcatgcatcagccccctgcgtcagctcccctctcactccactcgctgatgacaccaggcttgctgtggtcgggataacaggctctgttcagccacctcattggctcctcgctcctatctatccaatcagggccaggggccccttccttcgaggttgctgggcaaccttcagaggccacagaggcagggagaaaggtagagcaggaacatgcccatgggcatttggaggccatctgaattcagggaaggcctgtcctcatctcccccgcccagccctgccagggacacttcctcagattgccatctctcagcccacttggccagagacaggaagagggagaaagaaggggatgaagggcgggccggggcatctgcctggtgtctgaggtggcctggcctgtgcaagaggagttggacttggccctgaactgccctgggacaggctggtgttgcctgagtacggggctttgctcagagtcagcacagagaggggtactgtggagtgtggccacatcttgtggggcttcgggggtgcaccacgagggacagttcatgcagagggtgtcagaaaagccaaccattcctttggtggcccaggccaggtcctaagcaggatgatatggagatttccaaaaaaccagaagtcttctccaaatcaaggtagaaatgagggccatggtactgaaaaggcctagagtggctgtcctgaccagaaatgtgcccacacaggccatcaagacacccgtgtcatggcatgagagatccagagaggcacatgttctagcttggtgtatcctgtcaggaagagacccagtgagcaggcccacagatgccaccttacagatgaggagacctagactcggagagtgggatgtcacagccatgtgaggccacttagggaagaggagcagagatgtaagcacaggccacagcccatggggacagtgtttgcttttgggttgtgtggcctctctgggtgtcagggctaatggactttgaaagaagcctgagttcgcagaggaagaggaagactggaagacttgggcaggtagcaagcccctggcaccactttcaaaggtggctaaggaaggaacatttgctctccatcttcttggcagggtaaatgggaaggtgcagggaaccccagttacagcagtttctttttcttcaggaactttttctgagtctttctcaggcacaagcccagaggcatgagagagcttgacatactggactcagatggagagtgagagtgtagggctgcgggagtgggtggcctgctccgtggggtcctggagtcacatgtggcaggcctctgtggctgcatcaggccgagcagcacaggcaggcacggtgcagctgggtgagtctgaagtgtctcctccctccagcgggtgagcattgctgctggggcccagcggtttggaggaagccatagaggcgactggcagtgggtgtgccccaggagcactcgaggccgtcgtgcatgggcttacctgggccactgcgtggctgggactcagagccctgggagtgtggccagggccagacacgggcccactcctggctgactctgctgaaggggaagcaggagcattggcacagctcttgtgcgtgggctgcacacggtactgctggccttctgagacctgatcccaggagtgtgcatgcagggtgcccgcctgacacaggggtggtgctccagcaagggaagccagtgttgttattgcttcccagaggacggcatggttctcatcgcagagcggagcccaggccactgtcccagtggttgggtcttctggccgctttgctgggacctgggtgcagccctggggagggctggagtcctgcacacaggctctggaggcttcactggcttcccaaatggggttcacatccgctaatgactgccccggagagcggagagctgagggtggccctggggcagcagccatggtggccagagggtttatctgccaggcctctgtggtgggtgctctctccctgggtagactgggcctttccccccaccccctgctgccacccatatgaaagcagacataggcatcgcatgtccacacctgagccataaccggtccctgtaccaggctcttcagatattctggacgtgagcctcgtgagcagggagttgtccttgccccctggagtactttgctttctgtggaggtccctctggctgacttgccatgggctggggagccagggcgggattgcgtggggtgggagaggagccatcagtgggcctcatgtgccctcctgtcccgtcatctcttccctgggccccgtacatgtgtgaacggagaagccggcctcctgcttccaggggtgccaccgccactgccactgccgctgcagcaacctctgtttggcatccggcccgaaacacccctgcctgctctccgcttccttctccaccccagcttgtgggaaaagacgaaggaggccccgggaagaggcccaggctgcagcactgcgtggcccaaagcagtgcacagcacagctgggccccagaggctgagggcctgcccttgctgctgtggggatttcctcctcggagtgagcaagcaagagaagtccctgcatctgttcattctcctcacctcccatccttcctaggcactgcttgcctggcatcaactctttttttttttttttttttttgagatggagtctcactctgctgcccaggctggagtgtagtgatgcgatctcagctcactgcaacctccgcctcccaggttcaagcaattttcctacctcagcctcccaagtagctggtattacaggcacatgccaccatgcctggttaatttttgtatttttagtagagatggagtttccccatgtcggctaggctggtcttgaactcctgacctcaggtgatccacccaccttggcctcccacaatgctgggattacaggcatgagccaccacgtccggccctggtatcaactcttgagactaatcccttggctgctcaagcatactccactcgcacttcatttgggtaaaccaccgtcgggctcatctttagcacacagaagatacacgttcatgacaggaaaattagaaatacacaaaggagcaaaatattttggtgtatatctttacagattttttcccctgtgcatttttatgtaaatatattttgacttagatgacaccatcatacacatcctgctttacgggctgcttttcactgagtgatgtatagaaactgtacacaatacaggtttataaagcatgttaaatactacatgtctcagtatgatttgtaatagctgcatagtatttgcttgaatggatagattacaatatgtttaaatatgattgatgggcatgtagattattgccacattttcacccccatactcaacactgtgatgacacctgtttcatatacatctttgctgtactcgtgcaatttcttcctcaggctacttggctgcgaggggaattactggaccagcaggcctgcccttaagccttttgatacatacagaaactcattctgtcgagattcctggtttcccttcccacaagagccaccaggaagccacctctggaggggtccacattccatccttcaaggctgcttacatccgtagcaagggtcttcctggctgtcactgagtggagggccactctgccctgctctctgtgaagggctggacaaggggaggggacggtggatctgggaggagacctgggtccgagcaggggtaggtggcttcaggcaatcactccctggtggggtgtgctgggctgtcacagggtgcctgggcttggtccttgctgaggttgggggaggagcagggcttgcctgggaagacttggatctgcaggtctgtgcctggctgtgggagttaggggaggggagcacccagtaggagcagggctggcctcgacgtgccgggccctgagggagaagcagggcttagctcggcggaagttggaagggcatttcaggtgggcggaccagtataagctaaggcacaggcattcacttggcagggctaccttccagggactccaaggcacatggtctgcttggagcacagtgtcggcattggggggaaagaggctggctcaggggactggtgattttgctcccagtcttagaaacagtgtggaaccatcaggtgctgactgagaattgaaggctgatgtgggccaagtgggattagagaccaatgagtgttgcctggaggaggtgcagataaaggcagcaggccagggaccagggaggaggtctcaagggatcgtggcctagaccagggcaaattggagggagaagtcagctctgtagatgggatgtacattccaacctcatttgcccaccccacccaccccaccccgccccatcccatcccatcccatcccatcccatcccatcccatccctcccatcccaccccactacatctcatcccatcccatccatcccatcccatcccatcccatcccatcccatcacatccatcccatcccatcccatcccatccatctcatcccatcccatcccatcccatccatcccatcccattccatccatccatcccatcccatccatcccatcccatcccattccatccatccatcccatccatcccatcccatcccattcatcccatcccatcccatccatcccatctgatccgtccatcccatcccatccatcccatcccatccatcccatctatcccatctgatccgtctatcccatcccatccatcccatccatcccacccatcccatcccaccccatcccactgcctgacactcatcactttaaaggctccttgtcccaaagaactgccttacacttcatcgtgtggaaagactctactttggcagagatttttctgactctttcatatttattgtctcatcaaaaaagaaatttcacttgtgagactcagccaggcgtgagggaaaggagcccatgcagaagcaccagccctggtctttgtctggcaataaacccggagtcttctgactggagtctcagctataaagacgggactgaaggcagcatggtgccctctgcaggggacggatggtgttcccacccagccctgccctcctttgccatgggtccctctgcctctgtcattctgcatgtgcaaaagtgtctgtcttgactttggaagtggcttatttggtcctgatttggcaggaaacttctaggcaatgtggccatcaggtttgacaaggggtaactgatgagtccttgtgcctggtactgggcctgggatggagtccacccccgaaactgtggatgaccgtcacctgcttgccacgctcatatgtggaagctggtggctacagtccctgaggccttagaaaggagtacgtctttgaggtgcccagcgcaaaataagtcatactagctagtacagcctagcaaggttagaaggaacctaaagacgaaagactaggaggtcctcctgcaggtgaaaagctgaggcccagatgaagtgaggaactgtcccaaggtctgtagtcagtcagtggcacccagagactctgcacatgtgccctgcccatggggccactccacaggttgctgggatggggacagttaggcctgtatggccctaggaacacctgtggagtgagcgccactcaacagaactctaacgtggcagctttggtgcagggctgggcacgcggggctcccatttgcagtgatgaggtgccattcctggcacacagcaggctcgggctgtctgggctgctcgttcagtgcagtttatggaagagccagctcttgctgatgtggcaaatttggtttgctctcgtccccctgccctgcccatttgagtgtgcccctgacctccacagaaacacatccaggccctgccagctggcagcagtgctgagctggtcagaccctagccctggaggggcccaggggatgaaaggccctggagagaaaggctcttctgctttgtgactatgccagcacaaccagggccctgcttcctgtcatgcccacaagcctgagcccccagcccctattttgaggcccaagggttcggctgtggccactcagggctccctgcagctctgggtcgctcccagcctggagagccagcttcatcaccctgggcccttctccggagcaaatggccctcgagaccaccacagctcacccctcatgggcacgagagggcagcactgggctcaagggcagagaggctgaaggcagtgtggcaccgtctgggcagcatgagcagcaccgggctcaggggtagagcagggcgagaagacacagaggaagaggaagcagagctcaaggcagctgtgggccagggcgtaaggaagcctaacttaccacattgccacactcgcctgttccctgagggccactaggatttggcagtggggccctgggctttccccactgaaggtggagccaacccccgaaggaaacagggctgcacaccccagaccattcttggcgctgtttgaggaccaccgcgcctctcctagcagatgacttgagagctactgctgcttggctccttttcaggtggtgccgggtacttataggagcatcggcgcattccatcctcacagcagtcctgaaaggtagaattttttttttaactatcattttacaaatgatgaaactgaggcagctcggagaggttagctgacctgcccaaggtctgtcagaaaactcctaaggggtgagaagcaaggtccaaccccaaagcagctggtcccccagcccgtccctctccacaggccatctgcctgccctgaagctgttcggctttggatgcactctctcccaccctctgagtccaccagtgccagctgtcttccccacaccccccagcctgagccaggctgttagcactctgtaggagggctcatgttctcccgttatcagtgatcgctttgaacagacagtccctggcagcccctgagctccacattctctaggtgagcagccctgggcaggcaggtgggtgtgccgctgggcagcagcaggtacagtgagtgctggccccctggcttctgcccatacttagcactccaccaacgcttgccacccccgatgtgcagagggcagtctggatgatcttggtgtaccaggacccatatggtcacctgcaagacactacaaatgcatgaagtgacagcatttgcttacctttatccccagaagccctgctgaatcaagtgagaggagagctgcggagcaatcaccatgagtatctcagctcttggaggccgcaccaaaggtgaggcctgggctccctggtttcccaggctctgtttggggctgtttgcttccaagcctgcccctacaggccacaagcactgtcccagcagcaaagggagagcagcatactgggagaactggaaaggaggtcgagggtcctggggctgcattcctcttctgaggcggttggcttttcccaccacagggaagcctctgccaccaggcgaggaggagcgcaataacgttctcaagcagatgaaagtgcgaaccacgctgaagggggacaagagctggattaccaagcaggatgaatcggagggtcgcaccatgtaaggcaaggaggcggggagggaccgcagcaacgtgggggcgcgcaatccgtgggggaccgaccatacctggggatgcgaaggggcttccaccattcagagctccgccaggccatgtggagggcagagcgtgggaaaggctatccagcaatgtcacagggtgggagagcccctgggtgcctgggaaggagaatgtgtggcagaaatggcaggacttgctgggcagcctctaggatggaggccacaggatggcaggtgacagggagtctcggagccaatccttcaggatgcctctttcccccagagagctgccctcaggccggagtcgcgccacatccttttcatcagctggggaggttccgaagcctaggtaagaggtggtgctcaggtggctggtgggtcagccccagggactctcctgcagcttggggccagccctcaacagggaggggtgggcagtccacaggggacagggatgcagccccagccaagggtctgcaatgagtaatttgaaatctgcaggaaggaggggcttctccactgcaccttccttttgggaaggggagtgtaggagtcacttggtccaggcccttggcctggctgtgtggctgtggggcagctgacttccctgctgggcctccgtggctccagctgttaactgggattgaaattgtctttaagaagaagacgacctcccacccattccctgcagggagtgatactgcctctgagatgctttgggcagcttccagagtcacagtgactcactcctgcaggtcaccctgactgcttgagtgtacttgggactcagcatgcctgtagagaggcacgagtttgctctgactgtctcccaagtttaccgtgacatattttgtcagctgaccaaggagaactggcttctctctcttttgggggcttttccataacagtgtctaggggggctctgaagcgtgggcacaccctgctggcctctggaggaactgctcctgacagagaaagggaactgaaattcaggctcgctccttgctccaaacagccggcaggcggcttctcagggggtggtagaggcagtggcggcctctggaagggagggcctcaagtttacagccagcacacagggctacctttagtaactacggtctctctgtcacccctcgatgactcagcgcccactacctgccaggtcccatgctgggcacagaggatgcaggagtggtcaagacaaaggccctgtctttgggcaactgacgtcccagcaggggactcaggcaggaccctagtaaacagttcaatacaaaagcgagaacccccaagtgtgcctgcaacatggccacctctgggaggctgtcccctgttagagatggagattgtggggttggagactaccggaggctctgtgttgcccttgacccaaaccccgatgctccagcccacatcccctccactgcaggacagaagggtctaccctgaccccttgactcctcccctaactctgaggaggactctttgcaggggcccctaactcctgcccggaggccagaacttccaggctgaccacccctggctgtcagctccctgcccgctcgtcttggctgccccctgagttatctgagccccctcagttgctgccaagcaggaggtcccaagcacccagagcctaatgtttcccagccgctgaacaaggcctggccgcgccctctcgtctcaaacttccaccaagacttggggtgtgggcatgcaaggagctggagcaaagagggccccgagggacaggaagggggacagctggcttcggctggctgctgcctgggctctccccttcaagccctcatgcaccttcctggtggaggctgttgagggagatcaggtcagaccccgggctgaggggaagcctctggctctgactggggagcctccagcttgcactggttcagccccaagcacagaggatgggagggctgtcagctgagagcagtgctccgtcggcgcagcactgggaactggctggccaaggagaagctggactttggagaggccatcaagctgccttcctaggcacctgccatgaggagtcacctggggcacttttcctgggggagcatgagggaaataggcagagcatagcgggcacctgatcaggggcacagggggctggcacccctcgtttctgctgtactgggacacctggagcacttgccagccaatcttatttgctatcgttaagggcaggataaagtaggatgacctcagccctccagcaagcctcgcttcactccaccccttcttctcttcggcaggcctccgagcacaagggctcccactggctacatcatccggtaagtgaccgcaggactctgccggccttcctgtgcccactcacgccaagccctgacttcttacccctccagtccctccagggagctcaccggcatctcctgggctctctttcaggggagtgttcaccaagcccatagacagctcttcccagccccagcagcagttccccaaggccaacgggactccaaaaaggtatgtccatggggtgttggccagtcggccagtggggaggtgtgagggcctggtctgggctcctggcagagacagtgctctgcctatcaggactgtggggccttggaggtgccagctttcatcctgggtagggcaggaccctggagagcagggtggggtgaccagaggagatgggctggggtgggactggcagtcccaagtggatgtgtgggtctctgggaggtcctgggccactaacagtgtccttgtcctggggtcagtcctgactaggcctggctaatgggacagagaggtgcaggagtttgggaggggctgggtgtagagtccccctagcctggcagtgggcacccttgacttgacttgctgatggcattgagaaggctgaagttgcatgcaattcaagcaccttggcatcaggcattgcctgggactccgtcagactggaaaggccaaggggacccggaaacaggaagcaaagacacaggcaagagcccgctgggctgttccctgaagctcggtggggtttgcctacacagctgctctgagtggcgcagttccgggtgtctgtcagggccaaaagcaaagaggaaaggctcccaggcagctcctggtccacctctcatgtgtccactgggctgtgtggccaaatctggaggcaggagggagcctgcaggtagacacatggaaccttctcctctctagtgctgccagtctggtgagaacagctaacgctggtcctccccgcccctcctcctctggctacaagatgaccactgaggattacaagaagctgtgagtatgcaacgccaggctcagcgtggttccctcctccaaggaacaagtccaaactctgggtccactgaaggcagctgactacttgccaccgagcacagcccgggaagtcccgcctgcctgacactccctgccagttgcagctgtggcctggagcccaccagagggtaacaagccccagaaaactggatggctgtgcacattgcacgtctgatccgaggcagagcggagaccgcaggaagcttgtaggaggggccccacggatctggggaaagggtcatgggtcgtgaggctgctgctggctggctgtgcttcctgggcttggccctgcacccggccgagcctcaggtgctctgcctggctgcactgggctgggggcctggggatcctcagggtgctgctgtcagtctgagcattgtgtgcctaaatctgagctgcttcttggatagaaaccttcgggttttcccttagtgctccccttggggtccctttcaaagccccccaccccccactgcatgctcagggaggagggttctctggacagaggtgtgaattgtgtctctagttcccaggggaccacatctttccgttgtttgtcccttgcctccatcatccagggttggggagctgctgggtaacctttctggggaaggggagaggctcgaacagggagggaggggagagctggtctcagggaggaacaagtggcatgacctaaggcccaaaggcagagatattgacttgcctcgtcattgttgttgaaagccaggaagccaagctgctgagggtggcagcctatgacaggaaagcgcctctcccctctcttagggcaccctacaatatcaggcgcagctctacatcaggggacaccgaggaggaggaggaggaggaggtggtgccattctcctcagatgaacagaaacggaggtaatggaatggtgccttttgggcatcccggggggcagggcaggagcctgagtcttcgaagactgctggaatgaattgtactggttggggtgacaaaatgcacaacacgtaggccatcagcggtagcccacggagcatgagaataggtgtcattctctgagtgccagaaccacccactcagtgttggaccagctgaggggcccttgagaaccttctgtggggtagaacctaggtaatgtgggtccggggaaaagcctcctcatgtggaggctcttcagggctctaaatcggtttgttagaaagggccctgagacagttgaacaaaaatattcagggagaagccacctgcacagtgccctctatctgcatgatctgcatgccttgggggttctgaatgccccggaccccaaactgagctccaggcatgcacagcagtgggagtgtgccccatgctgctgaaattctaccctagtctctgcgccaagctgccctcgtccacacaggccagcaaagttccatggacccttgcccctcctcagtcctctgtccatggggactgaccacataccacccagtgctggtgaactatgacaggaagggtttgttaagcaccttttgtatgcctttggcttggggcctgtacagcagttgggccctgaggaaataaagccctcccctccctgggctcagccagccaccaggtccatatctgctgacccatctgtggcgcaggaatcacagcaaagccccattgccaaaggccctggcagattggctatcctcagggaacagttcacagtggcaggggcccccaggcctgggtggagcaaggaaaagagccagaagctaggagctgcctagcattgaatgccagctctgccacctgctaggtgagtgctcttgggcaaataatgaaagcttcttggactcagtttcctcatctgtaaatcacagaggatactagcgtctactttcctggattgagaagagcaataagccaatgcgaggatgttggcatctggcgcagagccgggcacatgccacatgctccataaacatgggctgcccttccttcaggttctacatttcctttgaatagtccttggagcaggtgcaaatctggtttctctcaccccttgcctccctggggtggccctaagtcaccccgagtccatcccaggctaggctggcagagcatgtccagcttggcacccatcagatgctcccccatcccgtgtcaccccaggtcagaggctgcaagcggtgttctgaggaggacagctccccgggagcactcctacgtcctgtcagcggccaagaagagcactgggtgagttgccaccaactggctccaggctctaggacagctctcctctcctcagagctccagccttctctggctgatgaaagggtgggtggagagatcacccccaagggccttcctagctgagccttctcagattctcagatgtactttctagaaaatggagaggtctggcggctaccaccagggacagtgaagtgccgggaatggagagggcccaggaccctctgaggtagagcggtcttgatgtcacctgcccacgggctctgcccaaagcattgcctttctgcttcctttccagcagtcctacccaggagacacaggcaccgtttatcgcgaagaggtaagtgtcatcaagggacaccttggaggcctgttactggccacaggaaggccttccgtcagcaggggtgtagtgtgggagctgtggagaggggatgtggatgtgggggactactgtccctgagcagggggagttgtgaggggctgggggcttctgtctggaggcctggcaagcacctgggtggctgtggtagcatatgtggtcaagctcttccatttgccaatggctaatggggctgggcccctgacccaacgtggagcatttccaaggccctctgggagttgttcccctgcccctgttgcttgcctgatgccttgccttctgctctcatccaggatcaaaacctgggccatcaggagaacttcccctgggaggtgactgtgacattggagatgggccctaaagggtgaacagggcttaacagggaatgatcagaacgtcgggatactccagctgaatgagggaggggtgtcaccattagttgagacagggcaccttctggaggaggaaaatattcgggggaaagcaagaaagaaacttctggaaacttgaatttgagggacttccagttgagtggacagggaaggcctctctctgtgctgaggtggctagctggggactgcaaacccaagagaagacagcatgccaactgccccaggcagagggccccagtgcacaggcccggggtgggactagcttgctgtgttggaagaccaggaagttggcaggaatacagagagcagggatggtggcagcacaaaggaagtgacagagaacggggggcggtgggggggtcttcctggctgcatttggttcctgtggtttctgtaacgcagtaccaaaaactgagtggcttaaaacatcagaaagggattctctcccggttctggagaccagaagtctagatcaaggtgttagcagggtgggttccttctggaggctttgagggagaaaccatcccaggccactctcctggcttctgctggtggttggtgatccttggtgttcctcggcttgtacctgcatcactccagtctgtgcgtctgtcttcacatggccttctcttctctgtgtgtctgtgtccagatttccctcttcttacaaggacagcggtcattggatttaggacccatcctactccagtatgacctcatcttacctgattacatctgcaaagaccctatttccaaataaggttacagtcacaggttccaggggacatgaattttggggggacactattcaacccagtatgctgtccttatcctgagctggagtcactgaacccccagcctgggccacctcttggccgtgatcctgaagggttgggtcagttagacgccactggaagcatgttctttgaggcctccaagctctagggcagccaagaagaccacgagcgctgtttctcttcttgctcaaagggtggaggtggtggaagaggacgggccttctgagaagagccaggacccacctgctctggcaagatccactcctggctcaaacaggtaatccattgcgctcatctctgcctggggctggtggctgccatacctgccactcagtcactgaggaacctcagtcagggcacctccatgctgggcttcgagatcagtgtccccatgtgcccagtgacaagacgggacaaagaaatcagtaagagcccatctggctggatgtcccagggctgaaaggagcaaaacagtccagccccccgggagagagcacctggctctggtctgatgagtacgtatctgtgtcaccttaacccttgcaccactgagcctggtggcaacttgaacaccccaagaaaaagtaccatccttggggtttgagagggccagccaccatggcagtagcatgccattgtcagacttgctccttgcactccaataagttagccacattcagcatgcccagggaggaggctctgacatctccagagcctctcacagccaccttctttgccagtgcggatggaggcaggaccaaagcgtctcgggcaatttggatcgagtgcctgccaagtatgcctagccccgctgggagccaggagctcaggtgggtgccgagagctgactctggcttgtgagtgggtgtgatggcttcccgccagcctggctggctggttctgccagctggggagggtctggcagtggggtgatggggcaaggacaggctgagcactggtgatctcactccaggaagggccgtgatttgtcttgatttctgatccctgagaatctgggcagataatggtgctctcttgtctgtggacaactaataccttcttgtactttgtgcagaatggtgctaagtcctgcagggagagccaccacctgctgttgctgctgtttaaagtgcctgcctggattgagacctttgctcaaatctaggtctcctaagagctgcatctctgtagcacccttggaagacccctgcatccagaaggggagagggcctgtccctaccggtcacttcccaggcccccaagggctgttcaggctctcctaataccatagcaatcccccaatttgagctccacagccatttatagacaggtgaccactgtcctcagggttacttcctcagtctgggagggagacagaaatgctggcagagggagccaggagcatgaggccagctccctccatggccccaggcagcagactgccagggtgcttctccttttcactctctccctctcttgatcttctctggttgtctgactctccccataagaactttggtccatagaagatgtggaaaggaagatttgagaattctttacaaggcaatatctagggcagagctccccagtctttttggcaccagggattggtttcgtgaaagacactttttccacgggacggagcaggggatggtttcaggatgaaactgttccaccttagatcatcaagcaccggattctcataaggagcgcacaatctagatctctcacatgtgcagttcacaatacggttcgcgctctcatgagaatctgctgatctgacaggaggcggagctaaggcagtaatgatctctagcttacctcctactgtgcagcctgattcccagcagaccacagactggtactgatcctcaggctggggttggggacccctgatctaggggacttggcaattgagggatatgggggcaaaggctgccacaacaaagtattgtaccacaccctggggcgcttaaaccacagaaacgtatcatctcccacttctggaggctagaagtgtgagatcaaggtgacggcaaggttggttcctcttgagtctctctccttggctggtagactccatcttctccctgggcccttatatgctcatccctgtctgtgtgtgcctgcgtcctaatcacttctgtttttttgagacagagtctcactccgtcgcccaggctggagtgcagtggcacagtcaccactcactgcagcctcgaccttccaggctcaagagagcctccagccttagcctcctgagtagctggggctacagtcacaggccaccatacccagctagttttttttttttaaatttttgtagagacagggtttcaccatgttgcccaggctggtctggaactctaggactcaaatgatcctcctgccttagcctcccaaagtgctgggattgcaggcatgagccaccgcgcccagaccctaatcacttcttataaggacattggtccaactggattagggcccaccctaacaactgtattttaacttagtcacttctttaaaggccccatctccaaatgcagtaacattctgaggtcatgggggagttaagacctcaacatatgaattttgggtggcacaagtcagcccataacagtatacagttctcatttctccttatttctcttttaaagaaaggcaataaatggtttcaggtgcctttctgtttgttcgtttgtttgttttgtttgtttttgagatggagtctcgctctgtcgcccaggctctgtcgagtacagtggtgtgatctcggctcaccgcagcctccgcctcccgggttcaagcgattcttctgcctcagcctcccgagtagctgggattacaggtgcacgcgaccacgcccggctaatttttgtatttttagtagagacgggtttcaccatattggccaggctggtctcaaactgctgaccttgtgatctgcccacctcaggctcccaaagtgctgggattacaggcgtgagccaccgcgcttggcctcaggtgccttttagaagataatataggaggctgggcatggtggctcatgcccgtaatcccagcactttgggaggccaaggcaggaggatggcttgaagccaggagtttgagaccaacctaggtaacatagcaagaccccatctctacaaaaaaataaaaaataaaaattaaaaattagttgggagcattgatgtacacctgtagtcccagctacttgggaggctgaggtgggaggactgcctgagcccaggagtttgaggctgcaatgagctgtgaccgcacccttacactctagcctgggtgacagagcaagaccctgtctctaaaacaagaaaaaaaagagagaaagaatggaggagaattagattgtgctgtattatagatttaaaaggcactttgacatttattccacaaaattcctttcgatgtttaatccccatcatatggttgtcattgcaaggtggctttttaagtttgctcaggttgccataacaaataaaggctagagattcagggtccggggcaagctcccaacaggaggctcagcttgatgcttctgatagttctttcctccaattctggtcactcaatatttggagctcacccaggcagcttccaggaaagctgctggctgatcctgaccctggagggccgtcttctctgaccctaccacgttaggtgctgcactggaccaagcagccaccatcagtactcccaggcccagctcctatctgcctggtgtctgagaagcccagcccgtgaggaacaatgactcaatcaaactcagggtcctgcagcacttcagaaaaggctggtttgtggcagagtggaagaggagaatgtcacagccttgtccccaggcacagacctatcgaggctaccctctccccaccccctgccctgccctgtttcccttagctacagtgcaaaggtcagctcctcataactcttgccccccttgcaacctgaacccagtttagggaccctctcttggagaaactggttctacacatgcaccccttctcggcccccaggcctggctgctttacccgaagcactggtcaagcttgcctcacctgaccagggcatggcctcctgggtcccggtcctaggctctgcccagcatgctgcctggcagagcgtctggggagcagggagtaggagcacagcttctggcacaggacaaaaccctggctttgcatcagactgactgtgtgaccttgagcaagtctcttcatctctccatgcatcagtttccccgtggataaaatagggagagcagtaatagctacttcccaaggctgtcccaaatgctaaatgagatcgtgcacctgaagtacttaccacagtgcctgggtgctggtatcctcgggggctcccagtcataggcgtgctgagctgcagggcccttattcaaatacaggaagagatcaatatctccacctgctggcatttgagggaaatgtggccaaaggcagtgaaaaggaggtatcccctcgccccacatccccgcctcctcgctctttggcagaatgagtcacacactgtttggcacaggccacagttggtcgcattcccacaggtggctgtgatcagttttgggcttcaggcttcagcagatgcctgcctctcttccttgggtgccttccaagggtgtgcagccttccagcgtggtcctggacttcagcttggactggagctgtctgtggttgagagtctggggagatggtagggtagcgggttgtgggggaggagagacccttgtattagtttactggagctgctgtaacaaggtaccagaaactgagtggcttaaaaccacacgcatttatcctctcacaattctggaggctggaagtctgagatcaaggtgtcggaagggccatgctccctccaaaggctctgggggaaaatctgttccatacctttctcttaccttttgttgcctgcaatccttggtgtttcctggcttgcgcccgcctcactcccatctcggcctctgtcttcgcgcagccgtcttccctctgtgtctgcccacattgccctagtctgacatcagtcactggagcaggctggggtgacactttgttcccatttcctctgtgacagagccagaaacgccagtgagaaaatatgttgtgcttgcctgtgacatccctgttccctggcaccacctgatttaaatgaggcagccaggggttttatactgtcatcataaatgacatcatcctcaacaacgatgtcatcgtcgttatcacgagaggagatggggagaagtcagagctgtctgtgtgtctagggcccctcctggctttcatgatgggagaggccttgtccttggtagcccttccatttccctctggtcactttgagcactccaggccctggccagggtggaagtggagggacagagatgagcagcccgctgacccagccctccatggctcattccttgctttcaccttggccactccatcccctacccctcctgggacccctgagtggcctctttaaagtgccagtctgaacctataaaccccccacctccacttcaagcccatcctgcatcttccctttgccataccagatctagtctgtacattcaggacccctgccagcctctacctcctcctcctcccccgatctcccttcagctggcctgggtcgggctatgcctccatgaagcttgtccactgctcccatggctaaacctgttctgggccctgcagcacagcaaggtcagtttccatgcctctctgcccctgcctgaccctgctgggcccagagcttcaccagggcaggcctggggctcaggcttgtctgcacttccagggcccagggacaaaggcaggagtgactgcaatgtggcttggaattaggctttgctccatggacctaaggaggtctggtttggggtgaagggtccacccccagaaagcctgggagctctatattctctctggccctggccacaccatggccaagcctgctgggcgtcatgccttgcagtacggccagagaatgcatcagacttggagggatgtgtgtccggggtggcctgtggtcatctgggggagggctctgagcgtggctggcaagaggaaagctcaaaggggccctttgtcctcatccccgagtctgcgacatcccctcccactggttttcattccatatttggtctgtgggttttctcagtctctcgtacccctcagtccccaccagtccatgaatgcagaactacccctggcctcacaaatggccactttggataccctggtggggtcacaggctgcggttgcccctgcaaatggttggtagaagcacgggttgggaggtttcatttctacccagaagggcccttgctgtgcctgagggagggctgggctcaggtcaggggtgggagaccggggaaggggcctacaggtcagtggcccgagctcagctgcagcaccaacaaggctcaaggccaaggaggagatgagagcacatcaaaagggggcagtgggtctgggcggcccaccgcactcaccagcccaagaagggggagacttttctcacctgcaacccactgggtctctcctttggcccgcagctcaagaggtgaggaaattgtccgcctgcagatcctgacacccagggcaggactccgcctggtggccccagacgtggaaggcatgaggtatgggggtcctgctgctgtcctggctccctggacaccattctagagatggaagcagcagcctcaggtggcaaatgatgaggcctagggccggctctgccactgtagggccaacaggttgatgggaggcatggtcgacctgggttttctgccccatctcattctttcactcagaaaaccattatggagcaagcgcttagtctgtgtaagggcacaggcccgaccctgggacacagtagtgaacaggaccccctggctggaattgccatctgcctggtgggggaggcagacgccgacatgagcatgaatgaggtcagccagagatgctgtgtgccaggagcccctgggaagtgacagctcaaccctgccaattgctgaagatgggaccagtcagccgtgctggggatgttggtgggggtgggaggaggattgggtctaaggagcccgtgaaggccactgaggccattgccctgcctgtgtgagagggccactgggaatagagtggggtcactgggtcagagtccacagctctccatgccactaggctctgtgctggggaggggtgggtcaaggaggccacaaccagcagggagcacgaggggctcagcctctgccctggggtgggggtcagacagccaggtgacatgcaggcaggattcgggggctggggtggaggctaggagagatccgagcagggagactgggcccctaccttgtgaaggccagggactggggagagaagcgggagtgtacactgaaggtcatcccttaatccctggggtggcaggaacttcgagcagaggcctctcaacagtgtggtgggtgggagtgcttggggagggcttcctggaggaattgacatccaagatgagtcctgagcgatctctaggtccctttaccctcctccttggctcctcccactttaattctgcccccaaggcaccaagtcctgtccactttattttagagatgtttccatccctattgctctgcccctggcccaggcctccactgctactcacccagttgtctgcgaccgtttcctactgtcccatccctggactcccttccacatctacctgggtgatgtttccaaagggcagaagtagttatgccagccccctgcagaaagccctgcaaagcccctcccactatgctctgcagcctgaactcagtacctggccccacctgcaggctcctccctccctgggcctttctctgtgcaggctggaggctctgcctgagatgccctttcccctcttcatctttctgttccacctcaaatgtcctgtcttctgggtcatgtccttctcctgagtttcttccccaggcagcatctgagggcttgtcgattctgcatggcagcatccattctgcatggatgtagatacaatcactatgcccattttacagattaagaaactgagaccctgaatggttaagtaacttgctcaaggtcacatggtccagagcaggcagatccgctcagcctgccctactcccaccttccaccttctgcaccatagctcattgtactagttggggcagggagcagggggacagagaggggtgatggaaagacttggcatttgctgagtgaactcatttgacgagtttattcgtaggcattgaagtcaaaatttccaggagggaggtattttaaggtttgtgattgaggtttgagagagtgattagggctcaagagatttccacgttatatgcagacagaatagagctgaaatcatgagcgtaaactagctttacatggggctcatggtgagccaatggaagctgggcaccgacctcagtatgcaggtggcagccacctggccagccctcctggggacagctgggcgagggcagtctcttctcgccatgttgagagtgggcctcctgagggccagttgggagttagtgggtgtgcaggccagtataaaggagaggcaggaacaagtggagatccctgcttcaagggtggcagttgacaccttgggaggggaggagacagcccagcaagtggtggagcacgccaaagggaggagaaaaaggcggagaccaggaaggtgtgtggccagggaggtaggcaggtggtgttgacaggatcaagggaggaggggtggtgagaaggctggagtggcccactgggtcagcagtactgaatggtggtttgaaataatgatgggactgtctctcctggatttgacaacatggggctccctgaggacctgaaggagaacagaagggggcttaaattaggagattaggatcagggatatagtccagaactcaaatcccagctactcctcttattacctgtgaaatttggggcaaatcacaggggctttgtgtgcctccgtttgctcatctgaaagatgggcatgggtgataacagtgcccatatcctggggttgatttgcagagttaatgcatataaagtcacgagaacaggctcaaatgctcaatcaacagtagctattgccaggcacagtggctcacacctgtaatcccagcacagtagctataaaacaacaacaacaaaaaacaaaaaacagtagctattagtaatgaagttttgataattggccaatctgtcaatcagcagggtttgtttgtttttggttctgttttttaagacagcatcttgctgtgtgtgcccaggctcaagtgcagtggtgccatcacagctcgctgcagcctcaaccttccaggttcaacctcccaagtagctgggaccacaggcacacaccaccactcctgactaactttcaaaaatatttttgtggagatggagtctagctgtgtttctcaggctggtcttgaactcctggctcaagtgatcctcttgcctcggcctctcaaaatgctgggttataggcgtgagccactgcacccggcccagtagcaggttttaagctccgtggagacagctggcgtttgaggatgaggtaacagcccacacctgagtgtgaatggctgctgcatggttaacttccatttctttcctccataggtcttccccaggcaacaaagacaaggaggccccctgctccagagagctccagagggacttggctggtgaggaggctttcagggcccccaacacagatgctgcaaggtaactcagtgcaggaagcagacacttcattcccagaacacggagcccacatacacccagctgaaggacttccatggcctccggtgcaatgtcaatggatgcagctggggccaggaaggtcctgttcccactgttcccccagtacctggggtactgcaggtctttaatgaacatctgttgaaagaaagaaagaatgaatgaatgaggcctggagggaggtaggcccctgccatgattcctcagggagccagttagagagcaggaccaaactccagggcaggctatccccagctcctggcctgtgctgagttccttccattcccctgaagcttccacactcactgtgcttttactgcaggacaaagcagccctgccaatggccagggcaaagcaaggccaccaagctggcagtctgggagagtcagtgaccaaagtatgtgggcccccatagagcatgtagcggagactttcaggatgacccgtggactaagggagacattgtggcaaggggtgaggggtccaggacgggaagttggagccatagcggtggatgatgagtccagatgggatgattgtccccagtcgctgcacagccagcccactgacctgtcctccaagccagaccagtgccaaatgtgtctggtgagcagtggctgcaggctgggcatttcttcagtgagaacctggtagccagttacagctaagaacccacacacccgtcttctcagtgtggatccctggagcccctagctggaaccctgagccctggaaatgaggaaaggaatccctctatggcttattaccagacccacatgtcttgccccttgctctgttggcaatcagctccccccaccaccaacgaactaacctcctcctgactttccaccttgctcccaaccaacccatcaggtttggaaaaaatacagaaatacttcctgttagagtcaacttgggcttggctcagctctggtcagagcagcacagagtagcagccaaaggcctgtgcttctggtcttgaggcccactctcatggcatctgggttagatgagatcaaaacgcaactagagtcagcaaatactccacttctcataacaggtcaagtgcacagttgagtgatggcaatgtgggatccggagccacgggctcccggcctgaaggcttggctgcagtagacatcggctccgagagaggaaggtgagctgcccgggggaggcaggttctctcatgcccctggtgacagaccagggtcaagctgccaggctgcttgggctgctatgggtggggcactggtcacttcctatggctcctgtctactgcttctcccacactcccacattccaccacatcctgtgtccttgggctttccactttttggaatcttgttcatttttctgatccctgccactggccctcaagctcctccagagtaggcactaggcccactcacagctggaggcccagccctcacatggtgctggtcttgggctggtcaaatgaacgtgtagggaatacatgaagggacaaattaatgagtgaatgactgaatgatggaagagtcggcaccttcttacttcttggttaagctctgaggaccagctaggaggccctttgctcctgctttctcccttctctccttttcctgccccatccctaccccaggcagctctgctctgaggttcagggagaggaaaagcggtagccctggagagaccagcgtgtccagctgggctctggcttcttggacctggagggagtcaggggccactttctcaggtgatttgcagagtggcaaggtccctcttgtccctaagtggttccaaaccaagcctgaatcattcttggggcaaaggctaggtatgcagatgttggcataaatagtttagctccaaactatgctagagtccttctggttcagagcagatggctagggaggagtggcaaagccagtgtctgcaaagagctacaaccgcaagatatcatctgcctcctgcatcctactgcagtctggccaaggagggaatcctgtggggaaggccctgctgatgctttcctacttccctcagcacacccagggcccctttccctcactaacttcaatagtttgcaattcatgccatggaaccagagcccgaattctaaatccaggcccacaagtcaacacaggaaggggacagcaggtcctggcctctgaaaccactgtctccgagcaggtccaaggagaggccaccagagactctgttctttaagctgccactaatggggaggactccgctagagccctgtccatgcagcctgcatctttttgccatctgcagaggcattggagggatctttttaaaaataagctagatcacatttctcccctgctaaaaccttctagtggctctccattttccttagaatgaagtccaaaccctttcccatggcccactgggtcctgcatggcagaatctttggccttctatccagtcggggctcctgctactctccccacagtggtgcagcttgactggctctgctgatggctgtcgcggaagagacttctggtctactgtgattgggtggctctggtctcctccatgtcaccccgcctgcttatacaccctcataacatgaagcctgtgctgtccactgtttccttaaaatgaaaccaagcctcaaagttacttgtaaagtcatctgaagaatcttctagattttcatgaattttaacccagtcttttacagttgtcttacctatatagtagtccctaggtatctgtgggggattggttccagaacctcactcatataccaaaatccatgcatgttgaagtccctgatataaaatggtgtagcatttgcatgtaacctatgcacatcctcctgtaccctttaaagcatctctagattattataatacctcatacaatgtaagtggtatgtaaatagttgttatactgtattgtttagggaatgatgacagaaaaaagcctgtacatggtcagtacagatgcagccatcctattttaattatttttcccacatctcatctcatcctctcctctcctctcctctcctttttcagacaggaccttgctctgtcaccagggctggagtgcagtgctgtgatcacagctcacagcagcctcaacctctggggctcaagggatcctcccacatcagcctcccaagtagctgggactacaggcgtggaccaccacgcctggctaacttttgtatttttggtagagacgaggttttaccaggttgcccaggctggtttggaactcctgggctcaagcagtccaccgacctcagcctcccaaagtgctgggattacaggcatgagccactgtacctggtcccaaatattttcaatctgaagttggttgaatccacagatgtggaacccacaacatagagggctgaccacacttagtttgactataattttcaacaaactcctttattgtttttcctttttttttttttttgagacggactcttgctctgtcccccaggctggagtgcactggtgcgatctcggctcactgcaagctccgcctcctgagttcatgccattgtcctgcctcagcctcccaagtagctgggactacaggcgcccgccaccacgcccggctaattttttgtattttttagtagagacggggtttcaccgtgttagccaggatggtctcgatctcctgaactcgtgatccacccgcctcagcctcccaaagtgctgggattacaggcgtgagccatcgcgtcctgccttgtttttccaaaggaaaggttgtttctcatggcaacaaccactctccttttccattcattttcatggatttacttaatcatcgaacttagtgattcttctccattagtggcagctcaaagaactgagttgctgccccaggggcctttccttggatctgctcagagacattggtttcagaggccagggtctgctgtccccttcttgtgcaaatacaactggcataaagaggtctgggaccaaacaagagcacctcttagtgagtgtgctggttagtggagggcacaggcttgtataggcagtgattgttcagcatgccgtgagcatcagtctgcctggtttacagagacacagagaatgtgactccaccctgagaaggttgggtaagacattccccactaaatccatattgagtgggtgaatacaggtggactgggaaggtgcactgcttctataaacagccactgggccctgtggtaacaggaacacattagcacatgttatggcccaggcattattcaaagtacttggcatctatgaactcatttacttttctcagaatacttacgagacagacatgattagcatccctatttcattgatggtaaaactgaggcccagaaaaaaaggtcaggtaacatgcccaatgtcacacagctgggagatagcaaagccatgatttgcaacgccagagggcaaccactatgccacagagccccaggtgtcaggctgccttgagatataaatattgttcctcaagcatccatttgagcagcttcttggtcctcatcatctgtggggggcaggatccactttctcgggagagggtagacatacagacacaaagtcctgaacctggaccaggtctggccttctttcacaggctgtgtgcagctgctagctttgcctctttcctggaagaccaggatgggcacagtgccaactctcagtcctgcaagcctagaccagcagccatcaggtaaggttagggccactgccctagtgccctatcccattgccagacacagcctttggggcccagcctcagctgcagcaccccaggatccccctcgaacttctcagctccatgccactttcacatcaggtgatcacagcaagacagggaactccagggggagctctgaccaggggcagtggaagaagagggatgggtgatatgtctgctcacccagagagcccagcaccaacctacatggacccaagctgaggtggcagagaggagggcatctgaaggcagagcctgggaagagatcctgctaggaggtctcagagaacctctgctgtagggactacagccaggtttagcaagcaggagtcagggagaagattcccaggggcagccagcattagagggctcagttcccaggagcacaggaccggtggctgggatgggcaaaaatggctcctggggcacaaaggtacaatgggaagaagctgtgcattcccatgctgtaagcgtctgccctgtttcacccaccaatccaccagtgggcatggccactttgctgtgggtgtgtggagcatttggcaagtcctagtaaggaacgatctttcttaactcccataaaccctacagaggtgtaggtcaggtaaggatacgtcatgctcagggtcaggttccagccgcagctgagggctaaggggaatgggtggacgtggggcagggagctggaagaacactcgagagatagcaggtaaatgagacatggctttactcagcagcagctctcttacacagctttctcaaactagctttctcattagcagcttactctcacaccgtctgccctgtcttggctgcttagtccggtggcccctacgcacagctgcgtggccagctctcccttgccttcagggtcagcagcttaattctttctctccctgggcacgggcaagccaagctgtgtcctggctcccctctgtcctggctcccctctgtccacctgcaaagacagacagctcttgctctctctctttctctaggttcccgtgcacccgccatgtcaagctatgttgagctgagccaagccccaagagacatgtcccccatacacagcgtcaacagggcagttataccttttacagacaatagtggtttagagccaagtatgaacttacataaacaggttatataagaagtggaggtgtgcacctgtgcaccagactcattgagtcatgcaggcctggatatccccctctgcctattccttgaacaaagcacatccaggtaccttacaggatactagaacccaaaaccaggagacttccccagggaacccaagttggtcaggggcagtgtttgctcttgaactcaggtgctaaggccatgtccaaagctgacatgaggttgtcacacacagtggcatcggtgccacactaatgccaggactgagacaccagcctttactggaagacacagttcctccctttctggtgagaaggcagcctggagggggaagacctgggccccagccttctttggtctgagatctcagcaggcctgtgtttccttcctcagctccagtgccacttcagtctctgctgtccctgctgataggaagagcaacagcacagcagcccaggaggatgcaaaggcagacccaaaggggtaaggcatgagcagacagtgctgaacttctggggtggagagaggcagcttgggctgtgtgtccattggcctttggctgggaaggtgaggccagcaaggtttgtgagctggcctgaggcacatagcaagggcagaagccccaaccagaaccctctggcttctggggccagggagctttccactaaactgttgccttggccaggaaatacatcatagtcagaaagggtctttcagtcagcaaccactctgacagcaactgccttttgctggaggctggagcatgcagacaaatcagaaacacctctgccctccaggaactctcaggcagggggtgggcaaaggctggtccagattagagcaatacatgagcgctagagcaggggaagggggcttcatggggactgtatgtagctggatgtggtcagcgatgagtgtccttgttggggagtgctggaagaggaggctcagtgaactaggtagggcttgattggcctcttgtactgtgatattggagtccactgtgtgcacagccctctactcacagtgtctcatacggttctcctcacagtctctcaaaggtttatgcctaattacaacaaaacccaaaagcctggagcctaggtctctgtgcctcctgggaaggatagtgctccgaagaaaacagccgcagctgagatagagtgatggcagtgaggagggtactacttaggtgggtggaaaaggcaactcaggcgatctcctctaaagaggagaaggagccaactctagaaagaacacggtggagagagctatagataaggaaccacaaaccaactaaccctgaggtgggaacatgcttagcatgttccaaaggacagagtggctggagcttggccagtgaggagggccacagatggagcagggccttggtaagccatggttaagagattggatcttatttcaagttttaagccaaaggggagtctcatgtgatttaggtgtttaaaaggtgaatgcatgtttgcattttcataccacattgctgttgcttttttacttaaaccaagatgctgggggctggggtgggcaatggatatctaaggtatgaggccttattgtgtttcttttctcattcgaattgcactgacaattaacaatcagagtgaaaacaacagctgacaccaatactgtgctgtgctaggtgccttacagccttcccagcaacttgtgagatgggtaaggtgggaaactgaagcatagaaagattaagtgacttagccaaggccttacaagtggcagaactgagttccaagggaagaggctctaagaaaatcctcaggagaaactacgaaaaactagtttatgaaatcttgtctttggagcctagtctcaagacccagaatcagtaacttacagctggttaacatggttaacatgctgtgtgatctcaccttaattttccccaaacgtggaaaaggataaggcttcttattatgcaacttgacagaggagaaaattgagggactcactcctgtaatgaacacacttaggaacagagcccagatccagccaactctagagccaggctcacgctactttcctctgatgtttaaacgtctgcaaaatcagaggtgttttttttttttttttttttttttgagacagagttttgctttgtcgccccagctggggtgcagtggcgcaatctcgactcactgcaacctctgcctcctgggttcaaacgattctcctgcctcagcctcctaagtagctgggattacaggcacatgccaccacgcccagctaatttttatatttttactagggatagggtttcactgtgttggccaggctggtctcaaactcctgacatcaagccatccacccatcttggcctcccaaattgctgggattacaggcgtgagccactgtgcctggccaatacaaactttcttgattacagtgtttcacaactctggctgtacttgagaatcacctaggaagtactgaaatacactgttgatgaaaaaggccatactctgtaaaatatttgaagaaattctgagccaaatgttaggactatgacccgtgacacagcctcaggaggtcctgagagcatgtgcccagggtggttcacttacagcttggttttttatgttctagggagacataagacatcaatcaatacatgtgaggtatacattagttaggtccagaaaggcctaggtatacattagttaggtccagaaaggccggacacctcaaagctgggagtgtggtgggggtgggggtgggggtggggttccaggtcataggtggattcagagattttctgattggcaattggttgaaagagttgttattctctaaagacctggaatcaatagaaaggagtgcctgggttaagataaggggttgtggagaccagagttcttatataggtgaagtctcataagtggccgcccttagaagcaatagatggccaatgtttcttattcagacctttaaaaggtgctagactctcagatcagaaaaagtcctggaaagggaaggagattctctacagaatgtaaatttcccccaggagagacagctttgccaggtcatttcaaaatatgtcaaaaaatatattttggtgtaaaatacttcaatttctttcattacctgctgtctgtcatgtgatgctatactagagtcaggttggaatttggcatattattgcttcaaggagtctgttttgtcagtctgaatatctctctcaatgttaatactggtcagttgggcatgaattccaaagggaggagaatatattgaggcatgtctgaccttcccctttctcatcatgacctgaactagtttttcacgttgtgtccccttggctgagagaagtgtccattcattcagctggggagcttagaattttatttttggtttacaacacaacaaaaacttcccgaagtcccaggtagagatttggattttatttttctggggtgggtctccatcatgtgtctttttcaaagctccccagtttgttctccttccaggctaggtcgagaaccatcgttctcaggtagtggttctgacccaggggcatctcccaaagcttccagcctgctacgatacaatgtctggagccatttttggttgtcaaaactgggagtgggagacactactggcttcttatatgcagagatctgggatgctgccccacatcccccaacacacaccatagaattatggggttcaaaatggtaatagtgctaaggttgacaaaccttgctgtagagccttgacgatctatttgggaagacagcagggacggaaaagaaaaagggatggcacagaaccacacccctcaccttccccgaaatctgggtagcgggcacaggacgtgtgcgcctgcgcgaatgcgcgctcgccaccagcgtacgcgacgcgtgcgcgcctgtgcacctcggcgagcacgcgcccgtagtgagtacgcctgcgtaggccgccatttcttgaagccccgaactcggtcgcagtgcccgccgggaaaatgcgaccgtccacaaagtgaaatggccgcccgggacgagctcggcctcggcggggattctcttgaggccatgcccgtgccggccgccagaggtcgcccgaggatcacgaatgggcccgaggagctggctgccccttcccccgcgtaaggtctgaagccgcggccagagtggctttggggtgaccgcgcgtggaccgtcgccggcgggaggaagcgcggtcccgcgaggggccgaacggggcccctgcggcttgagcttgtttcgcagggagccctggggccatggcctctgggacactggacacgggtcgtcagggctgcccagggggagggggtgtggacgtgcagacagggaaggcagctggaccctccaaccacgctgggccctcgggctgaccggggctggtctgtggggcagtgaggaggggcttcgttccctaggagtttgatgagggagcgccatgggggtggcgtcatcctgacatcccgcagggcagtggagccttactttccctaggttacaacacagttttaactgtcccaaactgtggggactccgccctattccatcttgggccgctccatcacactacagggagaggcggtatagtatagtggttgagagcctggactctggtgctttgggttccagtccaagctctgtcacttacaagcaccgtgaccttgggcatgttactcatcttctctgtgcctcaggttcctcacgtgcggaatagtggtaatcatacctcctaccatatagggttgttgaaatggccaaatcggtttgtatatgtaaagcctgtaggacatttaaacctgcgagctaagtgaagcagcaccagaggaatatctcctcctctcagaggtgttcagggacacctggaaagctaacttaaccagctttattggtttgatttcatttgacatgacacgatatctcatcttcttcctactaaacttttgtcatcaaattttccatctagaacatgctgttttcctcattatgttgcaagcatgggcttctcgtttatattttttctgcatgaggatcaggtgaagtttaggcaccacatttcctcaccactggcaaccgttgttggccagtggaggcagtacaagggtggaagtgtcagctgggtgcagtggctcatacccacctgtaatcctatactttgagaggccgaggcgggaagaccacttgagttccggggattgagatcagcgtgggcaacgtagtgagacctcatctctacaaatattatctatatctatatatgtatatgtatatgtatatcatatatatgatgtatatctcatatatatatgtttttgaaacaatgtttcacttctgtcgccccagactggagtgcaatggggtgatctcggcttactgcaacctctacctcctgggctcaagtgattctcctgccttaacctcccaagtagctgggactacaggcacacaccactgcacctggcttatttttgtagagaggagtttttgccatgttgcgcaggctggtctcaaactcctgacctcaactgatccacccacttctgcctgccaaagtactgaaattacaggcgtgaaccactacgccgggactacaatttccgttttttaaaagaatggaagtgtgtagattatggttgtgttaggagttgacagtggctgtattaggctactggatctttggtccaattacactcagaaggaaaggcttcagagaaattaatccaaaatccaaaatcccgttggtcaccatcccctatgttaccttgcctatctctaaccacttgacttccaggaagttcatgaggagctcggacaggatagctgggaagtaattcccctggatgttacattgtccagcagagcttcctgtgagtgtttgcctaagatttcctttttatgacccacataggtcatatgtcctaaaatcacagtggccctgccacaggcctaggaaagaagaagccttgttcatccatttgtccctgtgtcacaatagagcccaaatttctctttgtggataatcctggctctatccacagacttggtgagggcaacctctactagtgtatttctacagaggacgtgggacaggacgggactctgattaaatccatagtaaagctaactcagggctaccacagtagggagacaagctcttcaggccttgtatgtttgtctttggctcaagcaagcatgtcactgacagagattgaatgggtgtgtcagggcaccctgctggcaaccctgggactggtgttacctgtgcagaccacttttggatctgcatgggctgcagcagaccctaagggtggaagcagcacagagaagcacaggcccagtgggatggttccccacagttactgtgtggcgtcacactcacttgcctgcagttctgcctggtgcagctggaggtggcaattagcttgttgtgcctgctggagaattttagttcccttgacctccacctgaggctgaagaatcatgttgctttcagggcatactttccaaaaagtgtggcctctgttggccttgttattccagcttgaaggcaggaagcctgcctagacaaagttaactcctatatacaaagagtcccagggtagtttgtagcgtgttcttgtctcggggtagcccccaccagctattgaaggtaggctggtgatgttgggaaggttatattcagagtgagctaggatcgaggtgatggcgaagtagattttcattctgaaatgctgggctcactctcttagtagcccaacttggtgtttgcccctggcctagtagactctggaagcagtaccttgcacctcggtgtggggctggtgatgggaggggtgtggaagtggaggatcagctagcagcctctttcccacggtacccagattggagggtgcagtgcaatcatggggtgaggccagggaggacccctgaagagctcgatgcctgagacatctgggggaagccctgtccttcttgctggattcaggggtggcaaaagccaaaaattggagggccaggtgcaatggcacatgcctgtaatccctgcactttgggaggccaaggcaggaggatcgcttgagaccagcctgggcaacatggtgaaaccttgtctctacagaaaaaaaaaaaaatacaaaaattagctgggcgtggtagtgtagacctgtagtctctgctactcagaaggctgagacaggaggatggcttgagcccaggaggcagaggttgcagtgagccgagatgatgccactgcactccagcctgggcgacagagtgagaccctgcctccaaacaacaacaataaaaacatcggaggcttcggcttcatctattacacatggaggcctgttcagtgagaagggagcagcgatgctgggctcctgccaaggaggagactgtctgctccctggaattggggctgtgcctggctcctttctgccccgctttcagggatatgagtccctccaagtccacaggaggtgacagccagcttgcgtcctggggctgaggcagggttagtttcagagcacttttttcataagggtgcttattcttcttcagggccttggctgattatgaggggaaggatgtggccaccagggtcggagaggcctggcaggagaggcctggagctccaagaggtggccaaggagacccagctgtacccgctcagcaacctgcagatcccagcaccccagagcggcagagcagccccagcggatctgagcaacttgtcagacgagagagttgtggcagcaggtaagggctgagctgcagtgggctctgcctctggagcccatgtttttgttgaggtctgcgacccacatgggaaccacttccccacaccctgtgccaatacccgacacattgcacacccaggctcctgttctgtgagtgggtcatggtgattccctggtcctagagcagtgtcatcaggcttcttgtggctcaaggagctgggaggggactgtgataggaggatgtgtctgtccccaggtgtgagaagccctggctaattcccaatgcatggggcaggaaggaaggctgtctctcagagtacaggtgctctacaggtgggggtcctgggcagagtgagggctatttgtgtgggtaaaatgccattgtcagagaaggacagagtgtgaaagagcaaaaaaacaggagggtaaaagtgcaaaagtgacagagtgaagcagagagagagaggccagagggagagaaagggagcatgtgtgagcaggcatgagagagtgacacaggatgtgactggccatgtgttggtgtgtgccactgtgcatgagcaagaggacaaacgtgcctgttactggagctgaccatgtggcattggtgtgagagtttcaagtcaggctctcttgaaggcatcttgcctgccagcgcaaacactgcatgtccttgcagctctggacacgtcaacaggccagtgattccaggggtgcaaagcgaacagtttcttacacaagacagaaatgtagaaggagagagctaagactcatattgccccgagagaggagctagtggaatccagcagggcatctgctgtggggagcaggtggagcctggggttccttttgcagggatgaaagaaacacagtcatctgccttctttgttctggggcttcttgtaccacagaggttccataattattaatagttaggttatttttagggcctagctcaactgttagataacaagttttaccttctaagaatatctagcccatctttgattccttggctccaggccctggagggtcccagtccaaaaacagagtgaacaactttggacttgctgtcacattgtgtggcttctagaactagtcagtgttccatgcagaaggggtataaaaagtgaggcttgtggatgaaggaggaggcgagtggttctgggttttgttttcgttttgcgggggagtgtcaggaaaggctttctttacagggagagtgatgttggagctgggtttggaaggctgagggagattttgccagatgtgccagacgtgcttgggaaggcattccgagtggaggctcacaaagtgtatagggaacatccagtcaggtagccatcacaaaggagggttaatccagcctggcttggcaggaagcaccaagtaggggctgggcaggcacctgctcctaggctgaggagtgtgacccacatcctgagggccttgggagccaccgatggttttcctgcaggagagtgccacagccagactcgagtccaaagaagatccctccattgccctgtggaggaccaggccaggggagtatacgacgagacaaggcaggaggccatattggagactgtttgcttacaccaggggcaaggtgatgaggctgcaagtatttttgaattattaaaggtaaaagcgggcttggcgtggtggctcacacctgtcatcccagcactttgggaggccgaggtggcagtatcgcttgagcccaggagtttgagactagcctggggaacacagcaagaccccatttctacaaaaaatttaaaaacattagccaggtgtggtggcacatgcctgtagtaccagctacttgggaggctgaggtgggaggattgtttgagccttgcacgtcgaggatacagggagccatgttcctgccactgtactccagcctgggtaacaaaacaagatcctgtctccaaaataaaaataaaaaaaataaagataacggtgagggaaaagtggtagccaaggttgctccccagatttcagggctaggcaattggatgggtggtgacaggaactagctgagggtaaggagtttgggggcaggcccgctgagagatgcacagagatgagaaggtcactgggccatgccgaatgagaagtgcctgtaggggctccagccagtgatgtccagtaggctactgagtaaacaaatgtggagttgagcaaagatctgacctggggctagagagctgggagttgtcagctcataggaagtcactaaagagaatgcatgaggttgcctggagaatgcctttggaaggcagtgtgtacaaagcatgtattctcggcttttctctgcagacttccagggacagttgtccagccaggcccttggctgggtgggtgagtccacgtggttcagggatgctgagggaagctgcttcatcagctgacatttctctccattttctgctcttcttttgtctcaaaaagaaaaaaagaggggatattaattattgatcccctaaaaccctagctgaatatataaaatgaaaagaagtaaaaatatgagagaagcaaaggcagatggaccataattttggaaaataattccaaaaggtcttaaggaggaagaggagctacagagaggtattgagaaggaaaattttggataaatggaagaatcaggaaagactaccgtcatggaaaccaagccacgctgagctaactttccagtgctctgtagatgctgaaataggcccatcagatttggctatgtagaactcatgactgccttgaggggagtaggttggggcagtgggaaaggctgtagttggattataatggattgaggagggagcggaggataagcaggtgcagttgatggggtacacactctgaaactggctgtgacgtgatggatgtgggaggggtgagcagataattacagctacaagataatggggaaggtttcctataggtgaaagcaacgtgtgcatgttaggtaaaggctgggcagagggtgcctacgtgaccagtccccgataaaatccttggactctgagtctctcatgaattgccctggtcgacagcatttcacacttgttgtcacaactcactgctgaggggaactgagtgaatcctgtgtgacccactgggagaggactctggaagcttgtgcccgggttccctcagaaatttgccttgtgtgcttttccctttgctgattttgcttcgtatcttttcactataataaaccatagccttgagtgtgatgatgtgatgtgtcctgtgagttcttcttgtgaatcaccaagcctagggatggtcttggggacccctgacacagatgggcaggatcagaactttatgccataacaaggactttagattttctttcgagggcaaagaggagccaggaaggtttgaagcaggggagtgatatggcgagagtattgctttgcaatgggatctccagtggcagtgagaagagtgactgaagtgggcagagtggagcagggagaagaggaagtgcttacagcatcctccatgtaagaaatgatggggcctggactaggggactagctgtggagatggagacagaactgtaaaataagtagaagagatcccaaattggatgacaggtaagacttgggagagcagtgacggagagggaagtgacaatttagaaagccacatttctggtcgagtgagtggagtatgtgacccctcctggcttaggtggtggccaaagtatctctaacctgcctctatactgcctgcaactgactgagcaaatgcctggtccgtggagatcccaagctgacaagggcacctgaggcaagcctctggctttcaggtggaggccctacctaggctggcctggctggattgccctggcacactgctgttttgctgaggcagacagcagcactctgcaagtgctcttctcctgttcctcttagtggtctaaatcctgtagcatgctggggtgcgactgtagacaaatcccctttccgggccccctggggttctctatttgcagtctttgggtctggtcactggcatggcatctcagtaggctaggttcatcaggaagggtcaactatgtcatggcacctgatgggcagcatttagagtctgtgggccaggggcttaagggctgcttactgctaatagttctaagtagcaagcattccctcagccctagtctgggcacacgccaggaagaaagccactagatgtgctctcctagtggataactagcctggagttccaagaagggcagagacaggcagagtgagagccttcagagatgtaggcaacgatagtagcagaacttcgagggagagtagatggaaaaattaaaaaaaatccttgtcattatttttaaatgtctgaattgaccagattagaatctttgagagtctagacactagggagatctcatgggtgggccagttattatatcatatggagggagagtacgtatgacccagcacgagaggaccagaggacagtcagtgctaagggtaaaaccttaggccatgggagattgagtttttcatcagttggcaagttttcactttaatactccactgtttccatcatttcagacgactggggatgataaggacaatgtaatttgggggataaaggaagaactcattatatttcttggatgactttactggggaaatggattccttagtcatttgaaagaagcggtagaattccacatgtggggaatacttgttctaacaaaagcttaataacattagtggcaatgatccttttatataagggaaagcttcaagccagtgagaaaaacataaataaactagtaagaacatatttataaccatgagatttgggtgcagaataaaatcaaattggcagttcaggaaaggtcctaaacatctgtatattaacaatattccatcagtgagcaatgtgaatttcccataattgaaatgatgattgataaccttgtattgttcttatctaatataaggcaaagcagcactggggctttgataaagagcaatatctcatgtacactgaggacactgaaaccccgctaggaattctatggaatttctaaaatatttatattaaggacattttacccattatagactaatttagggaaggttctgcattttttttttgatttgacaatgtttccaatgcaatttatacaatattaaataagactaattagtttttgcacctttcttgttacaaggtgaaagaactaatcctttgagattttccagaaggtccctggcaaatcccaaagccagttttaggtataaaatatatttaagttttgattgtgggaaggcaaatgttaagagttgtcaggagttctcgaacatttgattgaatagcattatgggttagcgagaaatactacttggttagctagtgaatcagagttgtaaaaattttcaagtaaacatatgaggtaacatggttgtaaagaatcttcagttcctttaaaattgaaaagactttaaaaaaataactaaggacataataaactgaacatacagatagggcattacagtattttgataagacataaaatctttgcctcttaggcagatgactcagaagaaaaacagaccatttataactttttattagggacagaccaatgatcaagaattttttttttttttttttgagatggagtcttgctctgttgcccaggctggagtgcagtcgcgcgatcaccatgttggccaggctggtctcgaactcctgacctcaggtgaactgcccacctcagcctcccaaagtgctgggattacaggcgtgagccactgcacctagcctaagaaaattttgttattttaacagagaaaccaacattttaattttatacaagtataatatttgatattagttcttttttgaaaatcttataaatacactgaataaaagttttaaccatgacaaataaaattccttttctgtgaacattttctaattttaaagatatttgtttacattttgtctcacacatttttaaattatttgtcattttaatttgggacaaagctattctctttttccttaggaaaagcatatttgcatacaaagttgtttccctttgccatttttgccattattacttttagcagtttatatatatatatacacacacacttatttacttattataattttaaccattaataacttctctttcacagagaaaacaggaggtaggtaattttgaaatatcatataccagcattttgtagcagactagtaaagcttatgaatatacatctcataactttttatagttgttatatactttttatagtaccattttgcaatgtggacaaatgaacacatttaacagatccatatgtagtcacactgtaccataaaaaaagcaaaaagtatataaacttaaatttaggtctagtgactaagtattttatcttctttataaatgatatttaatgaatttagttaacttaattcagcataagtctaaggttttaagttaccaaaaagattttagaaactgcctttaagcttacatattataaaacataattactgttgaaataaagtttgccagaataatgactcagtttggttaaaagcaaatttaaatttttataatcttaaacatgtagtagatataatactagcttattcaacatgtaaacctgtttaagtttaggaggaacatacccaagtagagtaaaaatatatgcttgtattctgttgtattatatgtaatgctgataactcaaagacacataggtgtctattaaactaacaatattaaactagttttgtttgccaaaagtttacataaattctgtgaacttgagttttaaaagcatttgggttagtttttataagaatacttttttgttgtttacactgaaagtattagaagttgtttccttaatttatgagagctttataataatttatataagtacttatttatctctaagtcaattagaatagaggataagggattttgtaaattaatttggtaatgccatctggaggtactgaactattacacatatacaacatacatgtatactaaacatacagacagacacaaatagagatctaatggcgagccctcaatgggtgcagggggcctgaagctctactggctataggcagttgagagggctgagtgggaaggggaaagcctggtgaagagtagataggggtatgtaggaggtagaggcattgaaggggacagatgaaaagattcagggagctgaagggaaggtccaaggtggtgaaaagaagggaagagggatgcggtaggaagatgagaagggggaatcttagatgagcaggtttggggagaccccaggttccctaataaggtcactgaagttccaaattacccttcgtgattactttttttttttttttttgccagttttggaaatactggacagaatgagtgccataggggcagggcatgtagtcagcaagggaggaggaggaggatgaggaggaggaagggcacccagtagattgagagttacctgtgggaagaggcagatcaaatagagaaaggagccaggctggacagtctcattaggaagttctgcacacagtcgtcatctgggagccaaagtttctcttcagtcctcattgaggagctgaagggctttccttgtgcaatctctagacaaggtgtcaagggaaacaatgaggcctcacaaaagagccaggaatttggagtaaatctccactcaaaaggaaccaagaaaacttctatccaggacgattctggctaaaattgaaaaggaccaggaagagtcctgctcaacagagtcaggggttaaatccccactcaaaaagagctaggaagagttctgtctgcgaagattcttgctcaaacagaaaagaactgggaagagctcatttaacagaatcaaagtaactgaatcacagaaccataaaaagtgtccaataaaagcaaataccgtctctgggcagggtgcaatggctcacacctgtaatcccagcacttgagaagctgagggaggaagatcacttgagcccaagggttcgagaccagcctgggtaacatagcgagactcctatatctataaaaattttaaaaattagccaggcatggtggtgtgtgcctatagtcccagctacctgggaggctgaagtagtggaggattgcttgagcccaggagttgaggctgcagtgaactattattgcaccactgcactccagcttgggtgacagagcgagaccctgtctcaaaaacaaaaaacaaatatggatttagatagagacttttattttattttattttattatttttgagacagagcctttctctgtcacccaggctggagtgtaggtgccatctcagctcactgcaaccaccacctcccgggtttaagcaattctcccgcctcagccttctgagtagctggaattacaggcgtgcgccaccatgcccagctaatttttcaatttttaatagagatggggtttcgccatgctggccaggctggtcttgaactcctgaccccaagtgattcacccgccttggcctctcaaagtgctgggattacaggtgtgagccaccgtgcccgaccaatactttatttaaaaagactattgcaatagggacaatgctgcaacctcaggacttgcaaacatcacaaaataatacaaaaaacatcacaaaataataaaaaaaaaaaagcctttttttttcagtagggagtagtaagcacagctagcagctcagctactttcaagggccagtgggcaagcaaaggggaacctgtttggcatgatttgaccagaaatgtgtttccctgtggtcagccggttctcaggagaagctgctaagtggggcatgttctgcattgcagcacttacttaaccaggagcaagcaaaattcaggccctgtggggaggacagaagcctgcctaacattctgtcaaggcaaaggagagggtaaaaagcagacagctgtgaacacttgatcatccttcaggcaataatccattctgggtttctggcttaagactcttgagaaacaaggggaaacaactggtaggagcagcaggctcacctatatgtagttccgtgaggtagccttatggacttctgccaccttccaaaactcagcatgtcccaaaccatctttatcaacacagcttctcaccaaaaacaaccaaataaaacaaattaactaatgtactaattctgtatctccccctgtgttgttcatctcaaaaaactgttatcacctcattgactcagactctcaaccagcgaggtagaagaaatgtttgggggcatgttaaatgtaacacctatgagacatgtaagaggtgaggtgcaggacgcaggtacatggtgataaaagaaaaacctcagccggattaaatttaaaggagtttcattgagcaatgaactatttgtgaatcgggcagcccccagaatcacagcagattcacagagactccagtgcagctacatggtggaagatttatagattaaaaaaaaggtggagggggggaaatgacgtacagaaattggaagtgaggtacagaacggctggattggttacaggttgggggtatgccttatttgaacacagtttgaacactcaccagtgtatgaatggttgaagtatggccgctgggattggccaagagttagctattgttacaggtacacactcctaagttaggttttcaattttgtctgcctctaggttacagtttattgacaaagactcaaatatagaactatggagtccttctcaggccgtatttaatttgctttaacaattccccctttttggtcattttctcaactttgagagattgacaaaaaccttagttattgatatcactattacccttgtaaatgtacttatatggtcttgaaacccactgggaaacaggaggacagtgggttttgtaaggagagaataaggactgagtagaaggtacctctttatgctagaatgttctgtttacaggacaaaaacaaaacctggtctgttttaataactatttgtttccttaaagtcttagtttgattatgttacatttagcatgagcaactccattttgtttggtttggtctgttgggtcctagtgcatgagctcagtacacaacaatggcttgccagaattttgtttaaaaaattccccttggctgggcgtggtggctcatgcctgtaatcccagcacttagggaggctgaggcgggcagatcacgagctcaggagatcgagaccatcatggccaacatggtgaaaccctgtctctactaaaaatacaaaaattagccgggcgcggtggcatgcgcctgtaatcccagctactcgggaggctgaggcaagagaatcacttgaacctggcagtcagaggttgcagtgagccaagatcacgccactgcactccagcctggtgacagagcgagactccacctaaaaaaaaaaaaaaaaaatatttccccttattggccaggttctcacttaggtgagagtgtgaccaaaacttagggccttagcaccacttttagttacctagttaccatcattttaggtttccagtctcagcatgtcattcataggttatgatgtcctcataatcatacatttcaatcagttttgttattccagttgaagagagaccatttgacatttcagagatggctgcatgcaaacatttgaaacctttgagagaatacagtgcactggggagactactatgactaccagtaggataatacccagagtttgaagtatgctgtttacctgaggtccccataaaacaaactgcctaaattaaataaaataaagaatgagctagacgaagagtctactcacttcactaagtgatcttttcattaatcctgtatgactgaatttttataatctgcacttgatatacatattagaattttagaaaccccatataattttggaatatatattaatataattcactaaaaatataccctgaagattaaacattatttttattggccaagcgcggtggcttacacctgtaatcccagcactctcggaggccgaggcaggcggataacctgaggtcaggagttcaagagcagcctggccaacatggtgaaaccctgtctccactaaaaatagaaaaattagccaggcatggtggcatgcacctgtaatcccagctactcgggaggctaagactggagaatcgcctgaacccaggaggtggaggttgcagtgagcagagatcatgccattgcactccagcctgggcaacgagggcaaaactcagtctcaaaacaaaacaaaacagtatttttattttgacaatgcctcccatgatttttataccaaataagccaaatgtcactgttgcattagtgcattatcgatgtcaaacccaattcttaaataaaaccttatagacaaatgtattcaatcttaatcagtttgaacataaggtaagaattttataaaccttttataaccctttacaatttttgttgaagagcagattagtgctctaagaaaacctgttgtgcttttatgtccatgttcaatttatggaaaaacctaataatacccttttaaatttagtattatcatacataaaattttttacaaggttaattttttttttttttttgagacggagtcttgttctgtcgcctaggctgacagtggcatgatctcggctcactgcaacctctgtctccccagttcaagcagttctcctgcctcagcctctggagcagctgggactacaggcgtgtgccaccatgtctggctatttttttttttttgtatgttagtagagagggggtttcatcatgttggccaggctggtctcgaactcccaggtgctcaaaggaaaatttaagacagtccatggaggagaaaggtatagacaaggtcatgcagatattaaaccagaaaggacttatttcctaagccaggaatcgaacccagactgccactgtgaaagggcaaaaccttaactactgagcccagaaggagtctagagtagttaattttgagcttgcaaaggcttttaactagtcaagataatttttagaactaactatgatatgaaccctaaaattcctgttccctggaaggtagagacaaggagaaagtactgccacatggttacaaggtcaagctcccaaggacataaaacaggatggcgaccttgtccagttttttgttggtttcagggacctgcagcaaagtttgtcactgaccagcttgctgggccatcttgagcagcaagcttatgggggcccaagcccatgttttatcctaaggtacccctcgacacagaaaaacgactttatagcacaaaatataccagattgactacagcttaagactagacagcctcagaattcctttttgcattaattaaaattttacagaggagataaacagtgattttacaatcagtttgcacagagagagagaagcctgaaatctgactgggaagagatatttacccttttgctggcatgccaggcttctgggctccctttccctgagtggccctggtgatctggctctctgcaccattgccccgggagccaagccacaacacaaaagaatttttttttaaaatgcacttcagtgtgttgttgttcatttggaatgttccactgtaagttatctttcgtaagatgtcaccatttctgtaagaatttgctgcctcccgggcgtaatgtgtaacccagaaggaactcagttttccagaagcaattaataggttccatggaatgttgatggtaagaaaggaaggaaaaggtgacaagagtgagcgtagacagctctttctaaggagtttggctgctggaaggggaagagaagcagctggggttaggtgggaggaactaagtttagagacgctaaaagtgtatgtagcaggagtcacctgatcaggttgaactgcagcaggaacaaggaagttccattttgactactattagttgcaaattggacccttatgtcaactttttcatctgtaaaaaaaaagggatggccaggcacggtggctcacgcctgtaatcccagcagtttgagaggccgaggcgggcggattgcctgagttcaggagttcacaaccagcctggccaacaaggtgaagccccgtctctactaaaatacaaagaattagccacgcgtggcagcgggcgcctgtagtcccagaatctctggaacccgggaggcggaggttgcagtgagtcgagatcacaccactgcactccagcctgggcgacagaccgaaactccgtctcaaaaaaaaaaaaaggggggcaggggatgaaaatgctattgctttccaggaatagctatgactacttccaataaagaagacaagaaggttccacatgtgaaaactacgcggtcacaacgataagtgggcgggtgcacgcacgcgcgctgagatcgtgcgtgcacaggccggggtgcggccggcgtgagtacgcctgcgcgtgccgccatttcctgcagccgcagactctgcctgcggtgctcgccgggaaatgagacgatcaacaaagaaaatggttgttttgggcgagatcgaccgtggagaggctttttctgcagcagtcccggttcctgccgccagatggcgctcgaggatcacaaatgggtctagggttctcataatggccccgcctaagaaattttggattctcctggcccttcccccctttgtggggtcaacagcggatttgggaatctggtgaccaacacgtgcgcactcccctacccttgcccctaccgagccctccagggtagcttgggggagaagctcctccctagactgccgggtatttgatgagcctggccagcgcacaggtcttgagcaccatggtcagggaagaaggctgaatggcttaggtcttcctagagaggccggaggcgggaaagaactggagaaaggagagatggcagtgggaggatggggacaagaataccagtgtgtttccagccagaagacgatgtcttttaacacctcattgaagtcgtcaggtgactttgcccttgtcagaaaggagcagcactgcgggggtcctactgaggaggagactgactgctccttggggtggggattgtgcctccttcctgtctgccccactcttggggagatgagtccctccaagtccacgagacatgacagccagcctacctgccatgggagaacaaagtctagtctcagggcactcacttcataagggtcttattcttcctcagcgtgttgactgattttgaggggaaggatgtggccaccaaggtcggagaggcctggcaggacaggcctggagccccaagaggtggccaaggagacccagctgtacccactcagcaacctgcagatcccagtaccccagaacagcagaacagccccagcggatctgagcaattcgtcagacgagagagctgcaccagcaggtacgagccaaactgcactgggaccttacctgctagagccagtgtttttgtccagggcagcaacccaggacaaacccccacacactaggcatgcctgtttatcctctgcaggtgagtgtggttaggagccagagggaaggagagaaaccagcatctcaggggtagatattcatgggtttcagcttggagccatagcatcaaatctgttagactaagtctggcacagaaaggatgcacagagaaccaggttgtctggcagccagttcgaacctggaaacctgggtcaggggagggatataggttgctttttctgttaatggagatggaaactctctgagcaaggtgtgccatggtgtggatgtgattcactgccagaaataacaactgtaccagttggatgagctcttccactgccatcagcactgggatggccatggatttggacagtaatgtagctccacagtgctgactcagggttgctcattgattgcaagaagttggcagcagtagcctgaggaaacaggggctctgaattttctgagagagaccaagaaccaaggaacagccaggtactagggaacagacaacaccagatgcttgtgcttttctgtgagcagctcaggtctcccaaagtggtagtttcctggcttctggcctttgtagatcagtgtggatccacacccaattgtgatgtttgtggtagctgtaagaactttcccaattttgaaatcctaggtgacttgtagcatattttttcacatttgaaaataattgagttttgaaaatgtttttacaggcaatctagtatcagattttatatcatcctgaaacattctgtcaattgtcatttccaaaaatccatggaaaactggagttgttgaactggaaacagtgtggtctcaggaagtgcttcacagccattgcaacatgggcagggcctagagggcaggagagaatgccatgatttgatgacattttacccattcctgccaggtgaacttcatctccctctctgtgacagaattttctggctctcacatccagctttggtcactgggaacccacctattggctcttgcactggcaggacatgtggtagaggcttccagttcgaggcaggactggctgcattttcaagatgtccttatttctggtattttgtggcgatcgtcctgtccacttaactgattttgacccattgccttgctgtgatctctgtgctctctctgtctcccagttccaggtcattcccttgaccagcttccagtctttcctcatcttgtccctgccaatgaagtattctggctctgccttcactctcctgccatgatccattgctttgatagggtggcttcaggaacagggtgaggagagggctgtgctagctttatcttgccaaggaactcagcaaagaaaatttttgctgacctcttgcattcctcagcctggctctggtctctcaaacctaacacatgggatgcatgccagcagccagcctcagtttccctctggtccttttctgtgtgaggccagaggtccttgctttatcactgcctggagctgcagttgatgatggtgaaagaaggtgcacgtgtcttttgagagctccctttgttccccagagatttttttttcccaaagtggccatgagtttgggaataaccaggagccatgggccgccggctagagatgctgcatactaagagcctcctgtgagcagccatgtacacagtgaacacgatggctaaggccccatccagccgccctcaaagagcacatagtccactaaggaataagcatgatcgtaataaccattagcacctgctgtgtgctgagaatgtgcaggcactgttctgcatgccttatgtggactcactcatttaattctcacaccaactcaaggaggtgcttttattatggagaaactgaggcagatggaggttaagtaatttgctggcagttttgcagccaggaagtggcctaaccgagattagaatccagacagagatcagagcctgtactgttcatcgctgtggcatccatactgcccctccatttgtgataagcccaggaaggaaagaaaccaggtgctctgatggagaggggttagagcaaggatggttagggaaagcttttctatcgaggaggagacagttcggctgagacctgaaacatctggaggagcctgccttccaaagaacctggggagaggcattgtggacaaagaagatagggaggagggcctgaacaatgagccctgtgcttggagggtacggggtgaggtgagcagggggcaggagctgggccctgtagggtcttgtaggtgagggagaggaggctattgggagggctcctattgctcacattgcagtcctggggggatgcccagggcattttttcttttttttaagaggcggtgtttcactgtgttacccaggttgtttttgaattcctggcctcaagtgatcttcctgcctcagcttcccaagtagctccagggaatttctgttttaccttgcctcttcagttgcgccgtccccttcagtattctgctgacatggatcacaggataccagacacctggtagttgttcagtcagtaggaggtcttccttccttcctcttagaatcaatccttttctcacttgttggctctgcattttatcccccgtgtatcttttcagatttttgtggggcctcctctcccatccagtccaccttctccagtctctatggtatatttctttgtcatagggtgaagcaggaacaggtacaggatgattgggtacactgaggtgaggtaggagggcaggccctcaggaagggcttcccagaggaggtgatattgtctgcaaaggcatatgagagcctggaagtccaggggaactgcaggctggtctgtacggcttgagtggcacgtgatacagtttgagactatgaggcgagagagctaggcagatgctagaccatgattgttcttccctttccccactcttcaactagttgtaatcttaggcattggattctctggcaaggggacaatacccagtagcctgggccagatggaggcagccatatctggagtatgatctgagccacagcatgttggagaaaagccagaatcagcccagggcagtgtgcacccatagtgctggcctcaggcctttggagggtgagcagacttaagttggaaggtgcaaacaagtggtcagtggtgctgcccaacatcgtgccctgaactgcagttgacagctacggcagctttggtaatgaggctcatagcctgggggcaggcagagtgagagccgatattggcttggccagagaaaagcccttttgggctgccgaggaggttggattccaggccaagggccatatctggcagctgaagtgtggaggttcagaaaaacttcgacaccggtcagtttcccgcctctgctgggaatgaggtgcatctgactttcctcctcaatgatgcctaatttcatttggtcctctgccccttggccttgtgttctctagagagttccctgcagggtggcagaaggagctgatcctagtaagggaccgtcccatccagtgaggaggtgagctgggctgtgtcttccccttctgcaccctcctgactgtcacatccccgggagccccatgattccactctaactgagtgaatcacagaggccaaggcccttggctgcagtcaggagtactgagtggacactggaagattggggtcttgctactgactcacgatgtgacctgggacatgtctcaactcacctagcctgggtttgcttatctgtaaagtgagaagttccatttgttggtcttggaggaagcttcaagagcagtgctcaagggttaggctcagaaaagcctgtttgaccctggaaggtgtcagctcccaggttgacgtgcccacccctccctttatttctttcagggtgaggagcccctcgagctgcatggtcactgttactgtcactgccacatctgagcagcctcacatttatattccagcccccgcaagtgaattggactccagctctaccacgtaagaagggctatctagcaacctgggagatgttcctccgccacttcctccttggcggtaaaggacttggcttttgttccatgttgcttcccatttagtgccttccccagtttctagcaggccattagccaaggggccacacaggacagtgttagtcccctaatataaactcccatctaccgggcctagacattcccacacctcctttttcctatctctgtaagaggctgcagtggtacttcctagtgcactagtggatgtggctctgccattcatgggtccatgcctgggaagccagctccagtccgtgaaggccgggcctgtgagggcattcctgtgttactgtaaaggaatacctgaggctgggacatttataaaggaaagaggtttaattggctcacagtttggcaggctgcacaagcatggcaccagcagctgcttggcttctggcaaaggcctcgggaagcttataatcatggtggaagccgaagtgggagcaggaccatcacatggcacgagcaggaacaagagtgaggaaggggagggcccggactttgaaacaaccagatcttgtgtgaactaactgaatgagaactcacttttcactaaggggatggtgctagctgttcatgagggatccccccatgatcccgtcacctccctccaagccccacctccaacactgggaatcacatttcaacatgaggtttgtctgtctctgtcacatgcccactgcttcacctgcattcctggccacctgtcagggtgcaggaagggatgtcactgcaggaaggctgctcagtgaggtgtgtgtgttgggggcgggaggggggcatatccaagggggcctctgcagacatcaggtcagcaggctggagtgtgcagcatggaaatgggggaaaatttggggccatcctgagcccagcatgatgcagaccttgtttccagtcctgcagaggccagtccaggatgaggcaacctctaggcctctggactctaggagtgagaatggagaggttagatgtgaggtggagattgcacagtagctgagtaccttctgggaagtgctgagtggtaaagactgacagtgtaggattaaggcttggaggatatcttggttgtgggtagaggggaaagacgacgcagccctaaagtaggggtggaaagcccacaggactgaagtgtagaagtatagaagcctggggagaagatggggtcaccgaggtctgcatggaggaggacagcacattgtcattggttgcaggaagcccctttctggggccctcagtccaaacacaacaagagacgctcatggcctgggattgtagtctgagtccacagcagtgccagtgcctttatcctgggccttcccatgagctctttcacttccttcaaaccaggctgggtctccccagccctgaaccactcctgtgggccaggcctggttccctggaatcttctggtgtacctctgatttcttctgtgctccttctacagcaaagggattctcttcgtgaaggagtacgtgaatgctagtgaagtgtcttctgggaagccagtatctgcacgctatagcaagtaagagcgggtcccaaacccttccatgtcggccttctcctgccggctcccatattctcatccctgcatttccagttccttgtccaggacttggctcagagtagcttcggggtaattgtcgagtggatgagtgatgtagttgccctctgatgggattgatgcattttctactgaactgggcacctttgggttctcccttccggtgaattcatcctgcacaccattttcactgccattctgttctgcttgtctttgttattttattttgtaaaatgctgagaacacccctcttgacagagctggcagagccctagggaccaactagctcatcctatttcttttcagatcacagagctcttctcttctgccctcatgttcttttctgtcatgccaggctgcctcatttgaacacacatgtgactgcagttcctgatacatgtgtggctttgctttttaattttaattaattagttaattaattttaattaatttttttttgagatggagtcttgctctgttgcccaggctggagtgcagtggcgccatctcagctcaccacaacctctgcctcctgggttcaggcaattctcctgccttagcctccctagtagctgggattacaggcgcccaccaccatgcccagctagtttttgtattttagtagagatgaagtttcaccatgttggccaggctggtctcgaattcctgacctcaagcaatccacctgcctcggcctccccttttcattgatcatctcttcattttcttgctttgtgatgccatgtggaggggtacttccatgtcacctcggtgtattgctacctaccacactgaggtgaggtcccttagaatgtttcttatgacatgtcatctcactggaggattttagcaacagagaggagcatcctggccttatttcaggattgggcctctggggcttctggactggcttttattggtgctgtggaatgatgagcatggctgtgggggtcaagttcaagccccagctcaggcccccctgttaggatcacttcggacaagatgttcaacctctctgagctttgctttcacatctgtaggcccttagggtggtttttctcaacagcttattgagttataattcaccctttaaagtgtacagtcccgaggttttggtacattcacagagttatgcaaacatcattatccaattctggaacacctttgtctccccaaaaagaaactccaaacccgtctgcaccccctaattctaccccataactcaagcacaggtattataccagaatgatcccttctttcttctcattcccagtatctgatttctgctgagtgggctcctggtgactgtcacattatatcataggtggggaggaaagctctgctgttttcccactggtcagtggggtccccttggcatatacaacctcaggaatcctagccacccagccccgatcatctccctcattgtgaaaggtctcctttgcccccccatagaagggccctgtggcaccaagtcatgaatgacgactggcatcgtagttatgtctcagcttgtggccaaaggttaattagaaaattaactatgatagtgatttggctctcatctctgccctcctctcccctatcaaactccctgcagcgtcagcagcattgaggactcattcgccatggagaagaagcctccatgtggcagcactccatactctgagaggtatgttgactttcttagcacggagcttgcacttctacagaggagaatcagggaagggagagttcctgctgagtctgtttgcttttgtcttctgctttgcagcctccaatccatttgcagaaaggtgaaggacactaccgtagggtggtgcttcccttgttgggatatcacacttgtgacaactaaagcctttgaattgagctaagactagagggtagataccagcggtgactgagaagggaagtggtggcatctgacaacccagaggactcgtgtcagcaggaggggcccttcagattagaacctaatcaatcacttcattaacttgcaaatctaaccagaagtaaaaataaaatgactacaaaagagaggagtgggcagagaaggaagaaaaatgggctgctggcatcaagaagccagaaagacacacaaagccaagaatgcccagtgctgtggagccaccaaattgaaagcaggggcagagaacacctcgttcagcagttttgaaagctgtcactagatgatggcacagtcactagagagtcttaatgacaaagaaatcttatgttcagattcttggaatggggagaagagagtctcagagattgagttcactcaggcttctgtgaagaaaatggaataaatagccttcagtccacagtaagcaaatacggcagacccaggactaaaccccagggccctgactactcccaggttagggatgtttctactctgccatcttgcttctcattgatgggcagatcttaattcatgtggatgacattcagagaccaaagctacattggggaggaaaaggaaggaagtaagagggttaagataaagagaatcctaccgggccccagaggcaaacatataggagcagacaagcatatggggccagggaatctcctccactatagctgaagaagcaggtggttctgagtaactacagattacttggtgaggcacatcagcagatgaagtcttagcagagaagggcaggttggtcagaaacctgagagttaaccacttacataggagcaaatggaatgaggcttccaattctagtggagtgacaaaccagatactctagggacccccctttccattgcacaactactaaatccagaatcagtcattactgatccattgctaggcttggaggaaggaaggggactctctagggacaatctcagtcacttgcacacatgcatatgcacagacacacatgcacgcacacaaagaacagctgtgagctggtgctgctggtggtgaaagaagcaggaggagcagggctgcgctgagggcaaggatttcaagcagcactgctgtccagagtgaaccctgggccagcagcaggatggtgggccacacccaagctgcccgtgacacttctgggtcctccgacagagctaacgtggatctagattgttaatgtccccccgccccttgggcttctgtcagaagcagacccaaatctctggaagaaagtaccctgaattttggcttgtaggatcagatcaagcagttactttgaggaagtgcagtctgaggaagaaaagcagaggtgactctcagaaacaggcatcctggaactggaaagatgctcaacccaggagtcagtatctagaacttcagtgtcggatctgagtaggctctacagacagagcatgaagggtgggtccaggagtataggcaggggcagagctcagttggcccaggcgtgaggagaagggccatcaagacggggccaggcagggcacacaatgacatgtctcctgtaggagaaggcattggtcttcctgctctagagggtagcaggccccagcggataatctaagcagaaggtcagggggaggcaaactgtctggaataagtatcatatcaggacatctacaggagacatgtcattgtgagctggaaaaagatgcatgactagtttttggaaataatgcagaggtctacagcaggctgagaactgatctggcccagggctgtgctgcacaccacagaaaacagtggcatcctggggatcctgacagcaaacctgggcctggctgcaccaaattggaaggtctggctgtgtcacatcagaggtctgtacaccagcctgaccaccgggttattgttcttcatctcacaggacaactggagggatctgtacttactgcaaccgtgagatccgagactgtccaaagattaccctagaacatcttggtatctgctgccatgaatattgctttaaggtaaaaaagaggtggaagacaccttgagctaggcggtaactcctgatcacgtgctgctaagaacgttttgtagagtgcgggagtcttacgggttcagagactgtggaggaggcttgatctccatatacaattgcacatagtcgcagaggctttgcacaactgggagctgaatgagcttccaagtctaagacagtagatgagtgttggtggttctgcatgcttagtactgtagggaagacaaaagaggtcttttcaggaaagactatttctggcagagggccagcaagtgcaaaagccctggggcagaagcactagagtgttctagcttgcgtgggagaatgccaggagtgacagagtgggctagatcatgtaggccttggcgggcacagagtttggattttattctaagtgacattggggtccccattctccacagtgtgtggcactttgtaaccccaggttgttggttccaatccatttagggtgtcacctctgggtgcactgagaaaaacaaccctcccctttgccttgacagaatgttaggcaggcttctgtcctccccacagggcctgaactttgcttgctcctggttaagtaagtgctgcaatgcagaacatgccccacttagcagcttctcctgagaaccggctgaccacagggaaacacatttctggtcaaatcatgccaaacaggttcccctttgcttgcccactggcccttgaaagtagctgagctgctagctgtgcttactactccctactgaaaaaaaaggcttttttttgtattattttgtgatgttttttgtattattttgtgatgtttgcaagtcctgaggtccaggatgtgccacgggctcacagcatctgctcgcccaccttgttcaggcatccccttcccactccactcattcctcttgctttgctttgtgtgttgacctccagcttgcttttcttttcagtgtgggatttgcagtaaaccgatgggcgatctcctggatcagatcttcattcaccgtgacaccattcactgtgggaaatgctatgagaagctcttctaggtgggtgctggcactgcaaaggacaagtggccaagagactcattaaggagtagagatgcaccctggtctctcctggagtctcagccccagacacagctatctttcttggctcttccttatgttcagggggccttgtgtcctcatgtccctatgccttgtgatactttgagatcttaggtggcatggacaaaggccctcaatgaggacacttccaaatcacaccttccgtccagcacctgagccgagccctctagctaccctgggatactcgctcggccgctgttgttagccccattttgcaacaaggaaataaagatatagaaagggaggggacctggagaaacccaggtagaatcaggacctcaccccaggtctttggattcttgtccagggctctctgttcactgtcactcgcatagcttcagatcaggactgcatagccatggtgctcagtgaaacaagcctctgggccacattatgagaactgcctgaagatgtgtgtttgcatgctcatagccagtggaatttatcacggtgtctgagcacagagcagaatatatcccttgaaggcagtagcaaccaggctttccactagctccatgctgatggtcttctctccagaagacacaccttgagctaggtggtaactcctgatgactggagcagtcacccaccctgagggcctctagctgatgtgtttccagtctcatggctacttctgttttcttttagcgaccccccaccgccaggctgatcagaagctgatgactcgtggacaaatttggctgtccccagttttgccccaagttgctgtctccccttccctcacctcctccctccctgtttgatttcttcatgcttttgcccttctcaagttgaagttgcatacatccaatatcgtatcttaatgatgctatgataattgcttgtgtgtgtagcttcttgtagcttagaaagcgctttatgcccatgatgtcatttcaggctcaaccaaagaggatcaaacaggaattccatcttggcttccctaagacagattggctttctaatgagtttaagtgggcagaagtgtagggttcagtgtgtcctgactcccttgaggcttataatgggccaagttgaagactgttgatgatccctggtgggtaaattgcagacatcaaatgctagggattggcataggctagtgtttagcttgtctatttgccatatctattttttttaaatttccatacacttgtaaaagtagttagttgcttttgattgagttatatagcagtttttcatttggtcttccactcacctttcactatatttgagtgttcccttacaggtatgttggcatgtgttggaaaatttacacaattaggtttaaattcagtaggatgtgattttaggatgctactgatcaaagtgatatctgtgtctgttggaatcttgatagctgattaatttgccctcaattctgctccctgaacttcacacataaatcttcccaagtgggttttagggtgtatagatcccagcaggattaaggaggtggaaaagcagctaacatttcttgaggctctaccacatagcaggcactgtcacagagtaatggcattaatccccataataatcctgtgaaggtgatattctcatcccatcttagacatgaggatattggaactcagagaggtggctattgcattgcgcagaacgctacagagcccatgctcttcccagagcagcacccacaaaagcaagcattgattttgtgctcagtgtgtgccaagcactgtgcagagggtacacagttcctgccaggttaacaccctcccttcaggcctcccaaaggcataggcttgcaaagagcagaaggtgtgaaatcacactcttcctctgggcatcctggatccctgaattatccccccccccatgaagtacttcaagggccaagctgcccctttccctcctctccgcccatgaaaatgcctccaaactgagatgctttcagctgagaacagatttgactcacagacattaccaaagaggagcttgtgaatccaggaaaagctccagggggctagctgatctgagcagagagctttcagtgacccattttcctgtctagactctgccttaagctagtggcaactgctggggccccaggtacttgggacatggaaactcgttggatggctgggcagatgtaagcctgtccatgcagtcagccgatcctctgctcaggttcagctggactctgccatctgtgggcccagcatcactctgtaagttccttgaaaggaagaacaaccttagagtatttctgatacaaaatgagggcctctgctcttgatttaattataaaatgtctacgtctttctccagtttctgagccctatgcacattggcttgtgggcttgttcttcctgccaaatgatcagagaggaacattccatttatttgtagtggatttcctctggagggcatgtacccacactaaataccaactgctcttcctcagctgtagtccccaacatcagacttggcacgtggtggacactaacacacaggcactcaatgaatgagtgaaggaaataaaagtcaccccgttggtgagaggtgctatccctgagtctcagtgcaggaccagtggatgaaaggcaaggtaaagaggcccaagataggctggcttcccccgttcaaggtatagtctgcctttaagggagttttagaaccaacatgcaagacattgaaagaaatcttgcaagagccattattgacttagatccaaaacagcctctctcatgtctaaaaaggcacagaattttgcagatctgaggaagagggatgcattacctttttgcttcttttcaattgcttagtgtttctaatcatacttaatccacactaatgtgcgcaattataataaatggtaagatatcacatgtgtcagtgttaaagttttcttt

SEQ ID NO: 1331 - DNA, 75453 bp, mus musculus; identical to SEQ ID NO: 1330

SEQ ID NO: 1332 - DNA, 75453 bp, mus musculus; identical to SEQ ID NO: 1330

SEQ ID NO: 1333 - DNA, 75453 bp, mus musculus; identical to SEQ ID NO: 1330

SEQ ID NO: 1334 - DNA, 4996 bp, mus musculus; identical to SEQ ID NO: 214

SEQ ID NO: 1335 - DNA, 892 bp, mus musculus; identical to SEQ ID NO: 215

SEQ ID NO: 1336 - DNA, 196 bp, mus musculus; identical to SEQ ID NO: 216

SEQ ID NO: 1337 - DNA, 151 bp, mus musculus; identical to SEQ ID NO: 217

SEQ ID NO: 1338 - DNA, 885 bp, mus musculus; identical to SEQ ID NO: 218

SEQ ID NO: 1339 - DNA, 8013 bp, mus musculus; identical to SEQ ID NO: 219

SEQ ID NO: 1340 - DNA, 10179 bp, mus musculus; identical to SEQ ID NO: 220

SEQ ID NO: 1341 - DNA, 10179 bp, mus musculus; identical to SEQ ID NO: 221

SEQ ID NO: 1342 - DNA, 7595 bp, mus musculus
gccgcgccccgcgccgcccttgctagccgagcctcccgccccctgcattgctgatgctgctgctggcggacatggacgtggtgaatcaggtacgcgctccagcaccgtggacagagcccgccgccgcccggctgcctaggccgggtcgctcaggccagccgactctgggaggtggtggccagggtctggcagcggagacccggtccccggcgctggggatgggggtctgcggcaggtgaaggggaggaagggggaggtggagaaaaggagtgcgctctttgccgcagcgagggccgtcctcactgccgcagcgggggcccccggagccccgtttattactggcgaccgcgaggggaggaataggggcctgggggctggagtgagggcaagggacaaggggaggggagagtggaaggaagatggggggtgctgcggataagctaggaaatagagcgacagaaggtgtgggggcggggatgggggagagggctggcacccgcccctcccaaacagagactgtacccccataggcgaccaccccttcccccagagcacacctaggggacaatccggttttactccttccaaaacccccagcctcctcacccccaacacatagcgactgaagccgtgtcccagccctcccccaccttaatcagtccagaccctctccgccatgtctctcgtctttgccacctcagaaactcacccccaatcagtcccaacccttccccatccccatcacctcaaatatctaccgccaccgccgtctaacacacctttacccctgcagacccttcccccacctgagccaaaccgactcctgccccgttatgactcaccttcaccatcacaacccccccacccgaatgcaccccactccatccccattctctacccgaaccccttccccatccgactcgcctttacgtttcaaacctgctccccctccttaactagtcctgacctcatccccatctccctcacccccgacttcctctgccatctgactcaccatctcttcagaccttcccaccagtccttggaccctggggctcacaccatccccaaggtgtcactttctccttctcaccctctccccgaggtcacatgctccatcccctggggtcattgatgggcagccttgccgctcacctccctgtacctccaacaaccccaccccttccccactgtttctctcctcagctggtggctgggggtcagttccgggtggtcaaggagcccctcggctttgtgaaggtgctgcaatgggtgagtgtggtccgggctgttggggcagagtgcagggagagagggaggtcatggggtccagaagagcaggggtggagtaggggcgagtagccagggatgagtgcgggggttgtaggggatgggggaattgggctccagggtgaggtttcaggggtctgaagccagaaaacagatgagctgtgacgtcacatagggctgagggtacccccgttgtgaagtgggagactgtgacgtcctacctcctctcttgaagtgagggaggggtgggggaggtggagcctgtagcagatgctgggtgagagatgcaaagtcagagaaacccagagacagtgaaggtgacagagagaatgagggacagggaatgataaagacagagatggaaatactgagaaaaaaaaaagaaatatggagatgagaagagatacagacataagagagaagagacaaacagaaacaaagaaaaaggagacacagaaaacagatgcaaagagaaacagacgcagggagagaggcaggaaaacagggtgagggagagagagacacagagagaaagagacactcagaaaaaagagaaaccaacacacagaggcaagagggagacagagagagaaccatccggagaccgagtgagagacaggacagagagacagagacaaacagaccaagaaacagaaagacacagacatacaggcatacacttacacagacagagaaaaaagagacaaaaagagacatcgacagatcagataggcagaggcagagaggatcagagacacagagagacaaagagacatctgagaaagacaaagacacatagagaaacagagataccgagagaaacagagacacagtgagatacacagagaacaacagagacaaacagagaagagggaggtcagcatggaaaggcagagacagagagagacacagagagagaaacaggaagagacagccatacccttgtaatcagcttgtccttggtcccgatgagccctgattagggggtgggggtggggactgctccatctgctgctgcctgtgctgggcccccgatctgtccagaggagggcacctccctcccacatgcacacaggttcactgtggccatccccatccctgctgcccaaggtcttcgccatcttcgcctttgccacatgcggcagctacagtggggagctccagctgagcgtggattgtgccaacaagaccgagagtgacctcagcatcgaggtcgagttcgagtaccccttcaggtgtgctcccaccctgggataccaacagacctgggagaggaaggggcagggtggaaccggccaatacctccccccgcaagtagctcctgcccagctcccacctcgaggctacatccactgggatcactgagcacctgccttgtacctggcactgctctggactctaggactatgtggtgagcaaggcagacataggctgtggccctctggctctgttccagcgaaggggtaagggacaggcaataaacaagatacaaaagtaagacaggtgtatatacataccttaacccagtaggtacccaattaatgttagccaatattattatttaatccccattcattcattctatacacatttttgagaacttattttatatctggtactactcaaagtgctggaagcatgatagtaactaaaacagacccaactcccgccaggcacagtggctcacgcctgtaatcccagcactttgagaggccgaggtgggcggatcacctgaggtcaggagttcgagaccagcctgaccaacatggagaaaccccgtctctactaaaaatacaaaattagccaggcgtggtcatgcatgcctgtaatcccggctactcaggaggctgaagcaggagaatcacttgaacctgggagccgaaatcgcgccattgcactccagcctgggcaacaagagcgaaactccatctccaaaaaaaaaaaaaccagacccaactccctaccttcatggagcctacattataacaaataaattaacaaagaggataatagcagactgagagaaactcgaggagatcctcatgtagggttttatggtagagaatagaataatgaggggtgctgcttagatatagggaaaaattaaacccaattaaacaattctgacatttattgagctcacactgtgtgccgggcaatacactgggtgctaggtgcacaagaatgagcacggctggcatgggcactaccctcacaatgatgtttacctcctgcagggtgggatgacagagacccacagacacaatccccgcacaggtttctgagactcccccactatttggccaaatcacataaccactctgggtctcaatttcctcatctgtaaaaaggaatactaataatatctacctcacagggtcgtggttagcattcaatgagttaatattcatcaggtgcttagcacagtgcctggcacacaataagtgctccatcagtgtctgttcaataagtaaaataaatttaagggactcaggaaagaggacaggggttgagttggaaactgggggtcttcgagtactgagggtaaatgtaggctcaagtgatcacccagtggggagatggaagagtgaaagtagaagaaaacctagcacaggccctgagcaatgatggaaaagagaggagatgccgggaaagtgtggcctgagaggcagaggggcagccaggtatccatgggtccacaaaggcaagggagaaaagagtctggggaaggagggggagctggcagcaagggacactgcttagagccagtcctttggggatccacaagaccacaaccatcccctgtgccccctccccacgcctcccatgtctagaactttgggtcctaaggctctagcccacaagtcccctagaaaaacagtcttggccctgggtccccctgagcaaaatccctcccaaactgccctaatacccaaggacctctcattccctcttagggaccccctctcctgacccagcccactagaaacagaaactcaaacccagatgcaactcctagctccatcatttaggagctgtacaaccttgggcaagtaataaccttgctaagcctctgtttattcatctgtaaaaagggtctaataatgccttctttagagaattgctggaggctgtcattaatgagacatttatgtaaactgcttagtaggtgactaataagtgcaagcctcttccctcagggcctttgctacacaaaggcattggcaccatttgctcagtctcaggatcctggcctccaatctgagactgtgctccagaacttctcccacagacattttctctctacaacccccacctctcctccatcacaccacaggaaaggccttagtcccaggacacctcccctcttccctcacatacacacaccctgttccaagatccctttaccctcctttctttctgtctgtcttttcctgttatctagtcgctggcctctcctctgctatgcatacatttttttctctcggggacctgaactggggtgggggagaaaagtcaacatgagatagggagaaaacaaggttcagatctcaactctgacattcccttgccagctgtgtgactttaggcaagttaatgcacttccctgagcctctgtttccgcctctgtacatttcatttgataaacatttcttgagtgtctgctaggtgccagcactgttccagggcctggagataaacggaggtgaaaacacaggaaaaagccctgccctcttgtagttacagcaaaaaccaagattaaaaaaaaaaaaaatacctggtacgtcagatgggtaccactactatcgagaaaagtggagcaaggaagccaggctaagaagtgctggttgagagaatgtttcaatttaattttaagtagggagatcagggaaggtctcaatgagaaggtgacagttgagcaaagcttcaaggagatgagggaggccgggcgcagtggctcacgcctgtaatcccagcactctgggaggccaaggcgggcagatcacaaggtcaagagatcaagactatcctggccaacatggtgaaaccccgtctctattaaaagtacaaaaattagctgggcgtagcggcgcatgcctgtaatcccagctactcaggaggctgaggcaggagaatcgcttgaacccgggaggcagaggttgcagtgagccgggattgtgccaccgcactccagcctggtgacagagcaagactccatctcaaaaaaaaaaaaaaaaaaaaaaaaaggagatgagggagtaagacccgaagctatctaggggaaaagcattcctggcaaagggaacagccagtacaaacaaagatcctagggagggaggatgcctggcaagttctagaaataatcaagaggccagagtgcttgggttggagtgagggatgaataacacctatctcaccaggatgttttgagcaatcagtgaaatgtgactggtacatagtaggtgctcgatgaatggttatttcctcctcttcctggggccttgtcagaaatggggggacccatgattgggctggagggttgagggtgttctgaggggctgggccacacctgcccacctctgtttgcaggctgcaccaagtgtactttgatgcacccacctgccgagggggcaccaccaaggtcttcttagttggggactactcctcgtcagccgaattctttgtcaccgtggccgtgtttgccttcctctactccatgggggctctggccacctacatcttcctgcagaacaagtaccgagagaataacaaagggcccatgctggtgagtccccacagccacttgcatgtagggaccatggggacacggaaccccagggacacagccatgctcacagaccacaccaaatcccagacaggcccacatgcaaacagccaccataacagccacacatatagttgctgctgctattaatccacaccaggcatccgggacacagagtcatagagtcacggagacatacagcctatgcagaatcccagacaggcccacacctgagaaccttcccactctcacacaactacacagcctagatcaaaggaagaggcccacagaggttcgctgtgacagtcatgcctgtcatcatgccacacagacacactgattcctacaccactgtactcacataccctcagcctagacacaaaatgacaaaaattcccacatgcagacaaaagtagaaagacacattactttccacagattcggaaatcatcccagagttcccctccccccaacacccacagccacatatcacaatcacactcccacatcctctgtgtcatgtacacacacaagctcaagctgggagggccaccttcaggtgaaagtgttgtgggcttgagagctgaaaaggcaggggagagacaggcctcttctgggggacctgtgatccgaggaggccccagggcctagcgtgaagcagtccactcacagtgctgtcttcctcacccctgcctgccttaggactttctggccacggctgtgttcgccttcatgtggctagttagctcatcggcatgggccaaggggctgtcagatgtgaagatggccacagacccagagaacattatcaaggagatgcctgtctgccgccagacagggaacacatgcaaggagctgagagaccctgtgacctcgggactcaacacctcggtggtaagccctgggtgctggctggaggagggagagtggaaaacagtacagtccggcatggggagtggtggagtgggagaataagaggagagtcaggggagatccaaggggtgtccctgaagaacgcgtgccaacaacaacgttgaaggatgagctagcaattgtaaccactgtgacaccacagactgtccccaaagggggaacatgacaggtttgggagacctggatcccagacccagcctagacatgtaaaataagcaactcagcaccctcttgggacctcagtttcctcatgtgcaaaatgaaggaaaaacttgaaatgtttccccacttggatgccccctactggctggagtcagactgtctgcgctcaaatcccagctctacctcttgcaagctccctgacctgaaactagtcacagcctctcaaggttcagttgagcatgcataatcgaagactaataataggtcctgctccaaagttgagtatttattgaactaagaatacggagtgctcagaaaagggcctggcacaaggtaagtcgtatacaagggttacagatgctaagattacaacttttctttcctgtcacttgctggatgtgagacttcaggtaacttagcctct

SEQ ID NO: 1343 - DNA, 11426 bp, mus musculus
cgcgctcgcatccccaagatggcggccgttaaggacagttgtggcaaaggagaaatggccacagggaatgggcggcggctccacctggggattcctgaggccgtgtttgtggtaagaggcacgctgttccctggcatcttggcttgaggccttggactgcccctttcttcccggctcccacccaggcctcgactgttggaaggagctgagccaagtgttcagggagggggcgctcggtctgctctcacccctcgcacctggacagattgagctctgctgggggcccgcccggaagaaacgtagctcgagaaggccgtagaagagaacggggtgcggggccgggacgaggggcgaggggcgaggggcggcgggtggcagggcagggcggcctgagggacctccgggctgccgccggttttcgtccccctgctggttggaaaaggggaggtggtgaggagctctcgactcagcatggatgctggagacacagtacaatgaataggcagaacagccagtgctaagatgtgaaaaccgggaatatcactttgtctgttgaaggaatgcagtggtctcgggaatgttgcctcgggaaatggaagaagagaccgatgggaaaataggatgataggttgggagtgtaaagtccttctgtgtcttgctaaggaattgaggttttccagtaggcaacgggctgtcatcagaaggcctttcgttttaactacatcattctaacaacttagtggagaatgaattgttgagagaggaggctgaaccctcctgatggcgctaggtcccaggttcgctagtgtcctagaggggatcgggttgctccacaggccgttctggagggcgctgcctgtgctgggtggctttttaaaaattttattttatttatttaatttagaaatagtagttgaaaactatttgactaatgagagaaaacatctgactggccctccaggccaggtcatctgtctgtccccacttagctactataaaatcttcatggaagtttctcaatcttttggtttgtaccttaccttacctctgccttttttttactaactacgtcttatatccttctaaagactcatttatttataccacacttgatattgtatattcgcatttgctgattgaatttcgtaattggttattattttgtgtttttatgagctgtgtcatttatttctctacattgatctattatctaaccataacaaggaataaaatttgttgagtgccaggcactttcttaatgattttacaaaattcgaggtggtagctactactgttatgcccgttttttagatgataaaactgaggtacggggcacttgagtaacttgccccaggccacacaggatgtaagtgaggtatccagggtttgaacttggacaatccgtggaggtccagactggcagcttacccctcatgctctgctactgggaggaggtgaggtagttctcatgaatcgccctacttctcctggtcatagcatagtgcctcacacatagtataagctcaaactaagtgtctaattgaatttccatagggccttaaatgttacattcatggtgctcagctagagatggcgtcagaaatctaactcgggaggagacactttatctgagggctttataatgtcttgaaatgctttttccctacaatgtcgtggttatttttttctagaccttaaaatttctaccaacataatgtaataagcaacccaaattttatataactgtttatgtttccaaactattaataattgaagtgacatggtattgtagaaagattattggcctctaaatagaccagggtctgaatcctggctctgcttcccagttgctgcttaaccttaagcatattattttaccactttgagcttgagtttctttaactgaaatagggatgacaatacttagagagttgttatgggaaacagagaacatgcttgcagtattgcagtgtagtaggtgtcgaataggtattaatattcatgatgataggaagcaatataccatagtggttagaagtcagacccagtccattccccaaccccgctgaggcagtaatttgttttctttctctgcttgaattgttgtttcacccttgtccatttcatgacctcttcatctttccacatctagttcagatatcatctccctgtagttttctctgacctctaccccaaaacaaaatccctggcactttgtgtccctgtggcacattatgctatacataggtgtcacgtactcttataagcgtttcacatatgctaactcatttaatccctggtgacgaaaaggtacttgtacagatgatgaggaaattgaggcaaagagaggttaaataacttccctaaggtcaactcatctaatgagtggcgaagctgggattcaaaccaggcacctcctgtctcttaaccacagcctatgccgctatagttaattcttgctaaactccagcacctgataacatgtatcatgtgccagaaacttacacttctttctcttccctgcagtgacccttctaggaagatggcatctctctttaacatacagaactcagccattatctctcagcctcaccttttcaatttcctttactgtctagtttgatggcttcttagttcactcccttgctgtgtttctcttcctttttcttccttgtttcagctaagatattctctggtagctagtaaatatggataagaataatgatgtgaagatcttagaagctataagataattgaagttacttataataaagaactagagttctgtaaagtactagacgactcttgtagcatctcttttaagtttcatatattttcatcttgtttctgatccttatctaattaactagcctttcttcaaggatcagcatgtggtataaaaaatattttaacatcagttttactgcttttcttttgatcagttattactgttacaaaagattattctgtttgccttttaggtttactttgtttcagttatttgatactgaaggaagcatttgtggattgccttgggaacccagtaaccatatttagtatgatttctatggtaaaacttgttgaattaaaaataagtaataaaattgataatcttgacatgcaacctgtaaaatcattttgtgaataggatgcatgaataggcaatgtatttgattgttagtttcatatttactactagggatgcatgggaaatgcataaagtggtgggcaaggtcattcttcttttcctatttttgaataaaaaatgaagaggaaagtgaaagaataaattagctatataatatatatgtaccatctgaaattgtctctaactttttataactacaggttgagcatcctaaatctgaaaatctgaaatccagaatgctctaaaatccaaaactttttgaacaccaatatagtgctcaaaggaaatgctcattggagcattttggactttggatttttggattgaggatgctcaactggtataatgtaaatattccaaaatctaaaaaaaaaaaaaaaatctaaaatccaaaacaattctggtcccaagcattttagataagggtgcttaacctgtacttttagttaaaaacaaacctttggagaaaaacaaagcttttttttcttctatgttttaaaaacaaagcagtcaaaaaatctgagtggcatgaattctaaaatttgtaaagtattatttttgatattaaaggaagatgtagattccttcatgaaacagcctgggaatgagactgcagatacagtattaaagaagctggatgaacagtaccagaagtataagtttatggaactcaaccttgctcaaaagaaaagaaggtaagtgtaaaaatttctaagttttgaaaatcttatatgacttgaacttttaaaaaattgagatataatttacatataataaaatattcagatgtcaagtgttcagtcctccaaggtggctgtaccatatgaaattcccaccagcaacgtacaagagttccagttgttccgtatccttgccaacacttggtattgccagtctaaatgtggttttgaaaacataatagaatggttgttaaagactgtattccaaagctttcaaaatcataacgtcttatatgtctagttcatccttctaattttgccagtgagattagagacccacagagtctgggcataagacttaattagttatgaaatcccaagatttcataactaataggcataggaaaaaagctatccttactctcaactctttatttccctacattattttatatagcttataaagtcaattcactgtaataaatatttatagatctctgttttgtgcatgtgccagcattcttctgtaagataaatatttatggaatgccagctagatgccacatactgttttgggtgaaataacatccagtatctgctttcaacaaggacacaggactgggcatggtggctcaaacctgtaattccagcactttgggaggctgaggtgggaggatcacttcagtccaggagttcaagactagcctgggcaacatagggagacccccgtctctacaaataattaaaaaataattaggctgggcccggcggctcgcacctgtaatcccagcactttgggaggctgaggtgggcagattgcctgagctcaggagtttgaaaccaccctgggcaacatggtgaaaccccgtctctactaaaatacaaataaattagccagacgtggtggcatgcgcttgtaatcccagctactcgggaggctgagttgggagaattgcttgagcccgggaggcgaaggttgtagtgagccgagattgtgccactgcactccagcctgggcaacagagtgagactccatctcaaaaataataatagtaataattagctgggtatggtggcatgcatctgtggtcacagctcctctagaggctgaggtgggaggatcgcctgaacccaggacgttgaggctgcagtgagatgtgatcatgcccctgcactccagcctcggcaaaagtgcgagacccagtctaaaaagcaaacaaaccacacaaaaaactagggacacagtttggtggaaattataggtatataaataaaattagcacacaaagtagaacagtagaggtacagggggatggtaactcattactttgtaccaaagcacctcattaacctggaggggccaaggaggttcagaggaagcttctaagaggaacagatagctgtgtagaatttcaaagattagttgtgagtttggaggcagactaaagtgaggaaggggtagtctgggcctaaggcaccatttatgcaaaggtacagaagtttgtaggtatattttctcatttgattttggtgacagttgtacaaagttgaatatgtactgagtattagatgagatgaaaagtcattgacatggaaagatggagagtgttaatggacagaagcaagatagaaaacattaagaacagtgtgctctcgttttggaaaaaaatgtatgtatgcacaggaatatctggagaaatccacactaaaggcatattaacagtggtaatctctgggtagttagaatatggcatttttcttgtttttgcttagctgttttcttaattttttacaatgtacatgtactgcttttgtgatagtaaaagtttatttgaaaaagaaaaataaagccattggatttgagatcacctacagggaggttacagatagagaagaaaatgtgccttggggcggggtgcagtggttcatgcctgtaatcccagcactttgggaggccaaggtgggcggatcgcttgagcccaggagttcaagaccagtgtgggcaacgtggcaaaaccctatatctacaaaaattagctaggtgttgtggtgcatgcctgtagttccagctactagggaagctgaggtgagagtattgcttaagccagggaggttgaggctgcagtcagctgtgagtgtgccactgcactccagcctgggcaacagagtgatgataccccgtctcaagaaagaaaaaaaggaaaagaaaatgggccttgggaccaagtcctgggagagggggaaatttgcgtatcaaacttaaattgctcttctaactagtaaattaatgatagacaaaaacaaaaaaaagaaaaaagttatattgctaactctacaactgtggtatgtagcaggatactcactctagcttaacatatggtctaggcctaaatgtggggagaaggggtaaaaattcaaagcacttaggaaacatcagtgaacgttggtgttctggatgagaacagtgtttgtctagtgttttaaaagagaatggtagagttggagatagtgagttaggaaaattttcttgagttttacctattttaatagtgggttggtcatttttttgagacaggctttctctctgttgcccaggccagagtgcggtggtgtgatcacagctcactgcagccttgacctcctgggttcaagcaattcttccatctcagcctcccaagtagttggagggctacttttctctttttatttttctggaatttctctcactcctatgatgtcagctatgcaacaaaactatttttgtgtcatgatctagttgttttgcagcagatggctctatgtagtttacatgctagcctttttgttttttttttttttcaatttgctattattttatttaggatttttgaatttctgttcataagtgagttcagcctatttctttctttttttttttaatttttttagtattgatcattcttgggtgtttctcggagagggggatttggcagggtcataggacaatagtggagggaaggtcagcaggtaaacatgtgaacaaaggtctctggttttcctaggcagagggccctgccgccttccgcagtgtttgtgtccctgggtacttgagattagggagtggtgatgactcttaacgagcatgctgccttcaagcatgtgtttaacaaagcacatcttgcaccgcccttaatccatttaaccctgagtggacacagcacatgtttcagagagcatggggttgggggtaaggttatagattaacagcatcccaaggcagaagaatttttcctagtacagaacaaaatggagtctcccatgtccacctctttccacacagacacagcaacaatctgatctctccttcctttccccacatttcccccttctctattcgacaaaacctccatcgtcatcatggcccgttctcaacgagctgttgggtacacctcccagacggggtggcggccgggcagaggggctcctcacttcccagacggggcggccgggcagaggcacccccccacctcccggacggggcggctggccgggcgggggctgccccccacctgccggacggggcggctgccaggcggaggggctcctcacttctcagatggggcggctgccgggcggaggggctcctcacctctcagacggggtggctggtcagagacgctcctcacctcccagacggggtggcggcggggcagaggtgctcttcacatctcagacggggtggctgggcagaggcgctccccacatctcagaggatgggcggccgggcagagacgctcctcacttcctagacgggatgacggcctggaagaggcgctcctcacttcccagagtgggcggccgggcagaggggctcctcacatcccagacgatgggcggccaggcagagacgctcctcacttcccagatggggtggcggccgggcagaggctgcaatctcggcactttgggaggccaaggcaggcggctgggaggtggaggttgtagcgagccgagatcacgccactgcactccagcctgggcaccattgagcactgagtgagcgagactccgtctgcaatcccggcacctcgggaggccgaggctggcagatcactcgcggtcaggagctggagaccagcccggccaacacagcgaaaccctgtctccaccaaaaaaatacgaaaaccagtcaggcgtggtggcgcgtgcctgcaatcccaggcactcggcaggctgaggcaggagaatcagtcagggaggttgcagtgagtcgagatggcggcagtacagtccagcctcggctcggcatcagagggagaccatgcaaagagggcgagggcgagggtgagggtgaggctagcctttttctttgtatgtgttgtaaatcttgcagcctgtcatttaactttacccttcaagctgtgtaaaagttccttagtatttcatgtgttaatctctttttcgacacttgaatctgagatcttttatctttctttaattggaaattttgtgattatcactttttctatcgtctgttaattttttttcctctttctttctgggattcctgtttacagatgttgacacttctaattctgccttccatttatttatattatttcccttttttctgtctttgtcatttatcttttggcaattagatggatagccatgagttctttgtttcagctgttaagatttttatagctggtagttctggttggttcctcttcatattaccaatatcctttcttttctctttgtggtatctttaagtatttaatgtatagttttatcttttggtatttgttaattttgtttcatatggtagaggttgttgaatttattgtctttatttattataatgatcaaattataatgtcttttccctgtcagcttagattccctcagggatatcagctactttggccagtaatgtacgtggaggtgggggtaatttaagtcactcctggtgggtagcagtggcgctacctcggctcactgcaacctccacctcctggattcaagggatcctcccgcctcaacttcccaagtagctgggattacaagcatgcaccaccacgcccagctaatttttttgtatttttttttagtagagactgagtttcaccatgctggccaggccggtctcgaactcctggcctcaggtgatccacccgcttcggcctcccaaagtgctgggattacaggcgtgaatcactgtgcccagccaagctactttctcttcaggtgaagcagggtagggaggagtgtattgcttgggcatgtgctgtgtcattggtggtctggttcctaagttagctagggctgcatctgattgattcattaatatgctttatagcatattacatataatatttatatatacagaatgcatcttaaaagtcatttacatgacaaaaaatcttgatctgaacatactccttatgttgtgtgtgtatcacatattttacaaatgtataacatctttctgtttacctatatgaacatatcatgcaaaaataagcaaacttgagcaatctatggcatccagattgaattgtagtgaaaaaatgaatgctaggtgtttctagattattcactggactgtattatcaaatgatgacactatgtttttttcttaagcagcaggctcatttaacacatttcttgccaggtcagtagcacagggtgtagtaaatttgccctgccaacctgctgcacacatggagtgacttcttttatgtgacgcaataagttcattttcattgttgtgtttatattttgtttacattttggtctctaataatatttagtaaatttacctcgaaagaaccagagcttcgtttttatatccttagtctgttttgctagaaattacatttgacagagaccctagaactgttttgcatatatctccatgcaaaacacatgcatctaattaccataaagagctaaaccccagtgacaaaaacggtatcattgttttctctctttaattgactgaatgtttttagcatactgtttttctcttatgttcttgtcagtgaggttgattgcatttgggagtcacttactagcattttgctagtagctatcatataacttatccattaagtcggatcagttgtatcatgtccatcattgtttttttaaatttcttgtgtttaaatcagtgatccatttataattttaagaacgatcgttacctcatttgaaaagaagagcatttatcaacataaaagttaaggaagaaatacccaaagcttaaaagaatcactaaattatactgtatcataatgtggtgtgtttggcattcagatgattctgtacatttttcacagtgtgacaagtgcacatactgagaaggtgtcactgtgctttgcctggcatttagctgactgtgatgtacatgtgtgtatacccaatgcacacaccaggagtagctatgtgcatcactggataggggattggtgtcttctattttagaatgtaacttttgaatccatgttatttttaaaattagttttaaaattaatctatttaaaatttcattctaatcaaatgcagaacctatgaatcacctctgtggaatatagtctgctctagaaatgttaaatagccatggggtatttgacataatagaacagagctttgtcttcatggaatgggcattccataaacattcactagtatatcttaaatatttttattaagtatttatactttaaatattttatgaatattttactaaatatattttcttttggtgaatatttctttaaatattttatttttataaatatttatatcttattttatctcatatctaaaaatatcttaagtattttatatctataaatagtcctcaagaacacattagtagaaaatgcaaagttagtaagaccgtgtcctgttgtttatttttgcctgcaaaatactaagttactctttttcttgttcacaggctaaaaggtcagattcctgaaattaaacagactttggaaattctaaaatacatgcagaagaaaaaagtaagtgcatttttgtttgtaaatatgagcaagctaggatatgtcagcagaaactcgtcttctttgactctttggtcactgatatttgatctgtgctgtggaatccagtctgccttcttaagcacatacactaatgttatgatgtgcttctgtagcaaatgtggctttgtggccttcccccaaaagtcaagtttaattctagggcccacacttggattactttgcttatctttagtgcttgtgaaacttaaatgcaatttgaaattgttttaggtgtacaaagaaaatgtcttattctgtgctagcagcatctagggttttttctttgttgttgtctttctccctaagaataaggagttagtccaagatttatagagctggaacgaatcttagagatcatctgttacaggttctcatttcatagttgaggaaatggttatggagaggttatactcgaccattgtctatgtagttagttactggcagaactaaatttgagagtcttctaagtcttaatccagtattcattaaataaaagcaggttgtaaagattaaatctcataagcatattgtatttaaaagatt

SEQ ID NO: 1344 - DNA, 215 bp, mus musculus
ggggcggagggggctggcaggaggggagggagcgctggctttagagccacagctgcaaagattccgaggtgcagaagttgtctgagtgcgttggtcggcggcagtcgggccagacccaggactctgcgactttacgtaagtgctttgtaggcgccggcgggcactaggggagcgggtttcctgggcgtgggcaggagtgggtcccggggagagca

SEQ ID NO: 1345 - DNA, 37095 bp, mus musculus; identical to SEQ ID NO: 175

SEQ ID NO: 1346 - DNA, 92922 bp, mus musculus
ctcccggttcctggctccagctaggctcggcagaaataggagcgcgcaggcgcgacgtgcggctcgcagaacggcgagtagcggagcgggacccgctgtgagtgtggcggccgcgctgggttcctagctggggaaacgtgatccaggcgaagcgccccaggaaggattggggtgtgtgggggtgacttcggttctgcgaggagaaacccgtcagatatgcggtagcgttggtagcgacgctgcctgtgggtgtccggccagggccgcgtggggagcggagtgcgtggtagcgggagtgggtgagggtgggtatgacgagaaaaaaaattgaaggaatggggtttacaggctggaagtccgcacacagactgggcaggaccgcgaggcttgccaacggtgctggagggtgtcccagcttcaagttcagtcccctgcttggtgcccatgagggacgtcccaagctcatcccttcctccagcgctgctttctctggtgcagagttgctagaaacattccccgtcggaggggaaaggatttggaggcggtgggctgtcggcccgggctagtcccaaggagggcgtggcgttcgtgtgactttcctttacccacccccgggaatgtgtccctcttctgatccattgtgcccgtggacattttaacaaaggctatgactgttttgtaggcagtggcgggtgacagtgggagggggtgcgtgcgaggtcggtcgcggtgcggccctgggggatgggagagcggggggagggggaggcggcgtggggggaagtgaaaggaagagaaacagtcttcctgcttcaggtttttccttcttcctggtccgctgaatttgatcactggtaggaacagccccaagagggatatgactggaaagtagtgtgtgcgcgtttggactctggctccagccactggtttttgtgattgtgctgtgcaagtattttctacgagtccctttaggagaaaagcgaaactaatgggatttgagaggaaataattgaatgaaaggatgaagaggttgagtgacaaaacttagagcttaattatttgtctgttgatggtcatactataaagccagactttgaaggatgcgaaggtgttcaagccagggtaagtgaaaagttggttaggctactgttgattgtttcaatcaagagtggattattgggcatgtgtgtggatgtgctgtcaagatcttgggccgactcactttagaacctttgaaaataatattaaggatacaaaacattagggcaaatattgtaatattggataaagctccatatgctttcattttcaaacttagggacttttatgaaagatagtatatgtgttcccaagcatagatgttgatatttttactcatttgttttaagttaatacaacaaaataaactgaacttcctcctctccacccctttccctcgattgtaaatcccgttttataaacgtttactttctgatctgaagtatacttaaaaacacaattaccccgcccaacccccacccctgcaccaaccccaggcatgaggtgaacaggatttcttctggttttattgttatgttattctttctttttctattttcccaaatttggggcaggtggagggcggggagtgttagggatgccttttctcttttctagtgcctgatgaactcctattcatctttctagacttagcctgattcacttcttgaaaaattttgccatcttctccagagtgaattaatcacacccttttctgttaaatttatataacttgccttatttctccattactactagaacctcagtcttttgtgttacccttgtacctagagctgcctggcatgtgataagcacctaataaactaacttacagatatatattaataaatgctgttagaaagatggtaattcataggccgggtgcagtggcttactcctgtaatcccagcactttgggagtctgaggcaggtggatcacaaggccaggagatccagaccatcctggctaacatggtgaaaccccgtctctactaaaaatacaaaaaaattagccgggcgtggtggtgggcgcctgtagtcccagctactagggagactgaggcaggagaatggcatgaacccgggaggcggagcttgccttgagctgagatcgcgccactgcactccagcctgggctacagagcgagactccgtctcaaaaaaaaaaaaaagaaagaaagaaagaaaaaaaagatagtaattcatattgcataaagttcatgggataatacaagaaattcagaattctgaaattgtatttaatatttgagcagcattatttggaatatggataagtactgtgtggaaatatgttctcatgtattagtcatagtttatccctctaaaaagaggtgcaaaaactctacagataaagggaaaatagggatcagaaaaaggtgaagtttttaaaaaggccagtttctgatactgaaactagtgaaattaactatttgtagaaagacacaaataggttgctgctggaatttaggaagtactacaaatgaatcaggttgccagatggtattctctgaagggtgatgtaactaaagaaagctgtaatctaaccagttgtattatacttcttttacatcttaaagtattttcggcctttggctaatgggtctcttcatgttacagttccctgataggcttggtctaaccatttctgccaaactgtctttgacatctctcttaactccaccaggatcactggccttccagttacctctggctcctaacaggaattatcttccccctgttcctcacctccagccttcttctcctgaatggatatatgtatttgagaaaataccatgaacaaatgatcacttactttataaaagaatggaattggttctttagtttaaaaataagtcagaattggctacctgcttagtctagccttctgtgcctgcaaagcagacagagaactatgagcattagtaacccttatttttcatttctcccttattcatctaaatgcaaaagcactttttttcatttcacttttaaaaatagcattagtcattgttcctaaaacacttcaagttagtctctttttttgactaaaactcaaaactcagggaggaagagtagtagcatccataaaacttttttaaagttctacatcatctgtggacctactgactgaaaaaatattccaaaccaaccattgtgattataccttccttcttaaaactttcctcttagacttccttctcatatttctgattttttttctctaattctttgaccggttaacctcagtcacctccacagtcttctcagggttctgttcaaaactctttttctcactgtatgcacaagagtcaagggcatggaaactggagaaatcgaaaattggaggcaagacaagaagttaaacttttctttccgagcattagtttcctcacttgtaaaaatgataattataatacttacctgataattaagatcaggtatatagtgatgtgacgcataatgacattttggtcaactatggacaacatgtgtgatggtggttcccataagattataatggagctgaaaaacctggtgactttgtagcctttgtaatgtcacagtgcaatgcattacagtatataacacttgataataaataactatgctaatggtttatttactatactatactttttaattattattttagagtatacttctacttatatattttttaaaattaactgtaaaacagcctcagacaggtccttcaggaaggcaagaagaaggcattgttatcataggggatgatatctccacccatgttattgcccctgaaaaccttccagtggaacaagatgtgaaagtggaagagtgatattgatgatcctgaccctgtgtaggtctaggctaatgtgtatgtttgtgtcttagtttttaataaaaatgtttaaaaagttaaacaaattaaatagataaaaacttatggaataaggatataaagaaagaaaatgtttttgtacaactgtccagtgtatgttttaagctcagtattattacaaaagagtcaaaaagtttaaaatattaaaaagtttatgtagtaaagaagttatagtaagctaaggttaatttattattgaagaaagaattacattttttatatatttggtgtagcctaagtggagactatttataaagactacagtagtgtacagtaaatgtcatagggcttcatatccacttaccactcactcactgacttacccagagcagctttcagtcctgcaggctctattcatggtaagtgccctatacagatgtaccattttttatcttttatacctatttttactgtacattttctgtgtttagatacacagacatcattgtgttacaattgcctgttcagtacagtaacatgctgtacaggattgtagcctaggaataatagggtataccatattgcttaggtgtgtagtaagctataccatccaggtatgtgtgagtacattctatgatgttgacacaacaacgaaatcgcctaaaggcatttctcagaccatatcccagttgttaagtgatgcatgactgttaacagcttataatgtctagcacatagtagtgcttttaaaatgttagctgttgttatttatgtctgctgtttcttgtgagctcccattatttcaatagcaattaacttcagaatgtggatgtattgatatttcccaccctgtttgagctccagttctgtatttgtagataactcccatgtatttccaacaggttgcttagcacagtggttctgaaacttcagcatgtacaataatcacaagatgcatagatttctggaccccatacccaaagtttgtgatgtctaggatagagtctaagaatttccatttctaataagttcataaatgatggtgattctgctgtccctgggaaaacattgagtggcatttaactgtatggcattcagacaggttggtggagaggaagggagaggagaacaaaagaccaaaaatttatgaaaattaagaacagagtgcactttaagctggtagtgctttttttatttttatttttatttttttattttttttttttattgggacagagtctcactctgtcgcccaggctggagtgcagtggcatgatctcggctcactgcaagctctgcctcctgggttcacgccattctcctgcctcagcctcccaagtagctgggactacaggcgactaccaccatgcctggctaatttttttgtatttttagtagagacgggttttcaccgtgttagccaggatggtctcgatctcctgaccttgtgatccgcctgcctcggcctcccaaagtgctgggattacaggcgtgagccaccacgcccggccggtagtgcttttaagactgtttagagtgtcctctaaaatgtagagaggataggactgacagaagatgcttggatttgatgaccacaaggttttcttttgtttgtttttggtgtgtttcaggtgcagattgttggtttaattatacttctcagttggtattatattatcattattgtgaccaggagaacatatcacaggtatttgaggtaatggcttttttgtttgtttgtttgttttttgagacagggcctttctgatgcccagactagagtgtagtggcgcaaacacggctcactgaagcctcaacctcctgggctcaagcaatcctcccacctcagcttcctgagtagctgggaccacaagtatgtgccactatgcccagctaatttttaaattaaaaatttttttttgagatgaggtctcactatattgcccaggctggtctcaaactcctgggctgaagtgatcctaccacctcagcctcccaaagtggtgagattacagacgtgagccaccatgctcagacatagaggtaatggttcttaatctggtgtgtgcatcagactgtcatagggagctgtttcaaacaatacacttaagtttagtgcccctccccacaatattgactcataaaatctggatttcagggtgtgggatctaggcatgaaaaaattccctggttaagaaccatctcttcagcaatgttgggcagaatatggaagaactgaaaatagttttattggtaaattgctggtgaaaggagaatagaagaaaaagactggagtttgaagatttttggagttcaagaaaatgggaatatgtaaaggtgaaaagcctgctggagtcaaggagcgattgaatgtgtaatgttatgaacatataattgatggaatacagtactggagcaggagagcaggagagaatggaattagtaggtaccataaaaagagaggagaaaggagtgaaaaaagtaagtttaaagatggaagtgggagaagctgaaagaactctctttaagggaggtttgtttgcacactactgttcttcagtggaacttaagtagtcttgaactcttaagtggaatggattttttcaagtttaataatgctagcaaataaatcaataatttcagctattccagctaccactaatggctacaagtgtatttttcttcaacttagtttgaataattattttttgaaattaagtctagacatgctgtgttgtaatgttattgccctagcccttgccgtaagactgctatatcataagtttcatatgattttcattcagttattcaacaaatatttgtatgactgtcaatggccaggcatccttctaaacactgaggatacaacagtatataaaacagttatattttattagaaatttccgcctttgaggcgcttgcatcgtatttgagggaggcagataataaagtaaatgagtaaaatataagaaatatatatataattttctatacatatacacataaatatacatatatgttaagtgacatggtgctgcattctttggagaaatacaaagcagggaaggtgaatggggggacctacaggtattcatctataggtgaatagggcatgttggagggaggtaatcagggaagacttcactgtcagcaaagacttgtagaagataagaaaaccatttatttggaggaagagcttcctaagcacagggaacagcagttgtaaaagtcttgaggtgggttctttttgagacctttcagctaaatatagcaaaatggtttttgcggctggagtagcatgaatgagaaggggtgaataataaggcatagagtcagataagcaagaaggattgtgggagtggtgggaagattgcaagaggagaaatttttgaatggggagatcaagaactacatactggccatgttgagttagagatgattatttgatactccaggtagaattcatgggataggtatgggtaaacaggaaactctaggaatggatcacaacattataagggaagagaaggggtcattgttttgctttgtttttaaattaaaaaactttagttttttagagcagtgttaggttcatggaaaaattacaaggaaagtacagagagttctcatataccccctcttcacatacacaacctcctgcactatcaggacatcctgtaccacagtggtacatttgttgctgttcatgaacctccattgacatatcattatcacctaaagctaattgtttatattaggactcactcttggtattgtacatcttatggatttggatgaatgtataataacatatctactattgtattaatattatgatatgatatagtttcactaccccaaaaattctctgtgttctgccttttcaactgcccttccttccagcccctggaacccactgatccttctactgtctccatagtttttcctttttcaaaatgtcatatagttggaattataaagtatgcggctttttcatattggtttctttcacctagtaacgttcatgtaagcttcctccatgttttttcatggtttaatagcttatttctttttagtgcttaatactccattggatgtaccacagtttattcattcacctactaaaaaatatcttggttgcttccaagttgtcgtaattataaataaagctattataaatatctgtgtgcagtattttatgtggacatagattttcaattcatttgaatacaaaggagctcaattgctggatgagaatatagtagtccccctccccatccatggtttcactttccacatttccagttacccaaggtcaactatggtctgaaaatattaaatggaaaattccagaaataaatgtcgtaagttttaaattttgtgccattttgacatgatgaaatctcgcaacatcctaccacattctgcccaagacatgaatcatccctttgtccagagtatccatgctgtatatgcctttcgcccattagtcacttagtagccatctaggttgtcagatcaaaaaaccatagcatgtataggagttggtactatccaagatttcaggcaccctttggggtcttggaatgtattctccatggatcaaggaggactactttatgtttagttttgcaagaaattgacaaagtgtcttccaaagtaacttaccgcttttattcccaccagcagtggatgagtttctgttgctccacatccttgccagcatttggtgttgtcagtgttctgtattctggccattttaatagatgtgtagtgccagctcactgttgttttaacttgcaattctctaatgacatatgatgttgggctttccatatgtttatttgtcatctgtatccatctgtatatcttctttggtgaggtgtccacatatttagtccattttcaaatcatgtttttttttttctcattgctgagttttaagagttgtttgtatattttggataatagtactttatatgttatgtcttctgcaaatattttctcacagtctgtggcttgacttctcatattcttgacagtgtattttgctgagtaggagtttataatattaaatccagcttatcagtcctttcatgaatcatacctttggtgttataactaaaactcattaccatattagaggtcatgtagattttttcctatgttctaggagttttatagttttgtattttacatttaggtatatgatccattttgagatttttatgaagggtgtaaggccatatctagattcatttttttttcatgtggatgtccagttgttccagcatcatttgttgaaaagtctatcttcattgttttgcctttgctcctttgtcaaagatcagttgacgatatggatatacctctctattctgttacatttacctgtttgtccattcttttgccactgtctttattactgtagtttaatagtaattcttgaaattaggtagtgtcagtccaccaactttggtgttctacaatattgtcttggctattctgtatctgctgcctctccatataaactttagaatcagttgttttttaaaaaaaaaaattcacaatatcacttgctgggattttgattggggttgcactgaattcgtagatcaagttggaaagaactgatatcttgagactatcgagtcttcctattcgtgaacatgggatatctttccatttatttagtcttgatttttttcaccagagttttgtggttttcccaatggagatcttgctcatcgctgatatataggaaaagaattgacttttatttattaaccttgtatcctgtaaccttactattatcacttattagttccaggagattttatttaaaacaatcaattctttggaatttttctacatagacaatcatgtcatgtgtgaacaaaaacagttttatttcttccttcccaattggtataccttttgtttcctttccttgtcttatcacataagatgggattttcagtatgattttgaaaaggagtggtgagaggggacatccttgccttttttctgagcttagagggaatgcttcaagtcttgcaccattaagtatgatgtcaactgtagtgtttttatagatgcctttttccatttgagtgagttcccatctattcctagtttgctgagagtttttttttttttaaatcatgaatcagtgttggattttgttaagtgctttttctgaatatatggatatcattgtgtaaattttcccttttggcctgttgatgttctggagtacattaattggttttcgaatattgaaccagccttgcatacttgtcatacatctcacttgatcatagcgtataatttttttatatatggttggtggatacaattgataatattttgttgaggatttttcaatctgtgtttatggtagatattggtctgtagttttcttttctagtaatgtctttgtctggttttggttttagggtaattctgacctcatagtattgccttggcttctaacttcaggagaaattgtagagaactggtatagtttattccttaagtgttcggtagaattcagcggtaaacccatctgggtgtggtgctttctgttttgcaggttattattgtttcaatttctttagtatagtcctattcacattgtctatttcttgtgtgaattttggcagattgtatctttcaaggaattggtccatttcaaggaattggtccatttcaaggaattggtccatttcatctagcttatcaaatttgtggggataaaattgttcataatattcctttattatccttttaatgtccatgggatctgtagtgatgtcctttctttcatttctgataataatttgtgtcccctctcttcttttcttaattaccctggcaagtttattgaattcattgatcttttcaaaaaaccagcctttggtttcatttatttttccctattgattttctgttttcagtttcactgatttctgcttcaattgtattatttcttttctcctatttacttcaggtttaatttgctcttctttttctaatttcctaggatggaaacttagatgattgatttcagatctttctttttttctaatgtatgcattcaagctataaatttccctctaagcactacttttgctgcatcccacaaattgtgacaagttgtattttaattttcacttagttcaaaatatgtttttaatttctcttgggatttttttcttcaataatccatgtgttatttaaaggtatgtagtttaatctctacatatatgggggaattccagctatccttctgtaattgttttctagtttaattccactgtagtctgagagctgacattgcataatttctattcttttacatttgttaagatatgttttatgtcccagaatatgatctgtcttggtgcatattccacatgagcttgagaaaaatgtgtaattttctgttgttggacgaagtagtttatatatgtcagtaatacccagttaattgatggtactatcaaagctgttgagttcagccatttccttactgattgtcttcaaataacactataccccttcatgggtacaacctctttgtattgcaacacctttcctacaatggcaaagtgatttggttatcctgaaaacctgagggaccatagaaataatgttgccattgcaagttgctttttgaatctcctaaggaaataactgtatgtcaaaccttagttcagcatttactgaacacctttggtatgtaaggggtgtgtgtgctagctttaccttttgtaaattagcgacataattacttctcaagatgtcattgggcataatgaaatgagaatcaaagtgccacagggctggggtaatcatagctcttaaaaatgctcaaggccgggtgcggtggctcacgcctgtaatcccagcactttgggaggccaaggccggcagatcacgaggtcaggagatcaagaccatcctggctaacatggtgaaactgcatctctactaaaaatacagaaaattagccgggcatggtggtggtagcctgtagtcccagctactcaggaggctgaggcaagagaatggcgtgaacccgggaggcagagcttgcagtgagccgagatggtgccactgcactccagcctgggcgacagagcgagactcagtcaaaaaaaaaaaaaaagctgaataattgctattctttctccattattgtggggtaataattggtatagttattttcaacctcattcaaataccgatgatgagtttttgatagcacttgttatcttcttgaaaggcttgcaaattaaatgcactagaattaaaataacaatttcacaatttgaacttttaggtacattttttcagtgcctcagaattcgtaacctattatttctttgggagaacatgttatattttaatctttgagttggagtaagttgtctgtggtctatttcttcccttctttcaaaactgtgtctgagatgtgtgttgttttctggagtcctagttaacaaaacacctcctttttcagtgacaaagccttgttactgaaagcactttatgttctgtgaatctcctccaatctgtccccagtgtgcttgttctttgtggtttggtttctaatattatgcattccaattttgtaaaaaaatctatatgagtaacttgccacagtaatcctctctgacatgtttgcttcagggaaaaagcaggaaaagtcagaaacgtaagcctaggtttaaaatttgctgtcgctgcaaaaaagtgaatagaatatattccaagtttctttttctgtattagtattacctatgggaccagaataattattttggcaaggatatagttaatttcctgtgtaattttatcctgcttcagtatcttagtcatttttcctttgatttctcaaaaaaattatagaagtaaaaaaagaaatttagttatttaggtttataaacagtctaaaaatacaaatatttttgttgcattaaatatgaactatagtataaaataaatacatgtgctctttgaattttaaacttcctttaacttataatgcaaatagtagatattaatatgtacttttttatatatttcattctctaaactatgaatgttaacacggtttatatacttgacctttgcaaagttttgaacagtccactcctactgctgttgttctagcattatttccttcctaatatggtagtcatttttttttttttaacttttctccccagtcatttctggcctgtccttaacccaagtctgcccatccacagatattgaaagcttccaaccttcaggaactacccttcacattactcctagaaagccccatctagccctacagatcaaactgttcactttcaaaggttgtttgtgcctaacctttcttctgttttttctgtttgcattcctcatttgcatttcagttcttcaccttttaactgaggctagttttctgccagaatctcagccccatttaaccaggggtcagaccatcatattgtctttgtctacttggtttctggttggttcccactaccaggaaccaggatgctgaatatccctagaatccttaccgttggagtgggtggactctagtctacttcaactggggctgtcaagaggaaaaaggtgtcagagtcctcagcagactgggagggggcctggagcaaatcctgtgttaaaatgggattttgttttttcctctgcgacccaaacccactcttgacagttctcttcttcacatgagagtatagtgattgttcgttattcagaagattgcccaaattattttttcctctcatctgttgagcaattcctggccatatggattatcttccttagtaataatacgaatgacaacaataataataaccattctatgttgcactagatattttatttttatcatttttattaccctgtaagatatatggcttttatctccattttctagtaagtacattgcagttcaaagagtttaagtgcccaagctcactttggaggtatacagtagaactgaaatatcaaatcaggtttctctgacattacagcatggagctttttttttaggagacccgttgcatgaagcatagttttgggctgtctcttctcattctcagtttcatacagtaagactttgtgtttacgaagataaaatatatattgaggatttactatgcatgcatttcatgcatctagcattatgatctaacatggattagtgcttgatgaatattaactaaaggaatgagaggagactctaaatttgttagaaagggtaatctccctgtgcttaacacagtggcaggcatatggttggtgctaaaaaatatttgttgaattgatgagatcacctactcaggtattgttgaattaatgatattatccactatatctttccattaaaagagatgactgtgaatttaaatagctgagccattgatccagttgtctagtaaaggaaaagatcagtttaaatggatgttttttcctttggatgcctgaaagtgtacttggtatcatataatgaattctgcttccaaaagaaggctgtcacttacttgtttcatcttacttgacctttcactcattcaccccccaaaacttcttccttgacttttgcctcttccctggataatgccattaattcccacaacttccacctcattcttcacactgaaaattctcacatctgtacccagtcaaaatttttccctgaagatccagaggcatatacatgactgcctaccttaaagtaaactgtctaaaacagaacttctccccctacctaacaccccacctatatgtctgctttttctccttttttttctcattttgttaaatagtgaaggaggccctgtatttgggataaagacttctggatcctgggtataaacaggaatgtgaccacatgggattccctttgccactcctttggagaaatcacagtcctggtgctagagttaggacccctatattaaggagctaatggtagtctatatcaccccctccaaaaaagtttctgcttttttttgcttttctgttaaccatctactcctccttgctgatacaagcagggatgataagaaagtgagccctctttctcattacctccttttctcaagcatatgtgagagaatgcaatctgattatcatttataggctctcatcccaaacttattttaaatgcaaatcttgagattaaaaccattttatcttttatctaacattggattgactgcaataatcatgtgatttcatagattactttgagagtttatactgcactctaggtttagatatcccagtgtctatctgtagcccataattagtgaagacaataatattctcttgaatttttattgtggtttcatgtccacagaacactctcaaggcttgtgtggattttttccccattctccatttctttcttagctggataataggccacaaattgttttatggattccttttcgtgttacttcccatcttcacaaaggtagagttaactctcacctccctccctggacctatccacggtttaatccttcttgtgctgtagttactggacttcaactgatggtattaatgttttttcatgttacattgctacaatggcatgtggttttgcttctctttttttccatcatcacacacttggcaggaccaatttgtctaaaaccatatatgaattgtctccaaacagccttatttaagtcagatgttgtctctgtaaaacgttggcaaagaaaagtattcccttcctacatatagtcatattaaatagaactttgtgaggcattgcattctttttattccaaaaatgtttaatatagctccatatgtagtattgacggaagctatgaattctattaagatggccaaaagttagtgaacttctgccacggaccctggtggactgaacaaaggaggacaaatgcgggaataaagacaaagacaaaagagtatgtttggaagaaggagtcgggggctccttgcttctggtgaacaagggccctgagcttctagagcccttcgtatttattgggtaaaagaaatagggagaaggggtggttgtcagtcagctgcttgatttagtgcaggcctgcatgactactttctccagatgttccagtagataacctcaaggagcatggcaccaggaagtgactgccctcagcataccttctggtggcaggtgcagatgtgagtttgcccacatcctgcattcatgataaacagtttgctgtttgatcatatagcctccagtggaatgctgagttggtcagcattcagcttacagctcccaacaaacttctagcctcctttttggtataggtaaatcttagttgctatataataatctgttatctgtctgtccatatctgcatttaaagaaatgtgattaaaactcattttgttggaggttctccagccagccagggttaaagcagagtatttcagagagcactgacttgatcttattttatagcttatgttctagcactttcttgggtagatatttctcattgtagtgcctctgttgttttagaaccattgcctttgatttgaccagaagcaacagcattattttcagggagtattaccagaccttaagggtatccttctgtgggaccaagagtgtgtggtgaggtagtacaagtgcttccttcactgtgcatagcaatatcctcccacaaataggtcccctgcttcaggggtgcctgtattttgagtgattaattgcattagcctttatggtaggtgacaggatattctgttcaaaactttatgcttaccctactccactaccactttcttttaactaattcaagtctcagccgagactgcaaaaattttgaaattaaatgttattctagtacttctggttcaccaaaaatcaggtaagttcagcatattacagaacagccttgctgtgcagcactctgacaactttgcacaacataatataggatatgggggcaatgcttgactgtagtctgacccaattcttggtgaaatgccctgcaattctggctagagcaaggaagataacaagcctggtaagctgctgtgagacagtttctcatccctgtcatgtaggaaactgccataataccatttctcacccattttctagtttcagttgaatgcagaacttttcaccttataccctgtgtgggataagcctatgaattttcttgggtttagtttagagatggctcttcaacagcaccatgatccattgcttggaccatttgttatctgtatcttctagtttggtgtcatgatgtgagactagggacttggggaactgataccatgctgatttagctttcgatgtctgtgtaagtaatcagttgtctgaattcatctgggccaaatctcctttaccagccaaatcaatggaagtgtggcaagccaacctaacagctgtatcagtaatacttgtggccctgttagccatcacattgctgctttggtaatgtttaactgtgtaacaaagtgggactcttactgaccaaacacccagctagtatatgtactatgggatattccttgagccttctacttgtctctgggcataatggagcccccagtttggcaggtggacagaggccagagctgtatatcagaattactctgaattgcttttctcacattgtcagcccaaggaagataccaagacccgctcattggaaagtcttatttacacaactagaagggccataccaattctgaagctgccctcacacacacatctacctgagtgtggtaagaaaggaagcacagtaacagtgtttgggcctactcagaatggtgcactttgaatatgtggttgcctcctgctcgtcaatcctgtggtctcctcagtctatggtgttttgtgtttcaaagaaaccaaatgtttgaccatataagcatctgtaaaacatttctagtttggcataatatctggaaaaaatagaaggcaacatggagaataatctctaaagtatacatttttgtaaaaaaatatgcaatacttgattttgcattatattcttttctaatataggcatttaaggcatttttgccttctaagcactattttaactgtgtttgtagattttgatatgtatttttattatatttagttcaaaattttgtctactttctcttgtaatttattctttaattcaatgattaatttacaattgtgtttttactgtccaaatatgtagggttttcctggttttcatgtaggtaaatttgagaggaaaatgttaacatagcagatctgtgttaacattcagcagatctccttcatatctccaagggaacttggatcatgattgactcttgaccagccactgggaatgtgaccctttggatgtcttttacataaatggtggatttttttttttgtacacctggagcaatggactatgtaggtacctgcttgtcaaaattgctttgtacaaacatcaagattgataaggtatacctagtttctaagtcttggttattgtggctggtcctatagctggatatgcctatatggccagccctctataaaagctatgaatgctgagacttaaatgctcttgcgctcttcttcaaatagagatattctgtatatgttcctgtattgtgctactagagagaaagcacgtatagaaagcctatgtctgacctctctgggttctacccaatgcatatctttttcctgctgcttttactctgctccttttgctgtaatacattttagccttgattataacctaatattgagtcgttttgatgaacctcgaacttgagggtggtcctgggttccccaaaactgtattctaatttaattctattgtggtcagagaatacactccatatgattcctttttttaatgttgagacttgtttcatggcctagaatatgatctttcctggtaagtacatcacatgccctgaaaagaatgtgtattttggcattactggatgtattgttctatgaataccagttatataaaagtagctaatagagttcagatcttctgtgttttgctgattttgtttttctagttcagttaattgctgaaacaagattgttaaaatctctagttatgattgtggaattatggatttctgcattcaattctgacagttcttgtttcatgtattttaaaatgctattatgggatccgtatgcatttggtatgatcttttctattgaattgacccttttatcattatgaattgttcctctttatctcttataatacatttgttttttatatttgtcttctgatggccattctagctttttgcttaactctttgcgaggtgtatcttttccatctgtgtactgttgacacatctgcatatttatatttagaatgaatgtcttataaacagtatatagttgcttggatttttaaaattttaccttctgataatctctgcctttttaattgaaatctagttcagtaatttttaatataactgccaatatagttaggtttagacctaagatctgtttttttttattttctacatgcctcttctgttttttcttcctcttttccagctttttttaaatccgtaaatgttttcagaattctattttatttttcctattgatactctagctattcttttttttgtactttttttgatagtggctgccctagggattataagatacagccatagctttcatagtccacttacttagttaataatgtgctacttcaagtaaaatatggaaatcttacaaatttccaggcccacacccctattcttttgattgtagttattacatgtaaaacaaactcccctctactcacacagcccacaaggcactattatcattttacttttaaacagttatttggtttatatagaggaaaaaaaggataaaatagtattttgcattttctccaccatttaccctttctgattttcttcattcatttctgagtatcccaattccatctggtatcatttctcttctatgtaaataacttctagcatttcttatagtgcaggttggctgatgacaaatgcttttagttttatgtgaaaatacctttatttcactttcacacttcagtgatatttttgctgaatataaaattctgggttaacatttcattttttcatgctttaaagatgttttaacagtttttcagtcctccattttttttaatttaaaaatttaattgatgaaaattacatagatttgtgtaagatgatgttttaaaattgagcttgttaacatatatgcattaccttacatgtcatttttgtggtaacatcacttaaaatctactttctcagcaattttcaagtatataatacattgttattaactacagtcaccatgttgtacagtagatctcttgaatttattcctcctgtctaactgaaattttgtatcatgtgaccaacatctctttgatcttcccccacccagttcatgataaccacctgatatggtttggctgtgtccccacctaaatctcatcttgaattgtagctcccataatccccacgtgtcataggagggacctggtgggaggcaattgaatcatgagggtgggtctttcccatactgttctcctgatagtgaataagtctcacgagatctgatggtttcatgaagggcagtttccctgcacatgctctcttgcctgccatcatgtaagacatccctttactgcccctttgctttctgccatgattatgaggcctcccaaccatgtggaactgtgagtccattaaacctctgtttttttttttaataaattacccagtctcaggtatgtttttattagcagcataagaacaaactaatacaccaccacttactctctgcttctattagttcaacttttttaggtttcatataaatgagattatatgatatttaactttctgtgcttggcttatttcacttaatgcccttcaggtttatccatgttgctgcaaatgacagggaatcctttcattttaaaggctgaaatagtattccattgtgagtatataccacattttctttatccatgtatctgttgaaggatacttaggttgattctgtatcttggctattgtgaacactgctgcaatgaacatgtgagttaagatatctctttgacatactgatttatatttttttggatatataccccatagtggaattgatggcgcagtggcccacctagagcagtcgctgccatgacactggctgcagtgggggaggtacgaccaaggctgctcactccatggagccagcaggggctgggactaggcaggagctgtgccctccagggcacagctgtagccacccaagtcatggctgtggacccaggacttcctgtgcccttgggggctgggagcaggctggagccctaccctcctgggtgcagctgcaactgcccaagttgtggctgcagacccaggcctccctgtgcaccttggggccaggagcagacaggagccccatcctcccaggcacagctgtagctgcccagccatggctgtggacccaggagtctctactctcagtggtctgggaaggccccccatgcgcctgccagctcagaagtatctgctcctgctgcctggcctttccccactcctggtacccactctgatctcagagcaaagttgaggctgagcccaggcactgttgcaactggccaggtgggtgccaacgagcatgggagggaggtcaagggggagctgagagcagtttggtgctggcgtgcaggcacccttcagcacaaacagcctggatgccatgaacagcggcaggaggcagacaggctcctgagtagaaagggataggtcaccagtgaagccccaccttcaagtcagggaaggcctgaagcttgggagccaggctgccagtcacacagactggagtgggaacttatggtgcttttcccagcccacccatagccactcatggactagttagtcagcatgcacttcctcccctctgaagcacataaaaatcccagatatcaaccagactcaaggaaaggatgagatgtccagctgtggagagtagctacccactccagggtgtcctctctgctgagagctgaacactcatcaagacaccctgcctgtggagaggagctacccaatgtgggtctcctctgagctgttctgtcgctcagtaaagctcctttttgccttgctcgccctccatttgtccatgtacctcattcttcctggataaaggacaagaacttggaacccaccaatggcagggcaaaaagagctgtaacacaaacagggctgaaacacactccttgctcattacgttgtaggcaacaagaaggagagaagagagaaggagagaagagctgcttcccttctgggagcccagacctaggagttccctgagccagggctgtgacaccctgtttgaggcgttgcggttcctggcatttccaagcttctgggtgctactgtgttccctggtgccagccgtggaagctgcttgcagtacgcctggcccagccacagccttgcagggagccagcgcccatgccagcatctggagtttcctgccccacttcagccagcatgcctggctatgcacagaggctggaccctatacttgctcacaacgctcctcaccgctctatgcctggcttgcccttggcaggcttgggagccaggctggtagtgtgagccgagtgtagcctgccaggctgagtgggtggaatgagctcagcaggcccaagtaaaactcaggcaaagatgccactggccacagaggtttctggctggtgaagcaacaccacaagaatcctgtgacagaactgctggatcatatggtagtactttttaaattttttgaggaacctccattctgttttccaaaatggctatactaatttacatttccaccagtagtgctgaagatttcccttttcttcatatctttatcaacacttgttgtcttttactgttttgataagtgctgttctaataagtgtggggtatgtctagttgtggtttcaacttgcatttcccttagtgatgctgagcatttttttatatacttgtagactgtttgtatgtctttgagaaatgtctgtcaggtactttgcccattttaaatttaagttatttatttttgagatggagtcttgttctgttgcccaggctggagtgcggtggcacaatctcagctcactgcaaccttcgcctcccaggttcaagtgattctcctacttcagcctcccaagtagttgggattacaggtgcccaccaccatgcccagctaatttttttgtattttcaatagagacagggtttcaccatgttgaccaggctggtcttgaactcttgacctcttgacctcaagtgatccacctgccttggcctcccaaagtgctgggattacaggcatgagccactgtgctgggctaacttcgcccatttttaaattggactatttgttttcttgctcttgagttctttgagttccttatatattctggctattaactccttatcagatgtatagtttgcaaatattttctcccatcccatgggttatctcttcattctgtttattgttcccttggctgtccagaaactttttagtttgatgaaatctaatttgtctatttttgtgcttttgttgcctgttcttttggtatcatattcaaaaaactattgcccagaccaatgtcgtggaccttttccgttatgttttctactagtaggtttatagtttcaggtcttacctttaggtctttaatccattatgagttgattattgtatatagtgtgagataatggtccagtttcactcttttgcatgtggatatccagttttcctatcactatttattgaagagactctccttttcccattatgtgttcttggcccctttttgaaaaatcaattgaccattaaatgtatgggtctgtgtctaggctctctatcctgttgtatttgtctatgtgtctgtttttatgccagcacaatggagttttgattactttagctttgtaggatattttgaagtcaagtactgtaatgtgtcaagcttttttccccctcaaggctgctttggctattgggggtcttttgtagttcaacatgaattttaggatcattttctctatttctgtgaaaaatgtcattgaaattttgatagggattccattgaatctatagattgctttgggtggcaaggacattttaacaatattaattcttccattccatgaaaatagtgtgtctttccatttattcatgacttttccaaattttttcaatgttttacagttttcagtgtacacaacttttacatccttggttacgtttattcctaagtgggatttcttttttggtagcaactataaatgagattggtttcctgatttattttgtaggtagttcattattagtgtatagcaacactactaactttttaatgctgattttgtatcctgtacctgttttaaccaaatttgtttattacttctaacagttttttggttgagtccttcaggttttctctatataagaccaatagtttaactttctattttctgattttcattcctttaattttttttctcttgcctaattgctcttgctaggacttccagttctattttgaatagaagttttgagaatgggcatctttgttcctgatcttagaggaaaagctttcaacttttcatcactgagtatgctattagctgtgggcttgtcatatatggcctttattgtgttaagatacattcttctgtacctaatttgttgagagtttatcaggaaacaatgttgaattttatcaaatgcttttctgtatatattgagatgatcatatagtttttgtctatcattctgttaatgtagtgtgtcatatttatagctttctatatgttgaattatccttgtgttccaggaatatattccatttgatctggtgaatgatcttttaaatatgctattgaattcagtttgctagtattttgttgagtatttttgcatttgtgttcgtcagggatatttgtctgtaattttattttctttagtgtccatgatccatagtttctgatgagaagttaagcattaactgaattgttgttttgactgtgatatgtcatttttctcttgctgctttcaaggctctttctctttgacttacagtggtttattatttacctcagaatggacttctctgtatttattctgctttgaaatcatttcgtatcttgtatatattcattgctatcattcatcaagtttgggaaattttcatttattattacttcaaatatattttatgtcccattctatctcctcttctactggtatactaaattcgcttatgtatgactgttcgatatcatctattaagtttttgagcttctgttcaatttgtgtcatttttttctctgttcttcaacttgtgtaatttctattgatctgtcttcgagttcacttattcctgttatgtccattttgctgttaaatccatctagtgatttttttcataaattatattttgtattttaaaatttccttttttattgcctttatttctctgctgaggcttcctatttctctactgaggttttcatgaattgataaatccaaggtctctgtcataattgaggttggttctgatgttctgcctcatcaaactgtgcctttttagtatgctttgtgatttttttgtcaaaagctggaaatgatgtattgggtaaaaggaactgaggtgaatagacctttagtgtaaggttttatgtttatttggttagggattaagctgtgtttagtattttctgtagctgtaagtgtcaggaaataaaatatcctctgctgtctttgttttttacttccctgttacatttgagttcctctagcaactttttcttaagatctgagatatgtaattctttctgttgtatccccctgttattatacaggatccctattgatgtagtaaggtgtagggagagaagtgttctatggtcctatgattgggtctcaatcttttagtgagcctgtgccctagactgtgaccttcgcaagtgcttctcagttttgctttgtttttcccaccttaggtgaaataggaaggctaaatggggacaggaattgggcatttccttcttccaggtcagttaaggtctgctaaatccccagttggttatgttctagtaatatagttgggtcctctgtatccatgagtttaacacgcatggattcaaccaaccatggatggaaaatgtttgggaaaaaaagcaataaagaataacaatacaataatacaaaataacacaaataaaaattgcagtatagcaactatttacctagcgtttatattgtatgaggtattataagcaatatagagatgatttaaagtatatgggaggatgtgcataggttatgtgcaaatatgacaccattgtatataagggagttgagtatctctggatttaggtatccgtggatactcaggaaccactatagtttcacctgagggcaggccttggtaagaaagagaatgttcttgagtgcttcataaaatggcttttttttaaactctccctgcctgaagcccaaaataatttttcttttatctttactgtaagaacctgatagggttcctggagctaaaactcacagaactgggtatgggtctaagattgggcctccctggagtttctaactctcaaactacagtttatgttttcttagcctgatactggttctggagttttctcctgggcttctgcttcagaaagttggattttctgtatctgcctgtctgtctctatagtttgggggcagtgatttgccctgtaattgcaacctctaatggatctaggaagagttgttgattttcactttgtttagcatttttcttgtgaggataagagtgataactttcaagctccttacattctgaaccagaaaatgaaagtcaggttttcatgaattagaaacatgtctatttgcatttcattgatgataaccagtttaaaatcttcatgttacttccaacatctggttcatcatggagttggactacatcgattttttttttcctgtttatagtgtgttctattttcttgattctttgtatgctgggttcttttgagttatatcttagatattatgaatgctaaattgaggaaattctggattatgttattttcacccaaaaagtattggttcctttgttttagtatctagttttgttgactgggcttgaacagctaactctatttcttttgcagcagctcttatcttcattcagatctttgtttttggatgggctgctgaaagtctggactgtataagcatggttcagtgtttagtcagaaatgtgagtgtatatatatatatatatatatgtgctgaggagggagaggatcctataggttctgagctcatcatacccagaaatggaaagttttcaggaatatttccttgcgggcaaaaaatctctgctttactgaataatctcttagcaaccaggaccatgtgttccttcagtaacttttggtgaggtagaatcttgtgatgtcccagcctcttgatttccatataacagggagtaggggagggagacattgtggagataatcagaaacctttggaggctatgagcaacctatataatcccacctccctcagttatactgaaatttgagtagcttttcacagaatctgtaaattttttattaacctagttaggacttttttgagccaaatgctcatttctactgttcttaatacaatgcctgtcacaaagttaggtattcagtaaatactagttgaatctattaattagggattcaccataaatttctcgccactaataaattacctaagtgtgaacgttttgtttatctcggaaataagatgattaaataaaaatatttgcatatttttcatcttgcattcatgttgatacacagccaatatatttcaagtcattttaaataaaagattaatctgtccatgatatactttgttagataaagctatttaaatgaattgtttttggataaatcctgtaatggtgttttctacttcttctttttaactcatttgttgaaagacggtagggaatagtggaccaggtaattaaataaagttcatgttgtagtttctgcctcatatgatagccaaagtaaatgagattattaacatgaacactttaaagatgtgtatcaaaattaggaggcttatagagagtctcaagtaattaagtgtgtagcgtagcaaataatgactttctctaatattggggttaagatgttcagcagagtatgaattataaaatcctcaaaatacaacttgaaagacttttgacttttagcccattatcctcttgttaatgcacatgtaagagattatgtggggtttttatgtcattatggcaaattataggctgtactataggtgctattcagtattggatacgaatgagttccaagtagctttgttgatctttcactaaaactagggatttggcattgacttatcagtgtgattattgtaaaagagatgtagtgtggaactgtttcctgagattaatccaagtattcagtatcataatttagaaactcccttcagttatctgccctacgtctccatttactcagtaatgtacgcagactgggaaaccttaagaagggttgagacttctgggttcattacagagctgtgggtagccatcttgctgttgttgactctagtgacctgtaactacagatcaagctgtatgcagcctttttctccttcaggtaagttgggttgaaatccagtgctccaagctgctctgaggctttaattgcatgagtgaacactgaaaatgtgaaaaacaattttagaccagaatagcaaggtgagtaaggccaaagaatgtattttatggatattcatgaatgtcacccacagaattcaatattttttccagacgattctgaaagattataatttaatggatgtttgttttattcttctgaggacccagttgaaatcctgttgattctgtagcagactacattactatcctttgtcttactcttatatctctgaggtagatgaatgcttcagaggtaaggtgttatattttcaaaggacttttctatgtttcgttgtatctgtgtgatcagaaggacagggagaaagtctgttttaaaattagcagcatgagatattagaatcctataatgcttatatgaagtttggtgaaatggttagccaaagagaattttctcctcagactagtaactaaattgatatgtaggagcagcctttcctgagtgactttccttgatagttaaaactgcagcaagacatttcagaagcagtttccaaggaagtgaatggatagtgaggtaattttcttaagtacttggattctgattgtctccagaggttttgaagctgttagttacacaatagacggatttgatctcctaggatctttgccaggttcgtaattgcactgagatttttaatgataacaaatgacaacatgatgtccttctctttattctgggagtgaggtgatttgtacataagaaacaaaattaggttttagtttgaaaggcttggagaatcagacttcttttaggccaaatacagtggtatatctgagagaagagttatacagccattgagttgtaattgcttgattcattaaggtatccttgaaaatcattagactgtcagcagcatgagggcaggttttatgtcattttggtaatcactgagtcctagcacaatagttgactgtggtaagtccttatgaatttttgttggaagaatgggaagtatattgaattgcgacatctttttgctttttttttttttttttttttttttttagcatgggattagaggcagcagttttggacaggaggcaagtcttttggccttctgctcctggcaggcaagtcttcattttttaagactctcaagtgtcaccatgtttgtgaagacttcttatcttttctaggtgcaattgacctgactagtcttcctataatgtgtcctttacttactgcttttatagcgtctgtgatgggtttattgcatttttatttgcttctttctaccatagtagaaagtgcaattattattcatctgtctattcctggtatatatattagtagaaaaatgttccactgcaagtaacagttagcaataattatcggccaaggaagttaatctcagaaaatagtaagaaatgtgtataaaacataggtagatatatgtttagtgctatttataatgaagaaatagaaccatcctagactaaaaccaatagaggactgattaaataaatgataaatatttatataaggaactatgaagtcacaattaaaatttatgcattttccaaattgcctgccttaagtatatatgagtttggtgaacagaaaatattcctgacccatatcatacaataatctgtattcaacccaatattggttttgtgttatagataaagtaaaaaaggagcagtaaagaggaaaatgggaaattaaaatattgttcaaatctacagtgaaataaaggtagtgaagtaggcaactggtttgtttagacagtccaggggatttggtatcttattcatcagttattgagtgtattctctgtgccaactaagtgttggatgctgtgacaaatgcagataggccaagtcatggcctcctccctcaaagaacttgcaatctggggagaataatatacacacagaaaatgggggagcaaacgaaaatgagtactacagatttgaatgccatagatattcagaggacagagtgattacatcctcctgggctgatgaagatacatttctaaggaggagaagaattatactgtaattaacagtggctttaggatttaaataaaaatggaaggaatatcatatttaaatgaaggagaatggtgtgaacaaaggcatggagatgggaaagtagacagcatttgcagagaactagcttgactcaaattttaagattcttcttgtagtagaaaagcaaataaaaagggccagaactccgagagcctgtcttagaacctctgattcatatttgcatgcctttatatttgttgcttttaatttgcaagttgcaaaaatgggcattttaatattagaaaatctactgtaggacagtaagctgagagctgataattttccattcttggttcaatactttagtgaggacaacattagattaagaatcagacctggaatgtggtactacaggttataataagtagtagctctgtaaccaaactaagccttggtttcctcatctgtaaaacaggtatgattattcacctctctggactcattgggtttttaatgagcagatcaagtaaaatggtatgaatgtgcttgatgtagagctgggggagcaagaaaaaaatcttcagacagaactccctccatacctctgttcctgtacctcaactctgatgaaaagatatgtaactaggggaaagaaggaatttacagatagatttgaatccacctgaaaatggagtactaaagtggtaatagtccagaaaatgttccctccacccagtaccatatcctttagtacattgtttcccgacagttagactccagtataaggttttggggatactttttagctataaccatataataacaaacatcctattttcttttggctgattgatcccagggctgcactgattctgtaaaccaacttggcaggatttccacaaactgcttctggggagtagtaattcttagggaaccaaggctacccccaaatgaactataatactttgcccttaattctttagaatggaacaataatcagaattatcttggcccatggagttgcttatcagcagttctctcaggactgctgttctttttggagaagggccagtagagtgagtcagatcttttatgttttgtttatagagtgaccatctgacattggtctgaaccacccaggtgcaatgagtttcctttggcatgatcattccactaggtatgctttcgattgtgtctaagttgttttaagaagccatttgagtgggccagtttctaaatatgttatacaaatacagagtacattgcttctatgctatcttgcccttggccgacttataagaaagaagttataagaaattatggcattaaatgtgttattgtatatactataaggatgttgaagacatcattcattacatttcttcttttgaggacactggataatttttctgtctaatctcgaaatcataagtaataaagtttctgggcaactggtttatttttatcttaggataccatagctcatgtaacaaattatttttttggcattggctactaggaggtttaccccttactttgtcaaaattacagaaccttctatatcctgtctctgtcttatctctcttattattgatctttccctttgtcatgtttttctcaaatgcttatttttaaacttttattttatcttcttttattacatgattttgtgtaaatcatgtttaattctttccagaacaggcctacctagtgtgaataaagtgaatttgatacagaaatattaaatttaatttgttgaattggtgtacatatttccttttttatcatgatttggtgataatctaggacaccaattaagtgatatccagaaatatataacaactgaaattttatataagataatttgtgaggtaaagcaacaattgatcatatgcatataataacccctgcaatgaacaaacaaagtgtgcacagattatatcttggccctttcttctcaagcttccctgagtcttcatacatttcacctggaagccttttataggagaggaaacatactcctaaaaatatctcacagttggtgaaggaacagaatggacttgtctgttgtgtattgcctggtcggaatcaattattccacactcaccctttgtgatctaactctttcactgccataccatctccacttcactataggaaagcttcaatttttgtagtttatttcagttaagtattaagaggcaggctggttaaattaattgacacatgtgaagagctgataacccccctgtttaattttaccagtagtatgcacgtgcttgccccaaagaataagatagctctgtctccagatgtcttgatctaggttttcacactcttcttccccaaggaaataatgtagcagtgtactaagatatacacagctatgtgtatatcttgcagctatagatatatatgatatacacagctatgtgtatattttgcagctacaaaaatataatcaaatcttaaaggctgcataattttccagtgtatggatataacaaggtttatttccaaatggtaaaacatttaggaatggttaaattatggtacatgagtataatgcaactattaagaatcatgtttataggaagattcttataatgtatgaataaaaacatagaatacaaactggaataacatatgagctcaactcattaaaatatctttttaattcaatagatttttgcatgtctagtatgtgtcaagtttagtgatgcatatgaggaaataacatcaaataagatacacatgatttctgaaagcattaactaaaataggacatcattacaaaatcaaatctccctttgaggattggtcatttttaatcaaatgtgattaagctcattttctagtttgtggactttccaggacccttgtttcatttctcttctgctttctctccgagaattcatagcactccagttcaattagattgagttgaagagtttaaaagcaaaagaaatcgataattcaagcctagaattccacattatttttagattttctttacctatgtagttagtgtaacctaagaacatcaccttctcccaggaatccatccttgtaattttgtctgggctacttctgcaggaaaagatactagtttgcaaagggaaaaagtgcttctgcacgtgccttttaattttatattacaaacaaacccacactcatgcttttatgagatgtaattcttattgttatgtagctttaacaatttaattttttgttgagacaaatttcctttgaataatttttaatgatatttatagaacatggatctttacttagaaagtctttattgaacatgtaaatcttatttaagaattcatcctgcaaaatatatattcttgagaattgaggctaatgttttattatctctgtcaagtcattacattttggttctcctggtagttgtaatgtgatattcttaaacattcactacagtgacatgatttagtatctagtgatgcaacagtgttacatctcacagaaataactgtgtccttctaaggcctcagaggcatatcacatttgtcccatatgctatttgcaatgatttctcaatgtcatttttttgtgacatgcttatacagtatgacaatgtgagagttaaaaatgtgagaacctatttctctctggttgaattgtctatattgacctcttgaagtaatttagtgtatctgaccttatttattttaaaattaaaatacctgaacttcttatatgatcacttttaaaacaccagattgttacatttggagctaaaattctgtgctgtggtatgcctaagatgatacaaccaaagccacattgtttattctactttttcacttatacatggtgtccattatgcattgatcttgtccagcaaaattaactttttaaactgattgttctgctatctgaagaatcttactaaaatttaatcggtaaactaaaaataagcacctaatgccatagtgcattctggtaactcataaaagaaaaaaaaaaaagaaactaaagcctaatgtaggcttgtgaggttaaaggaaggttagtatatacttactggccattcaagggtatatataaatgaccatttttcctcttttgagaagggtgatataatgcaaccacacttacaagtgatatactttcccgtttgcagaatatttactgttttgcctactatcactgaactgccctgagttatataccgctatataatagggttaaaactcatccgtgtcccttcatttccatggaaaagactttctggacagtggctaaggctaacataagattcttgagctatctcctatgtgtggcttacttcccacccaccaaaatgaagcaaatcctgtccagatgcattgtcttcataatggcttctctcttttttgtctcatttctaccttaaggattccttctgccttactgctgttcttatttctcttatatttctagaagaggcacgtaactatattcctactattagttctatcttccttttattttgatgactgttctgttgctccaagactcttattttcacaatattatacagaactcataagtttaggaaattatggcctttagctgatccaaaaattgatgtatgtttaaatggacaaaagacttgaaacaggcacttcacaaaagatattcaaagggccaatgtgcaaaaaggtattcattttcatcacttatcaggaaaatgcacaatgtgataccattaccccctcaagagtaacaaagatgaaaaagacaataccaagagtttgtaagaatatagagatatagaataattgaaactctgctgggagtgtaaattggtacaaccacattggaaaactgtttagtagtaatgagtagagctgaatataggcagcatgtgacccattaattctacttctacacccaacagaaatagaaatataggcatacacccaacagaaatagaaatataggcatacatccaacagaaacagatacatagtttcatcaaaagacatgcacaagaatgtttacagcactacttgtaataaacctaaacttgaaataacttaaatttctgtcaatagaatgaataaataaatggggatatatacctaacatggaatcagtagtgagaatgaatgagctacaactatatgcaacaatatggatgaatcttacaaacatgatgttgagcaaaagaagcttgatccaaatgagtacatactatgattccatttatatgaaattcaaaaacacacaaaacgtgtaataagtcagggtagtcgttacccttattaggaattagtaactggacaggaagcagaaggagggtttctggggtgctagtactattctgctaagtgtcttgatttgggtgctggttacctgggtggactcactttgtgaaaattcaacaaggtgtatactaatgattcgtatacttttctgtatgtatgagatatatatgtgtatatatatatataatataattttacaaaagagcagtactatatgctgtattatttatctaccactgcataacaaattaccccaaaacttagcagcttcatgtaataaacatttgttatctcacacagtttctgagagcaatctaggagcaactcagctgggtggttttggcatagggtctctcatgagattgctatcaagatgtaggctggggctgcagtcatccaaaggcttgactgggcctgaagcatctgcttccaagatggcttccttttttttttttgtttttcagacggagtctcgctctgtcgtccaggctggagtgcagtggcgtgatctaggctcactgcaacctctgcctaccaggctcaagcgatactcctgcttcagcctcccgagaagctgggattacagatgcctgccaccatgcctggctaatttttgtatttttagtagagatggggttttgctatgttcgccaagcttatcttaaactcctgacctcaggtgatccaccggccttggcctccccaaagtgctgggattacaggcgtgagctactggtgcccagcccaagatggcttcttcatgtacctgttgagggatgcctcagtgaaagctctttgtattgccagaggctacaaaataacctcacagataacattttatatatgtataatatgctcttacatatgtgtttatacatatctaacaaatgatatcatgaatactgttttataattttttctctactcaatacattgtggacatccttttttattttttgattggcttatctgtagatctattttatcctttttcacagagctctgttgaggtataattgtcatataattggcatacatacacatatttgaagtgtacaactggagattttttttatgtatgtgtacactcatgaatttatcatcacaatctagataatgggcaagcagtcacctgcaaaagtttcctactgtccctttgtaatcctcttctcatactttttaatggctgaaaagctttatttgcatatatgaagtgtctttaaaatccatacttacatttgctcacacatagctcaacctaatattttgtttaaattgtaggatgctcaccccatttagagaaagaaatccacctccccaaccccaatcaagaacctgctattgtatatcatcatagagccagattacctaggtaagaatcttagccttgccactttgcagacattatgatcctgggcaaattgtttaaccactctgtatcaaattccttacctgtaaagtggggataataatagttttatatttaactcataaaattgcaaagattaaaggaattaacacaatgatctgataacaaagcactatgttattatctgctgctgttattattcccatggtttgttatgctaaaagcctcttttcagtttctcctgatgatattaaagatacgagttgccaggaccttgtattcaaatagcctaccagaacttatctcctctttttaattcctacttctctgtcacctccctctgagcatcttgataaaggtgaggagaagtatgtagctaatcataggctgtttaagtattggagagtttggctttagggacatttcataaggtgagagatacccaaaatagaacacttaaaacaattccaagaccttatcaaccaagatgtcaaaatataaattacatttctacattaaaaaatgttattgatcactttgatggtaatgattacacatgtataataacctttccttgagcacatactaagtgtatattctaggaaagatcctaagaattaaggtatttattgtctttatgaagcatactatattagtctgttctcacattgctataaagaaatacccaagactgggtaatttataaacaaaagaggtttaattggctcacgtttctacaggctgtacaggaagcatgatactgacatctccttagcttttgggaaggcctcagggaacttaaatcgtggcagaaggcgaagagccagcacttcacatggctggaacaggaggaagagagagaggggggaggtgctacacagttttaaacaatcagatctcgggagaactcactatcacaagaaaagcaccaagggatggtgctaaaccgttcatgagaaactgaccccatgatccaatcacctcccaccaggacccacctccttgattgtgagatttgggtggggacacagatccaaaccatatcattctggcactagccccccacaaatcacatgtccctctcacattgcaaaatacaatcatgccttcccaatagtcccccaaaatcttaagtcatttcagcattaactcaaaagtccaaagttcaaagtcttatctgaaacaaggctagcccctcccaccaatgagcctgtaaaataaaaaacaacttatttccaaaataaaatgggggtataggcattgggtaataaatccccttccaaaagggagaaatcaatcaaaagaaaggggctataggctccatgcaagtctgaaatccaggaaggtagtcattaagtcttaaacctccaacctccaaaataatctcctttggctccatggcctaaatccatggcccagtgatacaaggcgtgggttcccaaggccttgggcagctccacccctctggctttgcagggttcagcacccttggctgctttcaagggctgatgttgagcaccttctgcttttccaggctgagggtacaagctgccagtggatctaccattctggggtctggaagatggtgaccctcttctcacaggtctactagacaatgccccagtggtgacgtgtgtgggggctccaaccccaaatttctcctccttactgccctagtagaggttccccatgtgggctctgcccctggagcaggcttctgtctggacatccaagcttttccatacatcctctgaaatctaggcagaggctctcaggcctcaactcttgctctctgtgcactcacaggcataacaccatgtggaagctgccaaggcttatggcttacatcttctgaagcagtggcctgaactgaacctgggcccctttgggccacgactgaagctggagcaactgcgatgtcgggagcagtgtcccccggctgcacagggcagcagggccctgggcctggcccatgaaacagttcttccctcctaggcctccaggcctgtgataggaggggctgccatgaagatctctgaaatgcctttgaggagtttttccccatcatcttggctaatagtatttggtttctttccacttctgcaaatttctgcagccttcttgaattcttctcctgaaaattgacttttctttcctaccacgtggccaggctgcaaattttccaagcttttatgctctgctttccttttaaatatgttccagttttatgttatttctttgcctacacatattagaataggtggttaaaagcagccaggccacatcttgaatgctttgctgctgagacatttcttctgccagatatcctaaatcatcattgtcaagttcaaagttccacagatccctagggtgggggtacaattcagtcaaattctttgcaaggacataacaatagtggcctttgctccattttccagttagttcctcatgtccatctgagacctcttcggcctggccttcactgtccatatcactataaccattcaaccagtctctaggaagttccaaactttcctgcattttcctatctccttctgatccctccacactcttccacctctgcccattacctagttccaaagtcacttccacatttttaggtatctttatagcagtgctgcactccttggtaccaattttctttattaattcattcttgcagtgctataaagaaatacatgagactgggtaatttataaagaaacaaggtttaattgggtcatggttccacaggctgtataggaagcataatgctggcatctgcttggcttctgggaaagcctcaggaaacttacaatcatggtggaaggtgaagggcagccagcacttcacatggctggaacaggaggaataggtagaggggagaggtgctacacacttttaaacaaccagatcttgcaataactcactcactcattctcacaagaacagtactaaggggatagtgctaaaccattcatgagaaactgctcccatgatccagtcacctcccaccagacctcaccttctacattgggaattacagttgaatatgagatttgggtagggacagagatccaaaccatatcacatattatcaatttaaagagatgtggctaggatttgtaggggtgagaatagactgggatctgctgttagagcaaaggaagtgagtaggtcttactgattggtaatgttagattgagccatggatattgccactgttttaaacctgtgtaatgggagtttgttttactactttccctaaactgaaaacaacctgtcttagttgattcaggctgctataacaaaatactttaggtaatttttgaaaaacaaaaatttattgctcacagttctggaagctggaagtcaaaaatcaagatgacagcagatttagtgtctggtgagagcttactctctgcttcaaagatggtaccaccttattgctgtgtcctcacatggcaaaaggggatgggaagctccctcaagcctcttttataaggatagtaatcccattcatgagaatggagcctcatgacttaatcccttcccaaaggctccactccttaacactgtcatattaggtattaatttccaacatatgaattttggagggacaccaacattcagaccatagcacaatccaaatgtctatcactggtagaatgaaaaaatgaacaggggtgtgtgtgtatgtacgtgcctgtgtgtgtgcgtataatatacagagccagtggtaagaatgaatctgctacaattacatgcaacagtatggatgaatctcacaaacaagatactaagcagaagccaaaaagatctaaaagcatacactaatgatttcatttatatgaagatcaaaaacataaaactcatttatggtataagaaatcaggctagtgattcctagtgcttgccactcctttcctcactctgctaattccaaatacagagcttgtcctcatcactgtagacaccaccactactcttactgtcacagagtgtccaggatcgtcttcttcagggcttataagttccagggaagttacaaggatggctatctacaaggaaacattgaatgggaactggctaaagcctcaggcatggataaaaattggatgggaactggctaaagcttcaggcatggataaaaactggatggcaactggctaaagcctcaggcatgggtaggcatccttaaggtagggaggtcatcagcaagggagtggctactgcccaagggaagccctcagcacatagccccaggaatgattctgaccatgtgcttgctcttatggtctgtagatgctgaacccacccccaagggcctcctgagcattcaagaaatggtcgtcactaaaaatgctccttcatttttaatctgtttgattcctttcagatctgactcttccaacctaggcctcactgatttctctctttccttcaatccagaggagactttctagcctgggaggtgggtttggatgggtaggattggaggaggaactttgctgtcattattttatttaatcatttcatctgctagaagacttcttgcttttcccgagtaccttaaaagacagaaaaacttattttttctctttttctgacccatacttgtctttcatttgaagcaataaacacaaaatggcttagctacttgcagggcagatggtaaatacacagtaaagaaagaagcagaaaaaaaaaatcaactattgggagaaacaactttagttaacatcttaaaatgtcattccataaaacttgggttgaattaggtaataaaagtattattaatattatggaatttcgaggagaaacgagtttatatgtgtggtggagaaaatatttgtttttagattcatagtatttcaggtggtggcaagatatccaggtgtagatttctctgaggcatttagaattgtagaactgaaggggtgggtcaaggctgaatgtatagatttattgggatggaagggaaaattcaaacatcattgtggatgaaataaactatttctgttagagaatacaattgactttatgaagtgatttatagggcatctagattgtttgatgtggtatgcaatgacgtttttattcactgaggtgtttctatagttaggataattttatttagatggttgtaccattatctttaatattttattgtgcactagaaatataagtcccactgtcatataaaattagtatctctcacttgaaagagaattctcttactgttgttattgatggtgctggatctctgtttcaatgatacttacactgggcttccttgttttttttttttgacttgttgatgtgtgaaaattcagtaagccatttcattgtatacaccagggattgtcaaataatggctggctgccagttttttgtgtccatgaactgagaatggttttacatttttaaatgctttaaaaaaattaaagaagagtattttatgatacatgaaaactatataaaattcacatttcagtggccataaataaagtttttattaaaatatagccacacacaaatttgtttctgtggctgctttcatgctataatagtagagttgggtagttacaacagagaccatatgaccctcacagcctaaaatatttattctctagctttttactgaaaaagccaactgacccctgatatacaccaactgatgtatcattagaaaactagtgccaggtgtggtggctcacacctgtaatctcagcactttgggaggctcaagcttgcctagctttgcccaggtgggtggatcacttgagcccaggagtttgagaccagcctgggcaacatggtaaaaccctgtctatacaaaaaaaaaaaataataaaattaccaggaggcttaggtgggaggatcacttgagcctgggaggcagaggctgcagtgagccgtgatcacgccactgcaccccagccagggtgacagagcaagactctgtctcaaaaaaaaaaaaaaaaaagaaagaaagaaaactagtaaagacaagtatcctcccaaaataaataaacccacagaagtacttctcttacacaggcaatagttatttaaataacatcttttcctgccttatttttctccttgataggtaccactatttatcactgttttacacactatacttttgcttgtttaaataaacagacacaggttaactatttcttccctctagattgtacctttagtgagggcaggggtttgtgtctgtattgcttactgttggattctctagcacctaagcatgtagtagacacacaatgtatattttatttgagtatttacatatctgttgaattgagaaaccaaccactgaatttgctacatattactgtatccaactctgaggatgattggacaacagaaacaaagtatcctttgttcatttgcatagcttgcctagctttgctctagagattgtaggaggtatctctgaatttcagcaacatctaacagcattttgatgctcttccctagtgtatatagcactgaagagcagcatgtataaatatacatatcagacacattcattttttaaagtatttaataatatacttttataatgtattttatataattatgttaatgtataatatattaattttatattatatttaatattaattatacataatattaatataaatttacatatatctatacctcaagcttttatatcaattattgtttttatacatttgaaacagtaggctttgtgaagtgaatggcacatagtaaatacctaaaggttaaaataattgaagaattaagcaagctcttaggtaataggttattttatgaagacagaggtattgcttagtggtttcccactgcatttacaaggaaatccaaatggttttccagccagtaaagccttgtatgatttgactgtttgtctttgtctcccaccttctcccttgctggttatgctgaaatcaaactgaacttctttaagttactctattaccttaaggtcctttatttatagttaaacaaaatattatgactcccccatagactctaagctctattagggcagggatcgcagatgccttattcaccattaacaacccaatgtttagcaaaatgactgaaatataataagcagtaagtaaatattttttgaacgactacatatgtgattaaaagaacactggggttgatgtcagaaaccctaggttaaaatcttgggaatgcattctgaatcttgatctaggtgccaattacacaactgtgtttgtgaaaagtcatcgagttttaatgttggcattttttatgtaaatgtgttgataagttttaaaaaacccagtcctaagatcctcctatttactatgcaaacatgagtaagtccatttctctgaaatttagttttatcatttatcaagaagtctttttgtacctatctcatagagttgttgcaagcactgatgacataagtgaaattgccttatcataatagatatacaacaaataccagttgaatttctattctttgaaggatgtagaagcagaaagatgcagaggtgaaactcccagaggccaaataggatgaaactttcacttacagaagagctcttagatagccaaagagagttgtgactttaagagacaccacgaggagggaatgaactccagggagcgcctgatctctagagtatgccacagggcccttagatccttttacccttaaaaattagaagggccttggggtctggggaagagcaagaggctgggattggcaaagccttaaggagagtaaccaggtattatagtcatgttgtgtccaagcactgtggtggacagtgaagtgattgacctgcctaattaaccatgagagagccatgtggctaaaaagtaaagtcaacatagaagtcctctacaaattaaaatgtagcctgcagtgtttcaaaactaataaagagctagatataattgaatcgcagaggattactggaagaagaataactaccaagaataggagtttccagtctattgtcacaggaagcctgggaaagaggggcaagtacatttaaggaacatcaaaaatggcaaaggaactcttagagaacctccagttctctaagagttccaaatttaaatcattccaaatttaaaacatcaaagcagctgaagccaaatcatatttaacttaaaacattcagcttacaaaatataccttatatcactctctgtctgaagtagtaatagttacacttaatgtattgaaccatattgaccaactagaagataaacctcaagaaccagattgtaccaaaacattttgaggggaaaaataccaaatctttgttagtatcctcataggtcctgcttactgttactaagaactattaaaactgttatttaatcctccctcaaagcctgtgaaattagagctactattaataaccccattatggttgaagaaactaagtcttaaagaggctaaataactttcccaagatcagatagatggtaattggcagacaaggcctcaagcccacatatgtatgatagcaaaacccatgctcttacctgttgttggaactctttgttgagatgtatataacgtgtcatcatttaaaagctcacgcttgtatgtgtctattaagataagtatatcaaggctgggcacagtggttcactcctgtaatcccagcactttgggcggccaaggcgggcgaatcacgaggtcaggaggtcgagaccagcatggccaacatggtgaaacccctgtttctactaaaaatgcaaaaaaatagctgggcatagagatgggtgcacataatcccagctactcgggaggctgaggcaggagaatcgcttgaacccgggaggcggaggttgcagtcagctgagattgcaccactgcactccagcccaggccacaaagtgagactccatctcaaaaaaaaaaaaaaagatatcaaaacatcaagttatacaccttaaatatatacaattaagaaagactatagtaaaaaaattcagactgaaaaatcaacaggaaacaaacctgatatggttctcagaaaagatatactttccaaaaggtagataaaatatgatacagattctattattgtcccaaattaaggaaattttagtgcatctaataagataagtaatatataaaagagcctaacattttccctagtatattataacatagtaattattcaatcaacattcaaacaactgtatattatacagtggtattttgtttggtattttctgaactgaaatgatagcagctcccaggaaattgatataaagtcagtctggatctccatctaaaacatagtgtccactttgcaaccttcagcctgtatttggggatgcatacttctgtatatagttgtttgacagttttagtgatgctgggctcctaataatgtggatattagtttgctctacctaagtactgtactgaacactgcatttctgcattgttaagttgtcatttctaaactgtatgaacaatataaagatcaataaagtcttaacttacaattttaaaagctgtggtactggacatctgttcagtgccaatatgacttccatatacaagaaatgcacacagagaagaaatcctgaaaactgtagattgttgactcttacttgaatatacttgatacggtttggctgtgtccccacccaaatctcatcttgaattcccacgtgttatgggagggacccagtgggaggtaattgaatcatggggggcaggtctttctcgtgctgttcttgtgatagtgaataagtctcatgagatctgatggttctgtaagggggagtttccctgcacaagctttctttttttgcctgctgccaatcatgtaagatgtgacttgctcctccttgccttctgccatgattgtgaggcttccccagccacatgcaaccataagtccattaaacctcttttgtaaatttcccagtctcaggtatgtctttatcagcaatgtgagaagagactaatacaatactgagagtatcatgtataacattgttactgaattgtaaactcaaaaaaaaaaagcagataatttgtctctcgtttgccaatttttttctctaaggcagggttttttaactttgacactattgacattttggactggttaattctttcttgtagggggctgttctatgcattgtaggatgtttagcagtacctggccccaacccactagatgtcagcagcacccctctccagttgtgacaaacaaaaatatctctagacattgccaaatgccccctcgggggaaaattgcctccagttgagaaccactactctgaagaataaaatagcgtgtggcaaataaaagacactcaccaaatatttttggattgactgaagacaggaaagaacagtctcccacaaaatgtaccacttgtgatatgctttgaatatctaggtatgacctggaaaaatttctataactttaatagttatgtattttatatacattagaaaatatataacatgacaaacccatgtttttgcctgctattttataggacagtgctaaagtcgatactgaagttaaaaagtaacttaattgaaagaaacattaactgtacacaacagatacattaaacacaactcatcaaattgattaaggtggtatgtgaattactggagtttgaagcactcatttatactaagggaaacttaagcacaaatgagcttcccctaagtctggtttgtgtaggccactagaatcctctttgggaatgatctactgccttgcacaggctagatacaggtgttgaagacaaattgcttactctttgagaattagtctgatagacactataagatatgaacatcaggatgaggtagcattatgagagttcaaaggaaaaagaaattactttctactcaggtaatgagggaaaatatcactattgatattgaaggatgaatggaatttttgtagtagataatacagaggaaaagagcagaggcaaagagttggaccagttcaaaacatatttaagggatgagtagaggctggtttggctggagtgtagtataactattaaggaaggtggaacctgcttgtagagggtatgtaatgccagggtgggttatccatagaacaaagattatttgattttctaatgtctggctaaaagctgctttgttgttattgtttttaagtgtattgtcattattttagaagtaatgtttagtttgggatggggacctgactgagaatcaagataaataaatactgctgcttacagaagtataaaaactaacacacacacacacacacacacacacacacacacacacatacacgctgaaagaagggaccagatgggggcagggcacagacaaacaaaaaaatagcagtaacctctgcagacttaaatgtccccgtctgacagctttgaagagagcagtggttctcccagcacgcagctggagatctgagaacgggcagactgcctcctcaagtgggtccctgatccccgacccccgagcagcctaactgggaggcacccccccagtaggggcggactgacgcctcacacggccgggtactcctctgagacaaaacttccagaggaacgatcagacagcagcattcgcggttcacgagaatccgctgttctgcagccaccgctgctgatacccaggcaaacagggtctggagtggacctctagcaaactccaacagacctgcagctgagggtcctgtctgttagaaggaaaactaacaaacagaaaggacatccacaccaaaaacccatctgtatatcaccatcatcaaagaccaaaagtagataaaaccacaaagatggggaaaaaacagagcagaaaaactggaaactctaaaaagcagagcgcctttcctcctccaaaggaacgcagttcctcaccagcaatggaacaaagctggacagagaatgactttgacgagttgagagaagacggcttcagacgatcaaactcctccgagctacagaaggaaattcaaaccaaagacaaagaagttaaaaactttgaaaaaaatttagacgaatgtataactagaataaccaatacagagaagtgcttaaaggagctgatggagctgaaagccaaggctcgagaactacgtgaagaatgcagaagcctcaggagccgatgcgatcaactggaagaaagggtatcagtgatggaagatgaaatgaatgaaatgaagtgagaagggaagtttagagaaaaaagaataaaaagaaacgaacaaagcctccaagaaatatgggactatgtgaaaagaccaaatctacatctgattggtgtacctgaaagtgacgaggagaatggaaccaagttggaaaacactctgcagggtattatccaggagaacttcaccaatctagcaaggcaggccaacattcaaattcaggaaatacagagaatgccacaaagatactcctcgagaagagcaactccaagacacataattgtcagattcatcaaagttgaaatgaaggaaaaaatgttaagggcagccagagagaaaggttgggttacccacaaagggaagcccatcagactaacagctgatctcttggcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcactcaacatggaaaggaacaaccagtaccagccactgcaaaatcatgccaaattgtaaagaccatcgagactaggaagaaactgcatcaactaacgagcaaaatcaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacgttcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaaaggatcaattcaacaagaacagctaactatcctaaatatatatgcacccaatacaggagcacccagattcataaagcaagtcctgagtgacctacaaagagacttacactcccacacaataataatgggagactttaacaccccactatcaacattagacagatcaacgagacagaaagtttacaaggatacccaggaattcaactcagctctgcaccaagtgggcctaatagacatctacagaactcttcaccccaaatcaacagaatatacatttttttcagcaccacaccacacctattccaaaattgtacacatagttggaagtaaagcactcctcagcaaatgtaaaagaacagaaattataacaaactgtctctcagaccacagtgcaatcaaactagaactcaggattaagaaacacactcaaaaccgctcaactacatggaaactgagcaacctgctcctgaatgactactgggtacataacgaaatgaaggcagaaataaagatgttctttgaaaccaacgagaacaaagacacaccacaccagaatctctgggatgcattcaaagcagtgtgtagagggaaatttatagcactaaatgcccacaagagaaagcaggaaagatccaaaattgacacactaacatcacaattaaaagaactagaaaagcaagagcaaacacattcaaaagccagcagaaggcaaaaaaataactaaaatcagagcagacctgaaggaaatagagacacaaaaaacccttcaaaaaattaatgaatccaggagctggttttttgaaaggatcaacaaaattgatagactgctagcaagactaataaagaagaaaagagagaagaatcaaatagacacaataaaaaatgataaagggaatatcaccaccaatcccacagaaatacaaactaccatcagagaatactacaaacacctctacgcaaataaactagaaaatatagaagaaatggataaattcctcgacacatacaccctcccaagactaaaccaggaagaagttgaatctctgaatagaccaataacaggctctgaaattgtggcaataatcaatagcttaccaacgaaaaagagtccaggaccagatggattcacagccgaattctaccagaggtacaaggaggaactggtaccattccttctgaaactattccaatcaatagaaaaagagggaatcctccctaacttattttatgaggccagtatcatcctgataccaaagccgggcagagacacaaccaaaaaagagaattttagaccaatatccttgatgaacattgatgcaaaaatcctcaataaaatactggcaaaccaaatccagcagcacatcaaaaagcttttccaccatgatcaagtgggcttcatccctgggatgcaaggctggttcaatatacgcaaatcaataaatgtaatccagcatataaacagaaccaaagacaaaaaccacatgattatctcaatagatgcagaaaagacctttgacaaaattcaacaacccttcatgctaaaaactctcaataagttaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagtgcaattaggcaggagaaagaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggataaaaaatcaatgtacaaaaatgacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaatgaaattaaagaggatacaaacaaatggaagaacattccacgctcatgggtaggaagaatcaatatcatgaaaatggccatactgcccaaggtaatttatagattcaatgccatccccatcaagctgccaatgactttcttcacagaattggaaaaaactactttaaagttcatatggaatcaaaaaagagcccgcatcaccaagtcaatcctaagccaaaagaacaaagctggaggcatcacactacctgacttcaaactatactacaaggctacagtactcaaaacagcatggtactggtaccaaaacagacatatagaccaatggaacagaacagagccctcagaaataatactgcatatctacaaccatctgatctttgacaaacctgacaaaaacaagcaatggggaaaggattccctatttaataagggctgggaaaactggctagcgataagtagaaagctgaaactggatcccttccttacaccttatacaaaaattaattcaagatggattaaagacttaaacgttagacctaaaaccataaaaaccctagaagaaaacctaggcattaccattcaggacataggcataggcaaggacttcatgtctaaaacaccaaaagcaatggcaacaaaagccaaaattgacaaatgagatctaattaaactaaagagcttctgcacagcaacagaaactaccatcagagtgaacaggcaacctacaaaatgggagaaaattttcacaacctactcatctgacaaagggctaatatccagaatctacaatgaactcaaacaaatttataagaaaaaaacaaccccatcaaaaagtgggcaaaggacatgaacagacacttctcaaaagaagacatttatgcagccaaaaaacacatgaaaaaatgctcaccatcactggccatcagagaaatgcaaatcaaaaccataatgagaaaccatctcacaccacttagaatggcaatcattaaaaagtcaggaaacaacgggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgtggcactattcacaatagcaaagacttggaaccaagccaaatatccaacaatgatagactggattaagaaaatgtggcacatatacaccatggaatactatgcagccataaaaaagatgagttcatgtcctttgtagggacatggatgaaattggaaatcatcattctcagtaaactatcgcaaggacagaaaaccaaacaccgcctgttctcactcataggtgggaattgaacagtgagaacacatggacacaggaaggggaacatcacactctggggactgttgtggggtggggggaggggggagggatagcattaggagatatacctaaggctaaatgacgagttaatgggtgcagcacaccagcatggcacatgtatacatatgtaactaagctggacattgtgcacatgtaccctaaaacttaaagtataataataataaaataaaataataaaataaaataaaataaaataaaataaaatgaatcttaacacacacacacagacaaaaaagaagggaccagagactagaacagcagaggatccgaatggaaagatcattccatcagaagaagcaaggaggtaacctgggcctgggggagtttggggcttgaggtgatatgggtattaggccttgagccttttatctctctaagaaaattgtcttatttaaaataagatgctgatctttggaagtttattactgaaacgctcggtgaggtggctgacatgtagtattgatttttgcctccttggttttatcttcccctggaagatggctgcctccagtgatgcttgttgtctccaccatgctgacctctggagcagcaattcctctttgaaaatcctggcccatgcctgacagctcgttcctttgtggtttttcctaacacaactgaaataggtttgattcttttctaaaagactttattaaatattaaagaataaacaaaaaataaaatatgagaagtcctgccagatttacctagcatctctgatatcactgtccctggtcaagccactctcacacctcaaatctcctttccctactgctgccagaggtgtcttctttaaatcccaatttagctatatcactaccctgtttaactctttcatgcttctcattcgtacatggattatattttagtatattaactttcttttggtatttcctggagtaaggatggttttatagttatgttgacataatgattatttcatttatctgatttgaatgggttacagttaaaattgagatgacacttgggaagggtgagcaccttcctgtaaaaaggtatgagttctaacactttcctaaaggtttcccagaatagctttatctgaagggtcaggagtcactgtatttcaaattgtgcttcctatagtgctaggtttctgatgaggtatgtccaggccacctccagaaaaaatctcaatgggtgagactacaaccctccaccccaattctgcctgaagagttccaccctaacccattttttatatattggtggtccgcataaaattttttgagggctgtctgctgctttcaaaaaagatgtgttgatgagaagtcattagatgatttctaaagttcctttcaactccaaaattatctgagaatccagcccccttgacttctttcttgattcactttatgctaattttgttccatatgattaaaataatagaatttcagagctgcaagaaactttagcagttatcttgtccagttttccaaaatgagctccaaagaacaagactcctgagaaacgcccatcgcttacagaaaggactgtatagctaaatattttgagactgtacttttgtcccattgctcattagcattttaaaggctctgaaaagtcttataataaagaaacctgattaaattaagtcggtatttcctacatgggaagcatgggctctgtatcaacttactatgaccttctttatctggtactagtttctgccctattaccagatcaaagagctctgtttttgaataacacactttttaacatgctgtggaggataatttgggaaaactcatatagttgagcctcctccttttgcaaagaatttatgataggaaatgattgatcaagtgtcacacagctgattatcaggtctcagtctaatatttattccttattggtctctgcttaacttcaagtaggttatagattccttaatggactgatagtttatgtcttatagctttacctttcaggcgcttagtttcatattgggaacatgacaagtgaataataaatacatgatagctctatgattgaaccctgtgagaaaatgaagcattatgatatgaattggtttctgtgtatgtatgagtgtttttttttttcatcttttggaaacagaatttctgctcccctgtgtacaccctttctctgtaattgcagtgtatgttttttgtttctccaaagtttctgttgtcagtagtttatgatcattggttcatactgtttattggaaataactctgtgggctgctttgcctcagggctaatttgattagggatgctgttgttttacaccgtttgggaaaatgttacactttaaagggtattggatttgtcacagaatgatattgaagggaagccggagacaggaaagctagtaacttgctggcctggttattagcattggaccttttgggatttttgtctgccatttttgttgatactgctgttttctgaagagataagtgtgtgaccaatttgaggattgttatttggcacacgcagaaactagtaccagataaagaaggtcatagtaagttgatatagagcccctgcttccagaatattgtgcttctgtcctctgaggttagattttctctttgtgagggagaaaacatttatgtaagggagaaagattggaatgtactgaaatgaaatgctcacattgaccacatcagctgtactggagcttatctgatgtagccactcagcctctatcaatctgactgtgtgtatgtgctctgttttgtacagggaatcatcatccagggacgtgccagaaaccacaagaaaacatggggaggggtaagtttctcttcctttttaagtaattcagactgtctccatagctattatagtcaggaaattaaatttctaactcatagtatatttgtggacacctaaattgtatttcttgttagtgttagaaagtttttgtctgaagcagggcttttcagagaaagaccatcaaccacatttattcactggatctttgattttcttcttttgtagagacctcccagtatagggagagatggatcaagcttgatactatatatatagtatatactattttatatatataactcacagatactatatatatacaccttccccaaacccagcttctttataagtcttttttctgttttctgttttcttgctagtaacacaaaataaagagagtctactatgcagccaataacagtagtaaaaaaaaatcatctgtgaggttgatttgtaatttttttaaaaattttaaagcccggcattaagaaccattagatgaattccttttgtttatttttgccttctcataaggctgtttatgggcagtggacaacagataaatttaagttcatttcattgttaatattaagcagccaccacagggacttcataaataattctaattaatgtatatcatgtcaacctaaaataatcaaaagggtcagaatctagtttaaagagtttatttgagtgcaaaggttgaggacggactccaaagaatggaaatcactgtttccagttgtagaagtttggggatcactcgaatagacaaagtttaggatattttaacagaattttaacatctttctatgtaaggcttactgcatagttacaatgacctgattgatccgggtggtccttttctttcaggaaaggtatatttaacattccacactgaagatgtgattgtcatggggtctctgtttggggcaccatctggtctgagttaggtacaggataatagagtagcaaagatcagtgactgaaagggggaggtctggcctctggtctttgctattcatttacaaaacaatagcaatgaggaagagtgttaaactataacctaagaaacagaactgcaaaatgttatgtgactgaaaccacagtcacatgtctcccaaggcttaaagtgttttggggggtcccaacagcttttacattttattaattttcacaattataaaattagaatgccttgaaggatctcagaggaagatttggtgtgtggtgtggtatagtacagtgagaagaatactggatacagaaggcctgaattcaagttccacctctactaccttgatcaaatcctagaacctccctaaactcgtttgttcatccctgaggtgggattaatacattctgcacttctagcctcagaaagttgtcgttggcataatgtgataatacatgtaaaagtgttttgagagttctaaagtgtaatggaatacagcagtggtatctgcccattactgtccttactaactatatcttcattgtttttttaatggataaaaatgaggttatttgaccagatgcttctgtaggcagcatgactgggacttgggtcatgcaagcaactgagaattcttttgttgcactttgcttgccccacccttgtgtgggccctggtaggaagccctaaggattatggatcaatcatggaaaatatcttcttgaatcttgctgaatcagcttttgttcctgttttctccagagctgcccttggaaattgattaggcctagctattctggttctttccagatcttcacaaaagatggcaatctctgatggtttcgaaattttaaaactaaatgaactttttaaaaactattcggaattctgggactaatctgtgccacgtcctgcccgcaaatcagctctcaatggaagcttctagagtagtgatacggctccaatgactgggggaactccagggtccttagtctcatgtcgagttagataaaacgacacagatacacgtggagtggttttaagtagtggagagtttaatagactagaaagaaggaagaagctccctcctacagctgagagaggaaacctcgaatgtggtggaaaacagccagttatatgaggaggctggaggaggcagtgtctgatttgcatagggctcaggggattggtttgaccaggtatgtcgttgacatagcctgcgagaaaactggccctcccaccctagcgttttaatgtgcaaatgtatccccatgatgttctacacatgtgggggatatgtgggggtggccatgttgccaggaacatgttggggcaaggggaagaagatggtgggaatcgccacgtttgtgtggacccagtttccagtggcaggtatttgcatatcaaagcttgccggcccaactttaagagcctgggctttcccgctagacaagaaacgtttctggagcagctttaaaagaaacaaaaacttcccaaggaccccctttcctatctattgcctaaaataatttcttagtaactcctataacattagaacatcatgtttgatcctcacccaatcccaaaagcttcaagtggatttggagaatgttctggttgttggatactgctatagccatatagaggagagagctgcactgagacgaaacccgttctttctcatttcctctattcatttttagactgctcatcaggtcactagcaaagggactgttaggtgcttagtttagaagatgtctcagcaactttttgttcaaatggtcaggcaattagtagttgacctttgaacaatgtgggggctagggatgactctgttgcataatcaaaaatccatgtataatttttgatgcccccaaaacttaactactaatagcctactgttgactgaaagccttaccaataatataaacaattgattaacacatactttatatgctatgtgtattacatacagtattcttgtaataaaatacactagagaatagaaaatattaagaaaatcataagaaaaagaaaatgtatttactagtaagtggaagtagatcatcataaaggtcttaatttttgtcatcttcacgttgaatcagtggaggaagaagaggaattggtcttgctgtcttaggagtggcagagactgcagaaaatttgcatagaaattaacccgtgcagttcaaatatgtgttgttcaagagtcaactgtagttcttgctaaagaacagggcatggtaatgtaatctgcaaagataggcatgtttccaggctggtgatgagataagggaagtgcttcaaagaatgctgcttttacaaatacagaagcttgtgatagcattttcactgtgttgaccactttgaaagtatttgtaatatcctgaatctcaaagagactctatcctttactctctaagctttgcttagtttgcctgattacatttgttaattgctgacactgttattggggagaaaaagatgctactgtatgctcatttttctcttttctggcactgtacaatgaaatttttcctgcacttggcaaagattctcacaaacgtagcccagtgtatcatacagagggacacagaggaaaaatattgcaaagatatgacactagcctcataacataaattaaggatgcatgaaaacaaaaaacacacttggataactgtacagtttaggtgagaaattaaaactgaggtgaatttcttttagcattctttgatattagatgaagaagttatttgtacatatgtgttagaagaatcattcgtttatgtgacatgaaggattataaacaaaatttaaatattaaggtggggaagatgagaacagccttgtatatttaattttttattagtctactactaccagtgtccattgtgtgtggcactgaaatcccattcactatgtatgaattcttaaacagggcttagtatttaggactcttaagaatctataattattctgagattaacacatttctgtagagcactttataactcataggtattccctctacattatcttgagttgtaagacaaccctatgttgtaaatagggattattatcctcattttatgtattataaaactgaggctcataagaaaaagtcttatctgtaatccacagactactaatggagagccaaaatgcaaatctaggtcttatgttacatccagttttttttcttccaataaaccatgttctgcatatcttaatcatcagtagtgtgtaagtcaattaaaaacttaggagctctctgttgctgtgagaggtatggaagaaattattttttgatatctgcaatgttcatattatcatgagggactggacagataggcgaagggaaatggctcattgttcatcaacctttagggtaacagctaaaatacatgtgtatcagatggtggagtgcctcaaatattaaaatcctctgagcagcagtggtctatgtctgtggtaattcaaaaggcagctacactgattggcagtgaccatagtagataacaaaacaactcagttcagaagctcgtgctacacagtccacaagggaaggtgcctaaagtaaagggcctgatgccgcttacctggcctatgtgaaactcacccgtttgactgatgagtttttatctttgttgcttttgttgacacaaggaatataatgcatcatggaacaccagaatagcatgagatgacaagatgagatactggttcaaaaatgaacagcaggtataaataaaattatatgtaaaattctagtagagaacatttttacaaagagaatgtgaggattttacaaatgtgtatgtatagactcacatagcattataatataatcagccttccatatctgtaggttccacatctgtagattcaaccaaccatggatcgaagttatttgagaaaaaaacaaaaaaataagaatacaacaataaagtgcaaataaaaatacagtatgtaaacatagcatttacattgtattaggttttataagtaatctagagatgatttacagtatacagaaggatatgcataggttatatgcaactactatgccattttatataagggacttgagcattttggtatctgtggaagtcctggaaccaatccccagtggataccagatgactgttctaggatatttatctttaatcatcttcaaatggtaattagaactatattttaccttttcatttctcatctgaccaactggcatattcatgataaaatggtaaaaggcccagtactcccagtaagtattatctttacctacaatgaatatttttcagttttcttgctttaaaaattttgtgattattgtttttattacagtgtttcggtagaatttgatttttaaaaatatagctactttccatctgaatttttttctatctcagaacacatttctattactgaatcttctaagtgctgtagtttgtggtatctgctagcctcatatgaagttattaatggctattttcactgtctaccttaaaagcagagcttctgggagaagttcatcatgttgtcttgataatagcaaatcatgagctagctgctcgtacacatcttccacaaaataggaataatacttagccatgaattttcaaaaggattaattttgctttgttatatacaaagcaatatctggaatagcttaatgattgcaatcaggcaggtctactttgtggaggataatctgaattaaaatatgaagataacttaggattttttttttctgtttctcctcttccagtatttagtctttggaaataggtcttacctacctagcttagaagaaaatcttaggtctataaaatcttaatatgaaaagtcagtttccattttcattttctgtacttaatagtaacatgaccttaatgtcttagcataaatgaatttttatggtcgtgctatagcaaaacagtggtagtgttgccagttagtctttgtttcttattaaaacatagcagcataattcctctgggtccttgcatgtgctgggctcctttatcccaaggaactcaaacatatccccctagttgtcaagacttagtggaaggcaagatggtttacagccaccacagtaaatacataagttctttaattcactgctgaactattgttaagttgaagccaattctaaactttaactgagtgtacagctctatattgtcaaatagggaatgaaccttcaaactgacaagccctgtaaagtaactgtcttataatgaagtgcctaattttatttggctttatggttcaagtgaagttatccatttaaagtcaattaattatttcatttttctggcctatattagatttgagagtctctttattgtgacatattcaggcctctttagtttagatgatgtcaataatttattataaattcttatcttcagaattttataacagtaatacgaatttgcttgtagctgacaactgccataattttttcttggcaagtttttctcaccagaaaaaaaaaaagaactaacggagaggttacttttaaaaaactcattatagtgcttgatgctttttgtctttgatgcaatcctctctgccatttacttattaaagaagaaaataacctttggcacataattttagaaaggtttctcaactttagcactattgattttttttaatggaggcaaaatttatataacatagacttgactgttttaaagtgtataattcagtggcatttagtacattttgtaaccagaaggttgctgtgctgtaaggaaaatagttacaaaatgtactaaaggttgctgtgcaaccttccagttataaaacattttcatcacttccaaaggagatcctattcccattaagcagtcacttaatcccttcccattatcaacatcccttaccagagaggtacatttgttacaatcaatgagattacattgacatgtcattatcacccaaagtccataatttacattagggttcactcttgttgttgtatattctatgagtttgggtaaatgcgtaaagaatgacatgtacccaccattatagtattatacagagtagtttcactgccctaaaaaaaaatcctctgtgtgccacctattcatgcctcctgcccactccctctccacccctggcaatcactgatctttttattatctctgtgattttgccttctcagattgaagagaaagaagccttctcagattggcttctttcacttagtattatgcatttaggattctttcatgtctttccatgatttgatgcttgtaaattctcaactgtttgggggtaaatatcaaggagtaccattgctgtatcatatggtaagagtatgtttagttttgtaagaaaccatgaaaccgtcttctaagtggctttactattttacattcccaccagcaatgaaagagagtttctattgctccatgtccttgccagcatttgatgttgtcagtgttctagattttggccagttaaataggtgtgtagtggtatcttcttgttttaacttgcaattccctgatgacatatagccatgagctgcataatgatgttttcttcaatgacagaccacatatatgaaggtggtcccataagattatataccgtatttttacggtaactatcctatgtttagatatgtttagatacacaaatacttacattatgttacttacagtattcactgtattcagtaagttgcttatagtattcagtacagtcacatgccatacagttttgtagcctaggagcaatgagactataccatatagcctaggtgtatagtaggttatgccatctaggcttgtgtaagtatactccatgatgtttgcgtaacaacaaaatcacctaacgatgcatttctcatgatgcatcctgccgttaagcgacacatgaccaaatgctgtggagcatattttcatatgtttatttgccatccatgtatcttttttggtgaggtgtttgttaagatctttggcccatttttatatgcttgttttcttactgttttaagagttctttatacattttggatagcaatcttttaccagatgtacctttttcaaatgttttctcccactcggtggtttgtcttttcattctctcgatataatggtgttttttatagaagtaagttgagtctaaaggagagcagagtatgattctggagaccaaggtacagtcctagtcctatcatcaagtagctgtggctttgggtaagtcacttaacctatagatttcagtgtagtgttctggtcagcaaaatgaaggggttaagatggatcagtggtttccaatgtgttcggtgaagccacagatcttctaaaggggcccctgaggggccaccatgagggaagagaggaaaaggaagtgcccctggtacataacacctctccttcagacagaacaactgtactacattgtattttatctgtttttatttcatgataggttgatttgcagaggatcctatgactaataaaatttagaaagctaccagattcaatgactctcaaagatctctttcagttctgaaaatctgcgactcatgaacattaattaccatccaccttttgaggctgtattaatgtgtgaacagataggaaagaaagtgatagaggaactagtggaatagctaatgttatgtgcttctctgatggtgacaaatcattcactctctatttcatggatttgaagtatataattcttgttccaatgtggcctatgtattaggttgaaccataggaacctacacttaacatattacgttgaaccatatgaaatggccttcaaaaactgtaatttcatgtacttcaaccaatataaatgcagtatgcatagggaacccttgagttcagaggcttcttaaagcatctagatcgtatatgtataaatgaattaattaaaaatgtgtcgcagccagacgcggtggctcacgcctgtaatcccagcactttggcaggctgaggcgagtggatcacttgaggccaggagttcgagaccagcctgaccaacatggcgaagccccgtctgtactaaaaatacaaaaattacccgcgcacggtggtgcaccctgtagtaccagctgctcaggaggcttaagcaggagaatggcttgaacctgggaggcagaggttgcagtgagccgagatcatacccctgcactccagcctaggtgatggagtgagactctgtctcaaaaaaataaaataaataaaaatgtgctgatttcatgggtggttaacagtccactttggaaacaaatgagattccagaattctacacatcagcccaccacctcctttgggattgatgtacatgtagaatcaataggaagagtttattgaatataatcaaaatcaatttggcttttacaattgctacattctttttggcaaatgtcagtagctgccaatagttaaaggcatgtgaggtctaggctccccacaatttgactaccaggttacaactaagtcttaggccgaattttgctatacacggacatttatcaacaagatggcacagttctgccatataacttattatataaactctatgaaatcctatttctttccttatttaggatctcccacaatatcttagataaaaagttcatctaaggcatatgtgacagcattctagcaatggtattcagctaacccatctagttagattaaagcaatcaagaatccttcatatcagcaggtaaacatgaggcctttcaggaatcaagtcttggccaccattcctaagggtacaaactgcagaggctttagatttttctactgtgttcaggcacacccttgactgctgctgtcatttctggagcaaattcacataaaaacatgtctttcaccagtgaaaagtcatttgtgaaattcatgttagtgcttactaacaatagcactaaactcctcaatgaaactccatttcttaaatccatcatgctctattgtgggctggagagaaagatagccaaatgcgtttgtagtagctaccttagaaatgtggctgtttcgttaaatgtaacatgtgtcctactaggacagttatccacttctagagtctagattacaactatcacatagaatacctatcctacagtctatgctgatgagttgtaaagcaatcattgcaatataaaattatgcattataagctatatttcatcttgtgagttttatctacctgtctttattttctattaaatggtgattattagtcacagctattaccatagtcttctatatgagatagaatgtaatcagtatagatagggtccataaactagaaaggaaatcatacggttgtaacaaccgcaaacatcaagactactgatattgctgctggtacaattgaggcaccagtaagagtagaactagctatctttggagttctcctgttttggtgattccatctgattgtgtgcttagtcatgacaaattacactaataattccatatttgtttgtttcttgggagcaaggcattgctcttggttcagaaatatgtattagaataccatacctttaaatcagtttacataattgctattaatttgattggtgtaatctgccatttcatgacgaattctttttgataagaagtagttataaagtttaaaacccctttaaagaaaactttgccttttgccttcctctgtgggagaatatattgcgccatttctctctatgtcctttttccttacaaagcataaaatcattagatgagagacatctgaatgtattctctgaaatttggcttttaagtataccatattgagatagttagtgtcactctggtgggaaccatgtttgttttatttttaaagaatactgactttatagacacactttacctcttttgtcatctctcatagaaatccatttctggcatattatccacactttttccaggaaacctacctgttatctggtatttcattgtatgcctctggtactacagatttgtttaagttttaggtaatgatcataactactgtatggtccttagggggcagatttcaggtattaaatatattaataatcattatttttttctcagtctcttagacttcccactcccactagctcaatcctgcaacttccaattattttttaaatatatgagctttttaatgggtttcagttccctcattcctgtgtaaacatatactatatgctatactaaactctaagtttgcaaaaactggttgggcacatgagtaccaccatacaataaattctgaattattataaacatatcagctatgaaaagttaacttttaattttcagaaatagtttaacaatggtgaaataaattgggacattgtacatatttccaccttcctaagtaaaaataggaggatgatttaaatagtgtctttttagtttgcttaattttgttttttagtaagtgaaatgtcacttcagagtataagactttgatttcctaggaaaagttgtttccatcagtctgtgataagaagtacctatttaacacctatttcagcagaaaaaaaaagtttgaaggcattatatgcagacacaactgaataatagtatcaaaatgacttacaagcgagaaaacaaagaattatgagtttgacacttcataagatgtttaaaaaataaagctaagcacaggattgggtggaatgggtgcttttttgattttctctgtttgtttgtttattattggtttgggatatggtgattgcttggctggaaaattgtgtattaatatcccaaaaggattcggatccaatacactactcccacttcctgaaattctttccaattatagaactctttatggttacaactgaaagtacttaagaaatcatatccaacacctttgcttcatcaattaggaaacacgttcagataaattaagcaacaaatgtaggatcaggtagccagtttactgccagagctgcaacaggaatccatatatcccgactacaaattcagggcctttttaccataccacactttttccttatcctatagtttcacttgcctcaatgcagggttggtgaaaatggttaatagatattggctctcttagacttcaacaacatatctcaaaaggcagctttcatgtgacaaacagaaggctcgaataagcagagagctttgcatgttctatagtcttgtatgagaaatttacaattaagctggattactagagatttattcagaaaagaaatcggcttccttgttaatttgtggactctgtagattcagtctgtggtacagcaacatttatacaatactgggaaaaaattttcaatttgagcaaatatattttgcagattgaggatgcttacctttttaaacatgatttaaaagatttttaaaaaccatatttttatagaaatagctctaaattagattatataatttactgccttcttgaacatcatcctgaacatcatatagccctttattggtaactcacattcaccattgtaaacataatcattgatgtctatagccttgagagctgtcagtgtgatggagtttagatcctactctaaataacccccaaagagccttctgactctcttttcccttgccttcagattaattagctttcacttctgttggctttcagtatgttgatctagttcagcccaccctgccccttttgctttctagttttcatgtgcaatgaggctttgaagtctcaggagccaggctcctgcacatggatagaggaaactgacctttggttagtgtaagaagttgaggttcccctgtagataaagcatcaagtgagttgtaatgtatgaccttggtcatctcttgtgtctaagttcatgagaatgagaatgggtttatttgagcaacttttgcatttctgcataaacgaggtattactgtcattcatatctgtagtgattatgtaaaacattgaatagccacccaaactatcaacctaaagttcaataaagcatattttgttatagttacttgtgattatctaaacatacatatctgtcatgtatgtaacttttctttcataatctatcctttctaagagcttatttgtggtctgttgttaaaattccagtgatgataagctatcaacatatatttgaccaaagttgaagttaataaaagcaagcatatacattatggcaaagggtatttcctcacaagtttgttataagtatcaagtccttataataaggaccatttctggaccatttcttgagaagaagttctgaaattttaaaatctcatgatatccccaaaatatttatgaatcataaaagtatattgtagcaactatacagcattggttaattgaaaagacttataagattctacggggtatattctcataaggctttaataatggctcaaggtatggtacagcaggagagagatcactcacaaggccatttttagttgcacaggacacatttgtcttctaattgtgaaccaccaagattatgtgcaagataaccttggtatcgggagctaaggctcatgtgtacagaagatctttgatatcccactggtcatgtagctgaaactagactatgtaatcaattagtcaggtgcaatcagcctatatgttttccaaaaacagttcaggacaagctactacagtgtgcctccaagcgaatttgagacattaaatagcacttcataaagctactacatgtcatcccagacttgaccaaggagaccaaactcccaggcattcctgaagttaaggagacagactcacggcaagttaatcctatttattctatatttcctaagtgtatttttattatcagcttgataaatatcattttttttatttcacagaataactgccacaatggtaatgacagtgagtcacactactacttattgtaaatctgtttttttgtcaagccctgagcaaagcactcatttataacttataacttgagattggtgttattttttcagttttatagatgaataagtgacgcttaggtttttgttttcttcacatggctatttgttctgacaaccctttttctttctaactagtgcacactaacaagcttgggatatccataagattaaattgattactcaaaacaaccacaaggctccccccatcaatgccataatgtctttattccttttctgactaaccttgttcccacaagaaatccaataactccagggttgcacaataggtctagaggagaggccctgactcttgaattgaagaagagctatggaatgctaggttcatttgtagaaagtcctcattctctgttcttgatgttcttgctactgtttgctactgtttctggtgtatagtcttatatcaaaaatagggcacctatggccaggtgctatggttcatgcctgtaatcccagcactttgggaggccaaggtgggaagatggcttgagcccagagtttgagaccagcctgggcaacatggaaaaaccccgtctatgcaaaaaaaaaaaaaaaaaaagaaaagaaagaaaaaagaaaaaagagaagtcaagtgtggtggcacacacctgtagtcccagctactcaggagactaaggtggaagggtcgctttagcccaggaggcagaggttgcagtgagccaagatcacatcactgcactctagcctgggctacagagcgaaactctgtctcagaagtgaataaataagtaaataaataaataaataaataaactaaggcatccaaaccacaaactcacacacccaccagaaatatgcctgccttctgaccttgaagaacatccgtcatgttcagtcttacaatagagctctttgtgtatctcttttattatatctttgttacctcttgcactgaagaaccttgagggcagaggtcatctgctacccatctttgtgacttgttgcatccacttattttatttatttttattattttcttttgaagagaaagcatggatgagagcttatttattttgaaattatgaaaaagtggttacatttttttgaataatatacttattttgtgtctgtgtatgtgtaaatatgccttaggtttgaaatattcaatttaataagagtatttcctaaccgaatctgaagaaaaaaggtttaggtttttctttatttcctttaatgggaaaactgcatgttttaaataacacctcagtattgtgttctcaaggcacatttacattctgtatacttgtcacatcatataatccttgattaaggcatgcacatgattcctgatagctgtaatttaactcacacaatttaaggagaaagaggcaattaaggaagtgatcactcaatttaaggaagtgatggactttagtttcaaacatcatggctttagttaaacatcctaacgcaagcccttgcagcctggaaattgccccatgtttttagaggagataatctgatttcatcctatagatcaaagctgccaccttctcccttattttgttttcgcattttaaaaaattctaattttaggggcacatgttctcaggatctcctgagggctgtgtcatgggcaaaaaagaaaataatctagttctggtatcatcatttagggtccattaggtttccaaatactttgatgagcactggcaaattctctgccactacttcctgttccctaataaatggcagacataactaatctataatagtatctttcctacaggtcagattcttactttaagtgatatcttctaatggactggatttggcaagtgagataaaatctacttgccagctgaatccatgtagagttcttagtattatattaccttgccgcccagtacaagaaatacatagaatatgatcatggaatgcttggtaatttgattagacttggattagaagctttgtgtcctgctgtattaccttccatttgcttattcttctaaattagactgctttctggttactggagtcagtggcttgctttgactcacctttttgagttggatagcatataagaaagtaattatctcttagaagcatttagcttttttctcttaaaagttcaaaatacattaatgttgattgatttatcttcagaaaaactgattcgaaacccagggatatcttagaccacattaacatatatattgtctttaaaacaaggaagccaataatcctgaccagttttgcacttgtcagaccaaacacaaagtattgcgctcagcataggtcactgtattttgagaggaagatgatgcagactcaaatccattttctatggcaaacagatgaagaagcaagacatgtttattctggaaaggagaagtcccacgggaaaccatttactgtctttcttcatgtattagttggcctgttatatggaggagacttatgcgttaattcagagggtataaataagactaatggctaggaagttgttaaatcagtaaaatatctcttgaaaaagggtactatagtcaaatatcacaaatgcatgtatcatgttccttttcagatttacaaatacatgcatgcataatgatgtttcagtcaacaacagactgcatatacaatgatggtcccataagattaggagctgaaaagtttctattgcctagtgacatcatagcatcacagtgttaacacattactcacatgtttgtggcaatactggagtaaacaaacctactgcactgctagtcatataacagtatagtacatacaattatatatattgtatgtatatatatttattgtcattctggagtaaactccttctacttatgaaaaaaaattaactataaaatagcctcaagcgagttcttctggaggtaatacagaagaaagcattgttataatagcagatgacagctccatgcatgttattgtccctgaagaccttcaagtgggataagatgtggatgtggaagacagtgatattgatgatcctgaccctgtggaggcctaggctaatgtgtgtgcttgtatcttaatttttaacaaaaaagttaaattttaacaaaaaagtttaatttttaattaattaattttaatttttaacaaaaattaactttttttaacaaaaaagttaaattttaacaaaaaagtttcaaaagtaaaaaatacaataaaatttttaaataggaaaaaggcttatagaataaggatatatataaagaaaatatttttgtacagctgtacaatgtgtttgtattttaagctgtgttattactaaagagtcaaaaagttaaaaaattaaaaagtatgaagtaaaaacattatagtaagccaaggttaatttattactgaagaaggagaaacattttccttctttttattttcatttaattttattttttattttttaatttaatttaattttaatttttttgagatgaggtctcactgtgttgcccaggctggtctcgaactcctgggctcaagcaatcctcccacctcagcctcccaaagtgctgggattacaggcatgagttactgctcccagccaaaatattttttttaagaaatatatttttatacatttaatgtagcctaagtcgacagtgttgataaagtctacagtagtctacggtaatgtcctaggccttcacattcactcaccactcactcaggccaactttcaatcctgtaagctccatttatgataagtgccctgcaaactccttttatggtaggtgccctatacagtaccattttttatcttttatatcatattattcctgtatcttttcaatgtttagatatacaaatacttaccattgttataattgcctatagtattcagtatagtaacaaactgaacagatttatagcctaggaccaataggctatatcatatagcctaggtgactagtaggctatgccatctaggtttgtgaaaatacactccatcctgtttgcacaatgatgaaatagcctaacaatgtatttctcagaatggatccacattgttaagtgatgcatgactgtttatactaaatatatatgaagggccctaaaaagtcattcagtgaaagatctctttaaatttgttaaccctagcattccataaatacttcactcagaatgtttccaaggaactctcattagggtagtgattctcaaactgtggtaatgggagcagcagcagcagcatttcctggaaactggttagaaatgtaattttatagccctacctcagatctatggcatcagaaactctggggtggggcccagcagtctgtgtgataatcagtccttcagggattctgatgcggctaaaaggcaagaagtgttagaaaattttactgttattctccaacttaacagtaaccttttgctttccttcattacacttaaccacaatttgtattttttaaagttctaatgatattctatgaatctgtgaattcatattccataatcataatctattctctgaatttccttccttctgtacctcataaagggtcataaagggaaccctttatgaggtacagaaggaaatactcattgaaggcctatcatggttttcaccctggtataagtgtcatctagctggtgtcaatttggatactttaaagaatcctaaataatgagtccatatattctataaagtaaaatactcatttctataacaaagcaaaactttaatccattgctggctgtcattgtcatttttaaaagagcacataaaaagtttttcatttccttcaaaatgtttttcagaaaatgtagacttttttagcatcttgaaagatctgtaatgtgccttttcttatgtcagaattctataaattaggaaatgttctaatctcttgcattaacggagatgaaattctggtggcattatatttgtctctccaaacaggcaacattcttttagaaaaatgtaattgaaattgaacttaaaatgtatttgtatttaaaaataaaacatcttattttttattttttatattttattattattaaaataaaagcatcttttttacatggtttcataaatgtattttgaatgtttatatgaaatgcctctgtaaatcatgcagaagaattttctttttctaaaggacagtgaaatgaggttgaatgtgttaaagcatcacactatatttaactcaagtacatttagaacaaaattattattaggatttccatagaatgaatcatggccaaatttaacttctcacaatttttttttacctattcttttcatacaagttagagctctctgggtttatattactaggtcaactgaagtgttatttatttttaggtagagggacaaagactgataatctagagactggatttgatttggctgctgctgtctgtcagcagaatgccttggggtatctacttacagtaatgagtataagtagtgctatcattattagtatatttaaacacccatggtttgcaggaatgtgctgaagtctgaatataacatagttaattatgtcactgtccctgcccagggcaactgctattgaaaggacatactcacatcatgaggaagatagcagatacagtggtttggagctaagtgttacttcattgctgactcacggaaagaggtttaggatgttggctatgttttctaaagagcatctagcagttttcatctggtatatcaacttgccacataggttttttatacttatatttctttttagttttcctcacgggagaaaaagccaattccatattaaaacgctacccaagagctaatgggttttttgaagaaataagacagggcaacattgagcgtgagtgcaaagaagaattctgtacatttgaagaagcaagagaagcttttgaaaataatgaaaaaactgtaagtatgttggcaattaaaaagttgcacagatttgcctacctttttgatgtatatttgaaatctgcatccctgaattatgtacattgctagcaattaaaaattcctttgttaggaactcggaaaatggcatctaactagtaatattctgtgggttggagagctaggttcacttccccttgtgctggactgtctttgagagccccgttcctataggactctgctgagcgaggatttatcatcttggcgagtaggaaggatttgatttgcacaaagctttgttctagaaggttatagataatatcactttgcctaattacagagaaagtgtggaggaagctaatggatggtgatagtgttttaaaaggttttacttctcgtacaaaagaaaagacatccagacataccttcccactccgcgagaatactcctctttacttctctttactctagactacatgctattcaaagagagcaggaatgggacagcacaaggcaggggtgaaaagtctatagaactgctccacagctggaaattgttaccagaggtagccattgtataaagattcagtcctgggcagcaggaaaataaccctagatgctaaacaagtggtgtcacttatgctaaaaagatactaaatataccttaagagcagcagatgcaaaagttttaaagaaaggggtaagaggaagaagccacatcttagtcaaatcacagggttagaaatagggaaaagaatatatcatccataataccatcatgcaatcacaaagcacggttgaccttttattttctttccagctttttccctttgcatccgcttagtcattgttggttttattttattttattcattttactttttaaaaatagtatatgttcattgtagagaaatttaaaaatgtagtaacataaaatcacttgagtttttagcaccaccagttttataattttggtatatctcattctggcctatttttactacatagatacttcataaataagaaaaataggattgtagtagaaatagtgttttgcaccataaagtttttaataaaaactggctgaagttactataaaccataaacaaaacgtggtttttgatattgtgttttatcaaataatagaaattatagatattctactatggttttcacaaggctaatggctttttaccctactttatcattctcctttaaagaaatcgtaagaacttgtttgggatttattgttctaaaagtactttatacaagtgaataatattcttttacaaaaaaaatttattgagttatgtttgacatataaaaagctgtacttatttaatgtatacgtttctatgagtttggggataggtatacacctatgaaacaaccatcaccatcaaggccacaaacatatccatcacctcctaaagtttcctctcacccctttattattgttgtagttgtgttctgtgagtatggtaagaggacttaacatatgatctaccttcttagcaaaatttaagtatataatataacattgttagctgtaggtaccatgctgtatagcagatctccagaattcatttatcttgcataactgaaagtttatactgtttgctacttctcatttctttctccccaagcccctggcaaccaccattctcctctttgcttctattagttcaccttttttagattccatatataagtgagatcctgtggtatttgtctttctatgcctggcttatttcacttaatataacgtcctccaggtctattaatgttgtcacaaattacaggatttccttcttttataaggctgaataatatttcattgtgtgttgtattagtctgttttcatgctgctgataaaagacatacccaagactggaaaaaaaggattaattggacttacagttccgcatggctggggaggcctcagaatcatggcaggaggtgaaaggcacttcttacatggtggtggcaagagaaaatgaggaagaagcaaaagcggaaaccctcgataaacccatcacatctcatgatacttattcactatcatgagaacagcacgggaaagactggcccccataattcaattacctccccctgggtctctaccacaacatgtgggaattctgggagatacaattcaagttgagatttgggtggggacacagccaaaccatatcattctgccccggcccctccaaatctcatgtcctcatatttcaaaatgaatcatgccttcccaacagtcccccagagtcttaactcattttggcattaacccaaaagtccacagtccaaagtctaatctgagacaaggcgtgtcccttccgcctatgagtgtataaaatcaaaagcaagatagttatttcctagatacaatgggggtacaggtgttgggttaatacagaccttccaaatgggagaaattggccaaaacaaagggtatacaggccctttgcaaatccaaaatccatcaaggcagtcaaatcttaaaactccaaaattatgtcctttgactccatgcctcatgtccaggtcacactgatgcaaggggtgggttcccatggtcttgagcaactctgcccctgtggctttgcagggtacagcctcgctcctggttgctttcacaggctggcattgagtgcctatggcttctctaggcacacggtgcaagctttcagtggatctaccattctgggatctggaggatggtggccctcttctcacagctccactatatagtaccccagtagggactctgtgtgggggctctgaccccacatttctcttctgcactgcgatagcagaggttctccatgagagccctgtccctgcagcaaacttcttcctggacatctgggtgtttccacacatcctctgaaatctaggcagggattcccaaacctcagttcttgacttctgtgcacctgcaggctcaacaccacatggaagctgcttaagtttggggctggcaccctctgaaaccatgggccaagctgtaccttagccccttttagcaatggctggagtggctgggatgcagggcaccaagtccctaggctgcacacagcatggggaccctgggcctggcccaggaaaccattttttccttctggacttccaaatctgtgataggggtgggtaggggctgccttgaaaacccatgacgtgccctggagacattttcctcattgtcttggggattaacattcggctccttgttatgcaaatttctgaagccagcttgagttttttcctcagaaaatgggtttttcttttttactacatcatcaggctgcaaattttccaaacttttatgctctgttttccttttaaaatggaatacttttaacagaacccaagtcacctcttggatgctttgctgcctagaaatttctcccgccagataccctaaatcatctttctcaagttcaaagttccacaaatctctagggcggggcaaaatgccaccagtctctttgctaaaacatagcaagagtcacctttgctccagttcccaacaagttcctcctctccatctgagaccacctcagcctggaccttattgttcatatcactatgagcatttttgtcaaagccattcagcaagtctctaggaagttccaaactttcccacatttttctgtcttcttctgagccctccaaactgtcccaacctctgcctgttacccagttccaaagtcatttccacattttcaggtatcttttcagcagtgccccactctactggtaccaatttattgtattagtcgtttttacactgctgacatacctgagactgggaagaaaaagagatttaattggacttacagttccacatggctggcaaggccttagaatcaggcaggaggcgaaaggcacttcttacatggtggcagcaagacaaaatgaggaagaaacaaaagtggaaacccctgataaacccatcagatttcatgagatttattcactatcataagaatagcacaggaaagactggcccccatgattcaattacctcccccaggcccctcccacagcacgtgggaattctgggatatacaattcaagatttgggtggggaaacagccaaactatatcatgtgtatataccacattttctttatacagtgatctgtcagtggacatttggttacttttagttaggagtaatatttagaaactgagatctgggaactagaatatgctcattgctaccagaatgttgttacttctggatctttcagcaatagagctaggaaaaaaaaatcacacatatgtatacatgcatacaaattctatatatgtctatatgtagaaatgtaaacatataaacatatagacatgtatgcatgtagacatatatgtgaaataactaattcattatgctgatctccaattgcaatccaatccctcagggctcttccagccattctacttttgtagagatgtaaaaattccttatagatgttcttccaaaatgagaattccagcacccaaaaacatcaatatattaataactcatttgcttagttgtataatacacaatggtttcggaattgtaatatctatactgtaatgtggagagggaaaacttatattcattcatgcatgcatgcatgcatttttttaacatcttatttggaaataattatagattcacaaaaaattgcaaagataatacattgaggtcccatgcagcctttactcagtttcccccaatggttacatcttacataactgtaagatcaaaactaggaaactgacgttggtacaatctgtatgtatagttctgtgtcattttatcacttgtatagatttgtgtaaccatcactgcaatcaagtagcagatatatttcattaccacaaagttttccctcatactaccctttaatagtcacacctactatcttccacaaccatccctaacccttagcaatcactaatctgtttccatctctataattctgccattgcaagaatgttatataaatggaataatataatgtggaaccttttgatattggctttttagagtcagcataatgctcttgagattaatccaagttacatatatcaatagttcattcatttttgtttatgagtaatattccatggtattgatacaccatggtttgttgaaccatttgcttattgagagacgtgtgttgtttctagttcatggcttttacaaataaagctgttatgaacattgcataggtttttgtattgacataaattttcatttctgtgggataagtcactgggagtacaattcttgggttgcatggtatatgtgtagttttttaagacactgacaaactaatttgtcattgtataaattaccatcttatagtctcaccaacagtgtttgagagatccagtttctttacatactcatgagcacttggtattgttactgtgttttattttagccattctgctaggagtgtagtgataacttcttgtgattttaatttgcacttccttaatggctcatgatattgaacatctttttatgtgcctattttctatttatgtttcttctttggtgaaatctctcttcatgtcattagcttactttctgatgggatgttttattttattttactattgagctttgagagttctttattatcctaggtttggatctgttttcagatatatggtttctaggctatttgaattttatgtattaattgtatattctactactctcgtattgattaagttttatcattgattctcagtgtgaacaatgtttttttgttgttgttgtttgtttttggagacagattctcgctctgttgcccaggctggagtgaagtggtgcaatctcggctcatggcaacctttgcctcccaggttcaagtgattcttgtgcctcagcctcctaagtagctgggactacaggtgcatgccaccatgtccggctttatatacatatatatatatatttagtagagatgggatctcaccatgttgcccaggctggtctcgaaatcctgagctcaggcaatccacccacctcagcctcccaaagtgctaggattataggcatgagccaccacacctggccatcatggtgaacaatgtttttttttttttgagatggagtctcgctctgtcgcccaggctggagtgcagtggcgcaatctcagctcactgcaagctccgcctcccgggttcacgccattctcctgcctcagcctcccaagtagctgggactacagacgcctgccaccacgcccggctaattttttgtatttttagtagagacggctttcaccctgttagccaggatggtctcgatctcctgacctcatgatccgcccgccttggcctcccaaagtgctgggattacaggcgtgagccactgcacccggaccgtgaacaatgtttttaatgcctacatttctggccttttatccatctcagtgcttctatatatcatttcccacccacagagacaggatgctgcatgtcagcaatctttgaagcaagtagaagaaattccttcaactgtgagagaattgcttgagaaattttctgtacttccggcatcaccttttccttcctatagaatcattctcatcttattagcctacatgccccagaaagaaagagaaaaaagaaaactctcttaacacatcgccatccaacaaccacttcatttcttgaaactctgctctgcctacacttgctcccctggtgatctttcctcttctcatacttcaaatgctaataacttccaaatttatatttgtagttcctggagcgctaaactgaactacagacttgtatggctaactgcctactcaacatgttatcttagaatcaaatatggttctcaaagtaaacaaatttgcaccccttcccccaaatatctacacttactacatcctctctgatctcaataagtagtaactccatccatcatgtttgctgatctccaggctttttgccatctctgactcctctctttttcatatcccacaccccatctgcaatagttggttctaatatgaaaatatactcggaatctagccacctttctacttgttatcactttacatccaagccaccacaaccctctcatctgtatgattttttggcccctgccccatagttgattctcaaaacagcaggttagagtgatcctttaaattctcttacttgcaagggcttcccatctccctcagtaaaggccaaagtgctcagaatcacccaccaggtactacacaatcagtcctcatctatctccaccccacagcttcactcgatatatagttatttctttaccacatctcctatgacaccccaccccttattcactttgctgtggctttcttgtgcgtcctcacatacacagacagcacgtgacctgcctcatgactttggcacttgctctctcctcttctagatggatatgtctgagttccttcaccactctcaagtcttcactcaagttcattttcacagtgagaaagcactctaccttaaattgcaaccgcttgtcccttctgtgactttctttttttcaagcactgacatcatttgacatctatttgtttttttttttaattgttacctcccccgccccatcaggactgttagctccatgagagcaacatttctcatctgttttgttcatagctatggtccctagcatataaagcagtgctggcacataatagaagccaaataagtatttgatggatgaatgaaggaatggattggcaaatcacaaagtaaatttagtttatgggaggaaccgatttaaacccaagttggctgatagataatagactttaaaatggtttttattatgttgttgttatatttccttctttgtgctttaaagtttgtcatctgagtttgttcatgccattaaaacaatcccatttaggataaggtgtgccagcctttgatctagcaaatgtaagtgaagtggcattctcattttttatctgtttcagaacaatgtttgttatctgttaatcaggatctagcattgccagcaaagtttcatcttaatcttggcagtgaagaaaatgattggatttgagatttgctttctacttttagactatctttactatctttttgtttactaaaatttatcgctcagaatacttttactcatacgtggtttcatcatttccaaacatgaagtatgtgaatttagaagtctgctttcagtagaatgtttattgttggaattatttacctaatttggaacacaagtctaattatacaatgggagaaaacatattgtacttcacggtcctcattttcatcatgtagaaaatgggtcagatttattcagacattatctgctgaatgcctactatgtaacagtcacagtatatacaacaatgaataggctgctcctcatggcatttgagttctgatagaaacagcagacatatgcacaaaggcttatatgagcatgctgtaaaccttaaatatacccaatttttatttgtcagttatacctcaataaagctgagttgtcatgccaaaatcctctgctttgagaatcagatggaccttgatctggtgtctgagctctgccatctactgactatattgatttgcgcaaacatttcatcttttaggcctcaatttttgtatcttttaaaaggaggatattatacctacagtatgaggtttgaggctgtgcacttagcatagtttttggaacagagaaaactttcaataaatataatttattctagtttttaggtgctgaattcttgccactttatttaggaatcattatttcaccactatcactttttctctcttctctctatgagactatgagggttctctacattttggagctgttaatcttgcactgacattgagaaaatagtagtaattctttaaaacaatgattatagaacttttaatcgtatataatttctagtttattttgcttgactttccacagtggttgtcttcaaagttaagcgtgcataggaacagtctgggtgcttagcacacctgcatagtcccacctagtgcccagatctgggtttctaattccattctatagtgaaataaaacaggactttctggggacatggctcattattgggctggagtgtggagaatacaagatgagctggagaacattgtggtaccagaaagtaaggaagtgtgataatccaaagaatgggagcatgttaaagggacacaggaggtaacctaaagaagctctcagtggccaaagctgaacaattttagccacaaaataaatgatgtagtattggattatagcccaaaacacaaaataaatacacatgattatataatgatataaatgcatgactgaatgaaaaggtgaaaagagaaaaatccacactatagaattccaaattatgtatgtaaatactccaccccagatggtggagcttaattttcttcttcccttgagtgtggcttgaacttaaagactagctttcaaagaacagagtatgggaaggatcagcgggtggggggaggtggggtaactttgcaatggagaaacctgtcaaactactttgacctggtaatcaaagttactaagtcacacatatgatatactgagaacagacatcatttatttccatcaccgcaaactcataaccccagtctaaccatgagaaacttacagagaaatccaaaaaccaaaagacattctccaaaatgtctgactactatcaaaacagtcaaggtcatgaaaaaaaaattagaaaagactaggaaactgtcacagaccagaggaaactagagacatgattagacgaaatgtcaattagattctggaaaaaaaggacattaatggaaaaactaatataatctaaaaaaagtgttatatttagttaatagtaatggactaggattgattcattaattataacaaatttaccatcctaatgtaagaagctcacattaagggaaactgggtgaggagtacaggagaatgttatgtattatctttgcaatttttctgtaaatttaaaattatttcaaaataagaaagttcatttttaaaatgcacagtccaggggtcacaagtctccttggaccagggaacttgccttatttggtaacactttattagattctaaagaaagcagtttagctaaaaccacttagaatactcagagctctgcagtgggtggtatttctagggatatggatgactcttttgtctgggtgcatcatcccaagtctttatcccattcttgtgcactccatgtgccattctgccgccaagttgctgctatattttagaaactgagttattgatatccaaggatctgagatctgagttcagcaatccctttttagataatatctctcattccaaagtgtcaccatttaaatttgtttatgtagaaattattggggaagaaagagatatgcagtcccccttcacactaggatatgttacaaaaactacatttggagattgtggaattcagagcccatggcaggaggtggcatgtagacacttgtgagttgggattagtgattacaagaaatactgtgtctgaggtatctaaaaattgatcactaggtcctggagattactcatggcacttgcaggcagaaagtccgattctttggcactgttagggaaactcttatttcacttagcctctcatgatctgctgatggcactagagccagattcagaatattttccccacccctagtgactaaagagttgttagggatgagagaattcaggaaagaagggaggtggaagtccagtctgggcaagaaatataggaggcaaacatggggcattgctgtggccttcttctagccataccttattcatttccattgagaccttctcctgccttccctagacgcatcccagaccctccttggggaaccaaatatgaagtttccctttaggcacatgggtggtttcctggaactcccaaaggcttcctcgctacttcttttggaacctcttgaaaataagttaaatagggccaaaatatgtcattttgtgcaactggtattctgagctaccttctgtaaagatgagggaggtctgactgttgcaggtcaataacatgttgttccttatatgattcatttaaagtacgtttttattgattatatcattgatattgtttttaagttagtggtgaactttagtctctggcagttgggcccatttgtaggttataaattatttgtagtgtcaattattcatgtcaggttatggtagtaactgaattaggagagtttcagcctgtatgatattaataaagtagtagacttcttcagtcagggcggggggggaggtgctctcctgcccatgccagcagtatgttaaccttgacctataaagttacctcagcaagtttcctctcccagtaccagtgccaacctttttcagaactatcctcagagactgggtaccagtgaggctgacagatctatttgttgtcacttgtagaatcatttgcaccatggatttaatttaacttgtggacctgtcacctatcatgctgctgctttgggatccttcactgcttaataagcagtactgtcatggttaggaaatggctcatgtatccattacagagctgcaaccagtcaatggaattgatgacaataaaacactgacattcaaattgggatttgagtagaaccctagggcagcaactttgcttggtaaatgtctaaggcatctatttttccatctgaaagatgatgtcaacatgtctcccatagcatgctgggaagaagttagctatgaattcagagaataaggggctagctgttacctaaggaattatattctttagcctaatacagtaaacctctccctctaaaaaaggacaagaagcagcaaaaaccactcaaccaatgatgagagagaggtgttgtgaaatgatattgatagccagcagaaaataccattttttttttcttttttgttggtttctatgggaggctgaggtgggcagatcacgtgaggtcaggagttcgagaccagcctagccaacatggtaaaaccccatctctactaaaaatacaaaaacaaattagccaggcatggtggcatgtgcctgtagtcccagctactcgagagggggaagcaggagaatcacttgaacccaggaagcggaggctgcagtgagccgagatcgcaccactgcactcagcctgggtgacagagcaagactccatctcaaaaaaataaataaattactaaaaagtataaataattatgggtggtgaaaaaatatagctactttgataaatgtatccaggcaagtagatgaccaaaccaattaaacatcatatttcattgattctctaatcatttattcatattttaacttctctgaaattgaggtgcagtttacatactatgacatggcatggattcgttgaaagcagaattttttcctttttttttttttttttttttttgaaacacggtttcgctcttattgcccaggctggagtgcaatgccatgatctcagctcactgcaacctctgcctcccaggttcaagtaattctcctgcctcagcctcccgagtagctgggattgaaagtgcccaccactacgaccagctaatttttgtatttttagtagagacgaggtttcacaatgttggccaagctggtcttgaactcctgacctcaggtgacccacccactgcggcctcccaaagtgctgggattacaggcgtgagccaccatgcccggcccttttctcttttttaatacataaaaatggtgtactcttcaattcgtgctatgttatatttgataaagtacagcaaccaaccaccactgctactcacttctcagaggttctgatctggatggggtgactactgtaattcaattattgttatagtgggtatctgctgatttccttaataacggggtttcactagttccttcttccaatgttagggtacagtcccctctagggcaggacatttgatcatgactctcatggttggtatatcagtaactatagaaataagattcagtttagccatttccaaagtacaataaaaggaattgcaaaagaatttgtaactttgccatagccctatgttgttagcccaagtcttgggtactgtcaagctgaaacaggaaatctgtctcctagtgaactacaacaaccagtagatccaaagaaggctctggttttccttgaactgtatatttcagagggtcacactaatgctataacttaaaatggcattattatttaaatattaagatagtatccaattccaaaagctaatatttgataccaatcactgctcatcatgaataggctaaaggctgccttttcattccatcccattgttgaagaatgacttatggaattggttctaatcatcttttcatggagtccacaaaaaccaaataggtcaaactgttcatttcacaaatgaggaaatagccccagaactgttgatttgcccatgttctcattacagcatactgatgaagcccaaaataggagccaggtcccaggtcatctatttccatcttcctcattcccttcctcccctcctcctcattgaacacagtgccctcctagtttaattagtgatggttatgccaggggctttacaatgaaacaatttaccttcaggcttcttatgccagtccttattgggccagtagtaaagacacatgacatggtacttattcaagctcagatatgatagaaacagaaaaagtggtggctggtacctattcttagtcttagcctttgttttaatttctactgctttaaaattcttttttttttttttttttttgagagggagtctcactcactctgttgcccaggctggagtgcaatggtgcaatgtcagctcactgcagccttcgcctcctggatttaagtgattcttctgcctcagcctcctgagtagctgggactacatgtgcctgccaccatgcccggctaatttttgtattcttggtagagtcggggtttcaccatgttggccaggctggtcttgaactcctgacctcaagtgatccgcctgccttcacctcccaaagtgctcgggttacaggcaggagccaccgtgcctgacctctactaattaaaaattctttagaacaatgtcctttgggatagacaaagcaggtgatattctttccatctttagaccagtattttaagtgtccaaaagaccagtgatacttccaatttctgaatggaattggaacttggggcttttgattcttaagccagttttcattagcatcataccatgtagctaacacacttgcagcctaagacagaatgtcttgaagagaagaaaacctaatagaacctacaatataattaggccgatttgggaggagtataggaggaggctgatttcctgttatctgggaagtggcaatctgaacttttaaacagacaattttgaacttttttggtttgaggcggagatcaagttcaaggcagctaccttttcgttaaaagaaactgatgaggtttcattataagcctagagtaatgtttgaaagggtagaagagatgataaagaagtagttctatctaaagttattgaaaattttcaatgctacagagattcatttttattactttgaaagacagattataaagatccaggagggtattaagtaaaatgggataaattaataaaaattataattccctattaacctaggttttatattagtttttcgttaaaactgttgcattccactttgctgttttctattttattttattattgttttaaaattgagacagggtcttgttctgttgccaaggctggagtgcagctgtgaacatggctcattgcagcctcaacttcctgtgcccaagtgatcctcccatctcagcctcccaagtaggtgggaaccacaggtgcatgccaccatgcctggctaatttaaaaaacaaaattatgtgcagacaaggtcccaccatgttgcctaggctggtctcaaactcctggactcaagtgatcctcctaccttggcctcccaaagtgctgggatttataggtgtgagacaccatgcccggccatctattttaaaatatttaaactcaaggcaaactctagacaaaacagaactaaatctggaaggagctattataccagaaacaagaaaatgttaccaaaaatatcaaattgatattctcagaatttaagaaaacaataggtttgtaaaatgagaagaagctattacagaggggaccaattaggggataagagaaagtccttggacattagaaatgttactgcaaaactaaaaactggacacaggtcagacagtgcagagttcactgggttgcacatggaacatagtactcattctcctccctgcccacttccactgaaaaggaatgcatccctccccagataatggacccaaatacccacttccggccctttccgccattagccatccgccttcagccagctactactaccacagctcccgcctgcctgctcaccacatcccaaggtgcctgccatggccaccaccccagtgttgcaggtgcgtcagaactaccaccccaactgcgaggccgctgtcaacaaccacgtcaacctggagttgcatgcttcctacgtgtacctgtccatggccttctacttcgaccgggacaatgcggccctggagcactttagccgctacttcctgcgccagttgcacaagaagagggagcacgtccaggagctgatgaggctgcagaaccagcacagtggctgcatctgctttcacgacatcaggaagccagagcgtcaagactgggagagcaggctcgaggccatggagtgcgccttccacctggagaagagtgtcaaccagagcctcctggagctacaccagctggccatggagaaaggtgacccccagctatgcgacttcctggagagccacttcctgaaccagcaggtcaaggccatcaaaaagctgggtgactacctgagcaacctgtgcaagacgtgagccccagaagcaggcctggcagagtacctgtttgacaagctcaccctgggcggcagcgaggaagacacctgagccaagatgggccccacagccacggtgtgccttccctgggtcaggccaccaggcgggggcgtgcatgttgccctttcagaacgttctcttcaatttttttcctttcagtgttaccattattggcaataaagttatctgttctcaaa

SEQ ID NO: 1347 - DNA, 92922 bp, mus musculus; identical to SEQ ID NO: 1346
